United States Patent 7,868,149 (PLANT GENOME SEQUENCE AND USES THEREOF) - sequence listing, part 118

SEQ ID NO: 65204 - DNA, 20440 bp, Oryza sativa
acaatactgacgagggacctccttttcattggttttgtaagctgaggggtgcgttgtatctggttttgcggtgcagggatgaatttcgaacttggtgacaaactgagggacctaaagtgaacttattccactaataaatactcctacagtaacaggcaaaagaaaagaaaaggaatccgactcgagcggtatgaggatctaaagaaaaccctagcggcggcgattggtgtggcgggaaggcggccatgtcccccaaacggaggaaatcggtggcggcctcgagcggcggtcccaaatcgtcgccggcggcgaggtcgactcggtccaaatcgaagccggattccgatctcgccgagcacgacgacagtcccagatcgtcgtccgggaggctgactcgctccagagcgaaggtgttggaggagtcggcgggagtgtcttcgagcaagaagaagagaaggatcgaggaggagtcgccggcggcgacgacgacgacttcgacgacggcgacgacgggtgtgatgcacagggaggggcatggcaccttggcgtcccggccactcccgccgatccacccgccgacgacaccccgcgtcagaaaaagctcccgcatcgtccggctcgaaggtttttagctctcgatccgtcgtcatcgatcctctccccaccactgttaatttcttcttcttgttttaatttcttgtatacctattattaaccatgttaatttctccccatttctgcttcttcttcagttgatcgacttcagaagctaactctctggcgcgataagaaagatgatccctccaccgcggccgccttgcctaccccctccgacaagaacatggtgttgggcatgtctcgctcaattgtccgcgtttcatccccaccttctggtaatttactccatccgtcccaaaaatatggtaacctatggacaacatcttagtacaagtttggaggcatattcagattttactgcctgaatctactgtatttactgctaacttagctactaagtgagccatgtgctaggctgctagcatgtcacgtgtggttaattgcgttgttttacgcattccctatctagcattacatgagaaaatcatgctgcatctccacatgggaattaccgtggattttgtgctaaactagctgcagatgttaagggaaaagccggtgatataaaagaaagctaccgagatagacatgtgtagtccaacaacaaatggaaatatgtgttgtttagtgtatttagtagcccaatacaaaatatgtatttatcggctcctagctatgtagctacctgctaatcaactgaatgtttttcagagggaaaattgatctctccgcgcaccggattcgtcatcagttgggatggagccaccaagcgtgctatgatcgtcacgctcttcacttacttcaagaagaagccgcatgagccccaacccgaggtgcatgacttagctaatccccatgttaccatcatctgagttccattactgttcttgttaagtaggggctaacccaattgctaaaaatgacttttcatgcatgctaatttctttaatttcttggtgcaagtgtagaacaccgatttccattaggcaatccccatgtttctatcaatccgagttccattaccatttttgataagtatagtatggtcaagtgattgctagccgtagctgggctgccgtgcatttgctttgtgtgaattttactgtgccctctgatttcaattctcaaacattatcattgtcaaattgatggccttttcttgtatatccttagcatgagttccgtctcttgtgcttaagatgagtaaccattaacctttctttttcttgcattgccttctctctctatctttcagctgcaggttcatcttccagataagtctattgtgcagggacggttgatattcatgaatcgccactacaatctctccatcttggagatcacgtctgacctaccattgcaggtccctgcttttgggtccgccccaaagtatggccagaaaattcttgccttgtctcgggatgaaaatatgtccctggtggcgaggcgtggagcaatcacgtggtcggatggttctttcatgtggagaaaccattacatgtttgtggattgtgatgttcctgaggtactgatacatttaccttttcttcacacttgctatttgttttaccttctacttagtggtatttatttattttttaattaatgcagggtggtgtaggagggcctgtggttgacagctgtggtagttccattgctatggtatacagagccggccctggtgcagttatcatttcaatctcaattatttgcacttctttgagatgtggaagcaattcaggtatatactatttttccatcagtattaaaatatactacagattgaatcaaaatcgagcaatttctatgtggcacgtaaacccactaatcacgatatattcttattaattgaatgtttatggataaatcttttatatctatgttattagcgattttaaaagccaatgctgaaaaaactacgaaaaaacacctaaaatcaacttaaaattaagttttaaaattcaatttgctaaataataaacatggcctacaaagtggttggtgcgccaacatgcacgctcattttctcctaatagactaagtcaatcttatctgtagcgctcattttctactatagactaaatccatcatatctgtatgctcattgtctactaattgactgaatccatcttatctgtagctgtgttgcccgccctgtgtttgacgtggatttaagaagtgtggaactagctggtgtgtcactccgggaggagctctctgtgaaacataacatcaatggtggctttattgttaaacgcatagctgatgattctgctcttgagcatctcggtgttagacggggtgacgtgatcttttttgagaacgagtgcgggactagtttgcctgaggtgaaatgaattctggtctcaagtaatagtttaatataaatcaatatttgtcaagaataatacaaatgtgttgtgatttctatttttaaaattctggaacagatcgaaggttatctcctttctcttggttggagatacctgcaggggatgaaaaagtcgatggttctcaaggtatggtattacacaataacaaaaatgccacttttttttttgaaaaaaattggtaaaaaataatcagcagaactgtcttccttgtgtagttggaagtacatgacattgaaggtccatgtgaggagacaattaccttacccttaaagttttctgtcgattcaggaaaggtatacttctctaaaccactgtacaattgtcctactttgcttgttttaatctctagattttaccccttaagcatcgacaaatgtgttgaatttaaggttgtccgctggaggatggcttgaagatgtacagcaagactagttagagcaaggtcaatagtatagcccaccgctgacggtaccaaatgccacgtcattttacagttagtgtaaagctaactaatacaatagattggctattgtgctaactacatagaagctattaaacaattaattttggatacacagtacgatcaagaatgtactccatctttgtagccatttgtgctgtcatgagcgtgagtagtctaccgatgaagaaaaagaaagagtttggtttttgctttcctagctcatctcccgcacagctttagattgaaatcaacaccagaaacagcaactaaaagaaaatgactggtggtttatccttttatccatctccattcacacggaagcaaaaatgagagaaaagaaaaaaaaacaagagaatagcaaagaagaaagatgggttttgcagctaggcaatggctgattcataccagagcaaaccgagcggtgggttatgtcgagtcacagattaaggagctccatccatacatcgattcgcttcagttcggaagggagggcgtcgaccccagcagcaagaactcgattttgaggtttgagaagcttgattcgtgccgagagaagatcgacccagcggcaagggcgtcggttcgcgtgcatgaggtcgatcagcgcgagctcgaaatcagctggtggagctctcgaactctcctggggtgaatcattgccggtgtagtgacgtgacgctggccaacattccggcgaggaaccaagcacatcggcgcacgccggagcggagaaggaaaaggcgaaaagcagaacataggtgggaacacaagtatgagacatgagatccgatgagtatagatagccaaagggcctgcccggcacggcccggcccaggcacggctgggcacggcccagcagtcatcgggccggcacgggctgataggcacttcgtgccgggccgtgccggcccatgggctgcacctcctgcccaggcacggcccaccagctgtcgggccgtgccgtgccggcccgaaggcataggtggcccatcgggcctttttaaattaagtctatttttgttcctcctctttgggctatttcatatgtatagctaaaataagtctattttccgtccctcctctttgggctgacatatgtatagctaaaataagtctattgtctgtccctcctcttcggctgacatatgtatagataaaaaaaagtctattttagatccctattctttcgttcatggcatataatatgtctatttttactcccctattttttctgtgtatcgggcctagctgccggcccatcgtgccggcccatcgtgccgggccggcccggccgggccgtgccgagccaacgtgccggtggaggggcccaggcacggcccagtggtcggcccgggccggcacgggcccgacctccgtcgggccatgccgtgcttgggccgagccaaaatatcgtgccatgggccgggccgtcgggcctcgagccttttggccatctataccgatgagggtggttgcgggacccacaaaatgtattttttatcgtgcgacacgtgctatcgccgggcgcttaaatagtcgcccacttcaatctctctcttcagttattctccttccacctaagaatatgctgacatggaatattttggagcctgctgactagacttattgtacctgctcttacctggggaagataatttagtgaatgctagggcatctccaatgtgcatgtaaaggtgtgtttataagcaataaatattagtacaactttgtgtatagaaatgtgtgtttagaagagaatattgttatggctaaccttaagcttagagctagccagaaggtaaacagaagaacttaaaccattgtaacattgactataattaagcaaaagatatgtgggttttatcttatggttattgtgtggctcaatattaaggatgcccttatgtaacttgagaaactgaaaaatgacttgtagagccaaactctgagccctgctttgatgagcttggaatttgtagttaggatagaaaataggagtactgaatttataagaattgagtatttggtcactgcagaagaaacatgtgatctcaataagtgcttgctcgacttaattacctttgtcttttggatattttcttggggaatttttccctagtgtcacctcaattttgctggattttgctaatatatacaccaatggtatatcggtataatgtacttagtgttactctctccatttcatactccacacaaagacattttgggtttggtctaaattaaatttattgacgtgagactcgaattttgggtttgataaagaaataatctggttacgcgagaggggtctacagacacgggagagatttgcaaaagtgtagtcgcagcaacacgagagatgagaacaaagactattgcaaaggagagggagagagagtgagagagagtgtgtgtgtccagtcttgcagagagtgtgtcgtcttgtagggagcagcttttgcatctttgctgtctgcacaatgctgggccccggtgatatctttgcgggccaagggctaatgtttggatgctagaattccggagagcttcccgtccgggcacagacagcaagcaccttgctcaggccatggaaatatgtttcggttttttccaagccctccatttttcgctccgtttgagatagtacgacgattgatggccaaactattttttgtgattgctatttatggatataaacagtggcgaatccagaatatgaattgaggtggtaaaaatatcagatgactaaaacaactagcttttgtcaactcgatattgttcctaagagacctatacgcatgtaatgaaaaaaacatattacttgacatataacaaaatttgtgaaaaatcgaggtatatggtgtacttatttttcttatttgcaactctgggcactagcatgaagcagtgagacagctagcgctctgtatccttgccatacaactagcttttgctaatcatgtttagtcattggtagctaacaagaggcaggggattatggaggtggggctggcgccccaaccagcccaaagagagaatccaagggctgttcactttgttgaaaaaaaaaaaccttaccaaaattttggtaactatgctaaaattttggtgacttgtcaaaattttgacaggatttcttatataggtaccaaaatttggcagcaaactaaatatagccactttttgggcaactttaccaaaatttggtaaggttgaaaatggcactaaagtgaacaggccccaaatataaataaataaattaattgtagttgtttagaaaagtgttcctataaaaattttacagggatgcaacactaaaagtttgacatcttgtaaagagaaaaaaaaatccaaagtccagaatcggaaaagagcagggtcatcataatgacaccaaatattatattttactttcaaacctttcaatttgtaaacattattagtaaaaagaaaaagatggcatgtgctaaagtatactccctaccagtgtagtggaaaaaagccgtatatatatactgtaacgacagcaaatccattcggttaatgtgatacgatccacatttgttattcatgaacgtcaaaactctgttttaatttagtgattaatcgaccatattctccgtttaatcgtccgaataatcacccgtatgttgtacttgatgatgacctaaagtagtcttttaggactttgtttagcgttttatttttaacatactctttagttttacttattcaatatgaccaaacatgtcaatgtttggtgtataaatgcgacgttggaagctactccctccgtactcgtaaaggaagtcgttttgaacagtaacacggtcaccaaaacataactttgacttcttgtttctataaaaatatttattgaaaagtgatatatgtatacttttacgaaagtagttttcaagacaaatctattcatataatttttacattttctaactcaacaacttgagagttattcatgatttatatttccaaggtttgacttaaacattattctaaacgacttctaatacgagtatggagggagtatatattttaagttaatgttaagttattcctgttcaattaaaaaacaacgtgaatatattcaatttatatagttatacacatttacatattcaaataagtgcataatattataaagtgtatacacatatttgcgaacgtcaaatttctacataattccaattaatcgatgaacggtaatttttggtctgacaaacgtaatttgtcttccataacatagctctctctgtatgttgataatactcgttgttttgcataggcctgatgtcacattttaaaatctttgactataaataatttctaaaatacctgttttagaaatggagaccatatggatagattagtctaaaaagtacttcaataaaatcatatattagttgatattttcatatattattattattattatagaaaatagtggttaaagttaagtattataaatccggagagagttataaattatggtaaatagataaaatttctaacttactcatgaattttcactcaatctctttcgtgtctatgaatttttcctcgtcctctatatgatactgagtttttattttgatcctctccatacccatactgttaattgcctacaagttgaccgtttgaattttcttaaaacgactaaattttgtgtgaattttctcttgtaaatatgtacataacaattttgttattttttcttaaaaaaaagggtatagccgcctagaccgagacgaacaaaaacgaagagaaggaaaaaatgacagcaaaagatcgaaaacacgacaaacacacccaagtaccctacgtgtagatagattgtgtttagggatatcttctccaatcccgtaatattttcgattattgttgtaatgacgcagcataaataagtataaatacgtggaagaaaaaaatatatatatagcgtgcatgtcgtcccgttcgcagtacatcgtcctgatcgatcgatatatcggccatacttctcttcgatgcctttccatgcacagatgcactctcaacagcttttggctcttggctaccccatatactcttgttttctcttcaaccttgacccgttgaccgcacctagaatatcccgaatttatggacgcgcttattttctttttctaccgaccgacccatacagaaatagaaatggtaaaccgacaaaaaaaacaaaaatggtaaaaaaatggaaatgatttgttgttttaccaaccgttttcatattcaaccatatttctatgcatggaaattaccatttttacaatactataattactgtgtttctgcggaaattaccatttctacaatattgtaattgccgtatttctaatacctatatggtcatgcatctgtttcacccaaagtgtaaaagtcaatcaactttttaaccaaattcctaatgtaattaattacacggctaaaacagagatataggttgtaatttattatgtggtgtaagttttaattaatttacagtcatattatatagttatggtgaactaaatatgtgatgattttgcagtttcatgttttcgacagcagttaccggttccgggttgataccgacacattttcatccgtatagttctatttctaattttctgatatttaatttcagtactaatttttttccagctctacgttatagattctgtatacgaaagatatatcgttatggaaatgggcgagactgttgtcagaccgtttacatgcatcccatgtaacagtataatagcatgtcctcagtaacaataagtagtcaatatcgattagttcgggcagttaggactatatatatagtgtcatcgcatctatttaattaacaccaaaacaactatctgctaacaaccaaatcgataataagccaaaaaatttcattttttttcgcgaacgcgcaaaatgattacacgtcaatatattagaagaatagacaaaagggcatgtagcctagtggttacagtgacctaagtagtaccctaaggtcctgagttcaaatctcctatggagcaaaattcagattgggttgtttgcggggctaagttctctatctcaatggccgtatatatctggttggacatagaggctgggtagaaaatacccttctccctaaggtcctgagttcaaatctcctatggagcaaaattcagattgggttgtttgcggggctaagttctctatctcaatggccgtatatatctggttggacatagaggctgggtagaaaatacccttctctaaaaaaaaattagaagaatagagttttgatacacgacgcactcagccagaccggcctataccaaggaaggaagaaaaacaaagaaaggaaaggaaaaaaaactcgaaacgacggtaactttactccaaaaaaattcattcggctaattgtttgactaataaccgaacaaaacctgtaccaaatttagctatcaacgcctagccagttcaaacttgaaagtaatactccccttatacactgtcgatacacacagtcatctactccccttatattgtttaattgacaattttaacaaaaagttcagctagtgactggctacatttcttttcatttcattattataggtggggctggtcagctagtgatcttgggtaaatatacgatggaaccttaacttaggtgaaaactattgtaaactctaacaaaaagttatctaaattcaacaaaaactcacacatatggataagatgatagttacataaccatgtaaatctcgtacaaactcgacctcatttctgagatataaaagcaacaaattttgaaaaaaaaatcattaggacaattttttggtttgaaatttgtttcttcaaatgaccaagacagttgcaaggtttcatattgatgaagcaagaaaatattataagattacaatcttagaaaattaattgtagccgaaaaaaaacaaacacacggccactgcaagctggtagctctttgcacatcctaggagaacaagctagcaccaagccaatcaccgctaaacctataaggtagtcgcaaacaacccaccgaacatcgactccacacagaagatcatcgatgagctctggattatcctcatgtagaggggttgaggagagggagagggcgagagagaaggagatccactcgtccctcactccaacctgatgagggcaatctataaccgttgacgaccaaaccgagagaagatgacaacggcgaggaacaaagaccttctaggcaatggctacagggaggtcatgacgtcatagatgccatcgttgcccgtcctaccggactaggttttcactcggagagtcctgctagagaggggaagtgtggccgctcgataacgccccaaggagagtcacgacgcccgaagaagtcgttgttgtcggctcaggaaaccctccaagctagacttttgcctacagcacccactcttgcacccgtcgccaccacttcaaagctccaccattgccagccacgctgccctccttgtcgtcgccgcacccgcagtcaccggccgtggcgacatcccgccgctcctagcgaaatccggagcgggacctagatccggttgcctatagattcgccactaccgcgtaggctcctcccccgccacccgccactcctccgcagacgagaggagggggggggggcggggcactagatctggctagggtgatgccaaacccgacgacacaggcccctcccccacgcgcagcctgccattcctccacgcactgtcgccgtgccatctaccccgtcgcctatcactccactgtgcaccgcctccatgccctcttccactccgccaccgcctcctccacggttctcctcgctaactccagtggaggagacgcagatctgggccatggtaccccagccgttgaggtttccatggggagaaagcgtccgccgctactatccttgtggttgtccggctttgttgacgagccgcttgggcagggacgaggtgaagaggaggaagagggagggaggcaacggtggcatatttttgcctttcgagtcgtccctggggtgggaatgacgcagacatgagaaacggaagctttgtttcactagatggatcgtatcagcttggtttaaatttctttattttttatctcacaaaagaagccgagtttggacaagataatgcatgtttatatatagttgtgtaatatcatctcgtccacatgtttgaattaattttgttttttgaatgtagagtcaaggtttacaccatatttacatacccggttatcctcgccgaagttgtggggagagagttgaaggctgctgcgtatatgtcgtgttgcagggagagctgtattgaaggcaactgctgcagttctgcacagtactattcttagtattctttggtccatatcttttttctctacagcctttgggcagtggtgcagtttccatcttcaggtaagtctagtctgcatggctagaggcagctccttggcattaacatcagctagcgatggccggactgaatgctccctagcaagtagcaacctgtgttcttgagtcccccaacaaccagtgttctccacctccggtccatggcgagctctctcatgtctcatctcatcactactggaggagctggccgcgggtgagaggttgcagagatgtccgggtcttctctccgctcgtgagaggttgcaagcaaaacagacggtatgcatgcatcatctatcatttctttcatcagttggtagatctactatatatatatatattcttgcaagaagccaagaacacatcttgaaaaagttttgcttgtccattcatcgcgatctacagtttgcttttccggcgaggttgtggactggagatagcgcaagcgcacacacgcagtccgtcgatcgatctgcctcgatctacagtttgctttgccggcgatcgaggttgtggactggagagcgcaagcgcacacacgcagttcgtcgatctgtgccgcacaagttgcaacggtaagtccctcttcttccctcgtagaacaatcgtatatatatgggaaactattctaatccctcgaggggatgttccctcgtttgctcaaaaaccatctaaatggttatgaaaaattctggaaaaatttgacaacattcatacaacacatatatacaacttcacaaaatcttaagtccaaactcaactcacacgtcgagatataaaaaagacaaattcagcgtatgaatagtagcgtactgtttatatctaaatttttcttttttgtttctcgatgtgtagatcgaatttgaacatgaattttggtggactagtaggtatcattataatctacattgtcaatttttttcagatttttttacaactatttgcatcgaatttggaagaaaaaagttatacgagaggatatcccctcgagggattagaatccactccctatatatatgttatatatatgttagttgtcttttggcattttgatttcgttctctctgctgtacctgtgtgatgccgatttggttttctttccctgcttggctagctagctgctgctacttttctactactgtaatccattccatctcatgcatgcatgtccaccaactaatctcaagtatacattacttttgtctcctagatctggatatatagatgtcaaaaaaatagatctggcttcttttttattttgtacgatatatagatgtcaaaaaaatagatctggcttctttttttattttgtacttactagtgtatgttcattttaattaacttaagttgcgcgcctttctcctgtctagtccttcctctcttgaacagctagctccccttccatcggattcgggcatggattcttttttacatcatctagatccagaaccgataatggcgtaaaaaccctaacctaatgagaatggatcgatatagaggtccaaaactggggtagtagaatgtaaaccggcctgcctgtgaattcttcgaattgggcttcaaagtaaaccatttagatgggcccttttcgtattagaatagggactgcatagaagcccatttgacgagcccacccaccatcaaaaccgatggccatctcatcacaaaagaaaaagaaagttacctccacgtaagcacaaagccatccgccacgtctcaacccctgccgcgtggacagacacttctcttctcttcttcctcacgagtcacgcacgccgttcactccgcctctttctttctctctttctttctttctttcttcctgctcccctgagctcctgccttattacccatcgttgccgccggcggttggccggacgcatggcgatgccgggacagcttcaacacgcgatggctgccctggatccatgccgcctgattggcatggatacgcggcggccaacgctggggtggcctcggttcgtgctgccgttgctaacgggttcacatcctttcttttctttcccttttttttcgagttcacatcttgtcctttctattcgatttctattggttggtttgtttgtttgttttgaattttggtttgcaatttcatttactttaagctttttatgtgttctcattcattcttgtcttctagtttttgttgatttttctgaaaatccatctcactatcctatccttctttagatggctgatttaaacaacgacaacgtcttccctgccccgcatcttctcactcatccagcaaagcatcatcttgtttctaagactattcactctgttttcaacatcgaggtgaatgtgaggcatcaagaggaagataacaagtctgctttccgtcacttctgtagaatcttaaaaaggctccccattaataagaatctggatagagccgaaatagaggaaactactattccgactgagctctgcactgggtttgttattgagcagaggggaaatatactttatcttctaaccacagcccatgctttggatgattactatgatgcaaagaaccatgaccttaccccaaaagatcttaataaatcatttattttcaaagtcttgtgcatccatcaggagaggcaccttctttctctccaaggagtggatgataagagtgagcatctgaacagatacttctgcgatgcaaaagtagttgcggttaacactcaagttgatctgatgcttcttaagttgaaccgtgaggatatctactactcatatcaagatgcggataattttatcatttgtcccgaggaccatacacgtatcaagctaggaaaatcaccaccagttgagtctgagaatgtctttttacaagggtggccagcattgcgatcacaaacttcagtttgggggcacattagtcatactaacagaagatacgacacacttactagcttgaatgtgaaaggatataagatgaatctgattgaagtgcctgagtttcaatgtgcagccggaacatcgggaagtgcaattctgaatggggcagcacgttgtgttgcggtttatcacggtatacaaaagaattgtaaagccggatacgcaatcagttatcaagatgtgaaaacttttgtagatactgcacttgcaaatgtaagttcaattttatttccttttaactcttctccttttctcttttcaattgcttagtgacttagtcggttagtcctagttctgtttgttttcttcttttcagctgccaggtgatggtgatggtgatggtgatggtgatggtgatggtgatggtgatgatgatgacgacgaggagaatgacgataacgacagcgacagtgactatgatgaaagtgatgaggaagaggaagagagaaagaggaagaggggcaagggcattggcagcggcaggggtaggggaaggggcagggcgagtgggagtgaaaaggggaggggcagtgggaaggggaaggcgaagatgagatgaaagacgaagacgaagactgagagatggctggtggctgcgctactgtgtatcgcttcatgtcgagatggctagcgctactgaagtgtctaatgctgcatatctgtattccagttaattagagaacatgtctgtctgtatcccgttaattagagagttattcactagaactattgccactaggcgtatctagctaattaattagaattgttcactaaacatgttgccactaggcagtactatggctaatcatcaaaacattgtctattaattagagttgttcactaggcagtactaggcaatggaacaaggggcgctgggcggctgtggctgcgacaacagcatgatcttggttctttgctgttttagatgcatttcggcacccttgtttatccagcctataaacgcaaacctgactgtctgatggccactttgcaattgctatctgcaatagaccaagatggcagctgaggggagtatatctaggaatccgtttctttttgttgctgtttcattcttgcatgcatgggcaatttgcaaatactgtaaattgttgtgtattggtgcctagcaatttgcaaagagaatcaagaggtccatgtgcttctgaagaatgcaggtcgatgtgaatcaagaggttccacaaggcattgcaagttcatctacaggtttctgaatcaaagtcaggagtaaataaatattgtgcagtttgttcaatttccacgaaattaaactgtgcagtttgcccaatgtggagtactatctgggcattttagaagataacacctgttcacctgtctggaaacactcacgtgtctgcatcatgtctgaagtccatcgtctctgctatgaaaaatattctactttcccagcttcatttcctatgtaaataatagaggcatacaagttgcattatcttttctgataattgagtgttttatgatcattgggtctgcaagacagcaagctccgattcagtatactactagggcttactctacatcatgatgaactcatggcttgtgtagttgtgtatagtgtcagttttttctctgctctgattcagtattgccgaaatcctgttactcaagatttcaggcactgcataggtaatgagctagagtagatttgctgcacatgattattttctttgcagtttggacattagttatgtactggttctttctccagtagcctgaaaaggaaggttgcatagttactccacactttaccttgtgcaaagattttatatatatatatatttgaaaggcgggattttttttttactttgcaaagagaatcaggagtagaataatgtacgctcatgtgcctggatgcaaccagatttagcacatgttatttttttcaggtaagcatgtcttcctttcgcaagtcatcatggacaccacctaattgcaatatcagaagggagccatatctctctcaggttggcatgtccttcttttctttgtttaaatcatgaagaggtaccttttaattgggagtaactctgaacaggtggaggcagtctacatggaatactctagccagataatgctaccaagaagaggaccgtagtgggagtagattctaaactctcgttttttttaacttgtagaagttaaatttgacctttgcatgtttgtggagtgatttatcacatattaatctatcttgttaaattttttcataattatttgggtgacatgcaaacaacaaggggatgtcccctcgagagtttaaaatagtttcccagaccatagtggttagtggttagttgtgctgatttctcttttccagttcaaaatctgtaaagagatgactggcccaaatctttaaagttgatttggactatagatttcaatgtgtaaagtgatgttaactcatttggagcatatttataagtgattttattatatttagaataattgaatggttgatttgcagtttttaattgcaccattcttgcaatatgattgaattagcacaggagtgtctgaacttgaattcagtgctctgcatatgcagtggatgaatactcgcagtttacaagaaacctggaagaaatcaacctcctttattgcaccataattttattaattttattttgttaactttacaagagttttgctgttaactttacaagaaattgcaaacattcacattatagacaattctgtcaattcacatcaacgtaaagcggtcatcaggaagttggcgtggatatggagtaggtgcgaatttttgaaactggaacatctctgaaactgaggtacatctatgaaacatcagtgcaggagtatctccgaaacatcccacaggagtatcacagcttgcaagtttatgatctgcaagcttgcaatagcttgcagatcaaacactataaaaacaagcatgccagtatgctacagatagccagatagagtcaagcattctgtcaaaagctgctctttcctcaaaacatcagacgcctttctcttaaaatcaggtgaagcagcagaattgcatcttcctcagaaaattgcagctgattcaaagctgcaaattgcactgaactagtgaactctgtactaatcatgaatggttgtttgaagttgcatccaatcagattgccaactgacatgctcacgcacacacctggagcctacactgcacggtgtgcaacctgcagatatgttaaccataaacattaattagccccttccccatcttaatgaaatttggtcgccattccttcggccgacctggcaaaaaaaaaacattaattagcccaatgtcaaagcgtcattgttcttacataattttcatcacggtcgattaacatcatgcccaaacgattgaacaaatcagacaacagatggctgcgatgattgtgacttcacactagtgaaaattacagttggagtcaaagtcatccaagtgtcccaaaatgaactgttgtcacaaatcaagaacatgttcatcccaaaaggatttggggcctggggaagttgacaacttgaatgatgattgatgaacaacaacaaagaacagaaacccgcaccagagcaccaggagcatcttctcctttttatccttcgccccttcgcctcctcgccggttgccacagtacgcaccagaacgcaaccactactactagtcagcgaacaagctcactgatggagcaaagctaggagaaggtagacttgccggcgttctcgggcccacaagcaaggtggcggagagcggtgcccgagcgggcggccgagggtgacggtggaaccatacgatacgacggcgagtcggcgagggcacgcgaggaggagggcaaagatgaaagcaacggtcgtgattgaactacagcgttaaattacattacaaaaaaaaaaaaaaggagactcccgattgacctaggacgtcaaataaaagttaaacatcccagaatcaatggagcgtagggcttattcaaattgatatacctcttcaaaacatcttatctctagttttttttatctctatctcttttctatctctatctacttctatctactactagcaaaatgcccgtgcttcgctacgggtaaaataaagggttaaatgctataaaatacacagttagcatgtatataataactagcaaaatgcccatgcgttgcattgggtgaaacataaaaaaaaacaacggttttgctggctagctgtcgacagttttggaggctaaaaactttcgattttctggccgtacgatccgcgcgagatgattttctagctgtgcgattcgattttctggccgtacgatctgcgcgagatgattttctagccgtgcgatccgcgcgagatttggaaaaaaaaaatctgtacacgtgtgcttgcaggggctcgaacacagggtccccatcatggaagccatgcgtgctagccacttgatctgctgcatgttttggaaaaattaagtgagttacattttagttataactacattgtaactactatgtaactgcactgtaactatattatatatatatattattttaatacttatatatgagttacattatagctatagtgaaattatattgaaattatattatagttagatttgaaagttttctccttaaaaaactttcgacagttctctagatagtcccaaaaacaacagtaatgggtgtgtaggagcaaatcgaatctttccggtgcaagtaagatactaacatgacataattatttgttgatctaaatccattgacatgaatgattataggaaaagtattaataccactttaaaataaaattatgtattatagactataaagtttgaaacccaaaaagtatttacttttgtcatgtattattatgagttggttgcaatacatggttattttttggtacttgatattgataaacacatttttttttacatattgtaaagagtagcaataatataagaaatgtttctcgctatctatcagatcaacctcattgcactccaatcgcataatcattttcactcaaaaaattagacggaaatcatacgatgaatagaaaaaaaattggatgtaaacacgattcattctgttggtgattacatttttttttaaaaaaagacatgtgattgttttctattttctaaaaataatttattttgtcgtaaataattcattttgttggtgatcacatgttttttttaaaaaaatacatgtggttttttatttttaaattaataaaattgctcgttatttttatatgattcttggtagacgtggatccaacctttttttttttggtgtagtagcctcgggcaagccttctattatttaagctagtgctgcccaagctaggcaaaatgtggtattatttgtgcactgacatatgacccgtgtggggcccacttgccatgttagttaaaactggccacgatactgctgagggatcgaaattgacatggtattgtaagttaaaggatgaggttacctggtatttttatttagggatggatttcatattcggtgataaactaagggagctaaagtgaacttattcacgtttgctacagtatcgcacagtactgtactgggctgctg

SEQ ID NO: 65205 - DNA, 10286 bp, Oryza sativa
ctgcagcccccggaagctttatctattttttaattaggtatatattatatatatatagatatgtttcattcgtccgttttaataataataaaaaatagcgtaaaaaacaaaataaaaagagaaagaagtccgattcccttaaaaaacggggaaaacaaaaaaaagtcggagaaaaatagagaaaaaacaaaaaaaagtccttcgtccgtctaaataaaaaatagcgaaaaaaccaaaaaaaaagtccgattcccataaaaacgaaaaaaaaagttggagaaaaaaataggggaaaacctattccccttaaaaatggggaaaaccaaaaaaaaaatgtccgattcctatgcaaggttaaaaaaaaagggtccgattcatatgccaaaaaaagcggcgaaaaaaacagtagatccgattctcttaaaaattggaaaaaaaatcctattcctatataatcctatttcgtacgtatggtttttccgtttttcttttttcttcgtttcttttctttttttttctttcccttttttttggttttttatttcttaaactttatatacacgtatacaaactttatatacagtatattttttcttttttatacgtacgtatataagttttgcatacttctctatctctactatttaaaaaattcaaaacatttcctttgtccgtccctacttgaaaaatcacatcttttatctatctaaaaattggaaaaaaaatcatattcctatataatcctatttcgtacgtatggtttttccgtttttcttttttcttcgtttcttttctttttttttctttccctttttttggttttttatttcttaatactatgcatgtatacaaactttatatacacgtatacaaactttatatactgtatatttttttctttttcatacgtacgtatataagttttgcatacttctctatctttactatttaaaaaattcaaaacatttcctttgtccgtccctacttaaaaaatcacatcttttatctatctgattccctaagaaaatggcaaaaaatggttagtgaaaaataaaaaaacgaatgagaaaaaaagtacaaaggtaggaaaaaaaatgcggcaaaaaaaactctgcttctattagtttctgtggtccctatatatatctctcctctagctctaatctaatctaatgtaatctaactacttaaaagagaagttttcatcatacaactaaaaaaagaagttttcatcgtacaactaaaaaaagaagttttcatcgtacaactaacaagaaaaaaaatacgcgagaaaataaaaacggttaaaaaagcgtgagaaaaaaaagcaaaaaaacgcgtgagaaaaaaatgtctgaaaaaagcgctaaaaaggtttccgtcatccctaaaaaataaaaaaatacatgcgaggaaaaatctattagaaaaagcaagcatgccatttctaaaaaaattgtttgaaaaaacctctcatgaaaaaaacaccatttatgaaaaacaagctgctctaaaaaaacggtcagaaaaaacgctaaattgatagacgcttgggtcggattgctcgattttttttcatcatctattatcagatataggtaatattcctgataacacatcatatagaaattatatttaaaagataaacatatttttaattgttatttagagaagagtgcacagtgactctattttgtgtagacttgaccatgcgagagaacgttggatttgattgatcctattattggttacaataatgagatcgaaagagtatgttagattatatgtatgttgtcacgtgaataatccaattattttaggtaaagcaagcattgatgatgtatgttgtcatcgtcgaggttggaccattacatcgaagatgttccaattttctaattgtcttagctacaaacgatccatacaaatattgtcattgacatggctatgtatgaaaaacgtatattgtcattagaatttttttcacccgttgcatcgcacgggtattttatctagttattataaaaatttaacatgtttttgccgaacttttttttacgccgtcaaaatttgtcttcgatttctatttgacttgggcttgactcgcgatgcccgatgcggagcgggcagcgacagcgacgggtatgacaaagccaggatggaccccggtacatgccggagcaggtggaggcgctagagcgggtgtacactgagtgccctaagcctagcttctcctgccgccagcagctgctccgcgagtgacccatcctcgccagcatcgaccccaagcagatcaaggtctggttccaaaacaaaaggtgagcaaaagcatgcaaagatatactatcaaactggtttgccttctgtgtgtctggctgtgaaatgttctggacaaattggttgacaatggagcaatagcaatggtagtgttcaattgtttgccttggttgtgcatactctgcttcaactatatatatatatatatatatatatattttttgaggggtcaacggcaggagctctgccaatttcattaaggagagtagagaaaaagcaatacaggttttttacaaacccagattacaaaggatcccaagcattcttctatcaaggcaacctgggagataaggtggtaaaattttaagaaaatgagaagcaactagaaggagagtgtttatacccaaatttggcacctatggacgaaataggggaaaattgccaaagtttggaaagtgacgtgttttcttactcgggaaggcaggttcgtgtttcctttggtttctatcccgagttggatgtggagaagggcctgtagagggtaagaccaacccctattcaagggagaaggccggttcattgtaaaacccccgaatacaatctacttgaattgttctttcactatgtattctattttaccctagtattagtccatctttgtcggtttgcgccataaaccgtccgccgccgctagcgagagtgcgacacctctttgtaggtgtgtcatgaaaacctttcgtttgcccacgagacgggtagttattctcatatcgatctaaatcggcctagaggctgattttgatctctaaatcggcttcgctagccggtttagcttttctttttacaaaacccatcttgatttggccctttggctagatcgaggtggttggcgacttcatatcaccgcaaggcgtttaggtgttgcgatcgtgcttgtcgacttgtcacaaaaagttgccaacacgatttttggcgactccgctggggaggagatccgttcatcgtcaactcaacttcgacttcgccatgacgaagccatcatccaagacggaggcggagccatctaatgtgatgctggtcacattggatgacttcgaaggagaagatcgtaaaactatggaggagtacatcaacgagctcacacgggaggcattgatgagagctactactaggactcgtcaaggcgtgatcatcaagcccgggccacgtcccaagctcgctcccgacatggtaagtaatgacgaggtatcacaatctatccaacaacaaattgcatctacaatagatttatctatggttaattttaaagatagattagatgtaatgtttaaggataaggttgatggatttttaaggagtaggctaggctcttttatggatgattacacattaaaggataaagcctataccactgttgatcaatctcctatagatccaatgggtagttaaactgacgggacggcgttcatggtcggtccgaccgagcctgacgaccggtcagaccgtaacatagccgtcggtcagaccggccagccggccggtcagaccgggtattaccccggcggtcagaccggccagccggtccgaccgcacatcatgatgccggtcagaccgggccttgggccggtcagaccaacgcaattgttccaatacagggtatagatccgatgactaatgctagttatttgtatcactttaaaacgtttgatcctcctgtatctactgctacaagtagtcctcaagttcccccacatgttcctaatgtttataatgatgttgctagggggtatcctcccgatactagacaaggccaatataatcatattgcgccacaaacacaacctattaggccacctaatccaccgccaaatcaacatgggcctaataatatggaggatataattagtgagattattaggaatagattcgggactgaaactaggaatcgtgctaatgtttaccaaaagccgtatcctgactattatgatgatgtgccgtttcctcgtaattatagagttcccgaatttaccaagtttagtggtgaagatagtaggaccacatgggagcatgtaggtcaatttttagcgcaatgtggtgaggctaatagtgatacttttaaattgcgcttattttctttatctttgtccggtactgcttttacatggtttacttctttaccggcaaattctatttcttcctaggctcaatcagaacaaaaatttcatgattattttcacactaatgaaactgagcttaagttgtttgatttaacatcggttaggcataaatataatgaatctattgctgattatattgaaaggtttagagatattaaaagccgatgttttagtttgagaataactgacaaagatttggccaacattgcatatgatggattgcttgattctattaaagagaaattgaatggccagatatttcttgatattgatcatgtgttgcatgaagctctggctcaggaaagccgagtggatgataatagcttaaatactagtttatatgatagtgcaatatcatgtgtagccgaaccaagcgacgattcggattgtgttaaaaatttgtgcaatgatgccataacgattatagccgaaccaaatgttggttcggattatcttgctagcgtggataataatgcaataaccattatagccgaatcaagcgatgattcggattgtgttactagtttagacaacgatggaatagccgaaccaagtaatggtttagattgtgttgctagcttagagaataacatcattaaaaatatagccgaactaagtgacggttcggattgtatcacaagcgaaagtgaaatagcattgtcacctaagaccgaatcacaaatcggtcatgtggatgttggaaaagataatgacaatgtcttacgggatagtggtgaaatagaatccaaagtagctatgcatacatatcaaaggccatatcctgaacatgtagattcggtcccatacccgcaaggatttgaggtgcccaacttcacgaaattcacaggtgagaatgctatgactacaatcgagcatatcggccgctttattgatcaatgtggtaaggccggtagcgatgatttgcttaagttgaagttgtttcccctttctttgtcaaactttgcatctacatggtatagtttgcttgctcctagttcaatttgtacatggtcacaaatggagcatgagtttcatgattattttaaagatgcaagattgatggagaaaagaccggttgatgattcatcggtcacttgtgagactatttcggttacatctatgcctaagaccggaattgttagtgatcctctccctgttagtcctattgatgtagacaaaaagaaagggaaaagtgttattattggggatcttcggcccaagaataggatcaaaaatgcgaaggccgaagatcataaagttgcaaaggatgggtcatctaattcccaaaagaccaaaaagccgaagctcacttttgagatgcttatggctaaatacaagaaaggattagccggtcaacgatttgataaccaaactagtgattcgaaaagactaagatcatctcgtaggaagagatttggtcaaacatcaaagaaatcggagccatcaaccataccaactccatataaacctccggttgtaatgccatggtatccatatccaatgtcactatatggttatccttttatgtattacatgccatggatgcctcaattctctacgccgtttcatcaaggatgggaggaatcacctaggtcagtaccgaatcattcatctaattcaagacaagaccgtttcccacaaaagaatcggtccggtggatcaaaggtgaagaaggtgtgggtgaggaaagaagctaaagctccggaggtcgttgctgtcaaggaggagtctcaagatgttcatgtacctactggagatgcggcaaaaattgtacaagtggagaagactgaagccggcgccgttactgtcaacgtcggcggtctgaccgaggcgtctggcaggtctaaccgccagacaacggccggtctgaccgaccctcctggccggtctgactgatggcttgcagccggtctgaccgggcccagaggccggtctaaccggggagcattggagaagagcgggaaaattgagagcaacataggagcttctacttcgaccaagaatattaagaatcattgtttagctcctagaaaacaaccacagccgaagtggataccttctggcttatctcgttctcagaagaggaggttacaacgtcttcgggccataggtaaaaaagaaaaggaggccgaagatgtagagaacaaaacatgtaataatttagagcctcgaacgacacctaagcgagtgtggagacctaaagaagtaaaagttaagagatcggtgattttccaaagtagtgatatatccaatttgatgagagaagaatcatcggtcattagagataagtctccttcgcatggtgctatgaatgttggtgcggtgtttgtcttgccttcgaaatagtgcagtcaagagagccgattttgctcggggggcaagacattaatatgctcatgagggaaccaagagaagatgaacggcgatggatacaacatcacatctttgagccgccgtttgttggatgctaaggcaaggtatgggtttattgtgttcaacgttatattatatgcctatgccatgttagaacattgcttgatatctagcacatgtgtgtttttgcttatcaaattgatattatgcatacatgttgcaaatgctagttctaggtagtggaattggtaggttggcatataatttgtttgaagtatgatttggctcatgagtctttgatatttatttaaagccaaatcatatgtgtttttatggatcaccatataatatatatatttcatatttattgcatcatgaaagttttgcttattagtaattcggctaatgtcaatggtcaatgtgatgatttgttctagagttattgtatttaggaacattggcattgttaatattttgcatacatgcttaagccgattacttacatttttagtttattggaatctatgcatgtgacacatatgactttggtgattcattattgattatgcttcaattggctaagtgttttgatgtcatgatgattattgtttcaaaagccaattgaattagtattcatctagacatattagttgaatgttataatttttcatatgtctagagagaaggaattttggtccaataatttgatataccaagcatctggctattatgtgaaaaaaaaattatatactaaaggccgatgcttgatttcaaaagtttggacgaaattgacaaagtcatagaccaggggtggtctgaccggcattgcacggccggtctgaccggtggtacccgcggtctgatcggctctgcatggccggtctgaccgggcagacagggtggtccgaccggcattgcgtggccggtctgaccgatcccagacaggaggctggggggcacgttacagttgattaaaaggccgaattaattgtgaattcggacatttgtgcccatgagatagaaatagcttggcgaattcctttgattagatatttgaaagatcctacacttaagattgatcggaagattcggcggcaagcgttcaaatattatatcgccgaaaaatagatggagtattgttgaaatgcttagataatgatcaatctaaagttgctaggagagaagttcatgaagggatttgtggaattcatcaatcggcccgtaagataaattggttgcttaggagagtggggtttcattggccgacaataattgatggttgtttcaaatactatagagggagtgaagcttgttaacggatcggcaatgttcaattaacgcctaccgctgtgttgaaatctatcattaaactatggctgttccgaggttgggctttggttttcattggtcaaatttatccttcgccatcaaaatggcattggttcgtgctagttgcaatggattacttcactaagtgggccgaggctgtgccgctcgagaatattacttatgcggaggtaattgactttattttgaagcatatcgttcatagattcggtattcctcaaacattaaaggagcttcttttatgtccaaggaagtgagaagttttgccgaatcttatgatattaagttgttgagttcttctctttactatgctcaggctaatggataagccgagtcgagtaataaaacattgttgaaattgccgttttgccagttgaggtaaatcttgacactcttcggtatttcaagcaaggcgacttgtcggttgaagattacaagaccttgatgggaagtaatttttgaagatgtcatcgacgagcgtttgaagactttgagggagatgaagacacttcaagacggtgttttcagggataaattaatgggaaatacttgaagaaatacttcccgagcattttgcaagatgcttaggaagtcctatggccggtaattggattatcgccctgagataacatgttctatgcttttaggttcacgtctgttcaccaaaaaggcaggggggcatgtgtttacacccaaatttggcacctatggacgaaataggggaaaattgccaaagtttggaaagtgacgggtttccttactcgggaaggcaggtttcgtgtttcctttggtttctatcccgagttggatgtggagaagggcctgtagagggcaagaccaacccctatttaagggacaaggccggttcattgtaaaacccccgaatacaatctacttgaatcgttctattactatgttttctattttaccctagttttagtccatctttgtcggtttgcgccgtaaaccgtccgccgccgctgcgagagtgcgacatctctttgtaggtttgtcctgaaaaccttccgttttgcccacgagacgggtagttatcctcatatcgatctaaatcggcctagaggctgattttgatctctaaatcggcttcgctagccggtttagcttttctttttgcaaaacccatcttgatttggccatttggctagatcgaggtggttggcgacttcatatcaccgcaaggcgtttaggtgttgcgatcgtgcttgtcgacttgtcacaaaaagttgccaacagagagtacgtgcactactcatctagaacatgcgctccgacgtaggctttgcacatagcgataattgaatcaaccacttgcatcactgtgctataagtgccattgaagattcttgcattgcgctgtagccaaatgccccaagctgtgcagatgaagaggccatcaaaatttcttctttgttctttggccatctctcttctgcaggttgaccaccatcgtagcatatctccatcgaaggtggaagccacaggcatgtggagccccgcctttagccatatctgtctccatacctgtttagcaaaggcgcattccatgaggaggtgcgttgctgtttccggttctactccacacagaggacaaatgtggctgttgtcccatccacgaagctggagtttgtcggctgtgaggatctttctgtgaatcatgagccaaccaaagaatttgcatttgttttctaccttcgccttccagaagaaatcagacctattgtcttgtatgcctccaacgaactggatcctgtaggcggagtttgctgaatatgatccatttggagtccatctccaagctatcgcatcgtctattccttcctgcaactccacttgttggatttggtgccatagaaggatgattccctaacctgtgttgtggtattcattcgtctcatctgtttcaaccaatggttcccttgtatctcctgtgccactgatctgttctttcttgtggccaactgatagagggaagggtaaagttctttcaggggtgatccgttcaaccatctgtcatgccagaattttgatttgttgccatttccaagggttatcgtggtcgaagctctgaacagctgcttgtctgtttcatcacaa

SEQ ID NO: 65206 - DNA, 9643 bp, Oryza sativa
ttgtcgacggcggtccattcctgccaaagccagcggagtcttaaagagcgcccaaaaagttcgaggtttgttataccaaggcctcccatgtttttttggtctacagaccctcttccagttaactaggcagtgtcccccctgtgcctgttctgaccctgtccagaggaagcccctacgaattttgtcgatctttttttcagcccattttttaagggggaaaacagtgaggtgataggtcgggagggcggagagggtagactttatcagaaccgtccgaccagtcttgtttagtaactttcctttccatgttgggagcctagctgagaacctatcgatgagaggttgaacatctgattttctgagtttcctgatgtggagtggaaatcctagataggtacaagggaagtgtttcatctgtgccgggaagggggagagaatatcctataagtcgagggtgtcacatctaatggcatagacttcgcttttggataaattggtcaccatgcctgtcgcgaggccaaaattttgaagaatcatttggaccgtatggagttcctgtttatctggtctaaggaacactacagcgtcatctgcatataaggccatattgaaacgagcagtccgcctgtggagcggttggaggagacctgcttcctgtgctgcggcaaggagcttttgcaggggatcaatcgcaagaatgaagagcatgggtgatagagggtctccctgacgtaatcctcgtccatgcaagaagctgtttcctgccttcccatttaggaggatctttgatgaggacgttgctagaatggaaataatccatccaatccatctgtctccgaattccaaatatctgagtttgtctagaagataaggccagctgatcgagtcgaaagcttttgcaatgtcgagttttagcagaatcgtgggggttttggacgattggaactcacgcaccatgttgtttacaaataggaagttgtcttggatgtttctgccttttatgaaggcactttgatttgttcaactatatttaggaattgcaagtctatgtatttatttgttttgcctcctttcttgcataatggaacaacctttatataatcaaggaagtatactgtacttaccagttaccagagtatgtgccagattaagccatccattaattagatgttgaagtaaactagatgactatattgcgatgtattctaagtccactacttataaaactgtagggtataggatttgcttatttctagtaagataagctaaacgaggatcctttaggtgatatggccaaactaagacacatatacataacgtattatcatgcatctgataggaatgcaaaacaatgctgtcctatttactttaactgcaggtatttaggctcgtcttttatttttctcaagaggcacttaacataatatacaaaatttgaagaattgcattttattttaaacttctatgagttctgccttttcttttatgattgttatccatggtgtgcctaaataattgttcgatctagaggtgatccaaagattcgtatatattagacgtaaaaataatgcagtgttttttttattttttagtctacaaatgtttgacaagaaaaggatgaaagagtgacataggcgagctctgtagcatactagcacccttccctccatgtccccgttatggcggctcgcgacttcgtcgcccctccctgcccactgacggtctccctctttgatccactccctagcacagattgcttgcctccctcttgagattaagttgactcgctcatgccactgctcttaaggtaagagaagctgagaagaggagtgtgtgggttctctttcccctgcttgattcggaagaggggtagaagatgggggggcggggagagcgcgattggagaccgtcgttggcgaggagaagcgaggaaggagggaagacgatgtggcgccgtcatgcaaggggaaggaggagagaatagggtggggaacagtggcggctagggttcggcgaaccgaggggatagggatgttatctttttcaaaaaaaaaaccctttcttttcattttctgagagtgcggtcctatattaggaatttcgtctccttcacgtaggatatactaggacacagatggccgttacgtaagaatacataagacagtaaacttacattgagggacttaagaaagattgtcaagttaagcgaggacgtttttgcaaaatttccaggaccagcgccggatgatgtggacatcagcggaattgagcacgtcgccccgaaaacgcccggagcactgtggtgcgagcacttcgcccacatctttaatacctccgtgttaacgaccaaatttggtaagatatgaaccaggttcgacattggaatcgaagcggattcggcgaagaaatagactcgaagaacagagtatgcatcggttgcgaaggcatttgttggcgtttgcatcggcagagatggatcggacagaggataactgataaagccgatggggtcggtacagccgattctgataaagatggcttcggggctgtttctagaatcgatcaatgtgcttcatgaggattgccacgatagagatagagctctgaacaaggcaattgtatctattaattaggatatttcgtgtaattttcttagagatatgtttgggcaaaagtctgccgcaaagacttatgatatcttagagtttgttagagataagagtcgtgtccggcaaggacatattttgtatcttgggtataaatatgacccgaactcaatgtaatcaacaacaacagttcagtaacactttcagtgcatcaccaccctttttactttcgttctatttcgacgagttcttactttcgggttgagctgcatcgattacgatcttcaactagaggtaaacttgtcatggcgccttgcgttctcgggattagtgcttccatctttatgacactctaatcttgtttatgtgattcgtcaagttatcatatacacgttgtaatctccgctagttgcgatctataacttgtcatcggttagaaagtaaccgatagagttatgttttgttattaatttagattatatcgtgtatctaccatctcttataggttttcatcatcttgcctagatcctatatttatatttacgcttaatgctgcatcggttgagttcgatctattaagtaatatctataactataatatctggcttgttttatgatcatcgagagatatagtatcggggtttcagccgatcttacctgatctagcttctttatatctcacatgcttgattgatatactagatctgccttttagattaagatcttattgcattcaagtatattaggctccttgtttgatatattctgcctgttctaatatcctagtttaaagtggtatcagagtattagccgatacatactggatctatttaatcggctatgctataaacgtctatataatcattgctttaatatatatttcgacttaagtgatttatactgtctcggcatagcgaccgatctatcccaatcacttagtttaaatatatatcgaaggaaggattatatgtcattaatatctacagccgattgagtagatttagttttattttatttattcatgactaccgatcgattccaatatgacatcggctcaaagataaatgatatgtcatcggcaactagccgatcagctatcatttatgaatttaaccacggtttttcttgtttttctttcttgttgattgtaggatcaaatcaactggcacgctcacgaacctaaaagcaagattttggacctgcacagaagttaagcagatcttccaggccagtgtgcgtttttcgcatcaacacgcttttggcacgtccggtgggactcaagttgcgacaacgtttcctcatggcagagaatccaccacagtcaccagcaacgggaggcaaaactaaacctccgttcactaagccaccgcccgagcaaccgtctgaggttaatgaagggaacatcgtcccggtcactatagacaaattatcactagaacaaaggaaggagtttgaacaaatgatgaagagtgcttaggagcaattcatgaattcattcggggaaacccgccagggaaaagttattcaaaagtacaaggtgaaggtggttgctgccgatgaacctggaacaagctcatccaaaggtggtaaagctaaagggactaaaggtgctgcagatggctcaggtgaaaaggtgaggaacctcgagatggtgaggttgaggatgtggatgaagatggtgatgaggagcaagagcccttgaaattcaataatttccaagatcatgttgactatgctttcaacatgctttgatcaaccaatcaggggtccttgtcaatactttaacgaatatggttaagtctgtggttgatggcacgatagttgagcatcaaaacacggtaccagtctttctaccaaatggcgtatttccacagtataggagtttggtgactggtaaccagcaacccgtatccaatgcaccactggtctagccgatggcatcagtttcggctccagcacctggtgcttcatcatcggcacaaagacaggtggttaatcctcatgtcttgactagagagcagcctcagcatgctgggcagaatattaataggctgactcaagagcagattgcggcaatgtttgggccaactcagcagattgttgaaccaattcagcatacaccaatcaggcagcatgtggtccagccgattgggcagcaaatagttcagccgatactgactgggtagagaacaccagttaatcaacaacatcagccggttggagcccagttaggttggagcccagtttgttactgtacagcagatatataacatacaacatcctcctcagaactaccttggaggtaatctgaacttgcagcatccacctcgctcacctcagattcaatatcaagaaggaggatcaccttagccccagtttctgccccaattcaatcaatttgatctagtacaacagtagatgcaaggagtaccccagcagaagccatgggctgatatgattgcagatgtcatgagggagcagtttggacttaagccgaaggacactggaaacttatatcggcacccttaccttgagtggtttgaaagagttccattgcctaaccgatataaggtccctgatttctcaaaaattttagggcaagataatgtgtcaacttacgagcacgtcagccgattcttggctcagtgtggagagacatcggctgttgatgctttgagggttagattgtttcctttgtctttatctggatcaacattcacatggttctccgcattgccctataattctgttcaaggttgggccgatttagaaaaacagtttcataattacttctacagtggaacctatgagatgaagctttctgatttgacaacggttagacagaggcatgatgaaactgtacaggattatattcagagattcggagagatgaggaatagatgttacagtttggctttgaatgactctcagctagccgatctcacttttcagcgtttgatagctccaatcaaggaaaaattttcatctcagcagtttgaaagcttgtctcaccttgcacagaaggtaaccttgcataagcaaaggtttgcaaatgctaagaaaaacttcaagaagattaatcatgtgtatccttataggtatgattctgaagaggaggataactccgaggtagcagcagccgagtgggccaggagcaaaaagatcatagcatgctcatgggtgaagagttctaggaaagaagaaaggtttgattttgataccactaaggctgacaagattttcgatttgctacttcgggagaagcagattcagcttcctgctggtcatgtgattccatcggctgacgagttagggaaaaggaagtattgcaagtggcataattctaattctcatgctaccaacgattgcaaggttttcaggcagcatatccaattggctattgaaggtggaaaaatcaaattcgatgactcgaagaagccgatgaaggttgatggcaatcatttccctatcaatattgtgcacacatatgggagagcagccaatggaggaaagaatcggagttctcgattgaattcagccaagattattaataaatatcaaatgaagcatgacaagcagcaggaaaagtactatgcagaagatgatggtgggtttgatcctcattgggattgtgaattcttcaggttctgctggaatgaggggatgaggctaccattgattgaagattgccctggatgcagtggcagggcagggagttcaagccgatcttacagtagaggaagtcggctgagtcagaagagggtttctgttcatcagaggttgggcccggtgcaccaggatcattatcaggatgaagatgaaggcaggaaatcgcagtggtgtccttctggtattttcaccaaaaatcagaagagaagggttcaaagaatgaggaacagagaacatttttaggaggtacaacaagagatcaaccatcggctgaagaagacaaaacccagacaggagtggcgtgctaagagcacagttacagcagccgatgaagatgaagctgacaaggcaagaagattgatcaagggtaaggctactgcatccacatcggtaaacatgatttttatgttacctgcagaattcgaagcaagacaagccgatgttgatgatgtggaagaggcctctgctagattaattttgtcaccagagccagcaatctttaagaagccaaaggggacataaaatcggcaccttaagccattgtatgtcaatggatttgtcaacgggaagccgatgtccaggatgatggttgacgatggggcttctgtgaatttgatgtcgtatgctacattcaggaagctgggtagaaatgcagacgatctcatcaagacaaacatgattctcaaagattttggtggcaatccatcggagaccaaaggagttttgaatgtggaattgacaatcgcagcaaaactgttcctaccacgttttttgtcatcgatgggaaggggtcctatagcctgttgcttggaagggattggattcatgcaaattgttgtattccttcaaccatgcaccagtgcttgattcaatggcaaggtgacaagattgagatcgtgccagccaacaggtcagttaacgatgctagcgctgatttacctctttgggagatagatggtattgattgtttgtctagaaagatttgggatggagattttctaaaagtgtccgattgtgatatacagccaattgaaaacggagagcccaaattattactttgagggcgtcgtggagggttcaaatgtctacaccaaggacacggtagatgatctcgataacaagcaagggcagggtttcatgtcggccgatgatttggaagaaatcgacataggtccaggagataggccaaggctgacattcattagtaagaatttaacagcagaattcagaaccaagttaatagagcttttgaaggaatatagagattgctttgcttgggagtattatgagatgccaggactcagccgatcaattgttgaacatcggcttcctattaaaccaggagttaaaccatatcagcaaccgcatagaagatgtaaagccgatatgtatgatgctatcaaggctgaagttacacgtgaagttacacgtttatatgatgctggttttattcggccatgtcgatatgccgagtgggtttccaacatagtcccggtcatcaagaagaatagcaagcttagggtgtgcattgattttcgcgatttaaataaagctactccataggatgaatacccaatgccgattgccaatcaattgattgatgcagcttcaggacataagattataagttttatggatagcaatgctggttacaatcagatttttatggccgaagaggatatccataagaccgctttcaggtgccctggtgcaatcggtttgtttgagtggattgtgatgtgtaacatcctgaaaattttgaatctggaatacggaatttaaaaattaagaataatcaaaaatctttttaaaaccttttttgcatgttgggatttattatgcatttgtgtgtatttaggttgtgtgccaaagatctcgattaaatcttatctcctagagggacgccctcagtccaacgtcctttccttccattatcttcacggtctgatttattaagtgcttcggtactaaacaaatcacagacctgaatatataacccgaaaatcttttcttatgtcgcaatgcgacatatctttctcaattcttaccgtccggttatttcaaaccttttattattccgactcgataattccctcgaatacctataaacgatcgacgtatttatttatcgcacgttgattcgaatatcctcaaatccattcctaccgcgatgactggatttgtatgccacacgtcacccctagaatcctcccttcgctatcatcgttcgttcgtgcgagcactctcaaataatcctacgacgacctataaatttgtttgtcgggcgttaagcctaaactcctttttggcatcacggtgcatccatccaaacaaatcaagtctcgtattacaatccatttatcccgcccttgtgcattctcggaatatctataccgacccaaatccagttattgtccaagctacaatacaccatataatccaatccacatttacagtccaagtatatttctagtccaaacacagagccaaaatcaatatccatactctacagtccaaatgcacagcacattatacagtcccatttacaagttccaagtacagactaccaaagtacaaatcccaggaaaatactaagaactcctattacaattgggccattttcctctctctcccagcccaacgaacaacccagcataagtctattttaccttcccagagacgtagcagcccacccctgttatctttctcaagccaacccactgaaagtctactttgcctcccctgctcaaaacaacaggcatgcatgcacaagaattgctcgatgaaatgcctacaagcccaacagtagtttgcaaccacttttgccgggcacacaacaggaaattgcaccaaccatcaaatgtctgggacccccctcaccaacatgcaaaaccaacacacatacacccatacccccattccacataacactctccaaacacatgcaaacacagtgaggagggctcacaccgaaaaataacaccaagttcacagaggggaactcaccttgcctcccatgcagacaaccacaacaccaacaaaaattttcacaatttgaccctttgcaaaaactatttttacaaatgaaccgtcaccaaaacttatttcaaaaataacacttggcgttgaatttagacacctcagcgccaaatagcgtggcgctgaatatgtgttggcacgctctccaaacacatgcaaacacagtgaggagggctcacaccgaaaaataacaccaagttcacagaggggaactcaccttgcctcccatgcagacaaccacaacaccagcaaaaaatttcacaatttgaccctttgcaaaaactatttttacaaaagaaccgtcaccaaaacttatttcaaaaataacc

SEQ ID NO: 65207 - DNA, 2330 bp, Oryza sativa
gttaattattggttatatatgtaatgcagaaatgatatatatgtttttttttctgcaccatagtgtactaaaaaaattatagctgctctatttattttgcttgcatctggctcagctcatactccacccaaattaaaacagcaaaagaaaatatgaaaccctttttttgtgaaaagaaaaggtggcatgcacggtggaaacaattaaatgggattttggtcaagactgcaagaaattaattagttcctgtgataactgaacatcaggtaatcaggtctgtgaaatgtttcaagccttcaagaccattctggtctccaatatacttctctgtttttcttttactgagagctagtatttactagttggtgtggcttatcagaatttgcttaattgaagaatttacaaacaagatgcttaattcgactgattaaacacaatgaattgacgtccattttaagaacggtagtgaaatgcagttccaaaataatggggacggaaaaacaaatttaacaatttatatgagaccaattgtaagccgaccgctgcaagttaaaccattcatggtgtatttgaaaggaaaaccgcttaaaataatttgtttgcttaaaattgggacaattaaaatgtgtgtgcattattggtgcttgactcactccaactatatatgtggaaataaataataaataaataaatatatatatatatatatatatatatatatatatatatatatatacgtacagagaaatagatataataggatattgaggatgtaattaactctgtgggtttgaaacaacatgtacacgtgcttatctacaatatctcaatggacggcatcaattaattatatatgctaatttgtaatcaagtcggcacacaattggtcagtactgtacactatatatgctccaggatgacctgaccaaatagtagatgtctcaagaattaattatatatgttgcaatttattgcttttgtcatctctatatgtggataacatattgttatggctatttttatgtcagcttatagtctctatatgatactaattgattttattttatttttggagtatataggacgctgagagacagttgtatgtcctcctcagtccacatatatatatttatatatatacacactgtcatataccatattttgttttttttccatccatcagtcaagaggccagaagtgtactggttgatagggaccattcgatcggtgtcggatgatatttaattgccatcttagtggctcaatagattagttgaatatgacatcgaattggtgtggagtcaaactttattaatgtgttgataaaatctggttcccctgcatccatactagtgattgaaccctgaagttctttaatcttagcttcccctagctaggcatgcatgaatggttgttcattttgcacatatatttgagtgcatgctagctagggtctaattttcttcctcatttcccttttcttggacatcatatttgtaccatatacaaggcacattgttatgttaaaaaaaatatttggttggcatgtacttattttatataatgtaaattgtttacatcttccacatcggtacacacaactaataagttttgactctaaaatagaagatacgaggttatacaacaaactcgcatctccttccaattgcatgataactcctgagctaatgaaaataaataaatcacacaaaactctataacaaaattataaagaaactatgtcacctaaagtaggataaaggatccctagctattgattttcaaagtacatagtatcctggtcccttgtaatagcattatagaccaatagtgaaccaagtggaagatataaagatgatatgcattgaattatttttttataaataaaaactatataactgtggtaaaccatactgactaatacagatcattggctccaaacaaaattaatttttaattagtttagacactcccttgagacaattgtcaaaaacatttctacatttcgattgggaggggagagctattggaagcaatgaaaagacaacgccaaatataccatgccatatgttattgaaagaaatgatgttgtatatatgatctggttggatgtatggtagctatactagcagggcagggtgcctatgcgttgtaatgattttttttatgaaattattagaaaaaatataggagttctgactaggacatattagagttaatagttgatacatataccaaattattttaattcgactgtatatagtcagtataaacatgtaatgttcattttatctaaaaaaaaggaaaacacattcacttttttagagacc

SEQ ID NO: 65208 - DNA, 2185 bp, Oryza sativa
gtcgttgataatacgttatatgaaaagaaaagtcaaaggcattgttcttttcttattaacatgcatattttacctcgtgcgaaatctttttatatagaagttgttttaatatatcttataaatccattttgtctccggtgaccttaaacgggataaattaaagttttacgttggagactatgtatgcaccaaatttacacactttaaagctttatttatattttaggatggagggaggtactaaacgagaagtatgcatgagagcatgacactaactagctagaagaacactagcaagatgatgcaggtgtcattcattaattaaactaattaatcagaagttaattgagatttgtggcttgcttgacacatgtatactatactctcccagctaagctgtgtactactcctcaagatgacaccaccaccatcaccagcttttccttcttctctctcttctccggcgtccataaataccagcgccaccctcctctcctccatcatcgcagccaactccaacatcctgagctccaatctcccactccattccggccgcgcattctcccgctctcgatcgatcgatcgatcatggtggtgccttccgcgacgacgccagcgaggcaggagacggtggtggcggcggcgccgccagctgcggcggcgtccggtgtcgtcggcggcggcggcggcgtgacgatagcgacggtggacatgtcggcggagcgcggcgcggtggcgaggcaggtggcgacggcgtgcgcggcgcacgggttcttccggtgcgtcgggcacggcgtgccggcggcggcgcccgtcgcggcgaggctggacgccgcgacggcggcgttcttcgcgatggcgccggcggagaagcagcgcgccgggccggcgagcccgctcgggtacggctgccggagcatcgggttcaacggcgacgtcggcgagctggagtacctgctcctccacgccaaccccgccgccgtcgcgcaccgggccaggaccatcgacgccatggacccctctcgcttcaggtacgtacaataccaccactcactcttagcctagcttaatcgattagttttttactccctccatttctccgtttccccgtttcatgttataagatgttatgggtttttgaatatatagattcacgtttcacgctataaaatgttctgggttttgaataaattcatgcatgatctattgatgaacttttaagagtccaaaacattttgtaacatggaacggatggagtggcgtattgtgttgcgcctacgtgtcaaagtatgcatgcttacatggcacacgtatttaaaacattgttatgcatgtatataactaatgttctctatggtttaattttttcttaatgctacccatgcatattctataataaataaagtgtgccggactccggtcacagaagaatatatttgttttaatgtatcagtttaacttcgacgataattattattgttcgaagtacaaattttcggcatatttaatagtgtggccttgttctatcaaaacataatttttcgtaagagattatatacttgtataacttatttttggattgtagggatcctttccctatggttttacttcaaaagatgacttacatttggattggtgataaagaatatacaactaagtagacaaagttatatctagttcattttgaaaagttcaaggctcttttttcaacgggaaaggagtatcctatataagatatattatacagttaactctgtgccttttaaaagctctgttgacagtaaaatctcatgtagctggttcatccaaaaaaaaaattctcatgtagctgggcatacacgagctttttttttttttaagaacttacatacacgagcttaattacttctctcgatccttttgcggatgcgcttggttgctcgtaataaattttgtcacaaatctttgataaccccaccatttcccaaatttaagcatacatggtggtagaactatattcactaagttttacagtgtcgttgttacaacaataaactaatattgcaaatattgcaatagttacaatataattaatttcttctatgtattatgtactgaaacgcatatcaatcacatgcatggcactgcatatatggtcttaaactatatatgaggcaacgtgaataatatatattattaattaagt

SEQ ID NO: 65209 - DNA, 11757 bp, Oryza sativa
tatattattttttaatcactaatatactgtttcgcttataactatatagtagtataaggtatagacttgcatgatgtctatctacatgcatgcatgggatgcatatgtaggataggcttggcttgagagatgtctagctagctatgggtttttcatcagctacagggcaattaatttatagatatgcataatatattgtgttcagaagtcaaaagaaggccaagttggaatcatgcatacctgcactgcactcatgccagttgcaagcttgcaattgcaactgggcttgcttcttttcttttcagctggtttggcttgcatattttccatgttatgatcttctgatgtagccttttgactatatatcaaggatggactaaatgttagtttacacaataaggaaaaggatggaaatgttacactcatgtcatcatatactataacttaaggtaaattaagatcaatttacattaattttattaagaaaaagttgactcaagaaagctgcagtttatgttataattttaacttattatgttagcatatggggttttcatttttaattcttcatagtactacttcagtacatatccatatgtatactgtcattttcagacacaggtcccatcaattaaatcacggaaatgcatgagtacatagttttcaaaacaataattatcacaataatggcataattgatgctatgatggacaggccaatgataagttagttccaacaatttaagatcatacatagctagtttctaaagcaaaagaaaagcatgcaactgatgggacataacaaacttgatagctccacaaaatgggcataagaaattttctgatgaaagttaggtatcattgtctaaccaaatagacattggaaaaggatcaagcataccaattgatattttcatttttgctctaaaaaatgactacataagtggttttgaaagcgaaagcgaatattgccattggagaaaatgtctaccaactaagacaataatatatcagattttccttaactatctttgtgtatgctgaatgagagctcacatactaggagagattactcaccactcactgactgtactcagaaccaggtagtggcctaatcagagtttgctgagagaaaatatgatgaaatggacaagaaaaccctcacttaggtagttagaagactcctctcagggtccctctccaacaaactgtatatatttgtgtatcaaccaatctgacatatatgcagtggtttccaattaatggcaatatccaaccaccaactgatgcagcaacagagtgagtacttgaagcatccttatctaccagaaagctctgcaagcttaattagcaaagtacagcaggttttcatgtagaaaatgatgtgtttagttgggatatacatgatatatactttttgaaactcctcttagttctctatcaccatacatacatcagccattaatatataatatccatactagtacaagaatattaatcttaatgccttaatcaactcaaaagcctaagcttaattatcacaagcacatcattttggaaacatattgatagcaacatgccagtgaagtagtgaacacaaagaatgggataataatgatcaagaatgcatcaggttaagaacagaatggctaggaaatcttcacagtaaccattttgctatatgaaaagtgcaagacaagaaggaagaacaacctctttttgtcaaatgcaacagacaggggcccacatggaagtacacacatgtctgatgagaataaaatgatccaggcccctaaagagcatatctatgctatccatataaagccaaacaaaagaaaggaggcacacatgcaaggagtcctctttatggtaagataaaatgaaatgtcccagaggttgtgtagtggcaggggcagtgatacttgtgatccacgcactgatgggtctttccatggagcagtggaaaaaagtatggccaatcctgtcaacaacacatttttgcccattggaaaatttgtcacccctcggctgcatgatgtactgctgattctgtggcctatccatgcatcacaagattcacaagaaacgaatatatcacgtcttgtagatggtggtgcacaagcacagaggcatacacatatacccatcagtgtatcatcttttctaactcatcaggcaggcatgccgagggagggtgggtgcagcttttgatttgctgcagccatcaatcagtcaaagaccttgctcctctttctccagcttctttttacttgtcatggcacatccaacctgattctgtgataacagcattcttttgataaaatcaatttcaagttgattgtgctcacttgctgatatcctccctcactctgttgcagtgctattgtgaatgagtacattgaagccatgaagaagctcgcatgtgagatcctggacctgttaggagaggggctaggtctcaaggaccccagatacttcagcaagcttaccacaaacgctgacagtgactgcctcctgaggatcaaccactaccctccatcatgcaacattcacaaacttgaccatgatgaccaatgcaatatcaagagccttgttagcaccaaggctagcaatggtgggaatctgatggcaggtgggcgcattgggttcggcgagcactctgacccgcagatccttagcttgctccgagcaaacgatgtggaagggctacaggtgtttgtgccggaccacgagggcaaggagatgtgggttcaggtgccatcggacccatcggccattttcgtcaatgttggtgatgtcctccaggtagtcacagtaaatgactagagcaaaaaaaaacagcattacatatatcagaataaggtttactattatcaaaagaaattatttcatagattataaaaggaccgcaaagaaattatttcatagattataaaaggaccgcattgactatcatatgatttacaaattatgtggctttcttccagttattcataaaaaatgtttctttgctcactgcaaaacacacaggaaagtaatatatatttaatcatttgattcataaggctgcagcactgctgaacaatgtttcttttgtcaaaaaaaatgcaacactgatatgtttgttattttcagactcaaattcattgtattgctgcaattcttaccagctgacaaaaaaatctctttctatcctgcaactaccgctgttttactcaacttaaaaaaacaaatcactaaaacatgatgctgtaagcctggacatagttttgcattcctgacattcttcggcttatcctttctttggcctttatttcttcaggctctgacaaatgggaggctgataagtatccggcacagggtaattgcaaccgcctgcaggccaaggctgtccacaatatacttcgcatcaccacccctgcatgcacgaatctcggcactcccagagacaatcacagccagcagcccacgccgataccgatcattcacctgggctgagtacaagacgacaatgtactcactccgcctgagccacagccgcctagaactcttcaaaattgacgatgatgacagcgacaatgccagtgagggaaaagcataggaattgctggttaaattgcagacgatgcctatggaccagtggggattaggaagctgaaactgtccccaaaattttggctctctggcagtctggctactatcgtcagatatctcactattatgatggtgtagtgcctaagttgacgggtgtgtaatatcgttagcagtctacagaagctatggttgtacggaagtaatgtactgtcgccttttcagctaactatccatgttctctcttatatgtaatgagttagttgacggatgtgtaatattgctagcattgtatataagctatggttgtatggaagtatgtaatatagccttttcagctaactatccgtgttccctttgtccctctaaagcacaaaagtaagacctaactacagagcacaatagatagtttttgagaactatgatctattaagaaatcttaagagaaatcagaatacttttgacacatggttggcataagctagttgcaagtaattctgcaaaccacaccattattacactagattaaatttcatacttcaggacagtcaccaagtgtcaactcaacttacatatggtttttcctgtgaatgggagataattgtagagccaacatcacatcaaacaaaatggagagttttatgatatatatatgttcatgcactgtcggaaagaacatgatattataagtcagttgcaaataagagggtagtaaaaaaaagatactgcctaacggatgcacctctacctcccaatttatatttcaatgcacctcctaatttctttttcaatggcagaaacagaaaggaaccaaaagatacatatcattaaagaaccgtatgcatatattattaataaagaatgagtcagtgataagcaattattgtgatataaatcacagcaaatccgtgaagtggtctggtggcggtcaattatacatgcagttttctattttcaattatacaactatacaaagatattcacttcgaaacttttcacttctttatatagtagtgtgactctctcaaaaatcaatacatactgaagcaggaaaagattatatttgatgatcttactgaaggatgttggttgcatggtgtgtacctagttcagccacccccattcttctttaataggcggttaacacagtctttaattacgaagttcaagcccttgcttgcaaccagagtcaaggtcagctgcaggcaagaaaaccaacaatagttttactcttgtataatcacaatccttcccattaatcttccctgcatggtgtgtagtcacaacggcagatgatgactgcatcaatgattcctcagggccactctaactacccaaattcatgcaggctgatataatctgtaaaataaaaaaaaaagagtgatcaagtaattcatggagataagaataatcatgaaacctgacagcactgttcaaaaaataaaaagaaccctcaaagcattttcattatatcacttaccagcatgtactatacacaacagagtagatcaaaatccaccattacatcaccttatccaagggctgtgagcctgcaatacgcaaaaataacagtatgtcaacagaacattttctttcatgaagtcaacggtaattcttggaagataaaaacagagataagacattggttatgcaaccaactaaaggacaaagtagctccaatctgatggaactattcattgagcttgctgtttataacaaaaagggaactgatcaaattacaaccaatctcaaaaataatctagaacctgcaaaataatgctttagaaatgattgctctaagtttactatataaagtgaattttgttccataagtatcaatttaagtgggacattgcagaaatgtctgttcagcactaataactaaagcagaaactgggtgttgtttaaaaacagtgttcaaaaagcatcctttaatgaatgtcctcaacttcaagaatcataaagcaatataaatatgagcattccaaccacatgtatatcaagtcataaatattctgttcagaagggaatggtaggactgtactcaggtttcttaatttgatatctttaaatcgttcagaatcaggttgggctatgcctatgctacctgaacttgccaacaaagaaatcgtcagtttgtcatcatccaaaaacaatctttttgaaacaaaaggggaacacacgcgcaccaggcttacttgtttctcaaatattgcagagatgcacctgattagtactgaaacagaaacatgtccagaaagggcatgcttcaaaattggagaagggcacactaaattctaaagggaatggcatgattactacatccctgaaacaaatggttggctcgcaaatagcaacttgaaatgtcgcaggctgtcatcaatttcatgtggcttcacgcatcagatggtcagataccgatgatgatagctcgcttgcggtgccaaacatttagccaacatccaggacaagaaatgcccgaatatgtcgattacttcatccaccacatccacacaaatcatgctagagtgcacaaaatcggaccaggttccaactgtgcctccagcatcagggagatcgacaatgtagtcatgtgcccacaatgcttagacattcaaaaacctgacactagatttggtactctactaagttggcatgtggcagcgaacgattctcacacagaagaacatttcctgcacaaactgcatcttctcggagcccagagctgcgcacgagcaatcaatcggaactgcaacgaaaacctgtgcagccatccactacttcacaacacccgcgcggctacaagacatgcccttacctttacctgcagctacagcaaccggagcagcaggagattcctgaggccgccggcctccgcccatcctacgcgcggcccaagaacaccagcgccgccggtggcggcggcggcacggagaccctgacgagccaaaacctggtggtcgcggttcagcccctccggcttggagcagctccatccccgccgccgccgccgatccccatttgcgcagccttccacgtgctttccgagttgatataaggctccctcactgtcccgccacgccgtcgccctcggcggcgagccgccgtccttccgccgctcgcttgctccaagagtgttcggcgaaatgcctgaaaggcaaacggaagagagagagcaaggaaggacggactatgctttgggctgaatggtttaatctggaattggaccacgacatcgagattaggaataggttcactttagatactccatttgtcgcccattctgattttcatcctcagtgcgaaaaaccgggatataacgcattctccaacttacaaaaccagtgcaaacaagatcttcatcctacgtggcgcttacatgatcgttcgattcaaaaaataaaaagagaaaaattgaatactaaaaaaattaaaaaatatatgtcaagcccatatgtcagtcaaaaaaaaagtgggactcacatgtcctccatctcatcccccaacctctatcttctctctccatcggtgagcgtgtgcagagagggacgaggcggggaggccggcaagattgggcccacgatgctgtcgttgataaggtgggctcatgagaggggaggtggaggccgaggcgccacttcctcgcgagctcaagctctactatctcttcgtctacaaccgccgcctgcgtcaccgctccgccacggccttgctgaaggctaccttaggatgggctcatgggctgctcttggccatgcgccccatctccagcggtggcggcggtgcgaagaggggtgcaagagtgccaccgcctgcggcaccgctccgccacggccttcctgaaggctaccttaggatgggctcatgggctgctcttggccatgcgccccatctccagcggtggcggcggtgcgaagaggggtgcaagagtgtttctcttgatttgtttctctgacaaccgcggtgcaaaaaacggcaaggctgaagaaaggtgttggtcgaggtggcggtagggacggctcttggtcaggctccccgtcaccgtccaatataaaggttcgaacatccccttagggttgatttagtctcatatgtattgctggtatactttgtcagcaaataaaacaccatcaaagaactattaaaactattaatatcttggtatgatatttggctccagaccttccttcattggaaaatagtttcaacattgctcttagtctcataagaaaattaccttatgtgtcaccgatgtcaaagagaatcccctatctatcccttcttatctctctccctagttcgttcaatgccgctatcttctcacttgcctttttatcaagtatgccatattatcaattgagttattctaaacgtaaaccctaaatataccaagtgtgtaattcaacgacatttttcatcgtcacatgtaatataagtaatactccatccgttcatgtatgatcgacgtattagcgctggaaaagttttatatctttgatcgccgtatttctcttccaccgcacattcttaggataaacacgtgcatcgttttgttctatgcatgtaggcatgcaacaagtctcacgtattgaatgttcaccattttccgtttgcatgtaggcgagactcctcgtacacatgcagctgcttgtggtttcttctccgtgcgcatgcaacatttcaacgtgtaattgaattgcgatctccttagtcactacatcgatcacacatgaatggcaatagtaaaaattccttatataccactttttttgagaattccttatatgccactcaaacttcattagttcctttatatgccatcgaaaatatattgctctcttatatgccattggaatgaaatttatggcccttttataccattgcgttagtccgacgtgaatgggctaccaagttaacttaaaaatactaaaacacccttgcttctctgcaaccgaaaacacctaacacccaaaccgatgctcaaaaaatttaaaaccgatggataaaatgactaaaatcgtacaagaacaacgccgtttgttcctagaatggagttcattgttaatctcgcccttcttcgttaacaatttttttttataaaaaacatcttcatcggtttcaaacacttgcggctaagttttttctccaactttcttaactcattttactcattttccgcatgtacgtttttcaaactgctaaataatacggggtttttttaagatatctatacgaaagttgctttaaaaaacatattaatcaattttttttaaaataataaatactccatccgtttcacaatgtaagtcattttagcatttctcacattcatattgatgttaatggatctagacatatatattcatctagattcattaccatcaatatgaatatgaaaaatgttagaatgacttacatcgtgaaacggaggaagtatttaattaatcataaaaaaaagttttatgtgcgtgggagttgagttcccgaacataccccgatcaccgcaaaccgacctgtaatcctcacacgctgctgtctccgaaaaaaaaggggcaattgtgtttctgcccttgctttacgattcaattgtgattttacccctatttttttgggtttgtgattttgcccttgtttttctaaaatgaagtgccgtctacccctggttttgacagaagtttggtgggtccggaatttcagaattaaacgaagatagaaaatgttattatcatttttgaatgaccattctacccttggttcaatgaaagaaccaaatccccaatccctatcccgatttccactccaaaacccggcggcggcggctacgcgcggccagcacgcggcagggaggagcggcggcgggggccagctgccacggaacagcgcgcggcggagttgggcgcgggcagggaggcgctgcggcggcggcgtcgcgcgcgcatggaggcgcggcgcggcgaccggtggccccgcggtcagcgcgcggcggagaggagcggcggctccgtcggccagcgagcgagcgagcagcgagcaggtagcttggcggcgggatggcgctgttaaaggatgtaggcaggcacggcggcgacctcgggctggagcgcaggctagggacgcagggaggcacgacttgctgccggcgggctggcgctcctaacctcttgccggtgcagggacggaggcctagcgctattgaaaatacaggattaggagacataatggagtaaatcttgtgcatggtggaaatctgctgcaaatcccctgttttctttcccattttcctgtcttgtatctacgagagatttgtttggtgaatggtgatttcttcctgtgatgaatctttttggtgaatttttgcacccgatgcaagttctttgaaaatgctgcagaaatatgttaaattcttccaaaatttgtcaaagtttggtcaaattcgaaatatatacacattatatccagaaaggagaggcaaatgtgtaagggtatacaagtccttctactgctaagttgacgctgttaagtgatgctaacagaataggggcaaaacagaccttcgtttgaaaaaagtaagggcaaaatcacaaaccctaaaatgttagggtaaaatcacaattgcaactcaaactgaggtcaagaacacaattgccccaaaataaaagttcctcacacgcacgcccacgtcagcgcatcacaggaaaggccagtacgtcagccgcatcacgccgcggagggcaatcccgtaaattctcacgctaccaccatctctccccttccccccaagtctcgtcccttctccccgacgaacacgaactctttcccctccacctctcgactcctccctcgcttctccccctccgcaagtctccctccctcccccacaaaccctacctcgccccctccctccttcgatcgggggagcgctccattgcggtaggatccgatcccctttctccgccgattttttgcgattttttttgattttttgggtgatttgtgtgtttttttgcggggggattgtgcaggcgaaggggaagggggagtcggggatgttcttctccggtgacccgacggcgaggaagcgggtggacctcggcgggcggagcagcaaggagcgggaccggcaggtgctgctcgagcagacgcgggaggagcggcggcggcggctgggcctgcgcctgcagaacagctccgccacgaagatccaggtatgttcgaggcttcccgcgcgaggggaacggtggttttggggggttgtgaggcggggcggcgtcgctaggtttagcggggttttctccagcgcgtggggacttgagttgagttgcggcctcttgcagtggcggcgttcgggcattatttgcttataggtgttgtggttcgtgtggttttagtggtggtgggtagcattggcatgttggaattctcagcattaggtgatgtttgcttcaagttgtttttccttttccaatttgtgttatatgacgagttgtgtggagtgagataagttaatgtagttatggaacttgcgaatgtgtcattgtgtaggttaagttcagtggagtgagatgagataattatggaacttgcgaatgtgtcattgtgttggttaagttcaatggagtgagatgagataatgttgtcgtgcaacttgcgaatatgtcattgtctagcttaagcaattctagtagaagaaatctgtttattttttttcattgtttagcttaagcaatatagtataagaaatctgttttttttttttgcctgacgaggcaatgcgcaatctggtctgtgtagagtggctgaaacggtacttcctatgtatcaacataagacaaacatgtttttatttcccaaaatggaatttaactaattataagctgcagaaatgcttcagagggaagagagatttggaattggcacgttcggaagttcgagggaacttttgctctacttttggggagcactgccagagggttgattggtaagtattgccatggcttaaagcctttaacctatgccttgagctagctcattgactatcttcctactcaatcaggagcagtttcggtgctaattctgatttccttcgtcaattcctgttcttcttcaatgcaaagaaagacagtgatattgctatactctgtcaagtctgcaatttgctgttatatta

SEQ ID NO: 65210 - DNA, 1792 bp, Oryza sativa
tgggatgtttgctatggcttgtattcttgtccttatggtgaacctttcaatgcattattccttttttttcatgcaccgagtgtaattgccttcctttcattttcgtttaggagatgttctaagactctttggtggtacaaattactcctcactggaacctcttgtgattcacagggttaaaaaacttgcactcatttgtgtgcaaactgtacatcagaaaaggtgagttcaattacagtaaactggtatatatatgtattgttttctgttcttgttttcaatcgcataatgcatattttatttaattgtctggtggataaaaatcacttatgttattctattgcttgcattatgaagtttctatggtagaacctggtaaacatgatgagtttcacttaatgaaacacttctatctcgagatacatgttcaattcaatgaacttcttttagtggaacattgcattgcaaatttgcaatctcacttggggaattcccacttatccttaatgtgaacttctgttttttgtgtcagtaaaggaaaaaaatatcaaagatgtgttgcaattgttgattttgctttctcttaccatccatgatccatgatgaaatgaacataattgtgtttgacttctttattatatttctataggcatgattggggcagtcagcttttgatgccgccagaaagcacaccaaagccttgtggttcattactcgaaactgccgcttgcttgataaatcctaagcttgcatggaactgcaaggtagttgggtatcttcagcggaagaagatctattgcttatttagggggattattatatccataccggtaagttgtgtttctgtattacggttttgtatttgtctactatcagtgcctacaccttttaggttacttgttgaccaaaatgtattaataagtgacaagtccactttctattgaaaatatacctttcttcttgctcaactctgatggtatatatcattggtcttgtctctgaattgatgaacatagtaaatctttatgattctttttttgtgattatgattcagcaaactgcaagaaatttggagcataataacaatacatctgctctggagcaagttcttatgcttattgcttcacatattggcgatgatccgtgttgttgtccagtagtggatccaagatggagtttctcctctcagcttctatcgattcctttcctctggcatcgtttatcacacttcaagaaggtgagttgttccatatttttttatcatttttttctgaagatattcatgtctgggaaatatagaaattgcaaaatgagatttcctatcatacctagtctttaaaatgtactggtgttatttctccattaattgaaaagttttgattcttaggagtttgtttaaataattagacgtttaaccagttattgcaagggtggtatatttgagtatctgatcatcgttacttattacttcaggttttctcagctaatggactcagcaaatattatatccatcagatagcttgctttttgcctagctgcgctgatgttcttccaaatgatatatcatctaatcatccaggttatgcatgtgttcttgcaaatgttcttgaagctgcaacctggattttgtccgagccaaagtttgcttctgaaacagtaggcattctacatctacctttcaagttgcagcaccattttgttgctttcagcattatatgatcatactaatattgattaaagtgagaggtcaccaaaaaccttgactttaggaaagagacttttagatcttgtt

SEQ ID NO: 65211 - DNA, 1389 bp, Oryza sativa
ttgttgctttatgtcaacagtctgcatgcacgatcaattcttttttcatcttaaaattatttatgatgcatgcagttctttgattggccatacatgtatgaacatggaactaatattattttatttttctcgcaaaataattttatactatttattttttataactttttttaatataatgtatattatgattaaaattcatatgcaatcttcttgaatatgccaagagccatccctttcccacttcgttctggatgttcatttgtggatacttgaattcttaaaatgcacattaaattattttgattatgaatatcttacatatattttatttccaaaccaggcggctgacatcattgcagtctgtacatcactgctggacgcgttgccaaccattacatcacctaccggaagtaagtatcatgccagtaaaaatattccccattatttgataatatgacttgctaatatcatgcagtagcattttctattgccatttgtttctatcagagattcttgtgatactgagtaacacttgcaacatatcttctgaagtctaagtaatacacctgcagaagtttgttggaggcatgcttatgtggctcaatatttgcccctaataagctttttagtacctttttgataatgtactctaatagtctaatgtaagttgtatccttttaaatatatgcaggggcagatgacgacgatgacacacccatggatgatgtcattaatggtcttgatgctgatttggaaaaacaaattactgcagcaattgattcaaggttgcttcaacatttggtatgcagtcccttttctggtcaagatttaatggactccatactattgttgctattatctgacagctgcttggatcattaggtgaatgctctgttcagaggcacaattagtacagactattcttatccaactggaccgtcagatattgaggtggaagctgtaggatctatatgtgcttttcttcatgtcacattcaacacattgcctgcagagcggattatgactggcctggcctaccggactgaaatagttcctgcactatggaacttcataaagcgatgtaatgagaaccaaagctggccacaattttccaagtttgtctcttctccgcctgcagatgccgtgggttggctcctacctgtatctgtattctgtcccatatacaagtaaggcatattatttcatatcactacaaattttctggttatgtctatatatttattttatttgatttattgcttgagcctttttctctcaagcaactatagtgtgggaaattgaatcttttctctcaggttgtatcttatatatggtttgttactttaccatttatcaggcacatgttgaagataattgataacgggg

SEQ ID NO: 65212 - DNA, 11357 bp, Oryza sativa
  unsure (1)..(11357): unsure at all n locations
ccattgttttttttatcacagatccgcgcccaaagcacacattttttgagaggctttcaacaactaatgccgaatgaatggattaacatgttcaatgaacatgaattccaggtactttcccttgcattatgnattacccagatagaaaaaaaatgctgtttttactccatatttttgcaaaataatatagtcctacagtggtcacaatgtctctatttctgtgtttacacccgatggctgtgggcttctggttaagtgaaaaatgtttgcatctacatgctaggttcagtagtagtttaagaattgcaccatttggttcatgacatgtagtagtagttttagaaaggtaaatgccaatcttactccctcaaaactgtctctggaaaacttagctgcacccaaaattatttttcatctcattttacttcttaatgacatttttgttttttgtttctcttcatgcaagtcatttcaagttgcgtttcgagagcaatagtgacgatataacctatattacaagtcattttcatttttttcatgacaagcacagttcttaaactcgacgtttaaatcagtcttaggtgcttccaacttatgcaaacaatgttcaaacattcgccctaaataaatctgtggacataagttgtgaaatgttatttatcatcctacaaaatttcaacttaaaacagagaaatgagaaaagagaaataccattagggagtaaagtgatcaattttcagtagtttatgggggtaaagtgagctgaaaaataatttagggagttatgtgctctgccaaaatagtttttctttagaaatgttcttcttagcactagcatagtatattattccttacttatttttgtggtgctctctggccatgttttgcccctgcaggttctcatatctggctctctagaaagcttggacatcgatgacttgcgctcgaacactaactattctggaggatatcatccggtatatgcgcttgaaataccatcctgccataattcaagaatactgaaatttcttattgaagtttgtgacaggctattctttcgttgctttgcaatgtagcctagaacactcttgaaatttgtgacattagaatcttcttactttcacaaaagctaatcaatagattcagttacgtggatcaccgttaatgttttcttagtgtttgtggcctgttattgattgccatggccaggatgtgctccccgtgaaccattaacttctttgaaacataactttatccttttcttttaatcgtgctattatgaactacaacttctgcgaactatttggcaattttgtgcatatttaacaatgtttgcagactgccggaaaagggaatattctataataatcaacttttgccacattctggatacccgggctttcaatcatgcatcaggatttacataatttaaatatcacaaatttacattttcaatagacataaaatttggaattttgaatattgaaattggttggtatagactggtttgtggggaacttgcatcatgtagcagtagagaactaccaaggtaattagtgtacttatgccattgatgaagacagaaactacaatatgccattgacgaggttcagttctaccatacagcaccggacaacccgttttcttcgttgtataccattcttgttactatcaagttagctagcctcagttaggtgctgccaatttttacataatgaccaaaataccatcacagacctcttatatcaatcctcttatgatgatattccctctacaatcaatatactcagccggtggtgcagacatcccatggcccactgtttccgcacagctgacagccgaaatcgtgctacctatccgcaggtcagctcgagctgcgctgaccctcggtgacgaggccattcagcaaggtgctttggcttcaggtgatttagaccctgcgctagcgaaactgaacccgagtgacctcaacacgtgaacgaggcacgcccaggcaacttggttgccatcccgtttctatgaagcgcgttgacccttgcggcatgtcgcaaattcctttttgttgtgctgccggcttcaaggaaacaagtcattttctaagttcgagaatggaatctttggtcaacttccctcagaaatcttgttgatttgcatatatatccagcagattaagcttgcgctattgctaggagttcactagggcaaactggtcttttcttggtgcctaatgaagattgcataacaaagtagtgacagggaatcagggtgccatatagggaagaaaatggttgtccaatggcatattatagaattaaactttgtcgacgtcatgttttggaactttgacctgttggtatattaatagattttctctttttttttccctgtcctcatttttgcgaggtctgaatgttcttgtatttttctggttaggtaaggattgacagtggtttttgtttcaggaccatgagcttattgatatattctgggaggtcctaaagagcttcagttcgcataatcagaaaaagtttctcaagtatgtgttcttttttgagtaatttgttccttgcctttttgagattcagtggttaatttgttcgtttttgtattacttgcctttttctgtgtgcatgtataatttctactctcaaacatggaaataaaaaagataagttgtaataatgtctgctgagtgtattgccttagtatctcttttagtttagtctctctatctacccctgctttccttgatgcacagatggcttatgcataaacatgatttatggctattttgaaataatgcttttctcctagtctcatcatgtggttgatacttgataaatgcacaggttcgtgaccggatgttctcgtggaccactccttggatttcagtacctcgaaccaaaattctgcattcagaggtttgatatacctctgttttaagttccattcattgaaattgttaattgcatcgtaaactctctctgcagggctggtgttcctggcatggaggaggaggacgaagaccgcttgcctacatcggccacttgcatgaacctcctgaagctccctccttatagaaagtaagtaattgtagtaactactgtaatgcatgttctgtcatccttatgggttgttcgctctatctgatcgtttcgattgacagcaacgggactaacggattcctttgttcttttgaacagcaagacacaattggaaagcaaattgttgtacgcgataaatgcagaagctggttttgatctaagttaaaatcggcttttggaccaaatattgtgcagtgtagatagtttctaggtaacagattaaaggcacccaagggccaaaacaccgacctctgggcccccttttgagccccccataaagtaaaaggaaggatcgattccaggaggaggtaagcgaaactgaagacacgaggagggaggcaacagccagctgctcaagtgctgattaggccggtgataaattattcaccttaaataagcagatgctgttgttgtaatcagccgtgaacttgtacatgtatttttaccaacgttgtggttggttgatgtcctctcgtggagttgtgggatgacatgttagttgggtttggaaaccggcatcagcgtcgctgtagctgtactttggtgttggtgttgctgtcatgtaaggtaaccctaacaccagctgcttggtgcccaggggctgggaatcatacataatcagtgaaaaaaaagggagagatttgtaagagaaatttggaatggttttgatgtcattggctgccttctgatgtttagatgtggcgcgtacaaggtgtttttagtccggcccaacccaaagtaaaatgcttttcttaacgcaaaatctaaattgagagccctcttgatttagtcataagagtactagtctattaagagtactagtctatcaagtaagttgaaaaaaaaatattcctaccacctatactttaaataaaattttcttttaaattactcatccgatttatgatccgattataccattgttcgtaacaattaagtctttacgataatatcccacgtgattatattttgataaaaaattataaattaattttataatatatctaaattatttttagattttactaaattacttcctagacatataaaagtaaataaattcaataaagcctaaaagtaatttacatatattatagaagtaacttaaacaaaaagaaagtagctttgtcatgatattagaagtaatatgtagtagggataaaaacatgactctatctagaaattaaattaatcagcacaaattataaattgactaaaaacaataataatagcaatcaactcatagaattatgaatgtataggaagtaatttaatcaaatctaaaagtaacttacgtatatatgataaacgtaacctacgtatataataaaagtaatttataaatattaatattttttatcataatataatcatgtaagatcttgcaatgaatacaatggtgtaatcggatcgtagatcagacaagtaatttacgagaaaaatttatttgaaatttagatgggtaatgactaataaggctgtgttcgttccagtgacattgggtgagaaagctcatcgttttccgcgcgcacgcttcccaaactactaaacggtgcgttttttgcaaaaaatttctataggaaagttgctttaaaaaaatcatattaatccatttttgcaatttaaaatagttaatactcaattaatcatatgctaatggcccacctcgttttgcgtatcttcccaatctccccaatccccttctcctcaaacacaccctaaggatgcaagtggaaagtgcgactacttttagtaaaaagagtaacgaggggatatacactgtactatttttggtacaaaggatggtcgttagttagcactaactagtgcatacgcttccattagtcgcgtactttccttaaatcttatttttgataaacaagtctgcacaggctagcctgtcgctttttttgcactctctaaataatacgttgtgtttatcgctattgttctaaaccatccaatttcaacattatcaaaaagaaaacccaattatatagcacctctcgattgtttttaattgtttatgccatgcacgtttgattatttatctcatttagaaaaataaataatttaagcatgacttatattttaatagttgcacatgaattttgaataaaatgagttatcaaacatatgttaaaaaaaatcaacaatttcatatattaaaaatcaaagatagtaataatgcatgaatatgaccagaaagcactgggagatgaaaacgaagcggattcggacgtatattgattatatcatatcctaaatcatatttttaagcggatagtgtgcagatgtggaacgaattgttttcagatgttgaaaatggtgtggaaaaatagatttaatttgacagatgttgcgcgtgtatgcaatcaacacaacatcgagttagtaatgcaagagacaaaaaaaacaataatcaatgaacgaccgatagtaataattatatgcttaattggtaaacaacatgactacatgatatctataaataaaaatgtagctatgcaagtgtgacatgagacggtaaaagcattatactaagaaatctaggttaattgatgaattagatcattggatgtgccatcttatgttatatgcaacatatagagtggttacatgggttgataatttaggattattcggcaaacgaactatcgaataatccgatagaaatattggataatccgtatttgttatattttagagataccatatccgcatccacaccgtatgtggtagatttctaaaagcccataccatatactttcagatggattcggagagggttggatcggaaattatccaatccgtattcacccctcaaggcactttcctttcaatctttcatgaggtaaaattattaccacaaacatatatatatcaaagcaataaaaataattttggaacgagactttcatgtataggttcttggtcgtcccaaagctgagagcactaaacgagcataatataatataataaagtagatctgtgcccaactatttacctaagctttttgtgagcacatttcttaaattattaaacgacgtatgttgtgtgaaaaacttcaaagtaaaagttttaaaaaccaggcaaatctatttttcaaatttatagtatttaacttaattaattgtgcactaattatccatcttgttttgttttggctaataagcttagctaaaaatctctactaaactcagccttatacataaaacattttatttcttttttaataatggaatatactttcggcctttgctcaacgagctacaaccaattattacaccaaatcgctcaaaaacgttcacaatctaatgagaccacaaaaaacacaccaatttaacataaagcaacacaaactaataagcaccaacacaagattaaaaatcaacaattattgaatcctattcgtgaaacctctatccaaagttggcgaaaatctgcatgactgttgacttaagtttacgacatgcataatttattagcttgatgacttcattacacctttatagttgagcccaacaccgaaaccagtacattgccctgaaaagtacttacatataagattctgaagatgctttatcaaaaaccatatcatttctactaagttatagagcctaacatattgtatatgcttctacaaggataagtttgttggtttttttatcaatacccacaagccaatccgtaaaaatatgagatatagtatgtggatggtataacccaaaagcaatatgtactgctctctaaagaaatctggaaaaatggcaatccaagaataaatgataaattgtctcatttttcataaaaaacaacatctcatattaccattctagccaagttatccttcggtaacactactcctttaagcagataccatataaagatcttaattttaagagacatattgagtttccatatgatccatttctttaagtataaccattattgattaaaactaagtacatagatcgaatcgagaattgaccattttgattaaggttctatcgaaaaacgtcattttcttctgtcaaataaatatgaacaattgaagcacacaagttgtgcctatatatttatcatattctggcctactaatgttcttctaaaagaaacattgagcgaaacacaactcataacatttgcaatcaaagaatttctcctacgaactatagaatacaaagacaggtacctatccttaaaggaagtattgtctatcaatttatccttccaattctgacttgttcaacattattaactatccaggatgccatatttaagaaactattcttaactttttatgagacccgacaaaaagggaatcaccttgttttctctcaacttgatttattgattgattaataaaacattttatttccaaagtacgtttttaatagtattttagtaaggttaaagattcgtcactatccccatctctttaatcttatatggcccatgtatatgtacggtgtgcacatgtcttccatgtaattacattgttttttttttttggctgtagggttttgaagtaatgaagtgaaaaaggaggagtaaattttactttgcgtcgcctttcattttggatgtttcaatttgaatactctttaatcaatatttttacttaaaaaaataaaacattggtaataaaaatgtgacctcaagtaaaatttaattaaaaaagagagagaaagaaatagtgaatataatcaactcctctctgttggatctcaagaaagagttgggcgcgagagcaccgacgacccaacaacacaagacgaagcgagcgacgagacgacctaaccccaaagcgaaaaaagttgctgcatccttagcgcgcaagcgaaagcgagagggagctcgcgcgcgcgcgagggatcgatggatcgaccccaggtgatgcccctcattcagcgctcaccctttctcctcgatccgagctcttgtgttgtttttctttttttctaggattttgatcgatctcccttaggagggagggagggagggagcttgtcccagatccagcggtttcttggattagggttcatgggggttctctccgctcggatccaggttaggaggtggttcgttttggattgggttctagaatgacccttggtttggttgatggtggcgggaggggattcttgatcacgcgcggcgggatctgagctgacagaaatcaagatttttcgttttcttttaggacaacttgtgccaattctgcttttcatttcagatctggttgtaatctgaagagacaataatctgacaccatatgaatgctgtttgtttgtttcaggtagttaccgagaactatgccaatcctgtgacgtgcctctttcatgtgctcttcaaggtgattgtaatttcgttgtatcgttggaactctgcttgtgctttctaggatttttgattgttctgtccgcgtctgatactcgttatcttgtctgtgcgaaggctggggcgctggtgttctacatcttgttttcgctcttcgtgaacagcttcgtcatcatattcgtcatcaccgtgttcctggcggcgctcgacttctgggtggtgaagaatgtgagtggcaggatattggtcgggatgcggtggtggaatgagatcgacgacgagggcaacagcgtgtggaagtttgagtgcctcgatggggaggtttgtgcttgcttcaaatgtgacattgctgtttaccgtcctaaacaatgacttttgcattgacttgatggaaataactccgtacaggctcttgctcggatgaacaaaaaggactcgtggctgttctggtggactctttacttgactgtaagtgatctattatctgttaaagagtgtttaatggaatatattatgtagctggatagatatattgcatgtaaagcaagtttgtagatttagcagaaccatttttgcattttagatataacaagaattcagaatgactaagctgccatttgcaatctattgcggcttgaaccaagcattttgaattactcccagggctagtaatgtgttctttttttctgtagggtcatattttactatgttaatcttatcggctttttaacgtttcacttttggttaagctttttcagtttttgatgttgaaggtctttgttatgttggctttcatcaaaatataggaatatatttgcttgtaggaggaaaaggaaacatgcgttcattgttagaacagggattaagaaccatttaatatccatcaaaagggctctatttgatgattaaatatatatataggtgttcctgtagcacttccatacaattccattcctttcagtattttgatgtgctggatgctattttattactgtgggccagtacataggacatgaataaaatattatttctagtttgtcgtactaactcaaaaatctcttttcacacacattactcacatttaatcaaagtgattctcatgtatagatcatttatctggctgtctgtctacttgtctgcttttcccaacacaaccactatactgtaataagcattaagttgacatagccggtgctgtgttctcttgagaaattggaaagtccataataaattgggatcactgtgaaacaagagtcttgtggtgacagtattttacagtaatccctaaaatgttttgctcacatctgtttgataccttttactatttacggaataaggtaataagtaagtcatgctagagcttaatagctttctgtagatttgtagagcataaaaaccaccatttcatgtttcaggctgctgcatggatcattcttgggatattttcacttatcagacttgaagctgactaccttcttgttgttggagtttgcttgactctaagccttgcaaacattgttgggttcaccagatgcaacaaaggtatttcctacttcagattctagtcaatatttctcagcacagggaagataacctctcacattctcataaactgattgttgattgtgatgaacaatgctatctgttaaaaagtttgcatgatatttgaaaaactcagtgtgtcaagctgtcataattccactacatctgggatgatggtttattggaaaactgtacttgatggttcagcttcacaaattccagttaggcacatgttcatcaacagacaccatgacctattattattgtcttaaactttgtcttctgaaacactcatttatgcctatcaattccattctctttgttttcaagatttagattcaagagttatgctttgatacatcatgttatatcgtgctacttattttgcaaatataacttatgaaaccttatattgaagctttctatgatttcattccagattaatctttttttaagccaaatctgactattttacatatgtaattgtgtattacagatgccaagaagaatatccggggttactttgaaggtcatgctcaaaatgcgatcacatcccgcatcacatccaccctgcaatcagcatttggagtaatctaaaatccgagctccaaacagcaaggcccttttcgaatacaaccatgtaaaatctgtcaaaaggattagcgtgcattatcccatttccatacatttttgttgacccaatacacccagtaggttgattttgattggaaagacagagaacaccttgttagtactactgccttccaaaggagtaaaaaagaagtttttagccgagaatatgtcttgagtctgagtgtaccctttagggattttgaccctggaacctgtcttccaatgcagcttcttgttaattccatatattattaatcatttgctgtgctgtatcttaacgacaattttctgtaattttatgcattctcgcaaaatgcccgtacatggttacgtgattgagaaaatcgcatcggcacattgaaacaagaaatctattttgaatttagagcttaacttcagaattaaatagatgttttttatttatagctactagtataaaaatttcaagcggactcgaattgacttctcattactgtataactcccttaaaagagttacatcatcaacggttcataaattcgaccgttatatttggttttgagaatgatggtcccacatgtcatagtttttagaattttcagactcaccaccgtcactactctctcctttaattcttttaaaggagtatagagaaggccagaaggccaattcagaacggcagtattgtgcaaaagaacatatataaacgtcgcttcaggaaagggaaactaaaaacagaatgattatttggaagct

SEQ ID NO: 65213 - DNA, 849 bp, Oryza sativa
tttcttggttagttcatgaatgtttcattcaattggttgtgggttcaattctcagtcccctttgctgtattctctatattttcttctttagttattgtctatcttttcttatttgggtatatatataatgttaaaagcatgtttgacaaagcttctgaaatggagccgcctgaatcccactctgctatctagtttatttttttaagatcactttagtccacttcaccttttttagtgcagctaaaactgttcggttggacttcggttttaggaggggtgaaccaagggcggagctacatagaagggcgggattttttttttttgggggggggggagggtaggcagaagggctcgagaacccggtcaaaacaatttttctatagttcttctattttcatcatatgtataacccccttaatccaaacttagatactcgtataatcctaactctaggtgtaaattaaagtatagtaaagcaagtggcacctcttcatttcattctatctccgtaaactggagccctactaaatagatctagatatacataaccatcaaaagaaaaatatcctatgttcgccgcgcggcgtagggatcagctaactagaagtcttgatctaatcctctacttgagaagttcagttgtttcttctctaaaatatcccccaacatactcccctttttagcttacccaataaaagggacaacaaattgttgtctcttcacgtggatgactcaacggcacggccgtttgccgcccgtgtgcatgcatgcatgcaaagcacacgtggatgactcaaagtcacatactacatgtacactgttaaattaatttaacccacaaataattgg

SEQ ID NO: 65214 - DNA, 1333 bp, Oryza sativa
  unsure (1)..(1333): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtcactggtttgtcgcacttggttctggttcgtttttgcttgaacagttgataagcactataaaaattcgtttgcagataaaacaaaccacacaccgttttgtcaactttggtatattcttacatagggtgaactgtgaagttttgaaatctagaacattgatggatatttatatgagtattatgatgctctaaacttttcaattttccccaatatgttgcagcatgatttcttcccccagctagtgaatctttttagaacgtgtgagagttcaggaaacatggatgcactccacatgatctttagattagtaaagggaatcagtaagtacatggcaatttaagctttgtcataggttatgtttgattgctgcttattttgtttgtccttctgcagtattgttgaacagttctgcgatatatgacaagattttctctgatgattttattcttgagataataggcgcacttgaatgtaagcaattacccttgacctctataagtgtctacatcagtaatgataaagtcttgctttgtcattttaacgggaaattctacatagtaacatacctgtataattgcatacgctgtttgttactaatgggatacagtgatctgatctgagcagatgatccagaggctcgcactgtgcaaaatcatcgcactttcctgaaggagcatgtagttttcaaggaggtaaaccgagttttatgcatcatatcctggttaagatggagtgattttcatgtcaagatttcttttgcataggctatacccattaaaaatgcttctgtggtttcaaagattcatcaaacatacagaataggctatataaaggtcagtgccctctgttctctgcccccttgctacatggagtttttagtagttttgattctgttgccatttttgtgcttgactgttttggtctggattgcttggtatttacaggatgttatattaccaagagtacttgatgattctaccatggcaagcattgctgcaatcattcatgcgaacaatgctgctgttagtatttcaacactatagattttgtacatgttttgaatcaactttcttctgtaatttcgctatttcagattatgtgattctcctgtaggttgtttgtttactcaaggacgatgcttcttttgtaaaagaactgtggggctgcaggaat

SEQ ID NO: 65215 - DNA, 11408 bp, Oryza sativa
atctgcgagcttttatgcttttgtgtagttcatcacccctacaagatcaagtaatactcaatgcaaatgcttccctttcctttttcttaattcaatatttcctttggacatctcatgtcttgctgttttgctaaaaggcaggtctaatcttgtagggtcaactttttaagaagcaattccgtggagaaaatccttactttaacccataggagagagaaggttttggtcgtggcagccgtccgattcatgaggactgttattgctagaaatgtatgacatttactttttttcccagtttgaattctaattgtaggttcattgacatcattggggaactcgagataaagtgttgtatgtgctctgcaggatgagcttcttcttagccatgttatcaagttcaactcattgaaaccaattatcgaggtatttgttgaaaatggggataggtacaacatgctacattctgttgtccttgaactgttggaatacatacgaaaggtaacctagcgggagttatttgccaattgttataatgctacataatgtgctgtcagttgatgcattatttgtacaggaaaatctcaattcacttgtgatacatgttaccaaatccttttgggaccaacttgtgaggttcgaaaaactagggagcattcaggcctttaaactcaagtatcaacaggttgaaacttatagttctgtgtattcttgcatcctgttgttactgttgcctcatttgaatgcttctccatgtcttcttgctagttaatggagagtggtgaaacaacacaaagtattagtctagttgacatgagaaagaagccagaagaaagaggtctcgacaaagaagaggaggactatttcaacaagggcaggtttgtccacttcagttttgctgcttgtttgtgttaaagagtccaattgagttcatagatggcgtccttaactgacatggaattttttattttaataccttagtgatgaggaagattctgataaacagacatcatatgcacagaaggaatctttggataagttacccaagggaagtgacatccgtcatatccctgcaaggtacattatctcatcttctataacttgcgataacttcctgccaactcatattgaagatttatttactggcttcttcttctttatattcataataacttgttacgttttacattctgtgcgcacattatgcaatttctggactctaaaacatacttcagttccagtgtttagcagatcttttgttttttcaggtctaaatctggtgggcttgtggattatgacgacgatgatgagggttacaacccacctcccaaaagggctgttaaagctgatgaggatgatgaggccttagtcataaagcgtaatccagtggatgacaaacaagctgatgggaggtctcccaaaaaaccaaagatggaacccagatttatctgctcaaagattgtcgctgcggctagtgtggcaggcagacgctcgaatttggcagataaacagggtccccatccaccttcctcaagcacgaaaacttctgaaggcaatggtgatgtaggggaggaaggcccaggttctcagaatctacaacatgacccaggaagcttggattccactcatcaaaatggagatgactgtaccaaagatgcagggaactcgccttccgagatgactgtaaatacatcaaaagcaactgattcagagccttattcagtgagatgacaataaatattttttttcctctattggcttcaagtcgattgcttttccttgcgacgaaaaggaattgcttcacatttggctccgaagaaggtcgttgaatccatagcattctgaccctcgagccagcaagcatggtcggaggtgagatagttttggtcaaagttgtatatctcaaccgcgatttcggctcagctgaacatgtaaattgacactcaaagagaagaataccaagctgagaaccaacatgccatttggtgctgcactatagacaaaaaggagagggtcttgctgttttagcttccgcctaaagatcaatgtgagctctctcacgggcacagaatgtgcccttcgattggactatttacatctcttatttttaatcagcctatgggatgatccactaagctgtcactcatgtaacagaaccattttacaacagcttgaagtatcttgctcaaaaccccccatttacacggtaacaaattcttggtatcctgtatatactaacgtggaccattgtcgggctgtttggaatgcctaaatttcacatgattttgatggaaacagcttggaacatatgaaattcaaacgattttgatggcaaatatctgtccactgtgaattgcccattgctgatttgagatcactttaagatgaagctgctgcttcttgcaccattgtccattggtttccagcagatacgtctacgtatttaggggaaaaacagagcaaattgcactcgtcgtcaaacttgtaggaaggttttacctatgttaatgaacttataaagcacgtttcaacttgatttattgtaccatcccaatccaatgtttgcaaaattgtgtcgaggcaaaaagttgctctgttctgttggtcctcatgcaaaacgttgttgtgtcaaatcaaagattgtgtgggtgttcagtttaccgctcatttgcacgttctcaaatcaggctttcgttggaaaaacaacgccgaccccaaacttaaccatcaacaggtaataatttggtaatttaagacgacactactacacatgggattaagaggctgtgttatcaacaggtaataatttggtaatttaagacgacactactacacatgggattaagaggctgtgtttgggggagaggggattgagaaaattgggaagatacgcaaaacgaaatgagccattagcgtataattaattgagtattaactattttaaactttaaaaatagattaatatgatttttttaaagcaactttcatatagaaattttttttaaaaaacacaccgtttagtagtttagaaaagcgtgcacgcgaaaaacgaaacaaacaaactccctttgttctccacacgaacgcagcctaagtctaaaacaacattggattacatcctaagtctcaaaccgcattacatatcccaagcaacaagacactttggattacatctgacactgcattatcccgagctacaattattactcttatcggtttcaactggttaaggaaccctaatgctcatcgtcttcttcttgtttatccatgcgtgcatgcaggtgcagctgatcgatcatggcgagagcatgcatgcagcttaatttattagcaatggagctcagcttcatcagaggtggttgaagacgatgccgccatgcgcggcgaagaagggggcgaagacgagcgcctcgacggccatgagcttgacgaggatgttgagcgatggccccgaggtgtccttgagcgggtcgccgatggtgtccccgatcaccgccgccttgtgcgcctcggagcccttgggccccagcgacctcgcctcctccgtcgccccggcctcgatgtacttcttggcgttgtcccacgcgccgccgctgttcgacgccgagatcgccacctgcaccccggacaccagcgcgccggcgagcagccccgccagcgcctccaccccgaacagcgtcccggcgacgagcgggctcgccatcaccagcgcccccggcgccaccatctcccgcagcgacgcgtcggtggagatcctcacgcaggtggcgtagtccggcgcggcgagcccctcggcgagccccgggatctcgtcgaactggcgccgcacctcctccaccatccgcagcgccgcgctccccacgctccgcatcgtcatcgccgagaaccagtaggggagcatggcgccggcgaggagcccgacgaacaccctggggctcaccacgttcaccgtccggatccccgcccggctcacgtacgcgccgaacagcgccagcgacaccagcgccgccgacccgatcgcgaaccccttcccgatcgccgccgtcgtgttcccggcggcgtcgagcgcgtccgtgcgctcgcgcacgcgccgcggcatgccggccatctccgcgatgccgccggcgttgtcgctgatggggccataggcgtcgatggtgagccccgtggcgatggtgctcagcatccccagcgcagccagcgcgatgccgtacatggcggcgagccggaagctggcgtagatggcgccggcgatggcgaagatcggcacgatcaccgacttgtaccccacggcgaggccgaagatcacgttcgtcgccgcccccgtccggcacgactgcgccaccgtctgcaccggcctatcaatttgaaatttgaacgcaaatttcatcaaaatttgaaattttacaaaatgtagaatcatcgcgaatttgggtgggtagaattcgttttcacccgtaagcattgctcgtgaagtactcggtgacgtagcctatcaccaatcccgcccacagaccagctgagacgcagatgaacaggtgcctgaattattcaacaaaaattcagacaaaactattattattccataatttaatcaaatttggtgcaagtacaactgctagagtcataggtgcatggctccacccaacaagattcaaatcttggtgcttataaatattacgcactgtaactaggtttttaacatgatttctccgaaatcaagaatgtgttgttgaatgcacatagacagggatgtgagtgtggtattatctgtgcacgtgtgtctcccgtgtaattgtaaaacttttaaaaaaaatgtattgtatacagggatgtgagtgtggtcttgtttgtgtgcgtatgtctgccgtgtaattataattttttaaaaaaaccaaaaaaaaataaattacacactatgtaaggtttttttttcttttaccaatttttgacgagcttgcgttcgccgaagtcgaagagggtgaaggagcgggggagggagaggaaggtgacggcggcgacggcggcggtcatgagcacggtggagatgaggatctggcgcttgagcgcgggcgcgacctcgtcggcggcgccgagctcgccggcgtcggtggcgacgagcgtggtggcggcgcaggccacgatgccggcggcgctcaccagcagcgggtacatcatcgccgcgaagtcgtggtcggcgccgaaggaggagatggacgccacgaacagcgccgcgcacgacgactccgcgtacgacccgaacaggtcggaccccatcccggcgatgtcgcccacgttgtcgcccacgttgtcggcgatcacctgcgcacatcatatccacacgcacgtacaaaaccatatatgatgtatcacttctctttgaaggaagggaacgatgggggtgaatttgtaagcttcccaaacttttaaacggttttttaaacgatacaattatataaaagcattttataaaatcttcttgtatatataatttctttcgagaaaactatttcaaaccaaaatcgatctcaactctatattttctccgttatatgttatacaacgttttggcctcttcatacatcatctaaattcactaatatctatataaatttgcgcacatatacatattgtacgtatctgaattcatgcataaatctattcaaattatacccaaaatatcttataatacgaaacgaaaagaaaacaatatttagttcattcgtttgtaacctcaaataatcattacaaatattcagatattgagctattcagtcaaaagaacaatccaaagtggatgcatacacaaatcaactgccaaaatagatttgtttcaatcgatctttttaaaaagaaagttggtttgaattgaattcacttaaatttctaagtcaaattcagtttaaatttgtccacaatttaaatatttcctagcgagactttttaaataattccttttctccaaacaagacaataaattttcaatctctctcctatatttctatgaataaatccggtaaaaatcatgcgttacgcctgtgccagctagcagagaacactgaacacgtgagtttcatgcttcctagtaatgtttaaggaaggcaacaaaaaaaggccaactggacttgctttcagattagtgcagtggctcagatcgaaccgagctcgcatgcaacatgcaagcagctttgagttgttttaaaatatgagatcgaattggttcggtcatgttcttttctgattaaaattcagatattacctctgttcgtattagcgtgctttttaaacaactaaacgatacgttacagaaactttttatacagaagttgctttaaactatcagatatatcaatttatcagttagcaataattaaaacttagttaatcatgtttactagccttagtgtttttgtatggatttggttggctgtgtacattcttcgggatgtagaagccgggttttatttaaatcctttatcttaaagaaaagttaattatatgctaatagctttctcgtttcatgtgcgttaacttaatttttatgtgtgttaacttaatctttaacagagtgaggacgaggagagtgacgtggcgtggcttaccgcggggttgcgggggtcatcctcggggatgttgcgctccaccttgccgacgaggtcggcgccgacgtcggccgccttggtgtagatcccgccgccgacgcggccgaacagcgccatggacgaccccccgagcccgtacccggtgatcgcctcgtacagcccgccccagtcgtcgccgtagtagagcccgaacgcgttcacggcggcgaacagcaccagcagcgcgctcgacgccagcaggaaccccatggcggcgcccgacctgaacgccaccgcgaacgcccgcccgatcccgcggcgagcctccagcgccgtcctcgcgttcgcgaacgtcgccacccgcatcccgaggtagccggagaccaccgaggtggtggcgccgaggaggaacgccgccgcggtgaacgccgcgttcgccagcgccgggcgggaccgcctcgccgcgtcgtacgggcacggctccgtcgacgtggagaaccgccccacggagcccagcgagacgaagatgacccccgcgaacgccgccatgaacgcgcccaggtacttgtactccgtcatcaggaacgacgtcgcgcccacggagatggcgtgctggatctccgcgcacctcgcctccacgccccggtagtccacgccgtcctcctcgtcgtcgacgccgtcgccgtcgccgtcgccgccgtcgctctccctctccaccttcccggcgccgccgacgccgtcgtgcggcgggacggccaccctggacaccatgtaccactggagcacggcgaagaggatgccgatcaccgccgcgagcgggatgagcacctcggccgccaccgtgccgatgagcgccatggatgaacgaagcgcaaagctaagctcgatcgagagctccaatggaggagaagacgagcgagtgattgattcttgatggagaagagatgtggagtggtggtgatcaccaagctaagcttgctctttatagaagggaagatgtctcactttgcaattacccacctgtattttaagataattacaaacaagtccttgtataagctttttggagggtgaatatgacatttttttccgcatatttgtggcttgtgagggtctaaatggaaagtttgctggtgttctctttgagcactgaacaaaccatgcattggatccagtgttcaagatcagttcgaccgtttgttatggcttggtgacagcttgtgctctccagggacaccgtagagctcatgctgtacatgtgtataaacatttttgttgtttttgcaacttattttgtcactgtcttctatctcaccaagaaaagtagcgaaaaagccgctacaaacggcaccgtctagaatcctttaccgtcggttcaaattaggtgtatctgacgcatgagcataagttatctacggtgcgtctcattgaggtttggacgcactggaaatgctgacggacaatgccattaggtaagctttggggttcacccatatgcaacaaaatttccctcatcatgcatctagctaccttcatttcgaatggtggtttttgaataaaacaactctgggtcatgtagatctttggcacttttctcttctttggtcaaaagaaacttggaaaggctacttgatttatcttgctatatttcaatttcaaagttgtaaatgtcataagttttcctgtgatgataaactttaatagtttgcatctctctttgctgttaagatgtatgcaatcctgttctaattggaggaaagatggccaaaagaaaccaaagttgttacagcttctagtgaaaaagccataaaaaaagctgttcaagggagcgcactagtgtcttgtgcagtacaagtgtcgaggttagatataataggacaaattaacttaggacgcgttcggttcgctcgcccagctagcctagcagcactaaaccatctatttgccaacttgctagccttgttgtagctcctctgtttggatggttttgcttcttgtggcaaggattaatggctagctgctacagatgagttcctcttgttgctgagttcttccataaatcaatttttccttttagatccagactgattgttcgttgtatttatgggttggtggagagggcaatttacaacaaaatttgagcgagcgagagttcacaacaagatctggaagaagaggccgacaagattgggtgagtcattgaaaaacatcgctaattttacggcgccaatttcatagaagtctgcatcgcccttgttccaatattttcacgcgaacggagtttgccgtcgaaggagagctaaatcggttctcactggctagcaagaattttcttgccctgcaaagctagctcgtccccaaaaccaaaagccagattattttaccagttccaaacgtgtagctttactaagcgaggttaggatgagccttgcccaggatccaaacgtgcccttaggccccgtttggcctcaagacaacatttctttggtaatgaacctttctcgctttcaacattttgatggtttgaacgacaagtaattatcactttaaatgtttgaactgaaatttaaccgtagagaaataaagattaatttgtaatgaaccggaaagtaacattttgcatgtcgagaatgatatgtgggcctagagcaatatgccaatgataaatacaacaacatttccatctttgtgagcttgtgatggtgtcatggttatattttcgtgttgccatgctttcaacacactttggtttgttcactaacaaggactccctcatttccattttaagcataaccatgagtttctgtctatttgggctagtaaccaacctcctctttttcttaccttctcttgaagttctcctaacattaggtagaaaatgttttgttttgaatgaaataaagaaacgcttttactatattatttttaagagagaatccgctgtgtgtcactgaatttattcatattctataatatgccattaagtttgtcaagatctacaatataccaataacataccatcgccgactagttagattcgattagtactgtataattatcctaatgacattaataactctgggacaaaaatttctaaaatttggccaaaaatttcgaaatattagcatagaagagagattgtccatctcaaacttcgcaaaaatgtgcacttttaagtaagtaaaaaaaaagaagataaataaaaaaaagaaagaagatactcgagtatcctcctcccccttggcgtaaacgaaaatctcccgtctcgtcgtctcctccgctccttgcgccagccaagacgagccgcggctgccgatcgccatcgcaggggagggggagggggatcctggtgagcatccacgtcctctttctgattcatctctctctcccaccgggaatttgcttgcgttaaccctagcttctcttctagtctagatctggaagaagctctcctcctcctcttttttacagccttaaacctctcttaaatacaaccagtaacagtttttttttctttttgttccccaaaaaatttgggggttcaactgaaccccccatgtcccaagttcggagtgctttgatttgcgcctaaaatgctctgcacaaactcaaggcgactttcataaatcggtggagtcttttttgttcattatccgaggttatattcttattgtgtgtagcattggatgttaatgatgggagaaatctatctagtatattaagttataggaaatcttgatagttcttcctggtgtgcacttgagagtaggcaaatgcactagcgggaacaaaccagtgttgttcagtggctgtaccctaattaggtcaccagttgaatcacatgcttgttgtattatccaagtgtatggatttgtggagcttctgtatgatgataacgtcttgtattatgtaggtgcattcgcaatacgaaactatggagctgctatcttatattgtagtaatgttgtatgaattcagggagcttctgtcttatgtaggctcatttcacaacaggaaacatgcaactgttagctcaaatggtttgttctcactcttgtagttgctgggtttcaaagccagctgtgggctctttctagcatttaggactaactgtgggctgagttgccttggcaacttgaaaactgtatgggccaactaggatctctgcggtggaccggctcaacttaggcactggatctggtatctctggtcagaccatggggctggtacagatctgatgatgctaaaacaaatagatgtatgctgatggtgcaagctgcgcaaatgttttgcggttttctcatttcccttgactatatttttcttggagatatgtgaaaagtttatgtaggaggacattatagctagatttgtgaaaagtttatgtaggaggacattatagcacaactcttttggtagatctggttccttctctacacttgttgtgtgtgatatgcatatcatagatgttacattcctgaaaaagtgcagcattgaattaagaataccattaaattgaaattttttaagtgtatacacctaaaaggttggatcatggttttacatgatggcgtattggcgttacaaggccaaagccaaatatacccagtcttttccatcaagtggaatcattatccattttttttctttgccgtttaatctgatgctcctagttgtgtatatactgaatttgttcatgcagacatgaggaatttctgttgatgtgtcatgtccttgaaaatatgtttgaaattttatattccttttatcaacattgcaagtgtgcaattcatccttgttagcagaaggggatgcaattcctagctctgt

SEQ ID NO: 65216 - DNA, 18375 bp, Oryza sativa
cacgcagaagcctatgaagggcgaggtcttagttggctccgtggacaagatcctcaagcatggcattttcctcaaatctggaccgatagaaagcatctttctgtcggagaagacgatgagcgacttcaagtacattggtggggagaacgcggtgttcatgaatgaacactcgaagctggagaaggacaccgtcgtgcgcttcaaggtcatggggttccgctggatggaagccgatcgccagttccagctccttgctaccctggctggtgactatcttggaccactatgaactgcttctaatggtggctctgctgcacattttgctaccttgatgaatggatttgaaatgtgttagccttaacctgctgtctgtagtttggtgtcgtgatgactgatcatacctgtatcgtatctgtgatgctggttgttgatgtaaatggcattaggccatatgtttagcatttcagcatgatgagaattgtcatggctgatgaacctctatttcctatggctgctcaccgttctaccatgcatatatttgctgccttcctttctgagatattgcctttccagtgtagaatttgcattatttctctatgcaattacttccctgtcacaatcagctcattgtgacaagtagcataatactcccaagatcatgaggttcaacagaaaattagtcctgccaattccaagatttccatcacaaacaatcgaaaacaaaaatgtctgttcgtgattggaatacaggttggaacacgtattgcagcccatgctatcatctcatctcaaagatagatcaagattcaaaaacgtgcaaaggagcctctgaaaattgaggcccttgctgaagaatgatattgcatgaagcacatgccctgataagacattcagtgtgaaaaaaaaaacagaaaaaagaacatgctcaagttgcttgcgtcacattgcatatcagaattgctagacaggcaacacagactgctatgggaaacagcaggatccatgctgaatgatcttgcatgaaccgtgctctgataagacattcagtgtgaaaaaacaggaaaaaaaattgctcaagttcagcacagattgctaagaaaaacagcaggatccatttcatagtcaggctcagagagtgcaagcacaaagtacaactgagcgtcttcagttgacttcgtttattattacaattacactgcatggtggttcaatatgtttcagatagatggacaaagatttaagcagactatataacacatggatatttatgacaataggatcaaccatcggctgtcttgacaactgtgactgggcaagtggcgttgttcacgacgtagtcgctgacgctacctaacagcaccctgaaggaaccaggaagaggaatgcaaaggttagaactggcaatgatgtgaacaatgtgcatcaataacaatggggggaaaagctttggttacaacctcttgagtttgccaagacccctgcttccaataaccaagcagctcatggggatttcgttgatggcttggcatagcttctcacggggatctccccaaaggactttgaaaaccaccacaacctgtataaaagaaccaaaaaccttataatattgcaagggagtgccaattaattgaaccatatggtattgagagagtgatcacctccttctgcctggccacagtattaagcatgtccaatgtttcggcatcaggctttgctccatatttctttgcaattgtaggttcagagaaatccgagaggggaatcaatgctgtatattaaaaaaacccaacgaaatcaagatgttaagcagtccttgtttgcagactagaataatcagcactgagtgaataataattaattgcagaataaccttaataacatatcaacaaaacagaatccttcacttgcaagtagtctgaattggaaatgcatcatgcaaacacacaccttaataagagatcagcataacataatccctcacatgcaactagcgtgcgctggcgacgcaaagcacaaatacatggccaatacttaccatttatgtacatgacaaaatatttcactgatgagtgtttcaatactcacagtattattaagtgcagtgtaggtaaatactctagctgcaaactccaaaagtttttttttgaccaggagcaaactccaaaagtttggacagcttgtgacatctatctttataatgcgaaacatggacattgtgcgcaactgcatatgaaagatgaactatctaccatttttcctaaactgttcaccgaatcttaaactggagatatagcaggatgtgggtaaagattctgaagatacacagtcacccattaatggtaagtacactaggccgtgattctgccactagccaactagccaagtaacctgttcttgcaaaaatgtttgatgagacaaagatgatgcactatggtttgcctgaaggatatcaaggtgaatgatcccaggagctggcagtacacaattagcaacaaattatcggccaatccactagtcaatcatcgtttctgggttgcacaaaatggtgtctggtaaatcaacggtcgattccattatggtaatgggcaaactaacccaacctcacacaaagaaatcacccaaacttaagtaaccaatcaagaaacatcatctactacgcgccaaataagcaaaaatccaagaagcagtccacagtgactgagaagagtaaatcactgaatcactcagcaaaagaagctgaaaagcatcactgattaatcctctcgatctggtcatcgaacagagcctacgcgtggaatccatcatcatgcagatcatatccgacttcgattcggatgggatggatggatcaaccaacaagaacagtaacgcgactacgcgagcgccatgggaggtagaagtggaagagaagggagaggaggagcgtacgggagccggtggcctcccagaggagggtctcgccctgctcgtagtcggggtccttgaggacgtggaggaggatgaggtggtcgccggcgcggagcaggttgtccgccgcccaccgcagcgccgcgcggctcccctccgagaagtccaccgccgcccccacccaccgctccgccgccgccgcctcgcccgccatgctcgctgctcacctcgctctcgctgctgcttcgttcttggcttggcttggcttgctcttgcagcttcttggcttgtggaggtcactgtgctggaagggatggggaagcaaggtagaaatactcgcctgcttgttctccctttattctcttttcactattttattctcaaacaagaaattcataagcatatttgtttgatccagagttttagacatgcctatcttgatgccagggatggttttttaatctatttttcttattaaacttttatttttcttcaataagaggatatttgttgatgcaaatatgtgttaaaaaagttatagtgtttgctctttggcttatcaatcgtagtcaaagtttaaattttaaatttatattttatttttatgatttttgattttataaaaacacatatgtaaatatattacacataaattacttttaattgctaaaaaggttacggcttataatcaaagctgttatgctttcttaataaatactctcttcgcccccataaaattataagtcgtttgatattttgcttatgaaagttctttgggaaaaaaagcaacatctgtaacaccaaattagtttcattaaatttaatattaaatataccttggcaatatgtttactttgtattgaaaatagcggtatattttctacaaacttgattaaacttatagaaatttaattaaaaaagagtcaaacaatatataattaacatataattgaagagtaactgttaggatatttattggtgcagtctactactttctctagggaaaagaaggaaaatgaaaatgagagatcttcacattatttgttgagccacagggcctttactttcatgtgaggaaaaaggagagaaattgtctagagttgtgctctttctgcatgacagctggccagcatctgtatgatgatgatccacgttgacaagcagtcagccatgcatgtgtttctccatttattttttttgtttggttcctcttatcttgttagcttgttgtcaatcagtattcaagtgttaatttgtctgttcctgttcttcaaaatagtcatgaacctgtatttcttctatctaagattttttttttcaaaaagaaaaggcgcagctagttttgcagaatgatgagttgaccgtgcacttcctttctgaagaggaaaaatggtgataaaacaagcaacaaagttttaattatggtccatattttcaaccaaacgcataataagagaccttttcaattatttataatccatcaataatatagtaatgccacccaaattgtagaactttaaatttaattgctccaagataaaatgtcaaaatttagcaacttgcacatgttctttctcaatcaacaataagacaaccaattgggtcccttgaaaaaaaagcaaaacatgtgtgcaagttgttcaatttgtatttacaaaacaagaaagtaaaaacaccatacataataatatatgcgtgcaccatcagtccaaaacgtcatgtgcctattgcgagagcgaccgctcatggtataagattccttatccaaagatcatccacatccaattgacctgatattaagaaaaaaaatgcaatatatcttttctagaagtattttggcatctagaatctggagttctggaccatttaaaatgcaacaaagttgaattattttattctatagtacatgtccacgtcaaaaccttcgttgtccactgaactatatagaatattcaaggtgtacatgcaaacaacaaatggatttttacacctttcttatggagttttacatggactttatggaaagcatgttgtgacatccaatctcagatggaatatctcctacttaccaagcttaagagtaagttagtgattgatctgctgactgttggattactgatttttgccacttagccagaaatggttggtcccaactcccaaactgttcattgggcaatcagttggcagaataccttctcaccttggcttaccttcacaatgcaacttccatactaactaactggatcaaagttatcctatatctggatgagaacttggagatgccatttactagtttcagagacttggcaaggttgggtaacctttcacaggcccgactagtgatagagcttcttgtaatgcttccaggagataatctgggtggtcctcaatgcgtgcatggccaaattgtgccggtattttgcgtagaactcttccaacaatctgcaactcataagaaaaaacaaaatgagcaaaacatgacatacaagactattctagcaatgatttcacttagaatcctatcggatgagaaatgcaactcataaataagaaaaatagagatcaacattcatttaactagttgctaggtgttggtgcgtccactgacagtatctatgctttagcctttctattctagcaggtatttgctgaatactttagtatcattccaataaaaaacactgtaaatgtaatatcaagagcaaaccttgcgagcatagccgccataagctatccctccaataaaggcttgctgacaatcagtcactccagaggttgctgcccctaagtttcagtaagataaataaagttggatagttcatggattaaataaacatattaccagaatataaaacattagtttgattgctcagtttcaaaaggcataggtttaattgcacacagtttaatagttcaagggcttaaaatgtgattttgcctaaagtattctttgacctcataagttgaacaagaaaaggaacaaagtaaacaaaatccggtgacatgttaaaaaaaagtaaacaaaataccaggaaaagttgtagattggaaaagaccagctttctttagggattctatggtgtatgagttggtgccaccagccaactgatagaagccttcaaaaccatattattagaaaatacttagaaatgtggatgataacaaagccataacgagtttttttttttctaaagattgactttgtttaccaggaggcctatttgacattgaagacaaatgaacagcaaaggatactgtttccctcgttgcacctcggcctatgtcgccactcatcggccggccatctaactgcttgtataaataaggtaacttgaataacctcagattttgagcatatggatatggatatggatatggataaggttcagattatgacatgaagtggaccagcaaagcatttacagaaaaacagaatgtagaatcaactagccaacaccaagaaaataattgtcctaatagaatttcaaattgctaaaagtatagttatgaacagtatgatcatgtacagacaaattagaatctgcagttgatacatttgttctcttcatagcaaacctgccaaagattatagccttgaagatgggactgcattgttgtgtatattgcattcattaaattaactgttgaatcgccaacatcaggcaggctgacctgaaaggtatgagttttttttttattcattatgatggtaaatgcaataggaaacatatccatcatgaaacaaagtgcaaacttactgcaatcagcttcacattattgattgactcacccaagttgctccagagggtattgaacatatcagttcccctacagtagcaaaaaaagttcagattaagtggtctgagtaatggagaaaaggtaaatgttacttggtataaaaatcatcaaagaaaaacttacgtactttccagtggtatgtatctctattgcatcaacatcattccttttcaacagttcagcagtcatagcaggatctcgaacatacgacatagctcctgaaatgttttcaagcaaggcttgtagcttctataagatacacaaaggcgtggaagtatcagattatgcttaaaaacatagggatgctacatatacatgtaaagaacactgtgggaacaaaggtcatgtaaactattgtcatgatgccataaaggaaaaacgaaggaatgcattactcagtgctcacttattctgtcataagggcaaaccgacaagcatcgtccacagccgtagcaccgctccgtaattacaccaccctacacaagacatcagaggtcaggtcataaaatgaaatgaagagaataaacaaaagcagaataaagtaaacaaaccaattgatacctcaagttttccacatgaaggatcagactgagagtgctcttcctcaatcataaccctctctaacaatattgcatcagcaggacagactttctcacatggctttgagcaatctggtgggcaatcctcaggatcaaattctagagaaaagagaaaggaagtggaaacctttagaagcaaagaacaaaggtattcagaaatccataaacatgcaacaggtcttgctagtgaaagcaggaaaccaagttcatttaacatgatacagcagaactttcttttaatttcaaattttccatactcaaatgaggataataaaaacgagactgttatttcaaagtggcattaacaaatatccaaaaataaactcaaaatatagagtacaacttttgtaaagagcacatcatttaccagctttacggaaatgaagatctctgcaatcgtcattaacactaaccatcacccatggcctttgaactgctggcacaattgaggctgctacatcaataccttcattcactgcacccaccacagatgcgtctgctgcacaatcaatgcaatccactgcatacacaaaatcagtccatgattatcaagagtagattaacctagcacaatggaatcactgaatatacagctattttaccaagtttttgccaggtctgccgaaggagaggcggaccaaatttcattaagatcaagggtatgcacaaatttacaaacttcgaattccgacaagaagctgtcgaaacaaaaggaggtcgctaggaaaaccacctcctgaaaacagctattttaccaagttgacatgatatttttcaaacaccacccattatgttatgatgccagtctgaattctgaaatgctacatatatgctccacaaaaatgtttataattagagcaacaagcatacctccggcaagcgtgtatacaagggagagattcctgacatcggcagcatcctacacaagaacaagaaaatcacatcccaagcatttcacaatttccattcacactatcaccattgctagtttcattactcaatataaattcaaaatcgatgtccccgagacgagggatttgcaccaacttcatcagaaatcgttccttgacaggtcaattgagctgggtttccctttgcaaaattaacaaaatgacaagagcaaaaaaaaaaaaatctctctctctctctctctcatttctcatcatatctactccgttcgcagcgctgctcctccatccccacttctacaactcgcaactcagtcgcttgcagggaaggaagcggaagtgtgctactacctcgaagctggcgccgcagatgagcttgacccagtccccgcgccggagggccgcgacctgcggcgggtggtggtcgccggcgaggcggcccctgcgagcggaggccgcggctcggacggcggcgtgggaggcgagcagagacctcgccgtcggcggcgccatggcttctccggtggctgcagcttcactgagccaatcgcgatagcctcatcggcggcggaaatatcttggagaccggagaagcatctccatccgtcgatcttggaatcaacggcttgatctgatcgcgtataatagtaggagatacgaaaagggctgacatggaataatactattttataaggtctcatttgcaaaaatgtaggattctctgaaataaacagggacttgtgtgaaattcccgatcgaaacaaacgcagaaacacgtatttgtaaaattcaggccaacgtcaggtcgtcaggggctcatttgtaaaattcagaataatgttcctttttttttttcttccaatgagacgagtaggaattagttagtgcaaatatttctcaaagattattcttaccacgcttgattcatcgagataatgatctgatctgacagtaactgataatggcaatattttacacaaatttaggatctgaaacttacctgacgctcaagtttgtgacagctagtagttgtcaataaagtgcattatctgcttcctttgttacaacagttttttgccgaaagaggcagaatcttttgaaattctacaaagaactttcatgattctcatttgtttattcaaatcatttcaatctttgtgacccagctagcttaaggtatcagaagagaaaaggggaaaattaatcgaagattattcttacctcgcttgattcatcgagataataatctgatctgacactaggtgataatggcaatattttacacaaatttaggatctgaaacttacctgacgcgctcaagtttgtgacagttagtagtttgtcaataaagtgtattattatctgcttcggtttgctcctttgctacaacagatttctgccgaaagaggcagaatcttttgaaattctacagagaactttcacgattttcatttgtttattcaaatcatttcaatctttgtgaatcagctgctagcttaaggtatcaagaacaaaagggaaaaattaatcgagcatgcatgtgcagttcatttgcagcagaatgagggataataaactaattgattgattaacaaaacgcgtattggagaaagcaaactaagacctggaaattgacgtccatttcagtagtatttcacaccaaaactatatactaataactcaaatcacattgacctttgtttctaaggtagacttatccccttgtacggtccaattaatctaattgcattcttaattaaccttaactaaccaaccaaccaaacctgctggctgttgctcaactgcagccacatatggatgcatcaacataattaactaatttcactaaaagaacataattaactaactagatgatcatcattaattatatgatcaattgcataatcttctccatggaatcttcctagaagttgcacatatatcttcaatacatatgcttgctcatgggcagcaccaccaactatagttaatcttgttccgcaaatcgcgctgttgatagacagatcgacggctggcgcgagtgacacgtgtcgtcggctcgtcagatatatatatgcaggatcagagatcatgaggtacattgcatgtacatattattgtagtggtggccaagaggagaatatttgtcattgtgggagagcatgagaagagaacatggcaaaatcaagccccaaatcagggagattaatctacatgtgcaatgcaatatattgcaaattaatatctccatttgccctgattgcatggcacattgggtggctatcatgatcagctccccataggggaacatggtggcacacaatgtgagtataatctatgattctatattataatagcatcctctaaacacacttaactacacacaaggtacatttatataccatgcactagctacataagtatatacatgtatatcatcttttttttaaaaaaatgcatgttgcacatgatgcaggagaggagaggagactttttctctctatgcatgcatgaacttttgctgaggtggcagcagtccacatgacacacaacacatgcatagagatattagagagttgatgatgcaagggtatagccagggtgttgtgatgaggaggcaaatcaaaagggagcttagcttagctagctagtgcatgcacttacatgcatgctaattcatggttggttggtttggtggtgtgcttggatacatgagagagagagacaggtgttgtgttgttggctgtgttaaggtatatatgatatgatcatgtggtggcatgtggccttgagttaggagaacatgccctcatggcctcatcctcaagcaaagctagcctccttcctctcccatgcatgcatgcactctcacacactaattaacataacattttgtatcatgtaaagagcattatccacacatcatctaatagctagccatgtttcatgcaattaattaagcttgtgatcacatatcaataattaatctctaactttccattcatgccacctaattcccccacatatacccccaaccttccaacctagctccagccttgtaccctcctaacccccttctatataaccatctctaccccctctctctaacatacttagccattttcacacatcatcatcatcttcttcttcatcttcatcatcataatcatcgccattgttactacttcgctaatataagctctactgctctagcaatggttgcacacgccaccatcaacaatggccgttgcgacgccgcgccggcggcggcggcgaagtcgaggccggcggtgatgccgccgccggcgagtaatcatggggcggcctgcaagaactccggtagcaacaaggagaggaggaggatgaggcggtgcgtggaggtgaggaggaagatggaggcgctgaggagactcgtgccgggcggcggcggcggcgaggattccggcgaggagctcctgttccgcgccgccgactacatcgcgcggctgcaggtgcaggtgaaggtgatgcagctcatggtggacgtgctggagcaaacgaaagattgattgattagccattcttgattcattatttaattattgattaggcttaattaatcatcagaggtgtaatacatatacaaagcgtattatttgcgctgtatacgtgtacggatttttttcttttgtttttttgttctctttttttttcctttgtttcgtgtttttgacacgtataaaataggggttattttatacgggacctggctatttaatttgtttgttgattgtgtcggtgtgtatgtacatacgtatagtagtatgtatgtgtatatgtgctacggttgtatatacatgagtatacattagttttatatgtatacattaatacatacatgtacatatgcggtggtaatgtcatctttaatttggtgttaattacttgagtattattggtgcatattcaaagctttactcttctctctctatgggtacaaaagaataaccagccataaatccacatgtgtccaggttacttaaattagaatgggcagattatatattaaaaaaaaactacccaaaagaataatgataaaagatgccttgtttttatctggattatttgcttcaagcttcaaaaaaatatgttttctttaaatattttctattaatgcatttgttttggacgtgattatactgttgcacagttttcttctactggattgttgtgataaaatcaattgtatacccaccacgatctaacaatgtttttatttttcttcaaacacgtgctaatttatacattgctccaaatttaaggaccggtcgtatactttactctatgggcggagcttctttcttaatttagtcaacttttgatcaagtttaagctaatgtgtgtgtctaagtttatattgagggaggtgtacacatgatgaaaaatggtgagttataactaaaaaaatttcttcaacaggttcctaagcaccccctcccacactccctcccatacactacctccgcccctgctattatatatgatgataaatttgggaagaaaggaataacaattagtaaggtaacaaatcaaacatattctaaccaatacgaccttactaaacattgataatacaagaagtttctaatcttaaaaattttatcaagatttgacaaggtttcaaactaaacgcaataaccaatttaccaaaatttgattgagccaaaaattatcattattaaaatttggtaatgttgaaaatatactattataaaaattgaagatactgctgatactttggtacgtcgtccgtatctgagtatgtttttaaattcgtttgcttttgaaaatacataaggagtcgtataagaaatccttttaaaaacatcacatgctaatttgggacgaaagttagactcctaattgttttatgactctcgccaaaccataaaaaaacgacattattatcatcatcccaataaggaactacttcatctgtttcacaatgtaaatcattttagcatttcccatatttaaattgatgttaataaatccaaacatatatatctatctatattcattaacatcaatatgaatgtaggaaatgttaaaatgatttacattgtgaaacggatgaagtagtattaaaataaaaatctcgtatatagtttctagaaaaaaaaacaataataagattaaaataaccctgcaacgcacggtattttttttcaaaaaccctaaaattacctagcggcggcgatctgggcggcggggggcggccatgccccccaaaccgaggagatcggtggcggcattgaccgtaggcggccacgacgctcccaaatcgtcgccggcgatgtcgacccggtccaaatcaacgccggattccgatctccgctcgcacgacggcagcaatcccagtcccgaatcgtggtccgggaggttgactcgctccagagcaaagcagattggactggttcttccgattcaggcggtggaatcgccgggaatctcttccaacaacaagaagaagaggaagaggagagagattgaggaggagacggcgaagaagcaggcgcagatgtcggcggcggcggcggcaggtgtgatacacagggaggggcatggcacattggcgtcccggccactcccgccgatgcacccgcagacgacaccccgcgtcagaagaagctcccggatcacccggctcgaaggtggtttcagctttcgatccaccactgtttcttgttcaatttcttttttgtatacctatcattattaaccatgttaatttctccccatttcttgttcttcagttgatcgacttcagaagttaactctccggcgcgataaagaagacgagccctccaccgcggccgccttgcctaccccatctcacaagaacatggtgttgggcatgtctcgctcaattgtccgcgtttcattcccatcttctggtaatttactccatccgtcccaaaatatggcaacctagtttggagtatggacacatcgtagtacgagtttggaggcatgttcagattttactggctgaatctactatatttgctgcagctataagctactaagtgagccatgtgctagcatgtcgcgtgtcgttaattgcgttgttttacgcattccctacctagcattacatgagaaaatcatgctgcatctccacatgggaattaccgtggattttgtgctgaactagttattgatcaagcttaactagctgccgatgcttagggaaaagccggtgacatagaagaaagctaccgagataggcatgtgtagtccagcaacaaatgggaaaatgtgtcgcagagagaaaatatgtttagtattcagtagcccgatataaaaatatgtatttatcagctcctagcaatgtagctaccttctaatcaactgtatgtttttcagagggcaaattgatctctccgcacaccggaatcgtcatcagttgggatggagccaccaagtgtgctatgatcctcacactcttcacttacttcaagaagaagccgcatgagccccaacccgaggtgcatgaccgatttccattagctaatccccatgtttctatcatccgagttccattgccatttttgttaagtatagtatggtcaaatgattgctaactgtagctgggctgctgtgcatttgctttgtgtgaactttactctgccctctgatttcaattctcaaacattatcattgtcaaattgatgtccttttcttgtatatccttagtattagttccgtctctttgtgcttaagataagtaacaatacaccattaacctttctttttctcgcattgccttctctctctatcttccagctacaggttcatctcccagataagtctattgtgcagggacggttgagattcatgaatcgccactacaatctctccatcttggagatcacgtctgaactaccattgtaggtccccgcttttgggtccgccccaaagtatggccaggaaattcttgccttgtctcgggacgaaaatatgtccctggtggcgaggcgtggagcaatcacgtggtcggatggttctttgatgtggagaaaccattacatgtttgtggattgtgatgttcctgaggtactgatacatttaccttttcttcacacttgctatttattttaccatctacatagtagtatttatttatttatttatttatttaatgcagggtggtgaaggagggcctgtggttggcactggcggtagtaccattggcatggtatacatagacggccctggtgcagttatcatttcaatctcaattatttgcaccttctttgagatatggaagcaattcaggtatataatatttttccatcagttttgaatttctttattctgtcagtattaaaatatactgcaggttgaatcaaaatcgtagaaagtaacttctttgtgataacatcatatgtctaagatccaaaaagatggtatgaaggatttacattgctaccatttgtgacgccccacacttttatcactaaagataaatgtgcgagaacatagattattatttaacaaccattattttgccaaataataatccaccatcagagatcgcaacagaggaatagttagagctacctttaattcgtccctaggagtattaaggccatctctaatccagctcactcttgcaagggatcaaacctgtacaaagggggttatatagcaagggtgagcactttcgtactcagcaagtcattagtagcaaaatgtacacgcatgaataataatatataactctatatactacaatactataccttacgtaacatcatcaccttcattgtcatcaaaagtaaagtatatttctattttgtaaaagagttttcaaaaggagatttataaaagctagagtacactcgtacattgaatagagtttgtagcaactccccgtagactccaatccaggagacaggcgtgaatcacgatttaatttagcactgcgcaggcttgtatcactgtacccatagctactcttaacatgtttgattgtcgcacttcactagatacggcaccatgctaagagtacataacttttcccctacttcaatttactacactccacgtttgtgtagagcctatcagctctccacaccaccgcgctactatatgcgcttggaatgcacttcatcggcattcatggggtttatatcatctcccattctactactacgtacccatgtggagtataataaacttgataaggtactaggtccagcccatcttaagacggatctatggttgacacggtatatacggttctctgatacgaatgatggggtgattagtccttatatttatacaccgtatgtagggagagccctgacctgccatcatcatcaatcatctcatccctgagctccccctacccaccatactagtatcccgatgatctccatcatcatcggcttgtcaatcatatcatcatcgttcatatcattattctagaaaatatatattgatgcaatactaggagaaatatttttatgaaataggtttttaagttgaaatagaattatctctatcaacatgatcaaatgagagggacttgcctgagttttctgtgatcgaaactgaaataatatactactgccaattgacacgttccaactctagcttctttcctgaaatttgttatatacgctgaggcttcaataaaatttcagcacaagaaatacaaatgctctccaattaaaatgtgctctgcagagtttattttattgtgccagctttcttatgtttaatagctaatttatctaacttttagcttgaactgcacaatactattccggtagcaggttcaatttaatgacttgtgtagtctagtagtgtacatctagcaatttaatccccttccattctctccttctctctcgaacagataaggcagcagcagcagtaattcctccgcttcttcttccttgctgctgttcctaaggcacttctcccttccccaactaaatcatccaagccatggctaccgatctaccattgctagtgtggatcagctctgctgcggctactgctgtggcggtggtggttgctgcagctacggctgcggctgcgggtgctctctctctctccttctctcatctctctggctctagcacttgtgcagtgatgggtgcaatttagtgatggccctaatggtgatttgcaggtgtaggggaacagatgcttggttgctaggtgctaaaaaaaaaaggaaagccaagtattgagggattcacctttgcctaggtgacaagttcgtccatggttgtgctcccgtgttcatcttcgccgatgcattggcctttcctcttccttgggtaaatcacattccctccttgctgatttctcttctcctcttcctagccgacatagtgatggtatgagtatttggccaagaactatttggctactaatcataggggattcaaaatttggtgcttgcaatggatggggcacaatcttgcatttcgctgatttgttggctattccctcactccctacttctctcctcctcctctcctgagctgctcactcctcactaattggttggagctcatatgcatgcatctgctgccattgctgtcgccatgctttgagtgcttgaccaaggtgagatagagtcttgactaaggtggctgaagttgtgctactatctttgtggtcttgtgtgaagcttcctatgtggagctatgtgattggtggaaaattaatacttctggtgaattgaggtccctttggtgagattaattctttatttgagatgtgtggcttctttgtgttaattagccggatgacgaacccgacttaagtgaggggtgccagacggtattagccgatctaggtatctcggtgaacggttgaatatacaccactttgtgtatgggtctgacggcaacatttatttacatattaccttttgtgtataaaaggggtcaagctatgtatgtcctgtgcaaccgtatatttaaatatatgcggctgtgttctttgccgtgagtcctcaacacatctccctcgttttccgtgtgcacgcttttcaaactgctaaacggtgtgtgttttgcaaaaagtttctataggaaagttgctttaaaaaatcatattaatccattttttaaattttttatagttaatacttaatt

SEQ ID NO: 65217 - DNA, 883 bp, Oryza sativa
tgcttattactagatcatagaaatattatattgcttaatacctgctttttcctaacattgtggatgccctaagtagtaacttgtaatttcactggaaaatgatagatagaaattggcaatcgaagacatatttgttttaggatatgtatttccacctgattacacagattctattctgcacatctgaaactatctatataatggaaacagcactaactttttagatgccattttcccgtaatattgtcttccgcaatttcttgaagttaaatgatctatctagcagactagcacgtaaacccactaatcacgatatattcttattaattgaacgtttgtggataaaccttttatatctatggtattagcggtttaaaatccaatgttgaaaaaaatctatgaaaaaaaaactaaaatcaacttaaaattaagttttaaaattcaatttgctaaataataagcacaggctataaagtggttggcgcgccaacatgcgtgctcattttctactaatagactaaatccatcttatctgtagcgctcattgtctactaatagactaaatccatcttatctgtagctgtgttgcccgccctgtgtttgaggtggatttaaaaagtgtggaactagctggtgtgttattccgggaggagctctctctgaaacataacatcaatggtggcttcattgttgaacgcattgctgatgattctgctcttgagcatcttggtgttagacggggtgacgtgatcttttttgaggacgagtgtggactactttgcctgaggtgaaatgaattctggtctcaagtaatagtttaatataaatcaacatttgttaagaataatacaaattctggaacagattgaagagggctgcagga

SEQ ID NO: 65218 - DNA, 4597 bp, Oryza sativa
atatatatatatatatatatatattgacggagcgtggggctcctcaccgggagaccgcgcaggccccccctttaccggttcgaccgggggcgctgagtgaggttcttcaccctcgatatgtggaacgttcgcgagagagcaaatgcacaagacacgggcgatgtatacaggttcgggccgctgagaagcgtaataccctactcctgtgttctggtggatctgtgtatgaagaagttacagagcaaatggagagccagagagttcaagctctagaacccctctttttccttctcttctggttctctttccctcctccccttaggtgggcaaggtcctccttttatatctcaaggggataccacatgcactactttctatctacccttcttttgagtggggaccaaccctatcttcaccaaatcttcgactcgcgccttcgcctggaagctaaatcaccgcttgcccttgagtgatgcccagcgccgtcactcgtcggacacaggggatcactctgtcatttcttcattaataggaggagatctacaatggccgctgtctgaatgaccctccgatgggatgggtcatacctacctccactccgccggaagcagatgcaacgtgggagcacggttgtctgccgatgacgtgaccggcgtcagtccagtcacagaccggtcattcttctccaccacgtgtcagtttagcatgccgcacatctgcccttcttcatacagtgacttccttgcaatggttgcgatgaagcctggcatgaatcgagtcgggactgacgtgctaactccaggagttaccacgccggctccagctagggacgagtgccaagaggctctcatcattccgacgggacggggcgaggcgtgtgacaggccgcctgctgccacctaacccgcgatcagaccgatctgtgaccggtcacacactgcgaccggtaacggaccggatatgtgtgcgccgtgctgcattaaatgcggcgtggcgcgcttgtccattctgcaataaatgtggtttggtgagcgccgctgtgcccacctaacccacacacgtggcgccaataccacagggggtcgtggcgccccagccctcggggccgaaacaggagcggctcgaccccccgagggggtcaggccacgtgggtgactgcggctgcccaagcctctagtcatgatactcccggtcccatgtcaccgacatatatatatatatatatataaagcctccaaaaacccctctctctcatcctctacacaacacacgcgtgcgcttgccttctacacgcacgataatgcgatgcaccagatcgaggcaactaagtgatttcataaggtgattacgatcaccacaacgctaccagtttgtcaaggtggggacacatcaaattatcgatggataatgattgtttgttaataaagtgaaaacaaattaaacgtgtgttgcagaaggaaattaattaagtccagtgggttaagtttttgcagcatgcaactctatgtaagctaaaacaaagggttgattacccaattgtagttataatacagtggagtcttcctgtttttcctttcaatctagattttggattttcatttgcacgtttcccaagtttctaaatgatgcgtttcgggaaaacaaattctatatattttgttcttaaagcgctttttctataacagggtgaaactagaacgtaaattaccctatgtcccgcacgtatataatatgtagttaatgttctagccacatgtacggttaatgaagaacatgctttgggcaaatcattttgtactctacgaccatggatgagaaaggagcattgtggtgttgccctttatgttaactaaacaaatagacaaatattgtctatatgactttcacgagatgattggtaagtggaggacactactgagcaatgagtggacatagagtaacgataaatagcgtatagctatatataagctatggcatgatgtgtcactttttctttgattccgagtaataacaaaggcaccagtaagtaaggagaaaaaaacaaaataagcaaaccattgtttttaagtaatcatattttttaactaagttttgttaattatgatgataaatcatactggacttattgattataatttacatgataaaactatagtctttgatataattggattacatgacaagagccactttactacagaaaacttcaaaatttataagtacactacacatactaatcaatttatacaatttttgatattttgcattaccaaaccaagcaattgtgtgggtgatatgtatcctaacatacctttaaagttcttcaaaactgtggaagaaaaatgaaactgttgtacttcgacagagtaaaaaatatacaacatttaatctatccttaatttggttgtcactatatcatgtgccttcatgagatgattcaatccaaagaactttgatttccttggtctcacaagttttgcttatagccatattacacattatgtgtacggatggtacaaatgataattagctatgtcagtttattattaagtcaattcaaaagtcatgccaccttaatacatcaactattcaaatgtcgatgaatggtttttaagatgcgtgtgaccttgagttgcccttaatttatacgacatatatcctatcttactataaaattatcccccactaactccttaagcttaacatgcaaagatgccacatcatcatccactaacaagataccacatcatcattcactaattaacaagatgccacatcatcatccactaacaaccatcacatttaaacatcatacaaacatgctatatctttatagtttttaatttaatttaagaacttttcaaatacaaacatgttaaattatcatccaacataattcacataatatttcaatgtatatctttattatgttttatgatatcctatatacttatatagttcatcctcacttagttagtgcttaaatgattaatctatggtccaaattatctttctcctttttttttctctaattaagtcatatcacatcaattgtttttagcctttagatgattaatctacggtccaaactatctccctacttttcttcttccataaagtcataccaccttactttttatgtttgaatcaccattctacatactatttaaatttaagttatcataaaccatattaatttacttaatctgatattatctagctattttacacgttatttttttattgttatcatactaaattcccgcagcaatgcgcggggtttcacctagttataaacaaaatataatcttacatttaaacaatattgatgcccgtgcatacacgcgggccaccttgctagttagtttaacaaagcagaagcgtaaataatatttttattatatgagcgagagaaggcccaacacactagggcgaagaacataggcatgagcggacttcaactagtaattaaataatacttagtgttctgctctgaccgattccagttaagccaatcaacacctaatcccattcggctagtttttttggaagggcgggtgatcgtggtgcgcaatcggtccacgcccgaagcgcacacgactcccgccatagctccgtcccctccgatagtgcaacttataacaaatacttcctccatcccataatatagtaacctaggactatatgggacatttcataggacaatgaatctagacatccttctatccagattcgttgtactatgaaaagtcttatccagtacaagattgctatattatagggcagatggagtatattttagattaattttaaaaaaatgtttaaaacaaaaaaaaaatcaaatgcgctaaaaatatacatgggtatagactttatacatcgaaatttatacattgtaaactttgcaagtacaaacctttttaataataaaaatatttaaattcatatatgaatttgaactggacatataaacttttgactgtaaactttaagtgtgtaaacttttggaatataaagtttggatgtggcttccctgttcctctttcctgttccttgccagatgactatcacttattggtttgtattttctagtagcctccacacccttgcgcctccttctcagccacgtatagatagccaaaaggcccgaggcccgacggcccggcccatggcacgtcattttggcccggcccaagcacagcacggcccgacggaggtcgagcccgcgccggcctggcccgaccaccgggccgtgcctagacccctctaccgacacgttgggctggcccggcacggcacgataggctggcagccagacccgatacacaacaaaataggggagtaaaaatagacatattatatgccatggacgaaagaatagggatgtgtgtatatatatatatatatatatatatatatatatatatatatatatatatatatatatatatatatatatgtcagcccaaagaggagggaggaaaaatagacttattttaaaaaaggcccaatgttccacccgtgccttcgggccggtacggcacggcccgacagctggtgggccgtgtctgggcgggaggtgcatcccatgggccgg

SEQ ID NO: 65219 - DNA, 8556 bp, Oryza sativa
aatgtcagatccctagaatgtatagtttagtaacttgcaagtgtaaattgtttctatacttaatatattaaataaatcaattgaacatatagggaaaatcagtgtcatattgctgaatcggcctcccttgatgcaatccttgactttcttgagtcagtaacagaggagtatgaaatgaagtatgtgtggatgcatccagaacagcgctatactctgatacgtgtaaaaaagcgtggttattgggaacctctagatgatcctaaccaagaaaaagtaatggaaaaagatcagcgacaataatcaacgcaagcagtttcttttaagaaaaacgattatgtgatgagtataccattactgtatgtatgtactggttgtggttgtggttgcgctcgcatctctacaggttgaggatgcggtgattgggctgagacatcattgatcttctttcttttcctccgtgatgaagctctgtctaagccgccaataggtcttgctgatccacgaatttcctttttcttaagtttaatacctaatggcttcataggcttctgattttctttcgcacctgcaaagacaaattacaacatgcatatttcaaacaaaaaatatgtgtcgggtctcaaaactaataacttggatccgactgagattaatgtaccaatccttggatcagtaaatattgatacatgtaatacaactgaattttcattgcatatgttaaattttacaatactatgggttttacaagagtaggtactcacttaactatacttagacctaatgttatacaacggaaactttaatatattttaactaggaatgaataaactctagggattttctaggttatcggggtcatcatagtaatagttataggggtccttctcttgacccaaatctgaaaaaaggagtaataggagcaagggtgagtatttgcaatactcagcaagttattgtggaaacatgtcatgcattggtataagtatggaggggttcttttgcacaaagcaatagtagacaatctggtcaattaaagcaagaatttataaaataaattattcaagtttctaaccaaagtaccatatgagtcccgatgctcaaatccgtgagcacggctattcaaatagtttcataatcattctattgcagtagatatacgctttacccgcaatccatgacttgccaataaacattagcttagttatgaccaagtcattaggttactaacaacagtggcacctattccatgaactctagtccccatgtgctttgaacgtacgttatcagcaatgtgaagagttctggtgtttccggggtctttagagaggattgattgtatgacactatgtcatcgcaatcagggtttaaataaaattttcccttgctcgcatagcgcgcaatatatttacccttgctcgataaatataacattttccctcctcggcataaacttgcctcatgctcgtggacttaaaaacaagaaccactatacagaggtaccactttgttaattaacataatagctaggtctgtaccaattcgagaactgcggtcatacacgttcgtttgtcacaagtacttggtaacatttatggcgactgagacagtactagccacccgaaaatcaacccattcttacgtactgtctcaatctaagtataaagcattttaatcagattgtaagcaaaataagcaaagctaaattatctgggtttctatggttgagttatgcatatataaaagagaatatttgaatagaagggctataaataaataatttataaaatataggcttaaatgagcaagaggtgaacaataacttgccttgctcgatgtcctaagattgactaatattatctagtgtgtcagaaaaatcctcaagacctagggttaaatatataaaattcaaattcaaaagggattcgaatgaagtccaaaaataggaaaaaataaaataaaatgagaaaatagtaaaaatagcctcaaaagatagagaaagattttagaagaattttggtccaagtttcactagaattggttttatatttcaaaagatatgggcttctaaagattaggatctgaattaaatctagaaattgtgaaatagtagtgtgctggggcccacctgtcagtaactttctttcccttttctttttctctccttctttccggaaatgcttatcatcatatgtccgggcaaggaaaaaaaatcggacaccccaacagagtggtaggtgcatgcagccagcatgcatgcaagtcggatagatctaaaatttaaaatttaaatgatcttttctgttgaactatttatccgaactatgaactaattataccattagatttgtgacaattaactctttataatgagatctcatatgactatgttccgatgatttttttattccaatgtttcaataagtatttattgttgtttcactgattcatttataatgttgcacgtggtctttttatatgtttcagtaaatatattttttattttttaaaaatttcaacaaaataaattattttcaaatatgttgtatcatattttttatgtttctctagttgggatctaatgtttcatgtaatggtggttattgttgcagtctgtaaattttatatagttattgttgcacgctatatttctatatgtttcagcaaataattttttatgttttaaaaattacaagtggacgtttcaatagtgatataaattttaacaaaatcaatgtttacaaatatactgtatcatacttttttttatgtttcactatttgggacataatgtttcatgtaacataggttcttgttaccgtttgtaaattttataagttacatatcactggaacattttataaagtgggctaaaacattcgcatctatgaatggtgcaacaaaaggttgatttttctagaacacatatattttcttaatcaaaatatattcgtgtaagatcttcttataaagatttaattataataaataaaatggtataatcaaattatagattagatacatattttagttgaaaattttgtttaaaatttgattaaacaaaaagaagagagagagaatgtagagtcaaacatatatgtgatgctgtgccaaacctctgtcacccctaccactcgctgcaccgctacttctcgctgcaggcatgcacacatgcagtatgccatgcaaatagataggcagagtgtgagcggcgtccgatatttggagaaataacggacgtccgattcctagcttgctcgccttctttctctcgtcttcttctttcttctttcttcttccagccgagcaactgagaggagggggaagaaggggcgccagggctctggtggctgggaggcggcgacgccggcggccggtggtgtttcagggagcggagcacctagggtgggcagtggccggcagagggagttaagggaatggtcggaacggcgagagcaagactgtgaagtgtgaaccggcaagagagagagagagagagagagctccggtggggcttgacatgggacgaaaaagaaggggaaaattggaaaaatgggttcgccggagtgaggcaaggctggtggtgagaggatttggttagtggtgctccggtgagggagatcggccgatggtggcggcagctggtcttgaggaagagagataaagacagagctcgaggggctcggattgtgaggaaaaagaaggggtttcgccggctatttataggcggcgaggggcggtggtcgatggcggttcaggaggaggtcgacggcttggccacggcgacggcggcgcaaaggaagaggagatggcgccggctctgtactccgattggatgtcgatggcggcgcgcacacgtggtggctgaaggggatttggacggcggggagggggagcacggcacggcggcggcggcggcggcgcaaaccgtgggcggcggcgctcccatggcgcacggcaacgacggctgcagcgcgtgtgtggcgtcacgcgcgcccacagagaagtgaaaagaggcggctgcctcttggaccgacttgggccaagacagggaaaagggccggaagggagagaaacggatttcagcccaaatgaattatttaggaatttttgaatattttggctaaggagaaggaattaatctaaggcctttgaaatgttttgcaagggttttagtactatggtaaggtctcacaaatataagggtgaactaaggaagttctctaggttttgaatttgaaagaaatttgctagaaaataggttaagggaattctaggggcaatacttgaaccaaaatcaagaataaaaggggaaattttaaaaaggattttgattttgctaaattagggttaaaatcaagtcaaaagctagcatgatgcgtcaaattttaattttataatttgaggatattacattgtgatccaatcataggactaataattactttatagaattgttaaacgaaccttctgaagacaagctctctaaatctggatttcatctaatttcaagcatttctctatgtcttctgccaatttttcagcacaattagtagatatggaatatgtttcttcaaactatctgcacaatgagaagtatcaatctgataactttattctattatcatcatgcgtgttaccactgccacttatatgtagtacttttgcatcaattgtccatctttttagtatatacatttgaggaaccgatatgatgttattgatgtcaagtactttcagggcatgagagcacaggatgccagcaaattcaaacttcttgcagctgcatttgacactagattccaatggtgagaatttaacaatgagtctttcttaagtgcagtcagcataaagctacataaaggtaggcacgaccaatgagggagcgccacccgtcagctgagtaaataatgaggttaatttaccccaggggtattacggtcatttggacaccggcgtaaactctaatcgttagtttactctagtcgtgattccacaccggaggaacgtacgcagtgttagagttcgccggagaggacaaaggaatccccggaaagctaagaggcgagtggaatgttcaattatgtgctagtttttatggtttacgctctatatcgcgccgctattgtagatcgcgtttagagaaagccattgcatcggcacacgtaaatagtggtacaaatgatctaatgtagaagatcctagctaaaaccaagcaattgtggttacatccgtttacgttggtctacaaatagaaaatacaaagtacatagccacataagatcgatagcactcctctggtatacaatatgagaacgaacaaattttatggtaggccaggctcacctaaatttagcaggtaatcctctcaaccgtgtactgaataacgataggagtaaatcccaaggtcagtcaattatgaagcccattttggcagtaaccgttttatataatagtcctttatatttccactattacaagccaaacacagcatcgattttattgttagccccttattattatccaaaatattgaaaatgtgatatatataatttataattttgtcaaggtcttgtcctcgggtcaccaccatccacagattgcggacgtaaacacatcgattctactcatacgttcaacgtgcctgtttatgtgcgcaatcccatggtgtgcgtaaaccatccacgtacgttgtgaacgcctagcgttaaagccttgtaggcacgggcaggggtgaaccttgtaggcacctagcgatctctgcgtacgcatagagcgtgcatgactcgcgaaatagcatatcagccatcacgcacgtgtaaaccgtgttgtaggcggtacgctctatgtacgtttttacatctgaaatcctgacgtaggcgtaatgcacacagctcgggcacaatgatgttgtatgggcgagacgtgcgtgaaggtttacacgtacgcgtgctgggatcgcaagttgcctacatatggttcatgtctgcccatgcatcgtggacgtaaactccttcttcgtgcgcgtacattaacctttcgagagtagcatggatgtgtttacacccgagatctacacatgggcgtgtagcatgtagggcacctcgcgatgcccacgtacgcataaaccgcgcatggcttacgccgaattgataggccggtccttagtcgtaccatacgcatgtgcgcgactgcaccttcctcgcggcctatttccctgcatcctgggcctggcttgcacgatgggcctaatgagctgatgggtgctggctggctgggctggggcatgggggaggggtcgatacatccaacatccaaagtacttaacaccagaaatatataactgctagttcaactatgtaaactacaatgtacttgcattttttctgcttcttcctcggtggcaagtctccagatgaactgtcgtcctcgtcctcgtcttcgtcgtcatcatcatcatcatcatatgatgcgagcggaggacttcatgttggcatttcagtcgtccgatatgtaagcgcagggggatcgcgagttgcctacatatggttcacgcgtgcccgtggatcgtggacgtaaactcatcattcgtgcgcgtaaattaattaaccttgaggacagggaggacttaagtgctcttgagggttgtcaccacctttacacctacctcaaacgatatgtgggatacgcagtcactggaaattaactacctaaacaccacgtttaagcaattaactattactctagtgtttataactcactaaagtgatcactataaataagagaataatagtgaacaatgatccagtatacttataggaactaaccaagaataattctcataaagtaaatcttaattacttagaaggatattactattaaactagagtaattaaaaaggtacaaaaataagaggagaattaccgacaactctggaattcctccgacttcttctaccttactctatcactaatctagtatataataaagtacaatagagactcttatagttcagctcaaacttggagtgtgtgttgtgaagtgagagagtgaagtccttacataggcaggtaatgacggttataacaatgtaaaatgtctgaatagccccgcaaccaccagcaggacatcatctggagcgttcatgccaaacctcaggatcaacggtggagatcagggttcgaccaaaccctggcttggcccaactggcccaagatttggtctgggcctcctcgtaagtcccttatccatttccatagtaccaactcatgtatggttgaatttcttattcagttaagtcttaatttcctcccaactttgatggtttattacatgcatccaaatatacaccaacactcgtggaatatggtaaaattaaatcctaacactatgttggatgtttcattatctatatattatgcgggtatcagcagcataaaattggcatttaacagccgccaatagtaagttacttttatcatatatataaattactttataatgctctaagttgattatttttattattgttttataagtcaattctttaatttatggactttaaatttaatttttacataggccatatttttctctctacaacgaatttacttctaatgttgtaactacttaccttctttttgtgctaagttacttttatgattgatgtaaattacttttcgactttattcaatttacttttagactttattaattttactttcataaaagcattttcttataaatcttctctacattttacttgtgaatttactttacatggtttcttattttaactcagtcacaatataattacttttactacattacatagagttacttatgttgcatagctaaattatttttataatttaaataaattatttttaaattaataaattattttaatatattcaacatggttcttgttttgtagagtacaatgatacaaatagatattgaaaataatacgtgatttaaaatatataagttatcaaataggtcaaatctaaaagtaatgtatatatatgataaaagtaacttgcatctataataaaagtaatttacaacatagatttttttatgagaatataataatgtaaaatcttgttgtaaagatttaattgtaacgaacacaacagtataaaaatgcatggactattgagtgtactagtagcaaccaaagtgaggttgccggatatgcctaaccagtcacgttcaaattttatgcgtataaatttacctaaaaaggaaaaatattaggtgctaaaaaggaaaaaactaattagcaaattcggttgtcgtgggccgtaggcatccgatccggtcttccgtttataggaaataactagacagagatgtatatggaagtcgggctgggagaatgagctgctgccgaatcgaccgaccgagtccgactcgttctaggacacctagcttgctccaaactccccatatatgttgtactcctactatatcggagaaacaaaactagctccactcctgcccagccaagaatcaccgatcctgccatggccgacgccgacgccgacgcgtgcc

SEQ ID NO: 65220 - DNA, 2874 bp, Oryza sativa
tgatgctccggaagatggtggtgctgtcagatcaaaactgaggtcggacgatggcgtcatgctggccgatgctcgagacgacgaacaacacgccgcaacatccgactccatggccggaacatccggtggcgccgtcacgggaggaggacacggaaagcttcttcccgacctcaacgtcgtcgcaaccgtggcgcacgacgacgaaggccgccacgcacggggcgcaccgcggccacaagacggcggcaccagcacgacgacgacgatggtggccagcgccggcgccgagcgcggcagcacgacgggccacctgccggccgccaccgccgggtaccgtcgaacgctgatgctcttcctggaggaggaggacgacgacgccgtggaggatgagcagcagcagcagcaggcgccgccgctgccacccgcgacgtcgacggcgacgacgacgacgaggacggcggcggaagccaatgtgcagcggcagcggcagccaccgtgttgtacatttgtggtgcacccgtgcgcggtgcacgcgaagatgcgacacggcgcggcctacgggtgcggctgccgtgtgaccggcgctgtccggagaggcggttaccatctgccgaggcgtgcagtacatactacgactactggacagtagtttatatacgacttgttgctccctcccgtcctcacaagaatgcgattgtagcattcaaattttgtactgtacaatagagaatataacaagagtgttgtacttcccatctacctatcatcgttctgaaacttctttctcatcttacctcagtcaccttcctagcctcaaccacatcttacgatttaactcaagggagatatagtcatttatcttccctactaatttatcttctgaatggtgcagtcgcctgcaaatttgtaatctatcagtcgatcccctgccgtcgattctgcattaagatatgttgcaactatcgggctggtgggaaagactttctggatatggacccaccgaaatgaaagctctcaattccttaactccttttccctcactcggctccaagttcgtcacagccagttcctaaagctcaacatgcagatgtgccacatcatcacccactaacaattattatctagagtatcttagatctcatgctaacatgacataccatttgtatttttgttgtatgtttagacctcagcatgcaaacaatgtcaaattaccatcttcacattatttttacattatttaaacatatacgtctatcacttttataatgtataacatgcatttatccatacatatcccacagcaaagcgcggggtatcaactagttttgaaaagacagtcgccgttgtttggcaactcgaggggaagggatggagagtttacacaagagaattgatgatgagattaagatgggaatttgatgtttaatatctcaatatcttgtttgcttgaggtggcggaaattgatagggagtttagttggagattaggtgattaatgaaaatgaatgggaatttgatgtttaatatctcaagatcttgtttgcttgaggtggcggaaattgatagggagtttagttggagattaggtgattaatgaaaatgaatggctaagatttgtttaggcaaagtaaaggaagaattccctcccaattaccaacccctactcatgtatcgaaaaggagagagttccttcctcaattccccattctcatccactggtggagaaactatctttcgtcggtcggccgaattccacaatagtcccggttgcaataaaaaccggggctaaagatgatctttagtcccggttaaaaagggtaacaggcatatttgatctttagtcccggttggtaacatcatctttagtcccggttcaaatgctgtcatggaagaaagaatatatagaaatttagtttatttgctaaagaaggttttataaaatagttgagaaggaaaatatagtgaaagttaatcttaaataatagaaaacaaactaaaatgaaaattaaaagaagtacaacacattaatattagtttaaaactttagaaatagtaaataagaattatttggtgtaatattttataatttttgtatgaataatgatatgtctttattgtatgactgttgaaagagtttgtaattattttataattattgtatgactgtcatttttgtacgaataattatttgtgtacgattttttttcatctcatgtagatggatcggcaatggatgtacgctgaccggcggtccaaagagtttattgacggcgtgcattatttttttagagtggccgaagctaacaggcataagggtttatttgttgtccatgcaataagtgtaagaatcagaaggagtattctgcatccaggactattcatttccacttgtttgagtcggggttcatgccaagctataactgttggacatcctacggagagcaaggggttgaactggaagaagatgaagtggaagacgacaatattccggactttgctcagtatgctggatttgaaggaaatcaaacaggcgaggaggaaagggatgctgatggtaacgacgttgcggatgatcttggtcagatgttacaggacaccaaggaggactgcgaaagtgaaaaggggcctataaattggacaagatgttaaaggaccacataacgtcgttgtacccaggttgcgagcaggggcacaaaaagttggataccactctggagttcttacaatggaaggcaaaaaatggtgttagtgacaagacatttggcgatttattgaaactcgtcaagaacattcttccggagggaaacaaattgcccgagacaacgtacgaggctaagaagatagtctgccctctaggactaaaagttcagaggg

SEQ ID NO: 65221 - DNA, 1917 bp, Oryza sativa
attcctgcagccccagaattatgtggtgcaatgtcttgtcagttttgagttgatatttccaccgtcatttttcaatataatgacgcatctgctttgtcaccttgtcaaagagatcggtattctcgggcctgcgtacctacacaacatgtttcctttcgagaggtacatgggcgttctgaagaagcatgttcgtaaccgtgctcatctagaggcaagcatcgccaaggggtatggaacagaggaggtcatcgaattttgcgtagaatttattgaagaccttcgcccaatcggggtacctgaatcacgccatgaagggagactacagggaaagggaactctcggaaggaaagcaataatgacggtagacaacaatttattccgtaaagcccatttcacggttctgcaacaatcttcattggtagctccttacgtcgaggagcacttggctctagttcgcgccagaaacatcagtaagtccgatgcatggattacacggcatcacattgatactttccctgcttggctacaacaacatctgatgggtaacgagacgatcaaccaacagctaaccttcctggcgaggggtccatctggctcgttcgcgacattccagggatatgagatcaatgggcacacattctacacgagagcccaagacatgaagagcacgaaccaaaacagcgctgttcgtatcgatgccatgggacacgatggaacaactggcacgtattacggtgccatcgaggacatatgggaacttgactatggtcctctcaaggtccctctgttccggtgccaatgggttacggtaccagtacttgaacgaggaagggaacgtggagagggatgcggaggggaaccaggagaggaacgtggagagggatgcggaggggaatgaggaggaggaggctagtggaagtcaaccctccgctggacagaagagggcacgcgggcaacgaggtgccgcgaagaagctagagggtcggcacatcataacggaagtagacgaagacggccgacctagtgccccggcagaagcagccaagaactacgtacgacacagtggttgggttgtgcgggataacgtgcctgttagtgcggtgtactggcgcagaacaagggcacacggagatcatgagagctttgtcccagattcggagaaagagatgctgtggaccacaatgctcgagacattcacccttcccgcgggtacagaggacaaagtgaaaaggtggactctaaagaaaatggcagaatagtttcagagcttcaagggagatctgtaccagaaatacatcctgaaggggcagacaccgtacttcgacacattcccgaagctaagggatcactgggacaagttcgttgcatataagacaggtcaacaagggcaggcgatgacggaaagaaacaaagaaaatgccgccaagaagaagtaccatcaccacttggggtcaggcggctatagcgtcgcgatgccgaagggggaggagatggaggcaagcttgtttgagaggggtatcgaaccggccaccgctaaatggtcggatcgatcgaagttctggtactatgctcacggtggaacgctcaacccagttgatggctccctggtcttcagcgatcagatacgcgaggctgcgcgtcgactaacagacgcagtggaagcctcttctcatggcacattccgacccgacagagagatggacaagctgtcactcgtcctgcagaatcccgagcatccaggacgaacacgagggaaaggggtgattccttggaagattggattcaaggaggacatccacacgtacaggagtcggataaggagcaagagagataccgaggcgaagattgcagatcttgagtacagggtatcgagctacgagctcaacatgcaaggggaggtggcaaggaaggttgatg

SEQ ID NO: 65222 - DNA, 2353 bp, Oryza sativa
cacaagccacgctattatattatggcgcaagcggtacatcatcatccctgggcgacaagcggcgtctcgtgcaccatctcctccgactccgccatctcctcctcaggctgctgcaccgtctcctcctcatgctccagcaccgtctccaccttaggctcctgcatcgactcctccttaggctcctacactgactcctctgcaagctcctcgtccggcaccttccaagtcaagggccccccaagctccaccacctgcccccacaagggcaacgaaaaaggcgaaagttgacgcacgcaagaggtgacgcttatgtggcatcagaagtcaggacacaattgaagcctcgaagttcagaaaagaagattcctatagacccgagtgtcaggaacttcttcaggggtatgtctgcacctgccaaggaggccataaagctatcggactatgagcgaacacttaagaaagcatcctctggaaagtctaaaccagtccctcagcttggagagcaaccataccaggagatcgagccgttggtgaccggtgaagattttggaatacaagagtttattaatgacactgggctaactacggatcaattgctacgaggcgcaccaatcgaaaaggcggaagtgaaatacatgtacaaactcggtaagccgcttgtcaagcctgagcagctgcagtccctacccacacaaatgtacaaattccatcaactgtacatggagatgagcgccaccggtagagagatgatcggagcgaggatcaagggcacagacttcttgcaaggagatgatattctctggatcaatttcaagggtatctacaaactataccagctggacgctctcgacgtctctattatgagttgctggattttgtaagtatcgttcagttagatttcttattacgtttcctttaattaattaggtccttgtatataagtagactatatatattatatacttccttctatcgttgtagaatggagattcaaagggcccgacggcggggggttttcgatactagattcatcgaccctcggaaagtaaacgtcacaatgctcgaccagtatccgcaagccacagaggacaatctcgtccatctcctgaaggcgcagcattacaagacgttcatactattgccgtacaacacagagttagtttttactgtcttcctataccaaatttcattcccgtacaaacatgctaagtgtttcatatgtaatgcatccgatgcacattgcagattccactgggtccttttactcttcgacttggaggcctgcaccgtcaacgtatatgactcaatggataaaaaagagtctacgtttgacaaggttttcgaacttatagacaggtactgtcataagttcctatgttaattaagaatcttgttataattaattgctactacgaatcatagctttaaactccatgtagggcttagtatcggttccgtcatttggtccgcggcaagtggagagaaagacttaggcggaagtttaattttcctgtgagtacacatgctctacatttatattgaatctccaattcaaatacatacaagtgtatattaattagatctctcgccgtttgtcatttatttatagtgcgcaaagcaagcccagggaactaacttgtgcggctactacgtgtgcgagtattgccactgccttgtagaccaaatcatcaccacaagagagctcaatgtacgtacaaataaattcaaaatttcattgtgtacgtatcgatttgttgtttactaattaatttcatacattcatatagtttattcgtatgagggataacctcacacacaaggaatttatcgcggcggttcaagaacaactcatgggattcatcgacgaacaaatccttgatctcaagggtgaattctactacgacagaaatacaattcataggtccttagcttctgagataacgactactactacatcgaaatcgtagctagctaggacattataatggattgtaattaatccatgtctatttttctatatgcatgtacacattttctttaatgtaaatatatattttggtcatatatatatatatatgcacataaaatgttaagtgctttcatatatatatatacacacacacacacacatatgcatttgcataacatatatatgtataaatacatatatattatgcatgtatctgtattgaaacatatataaatatcatatatatatgcatggtttatatatatatatatatgtatatatatatatgtgtgtgtatatatatgtgtgtgtgtgtgtgtatatatatatatatatatatatatatatatatatatatatatatatatatatatatatatatat

SEQ ID NO: 65223 - DNA, 1260 bp, Oryza sativa
ccgacttcgtccatctccatccgtgtacttttgtttataaccagactgagccacaaactaagccttacccactagacatgtggaagtacggtagtgctttgcaacagaggcccgagcttaatccttatagggccggggtgctacttcccacaactagcatgcacccaaaccccaccgaaaaacaggttttaggggctttgaaagaggaagagaggggtatgtccaattccaccatgagccaaccattccatagtgtccaaatgatatgagaattcccaaagtctaaagttataaaaccacctaatgttgcctaattaatcagcgaagcatctacctaaattcatactagtggaaccatgaatagagtgtccactagttggggttttgtttattctagggtgaacaaggtaataataacaatagcaataataatgtcataacaaaggtaaataggcatggctaaataaaacagtgataacgcgggaatttaaataaagcgataatgcaataattgaaatcaaaataattttataaactgggattcaatatgttcaaggatgatgtgacttgccttgctcagagagaacggccttccgtaccttcggcgacgaccgcgaaccacgcttcgggaacctccggaatgacagaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttatatggagatttgcggattattataattaagctttgcaactataaaacatgtgtaagcgctagcctggaaaagacaggaaggctgcgctgttgacatgcggaccccacatgtcaacctaaaggaccgcggtagaccgagtacacagagacggtccacgggtcgacggaagcggaccccgtgtgtcaactgaggcgacaggccgacaaacggactccactagacaccacacgggctgcacacgtggagaccacgcggctaccgagcgggcacactaacacggacactacacggtcactacccgcacacgtgaacgactaccgacaccggtacacgggtaccggggttgacaaccgcacaacgggtacggggcgacactgaaaggacgaggacggggcagcgagaggagagatccttaccaccacgcgacgaggcgtgggaaagaca

SEQ ID NO: 65224 - DNA, 3209 bp, Oryza sativa
aaagctcataatttatatccggttgctataattatgttgtattctatcaaaccatagaaaatcagtgttccaagaccaaataaattctttcattttttttcatttctagcatgaaaattgtttggttgctctacggttttctcgtagttccttgtaaatatgttccatgactaaaaaataaggcctaggtacgctggttgtgccttgtcccacctattattggttcattattcttaactcgtcaagactggtctactaactctctccccacttctctttctctcccatgcacttgtttgtgcatgaaaatatttggttccaaagtctgaataaatttattacaatttgtgtgtgtgtagtatatgacaattgtttagtgacaatagttttcttgtagctcctagtcaccttgctccatgttgtaataattgtgtagatggtgagatgtatttgttgtacctatgaaggatgtatacggtccgttgtagtgatgtttacataattgatcaagtttagttaatcattttttttattgtcctgggatagatatgagtcatctttttaatggtttgtgcacaaagaaataaatgaaattatgttcatacctaaaaggtgtagaagaatatctatatatgatatatgatatatgatatatgatggcgcaaacatgtgtcataaaattattttgtagttttttattcaattcggacgacatgaaaaaggcaagtgttgtccaccataaaaatatttaccaatttagctttactatgcatatttatagaatgatctatgtaatgatgtaatatatgtcgatattttatcatatttctttgatattttgatgacatctagaattcatgggttgattatgatatatttcttatatagaaaaacataggcatacgaaacttaatttgtttgcttaattaaaaatagagaaatagttatattagatatcaaacatgtagcgtgtagctatagaaatatcatcatttaaaaattaaaattattaattatttctcttttagttggataactaaataataggaacggagagaggaatgaagagtgccagtttaagctagtgggaggagcggacattgataaacgtatgtgaggggagggggacgggggagataaagggacctttgttttcttagagatatatttattgggtccacaggtgaagaaaatagatggaattgtttgtaaatgatgtggtgtttaataattgtttacattatttggtgcgaaagggcataaaaagacataatacggtttcgtgtgaaatttttttaattaaaatattgctaatatgtgttgtaatattctttatctagagtaaattgcacctgcgatgcaacaactaggcaagtgggtgtaatttggtataataacttgagaaataagcgttctagtgcaacaacttggtaggaatgtgcaatttagtataagaactttagaggtgatcacataaatgcagcaacttgtaaggtaggtacgattttgatacaatatattaagaagttatgtgacaacttaattatttggagcatttttatataattcgaatacacatacttacttataatggataatatactagcgtggatttgaataagcatacttatatttttatcctaataactaatatctgaaagcaattaacctggatgtagaaattattatatttcggttgatattttagaaggtgaagaaaaaaaatcttaaaagtaattggatgtaaattgtatgtgcagtataattcttataaagattaaattcaatattataaggtaatatccgaaggaatactatgtaatggcatattgatatcgtgaaaaaactcaccttgcatatgtttagccaagttgatgcaccaaaatactaaactttcaaatttttgtactagaacgcacccacttatcaagttgttgcactcggacatttaattcttaagtttttacactatatcgcactcacctgtcaagttgttataccgtgggtgcaatttactcttttatctattatagataagatagatgtgctatgttttaaatagatatattgattgtttgtttttctcgatggtaggtgcctgcgtacgtacgtacatgtttttttactttgtcatcgatagttaaggctgtcaaaaaaaaagctcgaggctctcaagctgcttgaactcggctcgtcttaggctcggctcgagctcgattcgaccatagtacgagccaagcccaagcttgcagaaaggctcgcgagcctcatcgaaccgaactcgaatagctcaacaagctcacctgctcacctacaatcaaaaagtgacatgctattttcttactagtatgtttgacttgttttatatctatgcaccacgggctagcagcaagcccacacctgtcttatatgaagtattaaattattcatactagcctagtacacctactagcactagcacactccccaataaaaagttgcatggctagattcgtgtgcatctctatctgtgctagtagtacaagctctcacatgttatctgtccggtgctagtagtactcctacaagcttacatgctgtcctgtgagtgtacataccccaagtaggcctatcaaaaatgctcgaggtccgtgagctactcgagcttgattcgttatgagctcgattctagctcggctcgtctaagaatcaaaccgagctcaagcttgactttaagctcgcgagcctgtcgagccgagctcgaataactcggcgagcctcaacgtctggctcatgttctttctcctaggcatttcctccccctctctctctcttactcgttcaaattactggagtagcacaattgcacatgtactggcagggcaggagggagcactatgcatttgttgtcccatttcccaacaagagagtaggagtactagtgtgtagtagtaggagtactagtgtgcggcttgcacagttgcactagtatacataggagcactagtatattacttttagccatctaatcatgcatcacagtgtcagctttttctttgaatgggatgaattgttccagtattccaccgcacgaagcaggcttgagagaagctcgaagctcgaacgagccgagctcgagctcaacttcaagctcgtggcaaacctaggggctcggctcgagcctcgactcgagtctatagagagcttgagcctacacatggaagctcgct

SEQ ID NO: 65225 - DNA, 6562 bp, Oryza sativa
tgtttatcaatattttttttggattgttgtggaaatttgtttcgatcactgacatacggacgtacgttaagaggggacatgtttatggatatttgtctatatgcatatgtgactatggaggtaagttggaccgacgggaatgttggatcctttgagggggtgtcttagacatcctagtgcaattaagatgtggtctatatttttttatttgaaggatttgacatgtgttgtccataagcattgtgtgcacatgagtagtagtactatcttgctatttaagcaagagtgtagccaacctgtaatgcattgtccctccaaccatatcattttttgttataaaagtgtaagtgaggtgatatttataagtaagcgtgccaattggatggaggttgggttgccttgttctgaaggacgggttgttacaaattgtacactaaaattacttgcatcatgtcgtcttaaatttatgagaaaaatatcattttaaaaatactacatgtttttattttaaaaatactacatgtttttattttaaaaatactacatgtttttattttaaaaatatttagcatcttaatttaaactttaattttttcttgtatactaaatatgtctgtgtagattttacgatatattaatataagaaattttctattaaaaatatgataatatgacatctttatctaattaaacaaatactcatatacttctatttacttctactacctctatccataaatcgaaggatttaaattttatatcctaaaatataaggaattattaatactactcgttccatccagccattcttcatttaatttttatccaacattacactaaccatcttctaactctctacataccccttatttaatgagccttatttaatgatgggtatcttggtatttttttttcattcctccttgatttctactccctccgtcccagaatataagaagttttagagttggacacaattattaagaaagtaggtagaattaaataggaagatgttatgttgggtggagaagtggaggtaggtgagaaaagtgaaaggtggagaaatgtgattagttgggaagggaatgttggtggtaatgttgttatatttgggacaaatcgtaagtgctaaaagttgttatattttgggatagagggggtataaaattttaggatccattataagacggagatatatagtaataaaaaagagtttctcatttatagacggattaatttgtacctttgtagattgatttagctttaaatatttgtataggtaaatagaaatggtataaaagttgagaaatataattaagttggttgaaagtctttagatgttaaatggtatgaagtaattagccaaccagttttattaaaaaaataatgtggatattttttgggggtaatttttaggatcttcttttattcagtggttaacttaattgttgtaaggaaaacaaagaggcgagagccagtgggttcatttcgtccgtgaggagggaactggatacatgtgttgtacatacgcactctgacggcttgatcgatcggtaggttttttaatacatagatctaacagtttaaaataaggtagatcagtttgggtaagacgactttagctcaataatgcatactcttgccatagttactataatgtagccagttgagatccatgcttggcacccttcagggtatgagtgagagaaaatggaggtgatgaaaatagtttttttttatgtcttgagttgatttattatatagggtatacataatttgtttatggtgttaatcgatactactaaattttagtggtatatatataattttatcttttaaaaattagcagggttgatcattggactctacttcgaaaaatataatagcttcggtggtgtggaccacgtaaaaaaaatgctcaaactttgatccttttctaacatacaagttaatataggttttattttttttcttgtattatacttttaattcatcaattcatgtttgtggggattaatattggataaatttattaaaattatttgtgctaaatgttaatactattttgctgggacgacataaaaaagagatacaatgttgttacatgtatgtttttcttctagcgaatagtagtctcacgtatggacgtttgttttttctttatttttctttttggacaaatatttgtttatcataggaatagagtgtgcgtatttgtattcataatgtgcgtctgcacgcatttatatgagctcttgcgattgccttttaaattgttagtaaaaaaaagtatttttaaaaatttgactggaagagggtggagcaacgggtggcatgagacggcgccgtggcaaggagtgatcactacgtatatgctcaatttagaaaaaaaaaaccttagatctagaaagaaagagaaaacaaccatatgggacaagtcatatacacactcttcttttttttcctttttatatatcttgcgtaggtatgtacataggagttgtgtatgtacgtaaggagtgattagatggtttttagacagagggattattatcatagatctaatttaatggttgaaaaataatagatcaccgattttgtgtgtaaatcgataaatattatttttgttttattttacattctttctaattagagcatcacatggcatcttagaagcatttgtaggagtatagaaatgctattactcatagtcacaatctacctgtagtcaactattgtttgcggtggattagttgcattctctacttacctataatttgttgatagttgcatacttagaattgccctttatctttggtgtttgattacatacatactcattagatatcagctaaccggccgttaggtgtgttgtgtacgaatacctcttaagtaatatgacttggtgattagtaaatagtgacttatgtataaaacttacatatattgggataattgagaatgtacaattgatattttaggctaggattggcagagtatattgcattctacatattaagtttttaatacctaagtaataaatttaagacaatgttgtaaagtgcttataagattagctactccctatttaatttatttggctgaaattatttatttggtttttatctcaagagagtgaaaaagaaaaagaaaaaataaaaagaaaggaaggaaggggaaggacgtacactaacgatgtacgtacgtacatgaacgtacacgtacgcgagtgatcgacatggatgtgtggctttctgaattctaaagatgaattaaatatatttagtatttttagatgtaacggttaaaaatatgggttcaccaaattaaatgaaaatcaatggctagatattttaaataccacgtggcgatttaggagcgattgtaggaagtttaatggatttttagtatataatagatagatagataattggaagataatagatagagtagaaattcagatgtgaatgcatttctttctattctaggaagccaatgtataccggccgggcactgttacagaattaagtaaaggatcagaagaaaagcaaatattcagattaatcactccaacaaagacattgtttttttcttcaccggcagcatgcagatacttacagtgtcattttatattggaccactctatcagggatagaggtagtacgcttttgttcagtgtggccctttagcatcagtggcccttaagaatcagtggcaaaacgaagattactgcaaagggccaagaaaaccaaaacgccaccgcgacggtttgcaggccgacgattagcgccgccaaaatgtcccctctagacagcagcgcgagcgtcatccagccaagcatccaaacctcgaaatttatgtagaccagaccaacggcagcggcggcgtagacagcgatgacgagcttaggggcgacccgtgccagcatcacgtacgtcgccgtcaggaaggcggcgcccacggacctgacgctgctgtgcaggaggcccatggagagcttcacgcagcgctcgcggaaggcgaagtcgagcggcgtgtagccggcgtacatcaggctgaaggtggccatcccggagagcatgaaggcgagcgtgttggcgacgacgaacgcgtcgaaggcgcaggtgccggccaaggtcggcgttccgcggcgttcgccgtcgtcgtcggaggaggatacgtagcctccgggcatcgtgaacgttgcggcgaaggtcacggtgacgatgagcaccgcgccgatggtcaggttctgagctgcgtctttgtatatcgtggaaagctcccccctctcctccttctcaactcgcttttcgtttaagctgtcggttgggttgtcacccgatggatggttgccggccgtatgggtcagggacgaagacatcatacactgtggattctgcagcaacgtacaatctgtcttgttaattggtgtaactatctactctctccgtttcagaattaaattgcttcaagtttgactatgtttatagaaaaaaaaagtgacattttcaacccaacacaaatatcttatgaatgcatattcaattatagatttaatgaaactaacttgatattgtaaatattactatatctatatacaaacttgattaaacttgaagtaatttaactttaaccaaagtcaaaacgacttgtaataaacaggagtagacacatatactacagtacagtacgtacgtaccacgggataattcagacctttcagatggttcttaaagcgtgcaagatcaaccggagtataccccatgttatttttcacatctagcagcacccgcctgtcaatcagtaggaagaagaagatcattatgtcacaaacatggacggcctgatgcagcgcggtgttgccgtttccatcctgcatgttcatgacggcggatcgtaacccaggtgagaaacgagccaacgcgaccactgacggacacaggttgtcgacggccacatggaggaaactccggcccgtgccgtctcgcaaacccgcggaatcggggcagaattcgatcatcaacctcacggcaaataatccggctacaccgcccaatgcagcagccacatgtatcgggtatgatccctcgtcgtcaggctgatacacacaggatctgtcgtgctccagtaggagcttaaccatagcccgcatcgataaacgattggtggatgcggcgaaatggagtggagtcctccccttttcgtccccttgtttggcgaggccactgttccatccgagtatcatttctgtcggacctgaaattaatttggaattttcattcagccctaaatataaacctgaaacttaattggaatttttttataactgttgataaccaaaatttgacaaactaaaacatgtagagagtttagggctccaatcagggcgaccgattggatggaaaaaaaaaaagaacaatctaatgttgcagttaaccatggatcaaaatattcgctttcacgtataataaaacatcaaattttcaacaattaacatatatataatcctataagattttgttgaaaatatttaattgtttgtacacaaatgaaaccaaatatgattgttattgaattatcctagttgagaaatccaaagagtaacctttggtgctagttgatcttgttgagtgatctttgagagattctagttctatccaatccacccgctatcccactccattcagttgatccgtgtcatatggtaccagagtttagggtgatggctagtcatcatcatcatcgagagaactccgacaatgacaacgccaaaggggggttaagcagggggaccctatctcaccacttatgtttgtgctagctgctgacctccttcaatcaatgatcaagaaggcacataaaggaattttcactatgccgataacaaaaccagatggtaaatttccagtgattcaatatgtagatgaaaaagacaatccaaaaggaaatcttttgtcagaaagggatcttacaatcttttgcccaatcaacaggtcttaaaataaactatcacaaatcttacatgatacccatcaatgttcctaaggaagataaggaaattttagcaggaacatttggctgtaaaactggttctatgcctttcacttacctgggactcccagtgggaacaaccaaacctagaattgctgagtttgcccctcttattgatcgagtggaaagaaaactaccttgcgttaattacaatgttcttaaaccatggtcagaggttaagcttggttagctatgtactctcctctatgccaacaaactatatgtgctcacttaagctacccgaaaaggttattgaacatatcgatagaggcgtgagacataatttatgaaggtaatcttctaatttaaatgtgggacctcagtccttagcagcatgggacatggtatgcaaacccaaaaacaaaggaggtttaggcatcatcaatttggaataccaaaatattgctcttctaatgaagcattgtgacaaattttacgataagaaggacctttccttagttgagactgatctggaacaagtattatcatagtggtgaaccccaccagg

SEQ ID NO: 65226 - DNA, 9105 bp, Oryza sativa
tctttcaatccaagcaaatgtattccctgtttttctcacatctacagcgatcacttgctatcaaaatgatctggaagagtaaatgcacagtagtcttcctaactgcttttgatgaatagactaaatacgagataaatgttgcaagaagcacaagtaaaactccagagtggaacaaactgtgtaatgtgcaaccaagcaagtccagaagatgcccttcatctgtttttcacctgcttgtttgcccagcaatgctggcaatttttgggaatccactgggatttcaaccttgaatttatgcacatgattcttacggtgtgtcgagacttcgcgcaaccttttctcgttgaggttataggacttgcatgcgcaatatttggacgagaagaaataatcttatgttcaacattgctccagtttcctttctatcctggaaaaatggcttcaagggggattttgatcttcatatgcatagagcaaagatatctgataaaccactctagcaattatggattagctcacttttttaatccaatttttattttccttttttctctgctgctcctcccctctacatattcctgtgcattccccccttttccattttgtattttatcctttcattaatattaatgtagtaggagcctcttcaactgttttacgtcaataaaaagtagtaagcctgggaattaaggaggaaaatgcagtaggcaaagatgtccagtgttttcgatacaagaactgaggtcataggatgcaagattgtccaaacagacataggcctcgttttttttttctccaacaaaagttagatgaaaatttggatattcgtggcatgcttttcaaaccgctaattaaatagtatgtttcgtgcgaaaactttatatatgaaagttgttgtaatatatcatataaatctatttttcaagtttataataattaaaacttaattaatcttacgttaatactatcttgttttaatcttcatctacagcacaaaacaccaccatactcttgccatagatggcagaaagtgtaatgttggccgtaggaaaaaggttttaccagaatgacatcccgtacgtgagatttggtaaaatgctacttttgaaatttacgcaacactctataatgcatttttctcctctttaggtgttttttttcctgtcttgcattgtgaatgaacgaaaatgcccctcgcgctgtgttgaactgtttagaggggatcgttctcttcctctccacccgcagtgcaccaacgagcttgagcagcctcgcagccgacacgatgccttggtaccagctccaccacgagtacaatggtgaattagtgatgttgttatttagcacaaatacgtttctaaagcacatttttttataaaaaaaaaattccatctagaaacattcatccgaagaacttatatcaaaaaaaatttttttgtccaaaaacaactttcaccgaagaacttttttcccaaaaaatttcatatgaaaaaatgtgtattcttaatgcacatgagccaaacaacaatcctaatactatggtgtgtctaggagaatgcattgatacaaaatttgaatatggagtgaactgagcatagctcatccggtaaggtccctaatcactctaattgaaaggttaataccaaaacacgctgtcactgggccacgtaattagaaaaataatagccgtccgatatgaaacgcgagaaagaaagccgttcgatagagtaaaggaaaattcctgatggtgagtttgtgacacttcaggagctatatgcttcgaccggaacactcgcacagaaggtctcacatgatgcactgatgctcacataaggcggcaagaaaagaagagatggcgagatgaggaggtgacgacgacttgctgccttgccgccgctaggctctctcgagaactgtcacagcactactggagaaactatctttgttggtcgacccaaatctacaataatcacggtttcattaaaaaccgggactaaaaaggatttgggccgccaaattgagcctcgatgcctatgatttggcaaagaagctcgggatcatcagggtttgctgcctctcctcgatcgctcctatcgtcgtgtcgtacgtgctgccgttgtcatcaccatcactgccactaggcacttaaggtctgtgtcttctccatcttcctcgcacaaatccaatccaggtgaccaaggagctcaaggatgggtctaggcgcagcctggagccggccagcttcattcttcttccccagcatagatccaccgctgcaaaactcgagctgtgcctgctactacaggacacgagagggatggagatggaggcagcaatgtcctagatgctcagccacagcctgttcctcccagcctgctaatagctagatgcgcagcaagcaaagcaagagaagagaatggggacaggatacataaagacgggtcaaattctcttgctggacaatataagggcatgcacaactctcttcgttgccatgcaagtaaaattgatgacgtggaagagagaggggaaagaaaaggaaacatagttgctacgcatgacaatggcttaaagtcgactcttaacatttattaatggaaattttgttgcatggggatggacaaaaggaaagaagggtagtaaaataatattttggtgcattaatggttaagagtttttgttgtctcaactattgtaggaatatagtctacaagttatatgtattaattgagagaacatatcagactctacatttgtacatgccctaatggtgcatacgtaactatttaaaaacaaacttttcaaatcaaaattctcaatgatattaaaatattacttcttttatctcaaaataagtttggtttttacccatcgcacacataccaatacaaatcaaaagactataacatctccactttatcaaagcttaatgcaatttttactctatttatctactttccatacatttatcatgtactttcacaaacatcaattcaatgattactaaaaacaaacttattctgagaaggaggaagtataagagtaggttaagggatgcatgatggagtattggagaggacggtaagactatcactaaatcagcattaaagaagaccgttatatatagtcacatagatagaaaggggaaacagtggagaagaagatgaatagaaactctaaccttaaccattgcacactcactgttttgtttagctcaaagctcatgcagcagcgaagagggcggatatggtcgcgcaaataaagaataaaacaatgatggtgaaggtgaatataaaccctaaccctagccgatgcaatcattgtcttgtgcagctaaaagataggtttcacatttcagattacaagtctatttacaataatattacaaataacatgtttcaaaattcaaccaagagggaagcaatgatcacgcaatatgtttggtaaaatattggaaactataataattttctcaagtacaaatcatgataaatttgttaatgtgatagtgacacttctcacaaagtatattattagtggataattacaaaatttaagctaattacttagaaaatgtataaacaggtctaaacaacataaaaactaacaattctaataaagagggaggtcatagtcgcgcaaatatgcgacttataatagactagtttggtgtgaaacatgtatgctcatctggtaaggtccttaatttgtggtgacacatgttcacccaaatttaagtcctagacacatgtcgtatatattagttcagtctttaaatgtcaggtgtgtgtatgcatatataggtatgagtgtgtgctaatttatatgattacatttgtctttaccaagtttcgaaaatctcgtgttttggcgggcctacatcatgttaggactgacatgagtcggtatatgtgtcgatttaataaaacgacggaaatacctttatctctactattgtaaaaattaaagatgtttttatcggtacttttggtacgccatccgtgtttgaatcggtttttaagttcaatcgctttggaaatatagatccgtgtttgagtcggtttttaattttgttcgtttttagaaatatagaaggagtcgtataagaaatctctttacaaacttgcatgctaacttgaaatgatcgaacccctaattgcggcttatgattttataaaaagaatatccaagtgaattcctacggtgaatttcaccttagctaaaccgtacaacaataataagattaaaatactcttcacccgttgtaacgcacgggcatttttttagttagaacaaaagctagcttatgtgcaccttgaaaagtaggagtataatcattaaccaacgacggagatattacggaactaatttataatccggatcggctaaaactcacctttgccaatgagcaccgcgacatgcaaagcgtttcggccttgaggtccagagtaggacagctgttcgtccctctcgtgcagcttcttcgcaacctcaaaccgtcgcagtgagatggccaggtacagcggcgaggtgcctccttcttctcctggaacacgggcaagctccggatcgtgggagaggagctcgtcgacgacgagatccctgctgttcgagcggatcgcctcgtgcaaggccgtctcaccgcgcttgttctgcgctctcaggaggagctccaccgccgccctctgtctccgccgttcgccgccgtcgtcgtggtcgtcgtggtcgtcgtcgccggcctcgtcttttgccatggcgatgaggcggcggaccatgttaacgctcccagccctggaggcgcgatggaggggcgtgtcgccgttgctgttgcgggcacgtatgaggtgcctggctgccccgtggatcaccccggcgcagtcgaggaacacgtcgtcgtcgtcgtctccgcatgccgccgccaccgccgctgccgccacgacatggagcgcggagtccccttcgctggtgactccctccaggagcgtgttcgcagctgcagatggcgccgccgccgcaggccggtcgacttggaggacgacttgtggcggtggctgtgctgtgttcacggcgaggaggcgttttagggtctcgatgtctccatgtcgagcagccatgagcagcttaggattcatggtggccggcgcagctggtattgcgttcatctttgagctagctagttagcgctctctatgctgcctctctgtgaattagacagtcccttttcttatacaactgacggtgtctttagctaatccaagattactataagtgtgataaccaacaagtgatttgtttacaactatcctgttttaggacaagggacaaaagtaaacttgttatatatatgtatatatcatcaatcatcgatggctacattcttcaccataaaatactgaaaaaacaggaacgcatcgttcttatactcgttcagttatgtttaaactagggccgttcaactgatagctatagttgataagtcattaagtcacatcacaataatttgtaacaacaaagtcgcactcacacaagtcgtatatctgtcttcaaattaaggaccacttggaggtcgggagtaaaattgaacttattgcggcgtgacctcgaagacatgccaatatatagagaggttgggtgacaggaaggaacaaaaattacaatttttattgtaactaggaaggtagtccgcgcattcgcgtgggcatgcatcgtatgctaagtttgaaatagttataaaatctaaatgttaactggagaacatctgccacgatttctccatacatttttttcatcggcattaattgtttcataattttctaacctattagctgtatattggactatcatctttttatattcttcctcatcatttgaaaagaaggtagacttattatctttagaaaacatatcatcacaagtaaaagtaaggtgttttttaattgcatatatattatgatagtttattatgggataaattggggactattagggaggacaatgagaagagtcagggagacagagaagatagggacgatcaacaaaagaatatattggaaccgtgagggtatcattgcatgttttatttagtggagacacattttttattaagtaatttgtatacttaaattatactatcaaattttagtagtatataaacatttttcgtcttttaaatttgatgactgtagttggttatttgacacattgaaaaaatagactcaaaacacgtcatagacacattgaaaatacgtagaacatcgttatcattgttatcatggatctaatttagctacatatatgtttctagattaatacagaatagcacatttgatatcgtatttattgaaaaaaaaattcatcactgtcttgatgcatagcatatcacttctataattaaaatatagttaacataggtcttaacttattaatttaatcacaaatattataaatattcaaaccagttggaaattagatacacagttaaacagttatatttatttgaatgttatttttaagtagttaaccacggtatactcttgctctatgtacgtacactatattttttaactaacttatgtgcgtacacttagagagagcaaaaaaaaaaaagttcgttatttctggatcgctccaaggccgaacataggcctgttattttacaaatctaatttaactatctgacataaatagtggatccatcatctttagttgaaatcgacggacggatatttatcttttttttcttttttgtaacttgggagttataatctatctaattaatattttttatttatatattaagtgttagctagaaaaatatgaaaggtcagttagaaaataggagaggagaagagatacggaggctggatggagtacggattatgtacgtgcgcaaatacggtgcggggtgttgtacaccggatttttttaatagagatataatggttaaaattaaagggtccacctattcaaaggaaaataatgattagatgtatttcttttctatcagaatttttaagattttctctactatattagagtgccatgtgacggtttaggagcatttgtatagcaccacgtggcggtttaggagcgtttgtagaggatttctcaaatttatttgagatccacgtagcggtttaaaagcatttgtagaaagtttaatgtactagatagatttagaatatggtttaaagaacattgattggatatttatatagatctttatttaactaaatatatttatatttgtgaagtaatatattttatctaaaatcatattttaaaaactgttgatttttatggaattatgtgttttctatcttttttttccatgtgtatgttttttttttttttggttccagcaagattaggaaaggtcatgtacattaagtttgtacgtatggaaagatcagcagtagtatcatacaaacacatacgtacagatcatgaggaggttattattttttaataatagatcaatctaatggtgtaaactaacgggaccatcaatttaagtgaaaatcaacggtgagattagataatgccatgtggtgacttgggagagtttgtagagcgccacgtggcggtttaagagcgtttgtataggaagtttcatggattttaggatataatagatagatagattttggcacgggcatgctatattccatgggtacatactgataatttgttgtaatttattattctattaaggtggttgtaatatttactcgaaccactagcatgccgtacattctagtgggatgaatcatccgggattcatttactcgatttttgctgggtgttttttcatttgctcgatttttttttctgggggagattttttcctggtttcctcgtgctgcagttatattttcagctcatggaagaatcgggcatttaaccaagtatattttttatttcttgcattctcttcctgtcttccacctaaatagcttttttggtgttccgttttgttctttcgtagttaattatttgagagttctgatagtgaagaggtcgaattgagacctcctctgcatccttttttttccccagttgtttgatttttggattaatcttggatttcaagaagtgaccgaagtcatacactttgagattcttcagaattacaactccgaaaattactttggaacacgagttttggtgacgttaatcaaagctctgcaaatgtcagtctcagattctattctgctgagcagtctgacaccttgactttcttgtggaatcttagggtctgtttagattcatggactaaagctagtctctatcccatcggatgttaagacactaattagaagtattaaatatagattaatgacaaaacccattctataaacttggactaattcgcgagacgaatctattgagcctaattaatccaccatgattagcctatatgatgctacagtaaacatatgctaattatagattaattaggcttaaaattttatctcgcgaattagctctcatttatacaattagttttgtaagtactctatgtttaatacttcaaattagtgttaaaacattcgatgtgacaggaactaaagtttagtcgctggatcaaaacaccaccttaagaaacaactcctgcaagttatttgacaaatttgtcttagtggagtgaaggcctagtaaaataccagtataccaccatggaacaatttggtgctgattttatttttaaaaaaaacttcaaaagagaacagggagttcctgttttgtatttattaagaaaagatttggtctagtttttaagggaaattaggtgctaaaatatagttatgtgcaaatacgcgtgcgtccttattgttttgactgaacttgaaaaactgtaattctttcatgaaaaaagatttgtctcctttttaatcattgtcattacagtttaatcactctgatattagcagatttcaggaattagctacctgcaagattccaaaacattctgtatttggagcaggtttttcttgtaattagctacttagctgcacattttacgtatatttcgccccacattccaaaacattttacttccactactacagaagtggtctttccatgcgggcgaaaaggattttc

SEQ ID NO: 65227 - DNA, 1507 bp, Oryza sativa
caaaataaaagttatagatctttatgagttatacaactttgttgttgatgactttttcagttgaaatcatttactgcttcaaaatattaaaatgttttgaaattcaaatttttaattgataaacacaaagtcacaacaaaaagtgcccaaaataatagcattaagaacacaataacatgatagagcatgattttagaaacatttaggaaaaagaatcatccaatttggagttcatatgagagagatacactagtttcaaattttatttttgcttacggctccttaagacgcccgtatggaaaaatcgatttttctatgcgggcgcttaaatgagccgcgtgcaaaaatgaccttgttttttcatgcggatctcttaagaggcccatttttccatacgggcgtcttaagcagccgtatgcaaaaatgccgttcgatttttgcatacaccactagttatggtccccatggaaaaatgatggggcctcgtacagaaaaatcacttttgtagtagtgttctgtgcgaacacagctaagtttcaacgaggaagacatccaatcatcgcatgggacattaagcagaaaacacccactgtttgagtatcacggatctgactaaaattttgttgaaagtccatcatcatgtgcataatatttatgggtgccaagatttaaaccctaatggatgaagtcatgtatctactactacaccatctcatcactaatctcctgcttggtattatcttcccatcttagcaatgcgacctcctctgtctctttttcccgtcttccacctaagtagcatttttggagtaacttagaagtttcaacaaatgaccgaagtaacacacttgttctttacaactaggaagatagcccgcttgatgcgtattagtttgttctgaaaatagttctaacaaaattaattgaaattaaagtaaggtgttttctattcttaattgtgtgttgaatgtatctcttttttctgaaaaaatctcgacaaaattttattggtaataaatgtattttttttaccaccatgttagccctctttttgattgcttcatatatatgcaattcattttgcatgtgaatcaataaagagaaaagttcttaaaaaaatatttattgtattttgaatttaatgattgagtgattctaattttgaatttttattcaaataaaatcattattttattctaaattgtcttttttaggattttaaactgtactttaatatcgtatcgtgttgtatttggactcttcttttaatacttactttattattccaaatttcaaatatttataacttatacttttatatggattcttatattttatattctacgtgaaatcttgttatatttttatagttttattattctttttatttttgaatgtgtattttaataaaattgcttgttttatttttttctgaatttaattacgaactccttgtaggccttgcggatcatctcgtcgacgacctcatcggtgagcctctcctgat

SEQ ID NO: 65228 - DNA, 3861 bp, Oryza sativa
tcaggctacaaagcgagagtactgatctaaagagtccaacccttcatccgtatctggtccccttacttttatagtccaaggagaggctcacattattataaatctactctttgtcttgtcttatcagcaatcttgtcgttgctggctggttcctatcacaatatttaagaaacccttcgagtcgtgcaattcgtattacctcgggatctgtctgagacagttgggctctcgccagtgtgctcgtacatggtgcatggtgggcctgacgagacccgacctgcccgaaatagcgccacggttgcttctttgcccgtttggctaaagcaggtggtgcagggcatgtgcgacgcgtgtccaaggcgtcaccggtcctaagtgactcagcgcagatgttttgtccacgccctttcaactctagactggctggggatcccccataaacttgtttcatttatggcggggcatgctacttcacagctggctgtggagcacgcccaacttcccggcaagttctgatgccgcgccctcccgcgtttaaagaagaggtttggttattctcggatgagcttcttgaagatgtcgttgatgaaggaatattctaagattatgtatcttgtatgtctcgacactcctctaggcagaggggcgtgagccctacaaggaccaaggtgagcccgaggcccggaacaaggctgggcccgaggcaaacctcagtttaaacctttatgtttggtatgtctcgacagtcctctttctcgagtagtgcatgaattgtgcatgatgagtttatactcgaggaggaagactaccctgtcgttgactacgtgttgattatccatgccgccaagtcgataatagctagataggttacccaaatattatacttgtgtgatccagatgaataaagagcaacatcagctttggccaacaggagtataaaaagagtaaatttcacaaaactacagatactatgaacaaactaccacaaaactacagatttaaggagttatatcacaaaactacacatttagcactaaatttatcacaaaactacatatttaagatgaagtgtcacaaaactacacgtttagtaactaaattattataaaactacaggtttagaaccaatttaatcacaaagtaataatgtttatagctccaccataacaatggtgctagggatttaaactccaaaagttgtagttttttgataagttcaatattaaatatgtatatttgtgatacttaatctaaaatctatagttttgtgataaatttggtgctaaatgtgtagttttgtgatataactccttaaatctgtagttttgtgataatttggtcaaaatacctgtagttttgtgaaatttactcgtataaaaatccttgtctccatctcttttacctcaatcttgcatatacccttataccaattgtcagggttacgggttaggcataccctttacccttcgatatacattacatatcggtacggcatacccacgcgcatacggatatttcttgcgtacactaaggaaatccttcacggagtctacggatgggaagagtcctactcggacaagactgggtcatcaatgtatcgtatagggtctattatctccgagttctacttggaaaccgcctgacctgcgatataaaagggaccccccggggaggacctgaggcatcgaatctcagagccaacacaaccctcacagcctacgaagtcggagcctgcaaggagccgaatcaccggggatctagtcgagccaactcgaccacgatctcgccggatccgtcaagttccattgttccctttgtaacctgttttttccaccatataatcccacatcaactggattagggctattacctaccaaggggcctgaaccagtataatcctcgtcttttgtctgcttgatgtcgtattacgtagatcattgtatcaatgtaccccaataccctctatatccggtctacgggtaccacccgtcgacagtggcccgccaggtaggggtattggctatcgatgatgtcggcacatcagcgcgcaccaatgcagaagcggagaatcaattgaccactccagcccagcacatcagagccgtcaacgctatactgagggaaaccccctacgatcccgttctgaaggacgatcttgcgcattggacagaacaattacgggaatcagtgaccaacctcagcaacgcattcgaagaggccgctgccgcagcgcacccagagcagccaccaactggcgatgccaatggtgaaaaccctgaatggagggaatcgcctcagcgacctacccctccacctcgcggcactggcgatctctgagatcacatcaacggtcgccgagaggcacgacgcacatgagacaacgagaatcattcccgacgtcatgtctcttcacggcgccatgataacaaagatcgaggagaccgctcaaacgaggaccgagaccgtgataactgccacaaccaccacgatcacaacgatcgcgaacggcgggtgccagacgatactagtcgaggacgtcaccataacaatgacgatgatggagaccggcgccgagacaacagcgggagacgacgacaggattctcgagatccaggccgacatcctcgtaatcgtacgccggagccaagcgacccatcgtcatcgtcctcgtcttcctcatcatcagacagacatccacgaaggacacacgatcgccgacaaccaaccgcccccagcgctgggtgtagggctttcagtcgtttcctgcgtgatgtctaatggcttgagagattccgacctggagcaatagaaaaatacgatgggagcaccgacccagaggagttccttcaagtctactccacagtactctacgctgccagagtagatgacaacgcgttggcgaattatttgccaactgcgctaaaaagctctgcacgttcatggctgatgcatcttccaccctactcaatctcctcgtgggcagacctatggcaacagttcatcgccaacttccaaggaaccgacaagcgccacgcgatcgaggacaacctacatgcgttgacacagaactcgggtgaatccttgagggaatatgttcggcgcttcaacgagtgcagaaatacaatccccgaaatcaccgacgcttctgtaattcgcgccttcaaatccggtgtcagagatcgctatactacccaggagttggcaacaagacgcatcacaactactcggagattgttcgaaattgttgattgatgcacccacgcagatgacgcgctaagacgcaagaatgacaaaccgaagaccgggggagagaagaaaccagccacagacgcgtctgagtcaagcaagaagaaaaattgcaaaaatgggaaaaggaaagctcaagcggaagtcctcgcagcagaatatgtcaagtcccaaaatgactctaaaatacatcctctaaattatgcctagaataattaaaatccgtgtgaaagcctccaaaaaaattaaaatgtgcaaagttaaaagtcaactaaggcttggaggatttttgtatatttcctaaaagcctaaaatgcataaataaattttagtgcaattttcagagcacaaataataattattaagaataaacaaagttaaaatggttttataaaaagaaaaaccctaaaggtcccctttccctccctcccccctcttgggccggctcggcccatctccctccccctctctctcctctccccgcggcccactcggcctctccccgcgcgcgcgccgctgacgggcgggcccgcccgccgccctcgctgacgagtggggcccacccgtcatctactaactcccgccgctcccgccgctccgcccgcgccaagcgcc

SEQ ID NO: 65229 - DNA, 8056 bp, Oryza sativa
gctctctctctccgccgtcgccgccgagctccggtccgccgccgtcgtcgccccggaccacctcccacctcggcgccgcctcttcggcttcgccgtatcctcgccgacctcgtccacccctctgtttcgctcgccgaccaccggaacgccgtcgaccccgtcgacccgagccgcgccgccgccttcctccgctccggccgcctttttcgtcgtcgccgtcgacctagggtgagccgtggaccgccgcctcttttcccccttctcttcccctctctcggccgccgctccgccgtgcctatggctgccgccggcgaccataggggcgcgggcgccgcctccggccggctgcgccagcttggccgccctcgggcgcgccgagtggctgccacgtggggcccggccgtcagccgcccgcgccctcgggtgcggctgacgcgtgggacccacggcgccggccggtgtgagcccgggtgcacccggtccaccgtggaccgtgaggctgccacgtgggccccactcccgtggacccggtccgcgcgcccctccccctcggctgacgcaataaaccctttttaaattaaaatttaaatgaagaaattcgcaaatattcatttaaagagcatataaacttcaaatgaccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcgtaagatccgctcttcgtggaggtggaagccgacgtttgggaaagcgagcaaggcaagtcacatcatccttgaacatattgaatcccagtttataaaattattttgatttaaattattgcattaccgctttatttaaatttccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcactgattaattaggcaacattaggtggttttataactctagactttgggagtattctcaccacctggacactatggaatagttggattattgtggaattggattcacacctccccctctattcaaaaccctcaaaatggttttaggctgggctcggggtgcatggttttgatattagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtctttcgtccgtataccgtggtggtatgtggcacgtggttacacgtgaggaagatgtgtcttgtgggtaaagatgtacacctctgatcagagtataatctattcgaatagccgcgcccttggttatgggcaagccgagcaatgtacccaagttagtgttttaaattcttaaaacctgcttaacaactaaaatgtggaatggttggcctgggttggcttgggacgagctgggacccagggtcgggttgccagttcggtctgaatcatcgtaggccttgggttaaggcaggttcgtgttggttcacggccttgattaataatattgtatagctctagaatcgtgtttacaaaatagctttgagcaactaagtgtcttttaatgctgtttactgcaaaccgtaaccctttatattataacccccttgtactcccttgcatttatcctgcacttgtgggtgtgtcttgttgagtacggtggttgtactcagtcttgctcaatttttcccaaacccagaagtggagttcctggaagatgaaggctttggtgtctagctcgtgcctgccgtcaagtgcctgtggtcgtcgtcctagtcttccgctgtttcccgtttgtctttgtgtgtgctgggccttcaccgcccatgtaataaattaactatttacgcttccacttgataaactctgaaatgtatcaacttttggtgtaccttgcctcctggcacaaggaataatacacgcacgtaaggaacgcccgttgggttaattccggtcgtgacagaatacgcgaaccctcccaagcgtccagacccacagagtagcgacacaaagaaagcatggtgccccatacacaagacggacagacatctttggaagattgccttgttttcaaaaaatcgctcgagaagcacattgcatttgaaaaaggcaagcgagtacgcgtggtcgaaaaggacgcggaggcggttcctcaggaatcggattcagcatatccagactccgacctcgacgtttcagacatcttcggaggttccacaacgtactcctcaaagcgagaatacaagaaagtggaacgcgaagtctgttcgacatggcagggggctgcacccaagatgaagtggtctgagcagaagatatagttcttggaagaagaccaccccaagaccgccgtcatcccaggacgatatccgattgtggtcgaacccactattcggaacatcaaggtcgcgcgagtcctcatcgacggtggcagctcaatcaaccttcttttcaccagcactttggacgcgatgggaattccgcaaagcgagttgacaccaaccgatcaaccctttcatggaattactccccaatcctcgtccagaccattgggcaagattacgttgcccgtgactttcggccaagccaacaacttccgaacagagcagatcacctttgatgtcgctgaattcgatacagcttacaacgccgtcattgggagaactgcacttgcgaagtttatggccgcatctcactacgcgtatcaactgctcaagatgccgggaccgaagggaacaatcactattcaagggaacgcaaagctggcggtacaatgcgacaaacggagcctcgacatggtcgagcaaacacccagcccacccgccacgactgagccaccaaagaaagtgagcaagacaaacaagacgccgaaaccggagggtgcaatcaagatcgttccactctccagtgccaaccccaacaagaccatcaagatcggggcgacactaagcgagaaataggaactcgcgctcatcaccttcctccgcgataatgctgacgtgttcgcttggcagccattcgacatgccgggggtccccagggaggtgattgagcacaaacttatggtgcgacccgataccaagccagtaaagcaaagactgcggagatttgatccagaccgaaaacaagccatacgagaagagctcgacaaacttctcaaagctgacttcatcagagaagtacttcatccagagtggctagccaatccagtcatggtgcagaaggccaacggaaaatggagaatgtgcgtcgacttcaccgacctcaataaggcatgccccaaggatcacttccctcttcctcgaatagatcaactaatggactcaacagccggctgtgagctattgagctttctcgacgcttactctggctaccaccaaatcagcatggcaaaagaggacgaagagaagacagcattcatcacgccattcggagtattttgctatgtcaagatgccgttcggactaataaccgcagggaatactttccagcgcacggtccagtgcgcacttagcgaccagctcagcaacaatgtcgacgcctacgtcgacaatatcgttgtcaagaccaagacaagcgactcattgattgacgatctgcgggaaacgttcgacaacctccgacaatatcgcctcatgctcaatccagagaagtgcacgttcggagtaccgtcgggcaagctgctcggattccttgtctctggcaaaggaatagaagcaaatcccgagaagatcaaggcaatcgagaacatgaagtcgcccacaagactcaaggaagtacaaaagctaaccggatacatggaagcactgagcaggttcgtcgctaggatgggagaatgagggcaacctttcttcgctctgctgaagaaacaagacaaatttgtatggacacaggaagccgaagagacattcgttgcactcaagcgctacctatcaaaccccctgtacttgttgctccccaacctaatgaagaattattcctctatattgccgccatgccatattccgttagcaccgtcattgttgtcgagagagagaaagtacaacgaccagtctactacatcagcgaagctctccacgacgcaaagacaagatatccacagatccaaaagctactttacgcggtcatcatgacatcaaggaagctacgccactactttcaagcccacagagtcacagttgtctcctccttccctcttggtgaagtcgtgagaaacagagacgttgttggccgcattgcgaaatgggtagtcgagctgagccagtttgatgtccactttgcgccacgaacagccatcaagtcccaggtactcaccgacttcgtagccgattggactatgcctgataacaaatcagacaaccaagtcgacaacgaaacgtggacaatggtgttcgatggtgcactcaacagccaaggagcaggggcaggatttatcttgacgtctccctccggagatcaattcaagcacgcgatccacctcaacttcagggcgaccaataacacagccgaatacgagggactactcgccgggataagagctgcagcctcacttggggtcaagcgactaatcgtgaaaggggactccaagctagtcgcgaaccaggtgcacaaagattataaatgctctaaccccgagttatccaagtatctcgcagaagtcaggaagctagagaaaaggttcgatgggatcgaagtccgacaagtctaccgcaaagacaacatcgagccagatgacctagcacgacgtgcgtccagacgacaaccgctcgagcccggcacttttctggacatcctgacaaagccattagtgaaagaggtttgcggcgaagttagctcggacacccccgacattagctcggaggccacaaaggcagaatgcgccgttgccgatatcgagaccacagacgactggcgcatcccactaatcaaattcatcaatagcgaggagctgcccgaggacgatacagaggccgagaaaataacccgtaaagcaaagatctactgtatggtcggcaacgatctatacaagaaagcgccaaacggggtacttctcaaatgcgtctcatccgacgacagcagacacctcctccttgatatacacgaaggcatttgtgggtcacatgccgccggtcggacattagtcgggaaagcttttcaacaagggtttttctggccaaccgcccttaaagatgcatgcgacatggtccagcgatgcgaagcctgtcaattccacagtaaacacacaaagctacccgcgcaagcgctctagactatccctctgacttggctgttctcgtgctgggggctagatatactcgggccattcccacgaagacagggcggctacaggttcctattcgtggcgatcgacaaattcaccaaatggatcgaagtagtacccacgggggaaatcaaggccgacaacgccatcaaattcatcaaggggatattttgcagatacgaactaccgcaccgcatcataaccgacaacggctcccagttcatcagcgctgatatccaggattactgcatcgggctaggagtcaagatatgcttcgcctcggtctctcaccctcaaagcaacggacaagtcgagagggcaaacggtatagtactacaagggatcaaaacccgcgtctacgacaggctcatgtcacatgacaaaaaatgggtcgaagaactcccatcagtactatgggccgtacgcaccacatcgacgacgtctaacaaggaaacacccttcttcctcgtgtacggctccgaggccatgctccccagcgagctacgacatcagagtacacgagtacataagcattccgacgaggaccaggaagagcagcgaaacatcgatgtaaatctactcgaggaacatcgcgaacgagttgccattcgagcagccagctatcaacaggccctccgccgttaccaagagaagcgcatccgagcacacatactttcgatcggcgactacgtcctccgacgggttcaaagccaagcagggcgaaacaaactctcacccaaatgggaaggaccttacacgatcacacaagtcttgcggctaggcgcattcaaaattgcagacagcgagggtcgcaagttagcaaattcttggaacattgaccaactacgtaaattctatgtatgagtcaataccatccgtacctgtaagacaccttacagtatcaataaagcctattcttaggcccacattacaatcaaagtgttcccgcccgatgatcccttactctgatgacacctagcgttgaaacctatcctcatgtccctttacgccgtcttgacaaggcctccgaagaacctaagggatcttcggctggggacgcccagagccgataaggccttgttagatcctatagagatgaaagaccatgtaagatctggtcgtgtaagagttctcgccgtgcgtattaaccaagccgcgaaatcggaaattaactttctaacttcacggctgggggctaggatcagagcttattcaaccaaggcaggtcaaaagtccaagagccttatcctccgagaaaattcctccgacgacaaggctgggggctagagagagtgtacgactcaaacgattgactaaagtcgtgaactgagaaaacactcttacacacgacatccggagtaagaaagatttgtcaaagatagatttcttttcaatttcacaaaatacttcttacggtttttacacaaatccaaagttatattacacctttttcctgagatatctatcacagggtacgaagattaccaagaaggccaacgccaatccatagactggaacatcttctccgccaacggcgccatcgacctcgccaggtgatctatctcagctggagttttccgagaacgaacaaaaccctcacggagaaaatcgaggtccaggcgcgggcgatgatctcataggcaagccaacacgtgccctccggcatatcggctcgatcaacgacactcctgcttcaaggcctcgtcgatacgtttgccgacgccatcaagttgagtacaggccccattcagccacgagatgtacccagccgcggactcctcgggatccccacgaggtactcggagctctctacaaaccttggccatggatgtgcagcaactcttcaaatacgagttgaaccacacctcacgacctcggagcatttccacagcctgctctttcttcactgcaagcatagtcctctcgagttccgctacttcaaattttgtcttccaatattggatacgacaatcctggccagcaagagcactctcgagatctgcttagtgtgggaacgactaagtcaggctacacgtctcttccgagaacataggggatctagtcggagaagcaaaaagggatggatggaccactaacccaaggaagtggtcgccatctccgtccccgtagcaagggtttggtctacattgtcgggcgacgcatgtggttcgaatgtgagagctggaataatcgccggtgactcgggttgcccgcgctgctggacatccccgtcatcaacatctctacaagggacaaaaagctgtcaagatcaacatgcaagagtaagctagaacaataactactcgcacaaaggcggttaagatccagttttatacagggctgcaggaa

SEQ ID NO: 65230 - DNA, 2646 bp, Oryza sativa
ctagtataggtgacccgcaacgagccacggatttctgacagattgttcccgagctccgacatgtggtgctcgagcccctgccgttgtcgctcgttgccggccaccaactccctcatcttcttgaggtcttcacgagcctccgacaactcgtgtgccagccggtcagcccgctcgtttgccgacgacgccgtcaacctcgcctccgcaatcttgcgaccgatgccacgagcactagcctcgaggaggcgtcccatctcgacatagagctcctcccaagtgaggacggtagccggtagaccacggccagccgcgggatcgctgactgggccgcttggtgtcgcctcacggctcccgggtacgagcacgacatccgtcgaggccgcagcgggcgatgcgccggaggtccctccggactcgtcttgcatagccttcgtccgtgccgccctgtgagacggccatggttcagacaacactcgaataaaatcatggaaacttaagttcgtctacttacttctcgccaaccgtcacaaggcgtcgtcgttgtggaggcgggggagacgcgtccgaggcttgaaaaacggtcgatgcgaagtaaggcgaaattcttctggctgtacgatctgacgactggatagcttaccgagggggttgatgccttgcgacgatgtccgcttacagaggagaacttcctcccctttgtccgaacattgccaccacttgtagtagcagcagcagcatcagacgcctccttggcgaccttctctttcagagacaccgccacctgatgttccgcgagcggcccgatgatgtcagtcagaggaagagcctacgcttaatcaagtcacaatgtgatctcagaaggaaaacgcagaatgcctatcgagtacacttacattgatggcagcatcacgttcggccgcccttttctcacaaaggggaacggggatggtactcgccgttgtcggaccactgatcatcacctggccaacacgatgttccacggcttcactgttcaggcctatgaatcgagaaccaaattttgataaatcaagaggaacgcgaacatgagtatgtcaggataaatgcgagaaagataccccgaggagaaacccgggtcgcgtcctccggtctggaatagtcaaaggctggatgggctcgatcctggagcagctggatccgcttaccaacgaagtctgcagcgacttcataccccgacaagcctcgtactcggagatcgtcgataatgtcgataaacgactggagagagcgggtcaaagggggctttgcggtccaagacgaaatcttgtccggttgttcctcgggaacaacgaagacagggttcgaatctttgatctgaaggtagaaccacctagtccgccatttgctgcgagaagaagggcactggaaggggatataacgcgacttcaggccatcccgaagttggaacccgacgcaaccagacatgttggactccatccaacgcagctcgtagtagaagcgaaagagatcaagaaagggctctaccccaatgtaggcctcacaaagatgagaaaagatgctaagaaaggcgatagaattggggttcaaatggagaagagaaagaccgtagaagttccaaaccaagagaagaaattcggaaggcggagggagaaaaccgcagagaatatagtcttcggtcacaaccatgcgacctaagacgggctggggattagtacctcctgcttccctttccatggttccgcgaccgggatgggcgccgtcttcctgaagcttcttcagcgacgcactggtggaggatgatttgccgaggtccatcgttgatcggagatcgccgaagaaagggctcaggtcgatgaactagggtttcttgtggcagcggagaagacgcagagcgcttacaggcgggatgttttcttcacaataggcggacttcaaaatggatccccaaaattcctttaaatagacgcacttccgacagtacgaattccaaggaaaggggagagatgcccgccggagatttctgggtccgttacgcgcggcagttttttggacttcagtttaaattcactcatgaccgttgggcttcacacggtgttctcgactacgtcctgtctctacagtcctcacaccgggaacgacaatagtctcgacacaagaagtcgcgaatggttacacgagttcatttaagcagaagtcggggggctactgtcagggttacaggttaggcataccctttacccttcgatatatattacatatcggtacggcatacccacgcgcatacggatatttcctgcgtacactaaggaaatccttcacggagtctacggatgggaagagtcctactcggacaagactgggtcatcaatgtatcgtatagggtctgttatctccgagttctatttgtaaaccgcctgacctgcgatataaaagggaccccccgggaggacctgaggcatcgaatctcagagccaacacaaccctcacagcctacgaagtcagagcctgcaagcagccgaatcgtcggggatctagtcgagccaactcgaccacgatctcgccggatctgtcaagttccattgttccctttgtaacctgtgttttccaccatataatgccacatcaactggattagggctattacct

SEQ ID NO: 65231 - DNA, 5652 bp, Oryza sativa
cctcaaacgtcgacaatatcattttttttgtttcatgatatgtactgataaaccctcatgtttcattatttgtttttttttttactcctagctcgattgtcccaaaaaaatatatagaaaattacttaataattctcgcagcaaagcacgggaaatcacctaattttcttaataatcatgtctaacccaaaacttcttatattctgagacggaggtagtatttatttgctaataagctggtagcttatactcggcataggaccaaccgacgagggctaaactatggcatcatctctgtgacttgagaggtttagggttgatgatgacagaccctggtttcgcgcgaattggtgcagtttttgcatcttggtgtacatggagtgagtcgaatgcatcgattggttaacaaagatggtgaaaaccacgtgagatcaaaaggggatatataataaactcagtttccgttgttatttttctggtggatggaacttcagaactcgcgaaacacatcgctccatctgccggtcatgtgaaatctaatctaatatagaggaagtgacaagtgaggtgtttaatggaaaaaaaaaagataacccaacccttttcttctccatttttgaatgcaaaattattgccaaaatatttaaaaaaaagaaagaaagaaagaaaaggaagtcaagcaaaaagcaatctaacggccgggctatttggtaatgttccgtagatttatcattctttcttagtcaagcttatcaaaggtgaggccatcaaaatccaaaccataatttagccaccaaattaaagctgtcacaatttacataaattcttatcatacttatggatgtcaactaaaatatgcatctaacatgattatacttatataacaatgcataagtatgataaaatgtagcaatctgtggctatcaactaaaacagcctctaaaatcttctagtatagatgtcttcccatttcatttcttaaatatgattcggtttgaaagggaattaaagagaatcgaagattaacagaaagggcatttggttgccatcccatgtgcacagctacttaggagtacacattttggaacggaaatatgctcatttggccgcaaagaacaaaaaaaaagaaaaggaaaaagcacgccgactgacagccgtaccccacatacaccctctgctcatgccctgccccacatgtcagcctcacgccgcccgtgggccccaccacaccgagcaagtccaccttcctttccaaatcccagaaaccgaagcgcgcagccgcaagccaaaatttgagggatttttatctctctctgttttcttttttttaatttaaatcatcattccgttccccccatctccgcgtcccacggtttcgtattcgcgaaaaaatcttacccgccagcgagcgcgcggccgtggcggcgatcgcattggcggcgacgcggcgagctccaatcccctcctatggcggagggggagggctcctcttccaggtgagcgcgcacgctgccctcccctccacaccccgcgcagcacacgcgggcgctcgctgctcgggtcaagtctgatgcgtttctttgttcgttttgggggggttgcgatgcgatgcgatgcgatgctggggggtttttggtcgcaggaggtgggcgttgggcgatccggatgtcgtcgaggtgtcgccggaggcggcggcggcggcgcgttggagctccgcgcgcctgaagcggaagcgcacggaaggcctctctgctctctttcttcttcttctactttcttttcttttcttttttctttttttctttcttttttttatttttgcgtctctgaatcttgcaagggtttgggctgtctctcggtagggaggttccaatacgcgcgtgtatcagcattgggaagaggattggaaatggcctgattctttttttttcttttcttttgggtgccataatgtgttgtatgcctgttataaaacatggaacttgcagtttgttcattcttgattgatcaatggaaatccaattctgccatatagatcaccgcattggcttctgtagtgattccaccaagtctattgtggtggctggttgtgttcgtgtaatttatctgtcaaatgacaagatataccccatgctgaatgtggagtcgttgggtgtaatccaacttatagccattaggcatatcctctcatgaaagtagcaattgtttactggaaagccagcacaagtcatacatagttcactttgcattctgaagtatgtttttgtatcccatttccctttctatgtgtcttttgattgttcctgggaattagtttgtgccacacaagccgtgttacgacttttaaggtccatttcacgaaacccctccgagaaataacagtttcgttattgcaactttgagtaagatgcgaagaatctaatatgctatatgtttaatcaacagactgttgctcacgaaataattgatctcgacgccaatgatgatcctgatggagttatgataatttgtgagaaggcgtcgagtcacaagagtaatcattctgttagtcatccttcggattggccaaagcatccaaaggttaattcattggagtgtttttgtttaccattgtttagtgtgctatgctaacagttgatatatctttctccattgagtaattctagagtggcttggctgaggatgttcctggtccaagccatcaacctggcacgagcacagttctaccatggggatgcacaactcctgggagaccacggaagcataaggaaattaaaaccgtggataataaaattgatgagaagtataaggcatttaagcagtttgatactgttaccgaccacagtgatcactattattcaatgtcaggcaaagggaatgttcctgaagtcaagaaggtatgagtttgcacgtgcacgtgctctatcttcacttgatctctgcaattaaatgtaatcattgttttttggcagccatccaaggactgggtgaggcggattcaacatgaatggaaagttctggagaaagatttgccaggtagagctctctgttcttttatggtttatttactccagatgttgcacatttgattaagggagtgctcctttttttccccatactattgttcttcattcctctttctgtacacgcacattaggtgagcaaaagctctaatacatgtttacaataaaatatgaatccgtttttcataatgcatataatgaccttgagtatattctctgtaacttctattggatgtagctggatgttaaaactgaaatgcagtagttcatgtcctgactgcatctttcctccatattgagcaggtacaatttttgtacgagtttatgaggataggatggaactacttagggctgtcattgttggaccggcaggcactccttaccatgatggacttttctttttcgatgtatatttcccttcccagtatcccaagaaacctccagtaaggatttgttaataatgtcatatgcatccataaagctttgttattccttctctctattctgagcttgcatgtgtgacatataattggctattctttcagctagtgaactaccgctcgggagggttgcggcttaatccaaatctctatgatagcgggaaagtctgtcttagcctattgaacacttggtctgggcatgggtgtgagaagtggaacccatccaattcaaccatgctgcaggtcctagtctccattcaggccttggtgttgaatgcgaaaccttattttaatgaacctggttatgcagcttctgctaacacaccccagggggagaaaatgtccatggcttataatgaatcgacatttctcctatcctgcagaacaatgctgtattctcttcggaatccaccgaaggtatgactacactacgcttacatgttttccttcctatttgttgtggatatatatgttctattctttttcgcatccaataatctttgttgtcatttctgttgatgaagaatgcctaatcgttaactgtttccattgtaatggtgtaaataatgtgtctgcccgtttggtgaagaagattaatatgctgaattgttgataaagatgggtgtgatgaacctgtattgttttgaatggtctattttgctttgccatgcgttgatgcctgagttccttacataaagctgctgaataatccgggtgcaacttttgcagcattttgaagacttcgcaagggttcatttttgcaagtaccggcgcaatatcctcgtaggatgcaaggcctacatgaatggtgcccaagttggatgccttgcaggaaacggagtgcaggatgttgatgaaggcgacaaaagctgctcagcgaacttcaaaggctccttgaagacgttatttgatgaactcatcaaggaatttacccggataggagttcattgccatgaattccagcctcagagggtgaatcctgggtctaccagagccaaggcggacaccacattgaggctatgataatagtaacgataggtggtcaacatgaggttgacaattttttttttgtttcttggggatcagagatatagttgttggtgctatcctcagaaatcaggaggataggagggcaaaaggcctgcatcagatcatgtccaattatctaaaccatcatgcggttagttggtttttgtgtatatccctgttaaacatgtgggttctattcatctaagaacagtagtttaccacattcatcaaagggccatgctggtgttacctgtttaccttttgtttttgttttttttttttttttggtcaagcaaaaaaggctgtttacgttttgttcgccggttttggtgtccgcattgagcgtgaagattgtttatccccgccgaagaaggcgatttgctggagctagagataatgccggaaggagagattaatttacaaattaatcttagtccatagagtagacgatagtcaatcgttaggattggcttaaatccagacgatagagatgaggccaaactccagagaatcgattggcacatggattaggctgtgataactgataagggtttgtaacttgttccccgcactaaaaacaagacagctcattagagtattaattaagtattaacttaaaacaaattaaaagaatattaagttaatttttaaaagaaactttttatacaaaatacatcgcttagtgcttactagctccgtcccaaaatataacaactcttgactatgaatctagacacatattattatccagatttatagttaaaaatatttatattttggcatggagggagtacctgtgattccaaacacaacccgtagagagtagagatagtagaggtaagcagtgttcttgtgcttgaataagttcacattaggtcactctattggtcacccagtctaattttcatcctcagtccagaaaaccggatacaatacatccctcaactttacaaaaccgtgcagacgagatccctcggcagtattatatctggttttggatgacgtggcgcctacgtggctggtttgactagatcctcgtcccacgtggtattgacgtggcgcttccgtggcaattggatccctgaaaaataataaaaaaaacatgggacccatatgtcagctaaaaaaattaaatggtggggcccacatgggccccacat

SEQ ID NO: 65232 - DNA, 3797 bp, Oryza sativa
ccgccatcactgcctgcatcttcgtcttcctcctcgctcccaccgcgcagcaaccgcggcaagcagccggcgacgacgacgtggagatggccgaggggaggaacaacaaggtcgccgacggtggcgggttcggcatggtgctgctggagatgctgacgggaatgcgggcgctagacacggggaggccggcgctgcagcacagcctcgtggagtgggccaagccgtacctggcggaccggcggaagctggcgtggctggtggacccgcggctggaggggcagtacccgtccagggcggcgcagcaggcggcccagctcacgctgcgctgcctctccggggaccccaggagccggccctccatggccgaggtcgtcgcccagcgccccccagtgctgccacgccgtcacccgctccagccgacctcctcgtcgctcagccgccgcccgctccagccggcctcctcgccgctccgccgcccaggagcgggagagagataagagggggaggaggatagagagaggggatagagagaagatagtgaggacgacatgtgggtccacatgggcccactatttttattattcgtgtgtgcagctgacatgtggccccacaagttttattattatttttttatctaattgccacgtcagcgccacgtcactaacacgttggacaaagacctagtcaaaagaagccacgtcggcgccacctcagacaaaaccggagtcaaatactgtcgagggacattatttaaacggtttcgtaagttggggatccgttgtacccggttttgcgattaagggacaaacattggactgggcaataaatagagggaaccaaagtgaacttattcctctcgtgctgggccggacttcagtttaggcctgccgaagtacctaattgggctctctgggccagattatctgtaaattggagaacaggctccttgtggaaaagcgttagcttgagggggggaatttccaatttaactcgttgaatctgattggcatccctaaatcaaaacagatagaacagttcctccaagtccaaatattaaaaccgtgtagaatgactccgcgatgggcacactcgaattagtcttttagcatgtgaatccatgctaaactgggtagggaatcaaagattattcgtccaaattggttatgaccgtgggatatttcaaagcgatgaactgagcattttcgactatatatttccatgtcactcgagaaactagctcacattcgtatgattctaccgccgtatcgataaagcgactagccataatatttttattatggctctcatttcttctctctgcctgtttatccccccccccccccccccagtgctggaaatcaagcaatatccatattcaggaaacatatattttacctagcatctcactttccctccacagggcaggacaaaattctgaggtgactcattatcagtttttggccaaacttttcacatagagcaaaaataaacctgtggctgaaactgggcttactactcacatcacaaattgaaccatgcacataagtctcaggggcggttcaggtttatgccattttcaacataccatttttttttcaaagttaccaaaaaaatatctgcgtttagtttgttgccaaatttgataaatacataagaaatcctgccaaaattttagcaagataggctgcctatcttgctaaaattttggcaaggtttattttggctataatctgaacaggccctcaaatgaaaaaaaaatagacatataaaatccacacactgcaagaatccttttatctgcatgcaactccaattatgcgtatacaatacacacaaattggtctccatcaagtgttccaatcactcaccctatcagaaaagcttgagatatagtatgaatctatgcaatatttgtgctagtggtgtctatgcaatctttgtgctagtggtgtcagacccctcacgaaatccatgcagagcccacaaatgctacatcctattgcgttgtttgtggcgcttcggattctgacaaccacatgatggtggaaatttggagaagctggagaaactagcttttgacctctaaaaacaattaagattgagaattgaaatagatatgattgattgaaatggaaaaatatgtgagaaaaaactaaatttgaggtagatgtgattggtcgagtcgaggaagtacaactctatattttcattttgatgaattttaaactccttatcacggagggaggatcctgtatccaagagcgccgcaaccacaaaaatcagaagggtctcactctaaaacctcatgccgtgccgtcccattgtacggcgcctcctccgttcgctgaagagacacccagtgagcagtccatgagtgaccgatcgatcaacaacaattgattaactagataattattagtgattaacggcagtaacagcagcaacatgaaagctgtcagcccatgctttacatgcatgctgattaacaatgagcttgaggcacaatgaagttgctaattgcattgagtaattgtaaaggttgtttgattagcatttgtctcttctctgggcagataatgctgctggatggctttagcacatggaccctgatcctgtctactgcagtaggtaactataggtgcatgttcttctgctttggtgaaaagaaatggaaggaggttaattaatggagtcatggagagcaccatgattcgataggtaaatgatactctactacagtctacacactccatgttctgcttgattttgaaatgaaatttccctggatcataccatacttgagtcccctgttggatgatcctcatgcagaaaatgtgagggggaagaaggaagaagtggaagatacgatgaagaacagcaagagggactgaaaggaacaagaggatgagtccctcctccaaaaagatcctgaatccacccctaaccataagttgtcagcataaacttgcatgtttgaggtggattccaaaacttgaccaaactccgattaatcaactttcacgttccataacttggtttaaatttcggtctttctagacatttttgcatttttgtctccttctatgcattgataatttaaagcctgtggccggtgtcatcgctaaaagcggtaaaactccaaatatgtatcctacacgcgtggagtgccacctttgattccctacgaataatgaattttcgaagaggaaaatgtgtcattaattgtgagatattttcttggcatatgatttagttgagtattaatttctatagacttaaaaaaatgtgcttacggaaaatgagaaaattgccgtaccttgtccaaacgaagtcaaccttaggccccatttggcagtgagtttaggacggtatagctccggttccttttttttttttttgagctgggcattcctaacacataaatttatagatctacgattataacgataacatttaaataaattaatttatttctattaaaattttaaacatatatagttaatatataactttaaatctatctagagctatgccaaacaagatgtaggtgtggcaactttcttgttctctgctagcatgcttcacaaattgttaaacggtgagttcttttgcaaaaaggaaatactttgtatataaatgttttcttaaaaaatcaaataaacctaattttttaagtctgtaataattaatatttaattatcatacattggcttttctcattttgtgtcgtgaattatcgtagaacacccaaaacaaactactcccttcatcccataaaacaaactaataggagacgt

SEQ ID NO: 65233 - DNA, 1277 bp, Oryza sativa
ttcctgcagcccttactctactccttttatcaatatagctacatggtctgtctagatttattaattgtagtaggatatgttttatgtaatataaggttggatgaggatagttaaacggtaaaagtaaaggaaacagtgagtgccctttgaatcacatgaatacaaaaattgaggaaaggaaaaacacatgattctaacaagagcaaaacaaatgattgcaaaatatagaaaaacatagggataatcatttgattggaccgcagtaaaaacataggaatcagatgagagagataaactcaaaatgaaattttcaagaggtttaagctcttactaaattttctgtaaaatctgtatatgattgtttattctatagggatttcgaacgatgatataggattcaatcttttgtttcaaataccttcgtagaaaatttttctataaaatttaaatcctttaaaatttttatattttttcttcaaatcaaagacacatgaataacagccaactccaaagagaggagggggccaccaccacattgaagtcactagcccccaccccacccccccagagccagattataccggtgcgcaacgcatgcgcggggggacacacgacacgagagacagcgacgtgtgcacgcaccgttcgcgttatcgcacagtgattttggtgatttgattcgattcgccgcgcggccaccggtagccgtccgcctcctctggggctctgctgtcgccgtcgatcgatcggctcctttccgccaactgccgccgcgactcactttcactagctttgcactaacacaatcgatcatgcatgcacacacccccgcctgagaaaacaaaaggcgcgaattatttttgtgttcctctgttgcctgttgtggtttgtttatcttgggtattccggccaatatgagatctgatgggatcgaggagaaagcgacactgccatttcacatcttggagatgggaaattgctcctgagttctcactcaattattctgggaattgctaaaataattaccgcaaatattgttaactatgatataactgcactggaatttttatatagcttaagtacattttttatggaagttacatgtattttaataatagtgcaaatacattataaattatatttgaaagttttctgacaattttctaatagtcttatcatttttaatgtctttgaacttatcccttatatacgcacttgaatttttattttgattctcactatatgcattacattagttaactgttagttttattcaa

SEQ ID NO: 65234 - DNA, 2802 bp, Oryza sativa
tgaaaacaaaaattttttttagttgatttaaaattttggtgaaattgttgtatgaatatcattaaattttatttttatatttattaaaaaaggttgaattttcagttttcaatttttcagacaaataatcttatcttcttttttttaaacaaatgaatctttgttcatgttgagaatcaagttttttttttttaaaaaaataagctagtgtataagcaagcgagtgggataatatagtcattttgaaaaaaaaaaatcaatgactagttcacattgaactatgtaagattgagatctttccccagttttcccaactcatcttccttgtttttcgtccgcatgctttttaaattgataaatggtacgtttttttaaaaaagtttatatacaaaaattgctttaaaaaaatcatattgatccatttttaaagaaaataattagctaatacttaattaatcacgcgttaatggatcgttccgttttccatgcgtaggagatgagtttctaacccaaatcaatgaacacagcctaagaggtcaaataaattgatggtaaactcagggatatataaagaatttcttcttttaaagaagcgtaaacctcatttagattgagtgcgtgtagaatctttttcctgagttcctacaagaaataatattgtactcctacgtatcgaagtcatgcgaaactcatgcatggccttttcacgtttttcttgttaagaaaccccaaacaacaagcttctaaattaaaacgagcatcgcatgggctgtgtaatttggtcgcatgattgttatgttgggcattaatattttcagcgtttaaagaaattaacttgacaagctaatcactttcaaaactaacgatatactaaatcagagaagtagagagcgtaccacaaatgaggataggcatgcatgattgaagatttgaagagcacatgagaattatacttcgcttatttcagcataactaaaacttattattattattattattattattattattattattattattattattattattattattattattattattattattatataaccaatatctttgtctcgctggcaatacgattccaagctgtgtgtatttttcacatcagtttttttacacatattgtaacaaacctaaaacctttgtgtatttttcacatcctaattcacgctgacaacaaatcgacaaccaaatttaatttatagtgtcattgtccaggttcatcagtagaaaacaaatctcgccaaaccttgcaaataaaaaaacaaaaaaaaaagaaacaaagtactcatccggatataattataattaactcggcaatttggttcgacgacgtgatgaaaaagccgcggcgggcgcgggcgtgcgcagctacgcggcgtgggtgcgggggttaaacaagggaaggggtttttggcgtcactcgcttctctctctcccctacgcgccgccggcgagatgcggagcctcgccgtcgcgagccccctcccgcccgccgccgcggttcgccgccggccacgcgcatccgcctccggaaggttcgggacacatccctctctctcactctcacggccatcccattccgccgcgttgtgtgtcgttgttcgttgctgcgaaatgggtcgcgtgcgtgcgtgtgtgggtggtgggacggactcgcagaacggccgtcgcatttcaggtggacgtcgcgcgggtgggtttccggccgtcaccggaggggttgcggtcaccggcccgatcgccgcggctagcgcctcgtcctcctccggagagaggccgcaatggatgtggctggcgtgcttgcagttggttttgcatactcaatcggagatttgagatgttcgagtgatgggaggtggtgtagggaaatccggctgtgggtggtgttagagttggtggatgaggccgattggttgctcccttctctgctttgatgggatttattaatagttcatgaactgagagttctgcgtttcatctctctcgacgtaactgtggaatttctcgtacaaactgtttcagaattcagattatgcgatagttttagcctttgcctgtgcagagtgcagtcacggaagaagaaaacagacgattgatttcttagtattagtgccaaccatgcaaattcaggataagccatgagatcttcagatttcatactgttggcctcccaagccataattggtacaagactgatggaattcaattttttcctaaataccagtctccataagttgtgaaacaaatggtgggtcaatgaaatatttgaatcaattgtaatctggtgggcttcaacggagattagtttagtccatgtcaatttcaatcaactcattacatcatttttagataagatattgcattgttaacttgctgttactacttgttcactccatgcaacgtcttctgtacaagttttagcttatcttcttctcataacattgatgctatgctgcttggcaaatcttcagggaagtgatttcacaatgttggaagtgtgagataaatcaggaccaacctttggggaactccctaaggtagataattcccccttttgcagtgaatgctgctgtacattaataaagtacctttcaactagaactatgctgtcatttgacaatttcacttgctgtttagttgtaaaagtcattctcagatacagttgcattttcactgcttgctgtccgatcttctaaaagttattcaatacaatttttagatacagttgcatttgcactgcttgctgtccgatcttctaaaagttatttaatggggtgcaggaat

SEQ ID NO: 65235 - DNA, 2155 bp, Oryza sativa
ctgtccgatcttctaaaagttatttaatacattgttcctggaacatgtttttcagtctagtctgggacggagggagcagtaattaacttctgaagtcttgtgttatcatctgcattatgttctaggagtatatgataacgatatttcttcatcagttaatattccttttatcttgttactgtcttattcaggataggtcactcacaaggtagtttgcaaagacatggttccaggaatttgctcgcagctgctggtatatctgctttccaccatgcaagactattatttgattttcttatctttcaagaaattaaattagcactgccttatcttttctggaaatatttataatttatttcttaaaacgtggctgttaattcagctattagttgaaaaatatggattggtcttcattttgactaaccagggtgctttagtgatactttttattgttcagacttgctcaaaggcctgggtatggcaaggcacaagacttgccctgggccaatctaccttaagcttgatgcctggaaaaaaatagtttatctgcttttatgcaacagtgctagtttatattatgccatattgcaatacatacatagtttccttcccatatttggcttgcgggtgcctcagtttccaaggtcaacctgggtcagtttttgaatagctcatttcagttaatctgtttcaattcaacacaatactgcaatattagcctctctctttcttgtttccatctcagttttcaagttcatatagtgctattggtgtcggtagtctataacattctaaccttattttaccagacatttaaccatgttaatttattacgtctctctgcatgcatactttttgcttgcagcggctatttcaattgaacaagctgaagtcagtacttatcttccaaaaggtgacatgtggtctgtgcacaagtttggtggcacctgtatgggaacaccccagagaattcagaatgttgctgatattgttcttggtgactcttctgagaggaagctgatcattgtttctgcaatgtccaaagtcactgacatgatgttcaaccttgtgcataaagctcagtcaagggataattcttatgtgactgcactggatgaagtttttaataagcatatggctgcagcaaaggaacttcttgatggagaagacctagcaagattcttggctcagttgcattctgacatcagtaacctgagagcgatgcttcgtgctatttttataggtttgagctttatccatatccatgttaatttattttaagttagaagtcttgttttcggtggaatatgtgttgttgcatggctcataggaagtttgtttgcttgatcctgagctaaccatgctttgacatttacatcagaagcaccatcgcttgatagtatttatcttttatcagtgtttattttttgaggcctatgcatctgttcgaacagtgacgttttatccactgctgccagaaacttgcagtgaccctgctacatctagcctaaattagggggaaactatcatactgtttccaacttcactgcagttgtttgagtatatatgcagtaacatgagtgtcatgatttttttagatgtttaatacctttgtttgtttatgtatgtttcagctggacatgcaacagaatcgttctctgatttcgttgttgggcatggagagttgtggtcagctcaaatgttgtcgtatgctataaaaaaggtgacgtaaaaaatatgcctgaaacatttttacaaatatctctaaggttcaacaaaatggattttgcagatggtttattcattctgaatcaatatttcctacactgcatggattatgttaatggacaactaaactacaatgatacaataacatttgcacatactaataccctctctttcaacaaaccagagtaaaatgtgaagttagtatcaggggtaaaattaagccttgaagtctgaagaggctgttctgactttccaaaagttcagttacaaatcctgcagcatatgcagcaacaacatatgcttttgtagttcagaccttgtcttaatatattacgtgcaactgccagtctgccaccatatgatgctgtagttcagtaggacaacttggttaatattagtgtgtaaatgttacttctccattcttaaa

SEQ ID NO: 65236 - DNA, 848 bp, Oryza sativa
acccaggtgggaggatgcccaccacccgtgtcgccgcccgcaccgccaccgaccgctcgcgccgccgtcgtggaaggccagaggtctccaaggccgcccgctcgccaaatccgttgccgtcgaggaagttccgagctaggacgccgatgccgcacgcccactcgccggatccgcctcccccactgcgcgccggccgtcgccgtagccgcagccgctccctgggggggatccggccctctcgagggcggcaccgccggatccaccgcccgttgatgccatcgctgcccggcggcgctctcggagagggagagggagaggagaaaagaaagaaagagaggagaggataggagaaaaagagagagagggcagggtaaaagaatagaggggagagagaggggagatagttagaaaatatttgaagtggtgggagggaaaagagagtggagggagatgaaaaggttggggtgatatttttgcatgcagaccacctaaggagccgcatgcgtaaatagatttttgcatgcagttccttaagtgggccgcatgcgaaaatagtcattaaaaaattaatttaaaaatataagaacttcgaatcaaattatatgatattaaatgaactcatatgaaaaggttgttaaaaacaaagttgtagaagtcgttgagatctaccaattttcttttggttatttctccatccgagtttgattgaactatataaaatttaaattttaaattcaaataatttttcggatagtaaatgatttcaaatggaaaagttatcaacaaccaagttatataacttatcaagatctacaacttttgtattggtcatttttctatatgacttt

SEQ ID NO: 65237 - DNA, 1036 bp, Oryza sativa
ccccttggatcgtgcccccaatcgccgggaacgcgcgcgttttctccggccgctttccatggccgccggccgccattcccgtcgccgttccgccctctccagtgctcggctcgcttccctccgctataaaatgcaaccccctcgctccgttctatcgttttagccccctcccgcgatctcccgtggtccctagccctctccccgccgtcctcctctctctcccgtgccgccggccgcctccagccgcctctccctcctcgccggagcgccgtccggtcgcgccgtcgcctcctccagcatcgcagtggcctccccttccccggcttgccctccgtttcccgcggagacccccggagctgcgttcccgccgtcgcccttccctttcctccgcgccggccgcctccagccgcctctgtctccctgcctgagcaccggtcgacgtcgccaccacctccctcggctccgcgacgccgctctcatccccggcatcacctcctcctcgcccgaatttcgccggaacaccgtcgcccgcgccggcctcaccttcctcctcgtcgacgtctcctccggcaacccctttcgccatgcccgtgcgtcagccggcgctgccgtcccctccctcggcacggtgacgtagccctccacctcgtccacccctcggtttcgcccggaagccgccgcacatcgccgcgaacctctccatccgcctcgccggagttgttcggccgcccgtccctcctcgcccttgcaccggtcggccacacctccaccatcttcggcatcgcagccgcgacgtcgtcctcggcatcgcttccccttcggccgaacaccgccggtatccgtcgtcgtcttcaccgttcatcctcgcccggttcgtcgtctcgcggcgccgcctccgtcgtgggcatcgctgcggcgtgttccacgccgtcctcgcctccgtgcagccgctgccggctgccctcgtcgcctcctcgccggtcccggtcgtcgtcgtcgtcgccctctcgtcgttcccggtcgtcgtggcgttcgt

SEQ ID NO: 65238 - DNA, 6622 bp, Oryza sativa
ccttcctgtcttttccaggctagcgcttacacatgttttatagttgcaaagcttaattataataatccgcaaatctccatatgacagcattaaacttcggatgaccatgtcttggtcatacgagctccgaatcgacccgttcaagtctcttaatgtttgttataacctaaagaaccctgtgctttctttttatgtattgttattgcttctttataggcttgtagctttgcttgtgtgcttcgcgtagtcttcgtcgttctggaggttcccgaagcgtggttcgtggtcgtcgccgaaggttcggaagtccgttctctctgagcaaggcaagtcacatcatccttgaacatattgaatcccagtttataaaattattctgatttaaattattgcgttatcgctctatttaaattcccgcgttatcaatgttttatttagccatgcctatttacctttgttatgaccttattattattgctattgttattattaccttgttcaccctaggttaaacaaaaccccaactagtgggtactctattcatggttccactagtatgaatttaggtagatgcttcgctgattaattaggcaatattaggtggttttataactttagactttgggaattctcatatcatctggacagtatggaatggttggcttatgttggaattggacccacatctccccctctattcaaaacccccaaaatggttttaggctgggctcgaggtgcgtggttgggtttggttagtcgtacctcgggtactataaggtttaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggttgtcgagatgtcatggcacagggccggtgtcctgctgctgggggctcagtcctgcctacctgtcccgggggttccggccgtaggtgggattgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagtcgcgccctcggttatgggcaagccgagcaatatacccaagttagtgttttaattcttaaaacctgcttaacaactaaaatgtggaatggttggcctgggttggcttgggacgagctgggacccagggtcgggttgccagtttggtctgaatcatcgtaggccttgggttaaggcaggttcgtgagggttcacagccttgattaataacactgtgtaactctaggatcgtctttataaaatggctttgggcaactaagtgactttaaatgctgttttctgcaaaacttaacccctatattattatccccttgtactcccttgcattaattgtgcatctccggtgtggcttgctgagtactgtggttgtactcattcttgctcaacctttcccctcttcagtaagagaagctttggagaagatgttttaggtgaagtcctggcttataccccagttgagcgcctgtgaagatggagccgtaggcccgctagtccgctgctgtttatttttgatggtcaggccttaagtgcctttgtaataatgtaaatattattgatataataaagatgtgccttttgtatcatgtttgtgtggtgtaccccggcttttcctgggacggggattaatacactagcgttcgggaaaatgcaattttcccggtcgcgacagcttctcctagtggttaacagccgatctcgtctcattttcaaccctcaaccatgcgggtgcttctccctctgtttctttttggttaaccagttcaaaccttagatcaagaacgaactgatgggagaagaagaaagaagatgcgatctaatatttttggggcaattgcacatttgaccctatttagaggtctaactacaccctgttctcgtcactttgctcatttgaccatccctttaaaaaacgaagctacactctaaccctcttatgttcaggacatttaacggtgttaacaaaagcttaaaatatcacttctacccttgcttatttgaactttttcttccaaattcattgccctttgagattagccctgacagttggactgtaaagaataccgacattgtctccttctaaatgacatggaatgactcggggggcggtatttatccgaattacttcggatgaaagctctgcctcccttaaccattcgtcaatcattatatatgtcagctcccaaacagtttcccttaggaatccaagttccataggatcgggaggtggcaaaggaacaagtggtttctttttgctaaaataactcagggtgttgtcgtaatcttcatcaaagccatccctgaatagaactggagcattatccagagtctgaatttcttcattctcaacggatgatggctcaggaactgcttcatcagtcaaatcagtcgaagtggaaggttcaggttgcgattcaactattgatggttcctctatcttagacgccaatgcctctggaggggttttatcgcattgtgtcatgaaggaagtattttctagaagtcgatctagaattactttttcttctgacggagttttgtgcatgaatgatccttcggcacatactcgggtatagacaagcttggttcagaccacactacattagtgaatctggaccaagctgaaccgattgattcgttattgatctgctggaaactaagtatttctactcgaagggtggtaatacgagtaactgggaagaaggcgagacaaaacctgtcttgcaacttttcccaactatcgtttacgcatcctacgatagatgtgtaccattgcttcgctctctcttgaagagagaatagaaacaacttccaccgtatagtttcttgcttcatgccatgagcaaatttactcgaagttccgctgatgatggtaggaattttccagatcgagaccagaaaaaggtttttccctaatcatactgattagttcggggcgaatttcatagcaagctgtaaaaatcggctccgatgaaggaggtgactcatagaattcgcacctaggggcagagagctcgaagagaggttgctccatggtcgagaagaattgaataggaatacttctctgggatagcaggggtagaggtagaatagaaaaaggtaaaaagaatacgaggatgaacaagattcggaaataatcagcaaccgttccccggcaacggcgccagaaatgcttgttagtatttcttaacgtcacagatagaatctgcaagcacacggaaaatactaatgtagcacttcacccggaagtattcttaggtatcgatttccacagggaacggataattgcttccttgtcaggttcactcaaggacactaagctaaggtgggcaaaggacagagaagatttcctggtgagaaacagcgtctagggaaatcttaattttaatcctaagatacttcagtcactggcaacccgttgttcccagatgtcgctctactacatacccggacagggaggacttaagtgcttttgagggctgtcaccacctctacatccaccttaaacatactgtgggatatgtaacaataactggataataattacctaaacaccacgtctaagcaattaatatctactttaatgtttataactcactaaagtaatcaccatcttttagttggttatagtgaacaataatcccgtacgctgattagaaactaatcaagaggtcattctcacaagtaaaatctaaattacgcagaataatatttcaattgaaaacaaagtaattaacagaataaaagaaacaggaaagaattaccgacaactctggaagtcctccgacttcttctactctactctcttcctaattctaatatacaaaatagtacaatagagcctcttataattcagctcaaacttggaagtgtgtgaagaagtgaaggagtaaagttccttttatagggcaggtatgatggttggaatgatgcgaattatctgaattgccccgcaaccatcatcaggagagcatctggagcgtcccgccaaacccttggagatcagggttcggccgaaccttggctggcccatctagccctcaattttggcctatggactcctcctgtcctaccttatccatttcttcaagttttgagcaggttctctgatattttaatgaagtctaaagcccctttctggtatggatatgttccttcttcgcttagtctgattttcctcccaactttggtggcttataacctgcatcaattaaacaccaacacttgtggaatatgttagaattaacacctatcactatgttggatgttttattatctgggttttatgcagatgttggcggtataaaatgagcacttaacagtttccaataggcattgactgagtcctaggggtgcacctagggtgaagccgaatgatggagcccgacgggtttgccaccaagctcactatccgaccacgtcatcactatgggcgaaggccactgagtcctaggggtgcgcctggggcgaagccatagggcgaacctcctgagcgaagctgaacaatgaagaccgaagggttcaccaccaagctcactatccggccaagtcatcactgttgacggtccttaaatcataatatctaaccatcaatacctgcatataatgaaataaatatggtatccaacttagtggtagggtttattactaatcatttccactagtattgatgaaatatgtgtatgcaggtattttaaggagaaaatacattcgtcacgcgacaaaaggcacttacgcacgatcaggacgcgtttacacggattggaggccccataagtcaataaaaactacttagaattgggctttggtatagtacatgatgttgggggcccattaagctacttaccggccagaggagaggccgggaggacgttttttctggttcagccgaaccaccagttcggctgaaccggtttggtgtccgttcatcgccatcttccacgtgtacgctcctggtttcgtccaaatgacggttggagggcacaatggtcatttcccatacttgtaaccgtcatttggagcctataaaaggaggtctcctttacacttcacgacacacaactttgagctaaattacaagaggctttattgtatcttttgtacattataaataggtagagagtgaggggaagctctggaggagtgcccagaagtttggcgctcatccgacttctacctcgacgagtgtagctttctaggaggaattctggaggagtaccggagctgtcggtaaactctgctctaggttcggagaaacttcttttataaagtaagcactcgagatcctttcttttgttatttaattacttagtatgagtaagatatatttccttgtttgcgggttcactgtttagtattcatactaagtgctctactagtactctggataaagaaggatgtttctgcgcaagtattagagtagtaattaacaacttagacgtcgtgtctaggttagagattacctttgtttgttgtgtatcccagggatttgtcagagatagatggcaggtggtgacagccctgaattccgtcctagtaatcctccacgttcggatacatcatagagctatagccgaaaccacgctggcagaccagcaggggtcggtgcccaaagcaatagataggaaattccctttgcttagcacagataactaaaacacataaaagtccactctagcctagccagcctacctatagttgttgtccttggatcgccttagccttaggttgattacacacgttctctaagttcaatatccttttagggtcacccgaaggtgaagtgctatagcggtattctgtgcgcttgtggatttatctgtggtcgtaagaaatactaacaatcactatgggcgaaggccatgaagtggagcaggaggccttctcctgagtaggaggtgcctttgactaagggcttgggaggccctgcggcccatgggggcctttctgcattaatgggccggtccaaggaaatcaccagatggtacataaatacaaaagacactgtgtacccagtacccacactaatgtctctatcataagggtatccctataaattcccctgtagtaactaatccctagggccatgcaatggggagatcccaaaaattttcttaccaattaatacattgcttttactattccatcaactcatcgagtgaaccacgtccttcgacatgacgcagttgtctttcgacactagtaacaaatatttgacaaaactcaaaatgataacaagcagtatatgtataaaattttatcattaagatcaacatatggcattggtaggaagggaacatcaatgaggagaatgtaaaactatttattttcttctttttttgtaaaattcccaagggttcatcatcaagagtaagattcatatcatcgggtcatctcttattaatcaataacttagataacaat

SEQ ID NO: 65239 - DNA, 2864 bp, Oryza sativa
agggttctttccatcctgcgctattaaatataatgttcatcctatagcacataatggagggttgataacagaaccctaaccgtgatagcatttttgcggacaaagtcgcttatgcgatggcatttcatgaaactcacacttctcaatagcatttcttggaattgggcgcttgtcaatggtatttcttggattttctctttgttaattgatggagttatttgttcttgtgactcaataatacaaatggtgtaggatcgaacataattaaccaagcctaccagaggggggtgaatggtagattacgtcagcggaagtcaaataatcgaatcttactatatcaaaacacaccccaacctcaaaagccaatggaacacatgtttggtggtctatccgacctactaggatcggtctgaccgaactctaaccagtctgaccgcaggtcctctcgcggtctgaccgtcagcttgaaaatagcatgacagcgcttcggtaaaaacacgatttctcttaagccaaccgttggctcgagttgcagaataaactagacaaaccaagaaacaactccaccgaagggattttaaaactaataaacggtttaagagaaaacaccctcacaattcagctgtctcagaatttcagcaaatccgaacaaaacctaaaacttaagaaaattcgaaactagcaagaaccaatcaacgaaactttctagatctgatctatgaagtattagaaaggttttggatggattaacttgaacaaaatcacatcaaaacgaactatcacaagttaatgccaaaaccaaatataaacataaaacttatgaaatcagaatagatcgtcaatgtcttgatgattgaatatgatctttattgctcaagtatattgttcacatggtgcagccacagcaccctttacaagtttcttccgaaaccctatctattctctcaaacttagcttactctagaaccgatatagggaggaggcttcatgcttcctctctatttatacataaaaatcctcctactcaaagtagaagtaccactcctagtcacactaggactctatccaaattacaatctcctaaagcctgctgcctcacagccggctacagccaatccgtgtcctagccaacccgacatggacacatgtccgtctcatacgaagtcccggtcggcctcggtctcctgccatggcgccactcctgccttggactcaccgagccaacacacatgtactccgtatatgcatgcatgcttacatgtactgccaaccactacagtacacttgcatgcatcaatcaatataccaacatatgcatgctacagtaccatgccgtactatagcaccatatactcttctccaattccttcgtgaacaccgacgcttgcacgcacacctcgtgaagcccgttacgaagatctctcccatacgatgtctatccacagtatgccatctcgtatccaacttcgtcacccggtatccttgacagtctggacctcaactcctccctgagtttagtcccgatccccaccgttaaccgaagttgacctccaagaatcctgactctaatcaccttctcacatggtatcccgaccgcactagacctctactcctctctgagcatagtcccggtcctcaccattaaccaaggctgacctcaagccatctgcacacaataagacaaaacaaccgtttctgggcacagatatcacaacctgacccacattagtcacacgcactcacaccaacattcacagatactctcaaaccaattctttgattatatcatttgcatagccaattgttcatcacaaatattaatcatgacaatgatttcacaaatggaattagaacagttcgaatttatttcattatatgagtgcatatatagtttagttttgacatatcacatgtttatgcacataccgccaacacacgcctcttacaggaaaacacaacatcacacttccaagttgtgtgtttactgtccatgtcacctcctgactagttgtagtgatataggaaaaaaatttttgttacaatttcaatactggagctcataacaagacacgtcagcagtaagacttccatcaaggcacaaacctgcaacaacgggatggcagagtagttctgagctctgcgcacattcagaatgctacagaagaatccatgggcaccacacctagcccacagtggacgcgcgtgctgcactatcttccgcaataggttggtgcacaacgttacgcacaacagtgaaaatataacgcagaaggcaccaattcctgtgccataaaccttggctagatcaagtcgtgctagccgatagaggccaacactgtaattttcagaatttccaaaatgtattttcagacaagtccgaaaatttacagaagcaaatctcagtttcgcagccatttttggagtttccaaaatcttttcggagtttccgatattttttcggaatttccaaaaagcacatagtaaaacgatcacaacttttcgctcgggagtcccatttttatgatcttggactctatggaaagctcactcagaggactacccaattcaaccaaaaacaaggtctaaaccaatcaaaggattggttaaagtttgggtttctctcaaggtagcactatgataggtcactttgagcaccaagacttacacaaacacctcggcgttgatccctcttaatagtacggcattcctaaactcaaatataaataggaagagaattatactaataggaatgtcttatttccatctttcttttattttcttaagggacgcccatgtcgaaaccgtttcaccatatattcttcaaatgattgatgcggttacttgtagcttcaaatggtctcgca

SEQ ID NO: 65240 - DNA, 1984 bp, Oryza sativa
  unsure (1)..(1984): unsure at all n locations
aaagtgacacgtggcattttaggagtgtttttagactcccatgtggtggcttaggagtgtttgtaggaagtttcatggacttttagtatataataaatagatatcacaaaaatacatatttaatattgaacttatcacaaaactacaacttttggagtttaaatccttagcaccattgttatggtggagctataaacattattactttgtgattaaattggttctaaacctgtagttttgtgataatttagttactagacttgtagttttgtggcacttcatcttaaatgtgtagttttgtgataaatttggtgttaaatgtgtagttttgtgatacaccgagttaaatatgtagttttgtgataatttggtcatagtatctgccgttttgtgaaatctactcttttaagtttgagtgtaaagttttagaaaaatttggttggaatttttttaaatttgaactaaaagtttcaaattagattgaaagtttgtttggtgcttcatggtgtccgggctccatgattgaaattgagtatatacccaattcaaatgagagtgtgtgtctatatatatacacacacatacatacatacatttatatatatatatatatatatatatatatatatatatatatatatatatatatattgtgacgcctatatattttaatatgatcttcgatgatatactttgctattaatttattccaggttatgttctcaacaaatatgaaataaggatcacataaaagtactttaaaatacaaatatagtgatataacatgcataatacttagcatatatatgattagtatgattattagtcaaaatttattgagtttgatttttctaaaaaagagggcatcctgtaatttgggacggagagagtagcacctttgaggtagcggtgcatgtgttctcccgatctagtagagcgcctgatgtgcacatctggtggagatgagcaagggacatggaacaattacggatatacttttttttacaatgacttatgcttatatacatatatgagaaagatttgcannnnnnnnnnnnnnnnnnnnnnnntatacgtggtacctcgacggtccagcattttgtagctgtgggaccatcacggagccgtaggaccgtcggtcactagttttggagctgcgggaccgtcatgataccgtgttttcatcctgcgggacgggtatattttttgcaaatacttctcatacatgcatataaacgtaaattataaaaaaaataagtatattcgcaaaatttttttcaaggacggataaggttctttttactgtagctgcagatcatagcgccatgcaaatgtaatttaaatttgtgggatatttgcgtgactgaagaatagagacagtccattaaattttaaaaccaactgggcggtgaatgtgaaattttgtgggatttttgctcttttgatcaactgctcttgtttctcttatatttctttatatcgttttacagtttttcttctacgttactcgtgcatgcatggttacttcacataggaacaatcaaatgtatgacggttgattaataatgtaaatgtcatttgcagaactgaccaccatactggtgaattgggaatgtagtctcataaaaatcccagatgaatctggcaggaccccacttcactatttggccgttggatgctttggcagatcatcacacctgctcctcgactatttgttagtcgaatgcgttggcatattatcacacctgatggtccggctcctcgactatatttcagtcgacaaccccattatcgctgggccctttttcagtattactgccactaaaactctccttgcgaaagatccatcgtcaggctattgtgcagatttagagggatcattgcccattcacattgctgcgttgaatggaaaagttggtgtcatccataagttgatacaaatgagtcctggctgtgaattatcatgcaatacgtcggccagact

SEQ ID NO: 65241 - DNA, 1510 bp, Oryza sativa
gaacatgggtttcttcatttgtaatacgccgaatatgttcttgaataaccgggtcaaacttagccaacgtttctaccatgcccaagaaatttccattgctatcttcatacagtttgctattagaaccacggaatgctaaaagattatgcttagctaggaattttacaatggcaagaattctgaacaaaacctttctccaatgatccttctctttcttaagttgtcgttgggcagatttatcaatagtttgatccttctgcaatctgttacgcaattcgtaccaattggtcatatttaaaacatgatctggacttgtttcatgttctctaagtctagaactcaaatgcaaccaatcattgaacccctcatttgttaactgacctttgcgatagcgatactctcttccttttgtaaatgatttgcaatagaagcataatacgctatcaagttccttggaataaacaagccaatctctatcatactcatctccgtttgataggtttctagtgtagaataatgcagaaaaccctctagacaatctatctttaggacctttctgaattgataagtcccttttaggacctaattgagcaagaatgtcattaggttcaacaacagtggtttctatctctgtttcactatcattaggttcattggcaacatcactatcaagtgtctgatcaccggatggaccttgtgattcttttgtaatatacctaaacatagcccctctctgagattgagttagatcttctattattttttcttcttatgtttcataaccggagtcatattttctattccgatttgttgaagacatatcttcaaaattaaaatacaggatgtaaggacaaaaattgatttagcgtatatagtagatgaaccaaaaacttaataatccatatactacaattagggaatagggattacattaacattacctgattaggacaggcgactagccgactagactaggcgtaggggacaagggcgccggggctcaggcgctgtagcctgcagccggcagggactcaggtaggcaggtaggctgggcgacggcgttaggactcagcgacagtgcggtacagtggcaaagcgccagacgccaacagagggataggcgagacatcgttttctttctgattggcgcgatgccgcgatccagagtgccaacgtgcaatcccgctatcgaaggtgaaacgacaaataactgattttcagggttaattgggctatcagtttacttattttatatatatatatatatgtatgtgtatatatatatatatatatatatatgtatatatatatatatatatgtatgtatatatatacatacatatatatatatatacatatatatatatttcaatcaccatgtaaagtttggacaaattaaaacacatcaattgagccctacctaaattttttgtaacttctggcttctctccattgattagaaccgagagaataagtgcagagatgtaaactgtacatttgttcattggag

SEQ ID NO: 65242 - DNA, 1375 bp, Oryza sativa
tagatgtgacacagtccagattcattatattagaatgtgttatatctagcactaggttggttttttataggacgcagtgtctaaattccatcccccaccaccaaccctaccatggtctgttgcctcccagtttatcccgcaaaagcctaaagagcccctctgaattgtccccatcgtcaccccgaggatattagagtttatgttaaatatgtgtacgtagttgtttatgatttaggacttagagttataagtataaggaaagaagtaaagtcggaatatgtattagaatatctcttaaatagagaggttcacctattgtcttgcatggatagtataataggcaaatttaattcgattgagatttttaaggattttcatataactaaaatctagcaattcccaaattataaatatattggctgcatttggagcaatagaaacttaactgaagtttttttaatacaaatctatattgttttttaattttaagaaaagacagattttaagaaaattgtgcatgcagcagactttctttagaattgtagttctgtaaaatgttagtgagttagtcatcgttggagcaaatttaatctaaatcaaacggcgagatatcaagtactagtaaatctttcaaaacttgacaacaaaacttgagattgcgtctgtaccttcactgaagagaacagcagcatgtaaaactgttttccctgcgggcccacaatacgacacggcacctgcaggcccacacgatgcttttattgtcagttcttggacaatgtcacctcttcgtaatgcgatggccaaatagaggggagaaatatcctcgttgtctactatttgcgccaatccttcatcttgcgaaaccaaatacttgacgatctccgtgtgaccgagtagaatggccttatgcaagcatgtttggccctccaaatttctcgcacgcagcagattggtagtaaaattggacggctctgtgatacatttcgctctttccacaatgagttgaaccatttctttactctccgtggcagctgcacagtgcaggggcctatctcctctcttgttctcttgttgtagtagcataactatgagggctttgtcctcctgcccttccaagatggatttggcaagctcgaaatggcaaaagcttgcagcaatgtggagcaccccgtccccgtcaaccgtcacaccccggatagagtatggctcaggtggacctctatcactagtaactgttgatgttgcatctaagcgcaatggactccgcataatctgattctcttgctcatcagaacggcatgaggacttgcaatctaaacggaaacaagaacggcgggatgatgtgctctcaaaaaaaacacaagaacagcaagcg

SEQ ID NO: 65243 - DNA, 2000 bp, Oryza sativa
acacttccaagctatgtttaactgtccatgtcacctcctaactagttgtagcgatattggaaaattttttgttacaatttcaatactggagctcataacaagacacgtcagcagtaagacctcgatgaaggcacaaacctgcaacaacgggatggcagagtagttttgagctctgcgcacattcagaatgctacggaagaatccacgggcaccacacctatcccacagcggacgcgcgtgctgcactatcttccgcaaaaggttggtgcacagcgttacgcacaacagcgaaaatataacgcagaaggcaccgattcctgtgccataaaccttggctagatcaagccgtgctgctaacgcctgcaggctaatcatggacgacccaatgagcacccctagtcccaagataagagcaaaggtgcgtcctatgacaccgggcaagatgggaaatccagcaatcgcaaataaaaggatggcacatgcagagatgctcagtgagtctccactgagtttcttaactttctgaatttgcttgagctgatcgcttccttgagttgcattgttgttgttggtgctggtgttattgttgtggtagatggcttgcacattcagaaagatgttaagcgccgcattgaaaagcagagccgcgcatgtggccatgaccgcggcagatttgctcagtgtgtcggagaatgcttccctgtcagccttggcttgttctgggatcttgctggacaaatggtccgcacggaaagtaccaaaatcagctccagcagcgagcaaactattgcatacccatcgctggtgacccttcagaaatgtcatggaaagtaacttcataagacatgaaaatccatgttcccccctattaatgaattaatctatatttttcacattaccctgcttctagatatatttcataattcatagacgatatgatgtacatgcatagcggtgtgatgcgtgtgcatcttcgatataattacgggaaaaataatagtaattcctaccatatggtgtaattagttgttaacatacatatccatgtcatcacacctaagattacttctggtcttacatatttgacattcatgacaagattcaatcatacttttgaaactttaaccatacattcttacattagtagaatatgtttataaaatctaataagtttacaacatagtgtactttgagaggtaaatttacagatgctacttttgtaaactaagcatttgagcaattgatcatggtttaagagtttaaagattgactgaattttattctatacatcaaatattaatgccaagaggaagtacctttgaattactttgtagagaatatgtgaaacaccaaccaaattagggaaattctacaacaatttttcgttgttctagttgcccaaggtacataatttgtagtgaactttgcagaaatggaatatgtttaaaaacaaatctcatttcagaaaaagaatacgagtaaaaatgcaaaataagagaaagggagggtgctaataggacatactggccaatatgtggcatacgtcagtccgcttgttttgttcagtacggcatgatcaagaggcgtatacccatttctgtttctgatacttaaagagacattcttgcatcccatcaaaatgccaaaggtcttgttatgtcccttctgtacagccaaatggagtgctgtattcccatcgtaatccttcatattcagaaccattttgaacatttcattcgaacaaacaaatcgcaccacatcatggctttccgtttggacagcgatgtggaggattgtctggccagaagcattgcatgatgactcacagccaggacacaattttatcagctgatcaatgatgccaagcgtgccatttgcagcagcaatgtgaatgggcaatgagccctctgaatcttcacagtagcctgacgatggatccttcttaaggagaagttcagtaacagaaatgcaactgggttcagtagtatacttcccgtctg

SEQ ID NO: 65244 - DNA, 5247 bp, Oryza sativa
  unsure (1)..(5247): unsure at all n locations
ccttaactgaattgaaatagcacaacccatatgatgtacggtaatgcagactaagacaagtacagtaatgcagacatgatagttttggaatattcattctatgttcaccaatattgtgccaaataccattgtcatacaaaatgtttgggtatttgcattgtttgtgatcctccttccttgcaatcaattatttccaggtcgaagtcattcgtgggtgcagcattcttgctgctgttggcttgaggatggccagtactcctggagtcagtgcaatcctttttgatgcattagcaaaggtaattagagtgttgggttgattgaattgagactttattgtttctgggactgatttatcctgtaacaatggattcaggcaaatattaatgtacgagcaatagcccaaggttgcagtgaatacaatattactgttgtgttgaagcaagaagattgtgtgagggctttgagagctgttcattaaggttcttcctctccaaaaccactcttgccgttgggatcattggaccaggtttaattggtggaacacttcttgaccagctgaaagatcaggtatcttttgttccttagtcttatctctctcttccttcccttgtgctgtggctgcctccattgtgccacttgggtctaggaacaactcaattaggtctgcaggccgtcaccctaaccatgcccattacattgggtatgacaagatttcaagagcataatatacttgacccattttgatcctagtatgatcaagactcagtataaaccattcatgttacaaaccctatacaaaaagtgatttgttttggctttatctcacagtggagcaatttaaagtttgacttcacagcacttctacacttttactgatttagatacttatgcaggctgctgttctcaaggaaaatatgaatattgatctacgtgttattggaatatctggctcaagaacgatgcatttgagtgacatgtacataagtgaaccctctctctgtgtctaaactcaatcttcctctattcctcaatacagtttcattggtaaattctcttatatgatagactaaaagagggtgttgtaccattatttggtctattggtctttcttttcaccattctcgtgaatgtcaatgtcatcatgtaattgtcatgctttgttgtccatcagattctgatgctccctcattgtgccaccctaataatgattaacaggaaactattttttgatgtactgttattgagatatcacgttacatttgatggacagtacttgcttttgtatgataacatgcctttcaaatttccaggagtcatatccaattagtaaggcatgagtttttcaagagtttgaattacatattgaccatcattcttatgtttttttttccttgccttgctgaataaactgctttattaacttaatagcttggtcatcactattttttagttttgctggtatattaaattttgctcaaatctgcttgtttcattggttttgtttggcttctttgtgtagaggggtagacttaaaccagtggaaagagcttctacgaaaagaagcagaaccagcagatcttgatagttttgttcgccatttgtctgaaaatcatgtatttccaaacaaagttttggtggactgcacagcagatacatacgtagcatgccactattatgattggttgaagaagggtatccatgtcatcacgccaaataagaaagcaaattctggtccgcttgatcgggtaattttcttactggcaagacttgtataggcatatattgttgcctttttattttgaaacaatctgttttttagttgttcaataatcgccgaccgagtctgggtagctagttggtttttacttcaataagaattccccgtgttcaagaaacctgcagtgaagacgaactaagagtcggaattatttgttcatgactgatcaacagataacttatttctaagaaaatccatgaagtaaatctgattactagcctgttaatttcatacatagccactggaaacttaagaaatcaatgtgcatctgtcgtgtagcattgtatgctgctgggttgtttatccactatgaaatcattttccccctttgtttgcagtatctgaaattaaggactctgcagcgtgcatcgtatactcattacttttatgaagcaactgttggtgctggccttccaatcattagcaccctacgaggtcttctagagacaggtgacaagatattgcgtattgagggcattttcaggtgcgtttatgcttcagtaatgtaccagaattaaacttgacaatattgtaattttactaaaccacaaaaattcctcagaagtttacttggatagaaattcatccttttgtgttccataaattagacaatgttggctgatacagtgttgattgttccattgcagtgggactttgagttatattttcaacaattttgaaggtacacgaacttttagtaatgttgttgctgaagcaaaagaagctggatatacagagccagatccaagagatgatctatcaggaactgatgttgccagaaaggtagatactggtttactttggttagaatttcaatggttactctcattaaaaagaggatggcactcaggatggggcaattttctggttttcttcattcacaaactcaaaagccataccatcccgggaggaggtcggatacatatatatagccatagctggctggatggctgcaagctaattgctgcccacactagtctaaaatttgaacgcgatgctgtcctagagagcatccaaactgaataaagcataaagcagatgctagatgctgtcctagagatgctaaagcaaaaccgaaagatgctaaaagcaaaactgaaagggtgctgtcctaaaagggaaagcaagagaaggtccacaagaaccaaaggccacaaggcttattccatcattctccccctaagtcttatgcgtcgtcttgtgggaaagttgggccatcccgatcctggagcagagctcgaggaacttgatcctcccaagaggcttggtgagcaagtccgcaagctggtccttggtgttgatgtagctcgccttgatgctcccttcctccaagtagcttcggatgaagtggtacctcactcggatgtgcttgctccgttcgtggaagacggggttctttgccagggccagagcggacttgctgtccaccctgagctctaccgctccagtgtctctgccaaggagatcaccaagcagtcgagcaagccagagcgcctgggtcgaagtggcggatgccgccatgtactcggcctcgcagctggacagggccaccacctgctgcttgaccgactgccagctaacgaggcactctccgagaaagaagagaatcccgctcgtgctcttgctggtgtcgatgtcgccggcgtggtcgttgtcgctgtacccgatgaagtgtgccttgccaggacacctcgggtagtagagaccgtggtcgagagtccccgcaacgtagcggatgatcctcttcacagcctgctggtgttccgtcgtcggtcgctgcatgaaccgactgacgtagccgacggagaaggccaagtccggccgtgtgtgggtgaggtagcgaaggctccccacaagacgccggtactgtgtagcatccacctcctccgccgtgctgtcgcggctcagcttcagtctctcctccatcggagtgagagctgggttgcaattggtgagcccagccagctcaacgacgcacttggcgtaggcggtctgtcgaagcgtcatcccggagtcgtcctggtgcacctcgatccccaggtagaaggagagaggccccagatcactcatctggaaggtggccttcatctcctccttgaacgccgcgacctccgcatccttggtgctggtgatcaccaagtcgtcgtcgtagacacccaccagcaaggcatttcctccattgccccgccggtagatggccgcctcgtgcgggctttgctcgaagcccatccccttgagcgtggaatccaacttggcattccacaccctcggtgcctgccgcaagccatagagggccttgtgcaggcgtagcaccttgccctccttgccggggatcacaaatcccggcggctggtgcacgtagacctccttcaagtcgccgttcagaaacgccgacttgacgtccatgtgatggacgccccagccttcctgagcagccaacgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctctttagcttgaatacccacttaagggtgatcgcgcggtgaccacgagggaggtcagcaagctcctaggtgcggttctcctgaaccgcgtccatctccgactgcatcgcggcacgccatgccgcgtgtttctcggcctctgcgaaagaccgaggctcaccgtcgtcgcacgcaaggtgcaactgcgcctccaggtcgcgaggcaccagtcccggcatcggttggtcgccgagaagatcctccatcgtacggtaccgtagctgctcgccgtcgtggtacgcgtcgatgcgctccccgtcgtgggagagcggagtagcgaactccaccgggctgcgctcaacacgagctggcgtcggagtagacgtgctcggaggagtggctgctggtgctggagcatgtggggtcaccggctgggatggtgtcggcgaagagctcgtcgttgctggagccgttgcagagggagacgagtaccttcggctcatcaaggtggagaaaagccgctgcggccggtgccgctggaggtagctcgatgcttgcatgagccaggagcagagccggctcttcctccacccgtgcgatgtgggcctggccgcgtcgtggctgtcgacagtctttggcccaatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 65245 - DNA, 1647 bp, Oryza sativa
ggaatcaatgggatttaaaaccccccaattaattttggaatccatggtttgatttgcgcggatttggaggaggaacggctctaggttttcccggagagggagaggaggctgagcgggaggaggaagaagacgacggccggcctggcgcgtgggccccacgcgggcgcgcggcgtcagcgcgcgtgcggcgcgcgtgcgcacgcggctggctcaggcagggggggcgccgctcgggttgggcccggaggtggcccaggtgggagggggcggaacggcttgggccgagaggcggcccaggaggagaggagggcgagggagcccgggagagagagggaggagggagtgggccgggaggggaggaggcccaagaggaggagggagagaaggagagggagagaaagagagggaggagagggagactttgggctgggcttggcccaaaggaggaagaggatttatttttaggtttttctttttaataaactttgataattgtttttgttgcttaataattatttccggtgctctgaaaattcaagtaaaatttgagggctcctttttgaccaaggagaatttaacaaaaattctccgggccacattcgaatttttcttgtacgtattttagtgtttgccaatttctttccgaattttaattaattctattattccttttagaaaatgatttttatttcgggatgaatttatcaggacgtgatagaagctcattaggtaagatcttatttacatagttgattaattattagttactaagttcacaaataccattgagaaaaggaatggaatgatatctcattatctcctctgttcttattctaggatttgaaccgctgcgctcacaacgtgttctaagaacttttatgccaataatgtattctaataacacatcataaatctagagaaaaccacaaaaagagaacatcaaagaacacatcatgaatctagagaaaactatgcaaatgagaatctgtaatgctagtagcgagcaaatgtgttattagttactaagttcacaaataccattgagaaaaggaatggaatggtatcacctctgttcttattctaggatttgaaccgctgcgctcacaacgtgttctaagaacttttatgccagtaatgcattctaataacacatcataaatctagaaaaaaccacgaaaagagaacatcaaagaatacaacataaatctagagaaaactatgcaaatgaggatctgcaatgctagtaccgagcaaatgtcttattaactcgtatgatcgtacctacgttgtactgattaaattggggacaattctgcccttttaactctattttgtacatggtatctgtgattgaggagtgttggagttttacctttttgaatgaaaagtcataaaagttctctaaggacagtcccaacccatagtgtccataagcagtgtctatggtgccatgtcaataagacatcacaatagaaactacactctacaactcatggtttcttaaagtggaccattaataaatacatcatctttcttctctaccaatcatatttattcttcatctattatgaagacactattatctcccaatacaaaacttgatagtgtctagtgtataggttctcgtgttgaagctgtgtcttgcat

SEQ ID NO: 65246 - DNA, 1254 bp, Oryza sativa
acccgatcctagcatactagatgaattgtacagcttgactatggcttttaccgattcagagtcaaaacagtaagtttgactttgtctttgaaacatcgacctgttaggctgtgatgtttatttactgcatccatgacctgccttattgataattgcgataacgatacaggaccgattgggtatcaatcaagcacccatcgttccccatcagatcaaagcttgaagatatccaggaaacagtaaaacctggaggattgatggataccgattgcctcaacttaactgtgagaaatttggcaacagaggatgctgaaaattttaagaacactgagtgtttgggttggaggcattacgttaaatcagattggacggtaagttggttgcgcaagagttggggggggggggatatacagtcttttttttttcacttatgcttatactcatcagccaaaatttaaattttaaaccttaaatttaaagttgattttgggtttttttcatcgtaatttatttttcagtctttacttttatattgctaaaatatgcataaaaaggtttatttacaacttattttctatttgcaaatatgccattttgtttatgcttaaaatcagccaaacgatggggccgataattccgagtcaactcttctagtagtgtcacaaatgacacctattttttgtttgttttttcctccacagcaactggtcgctagtcccacgaatctgaggattgcatattcgtgtgactctactctgtatgatgcttcaggatcacatctggtatgatcgatcttaattattatatcctaattttgtagggctgaaaaatacttgctaatatcttgtcaccaaatcggtccattgatgaaatatgacttcttacatacgacttaaattacagaatgcatgcattctgttaattaagtaaaatttgaacattatattgttttttaatatgtgtaggtattcatccccgtattacattgcgaccactggacacgaattttttttatttataattttttttattaaaagttttacaaaaataattttccattttgaaaattgacggaaggagtcgcctaccgccctctgggagggcggcgaaaatgacgtggcagacggccgttcgctctcgggcgacggccgtcaacgaaatttgcaggcggcccccttgccgccctccgctagggcgattttatactgtgcggggggccgcctgcaaattggcggcgaggggggcatggaattt

SEQ ID NO: 65247 - DNA, 1588 bp, Oryza sativa
catcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagtccactagttgaaggtgacgagcctcccatacctcttggtgcattacatgatgacccaccaacaatgagaaggaggtcagggtcgtccatcagaaatttcactcagtggattgagaatgagcctaaggagaagttgtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgatgacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaattgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgctgt

SEQ ID NO: 65248 - DNA, 3249 bp, Oryza sativa
attcctgcagcccaggacgtgtcgtacctgctcgggctaccgctggcgggagcagcagttggtcccgtggacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccgaatgagtgttttgtactaacatttcattcttaattgtaggcggaccttctacaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctatggggttggtcgcagcgcgcagtggccagaggacggtcccacgatggggacttactggtgtcgacgtggggttagtgcaacttcgctgcgttataagtttatcagtcatcttttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccatacacagaagaggtcgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgcgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttctcacacacggaggagaactaccgtgactaccttcgttggtaccttcctcgcactcgtgcgcgtgtgaccttcactccagacgccccagagccgcacgttgccgctgtcacggacgcgtatcccacgcaccgtgaccgagactacttcgtggcggtacatccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttctgtttttgtacgaaaacatcaccccgtcgtaacttgatgatccatcctcgcaggacctcgtttgccttcgagcgcccctagcttcggattagtgcgacctacagcaccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcacacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaatctcttcatatcttctttcccactagcacacaacacacgaaaatggaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataact

SEQ ID NO: 65249 - DNA, 1236 bp, Oryza sativa
gcctgcaaaattccatgccccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggaggcgatttttaaaaatcgccttcccagagggcggtaggcgactacttccgtcaattttcaaaatagaaaattatttttgtaaaacttttaataaaaaaaattaaaaataaaaaaaattccactggacactatatgctttcaacatgtgtgataagaagctcagtattctggactctctaccagatgccagtgaaggtggtcaggatagtctgaagcgtcatgaggaaatcagaaaaattgtatgtggtgctcttaacaaaaccatggatgttgcgttctgttttttctcttgggagtacgagtttccaaaagtgcctaggcaacagaacaggtgtgacctgtaacacaatgtttcttactagaatcatcttgttgtctgatatatgttttactaagtgtcaagtgattaactcatttcttcctatgatttatttatttagttatgacggtgggttctttgtattcaattttatgcgattatgggatggccatcgactgattcgctggttttcaactgtaagtaataattcctagagatttaattttgattggaatgcatattcagaatactattatcatacatttaatttgtacacattgtcttgttaggaaacgatggacatgcggaagagctttctagcatgcatactctccagcaaaaataatgatgccaccatgcctactaatgtttctgagttgatcaaaacgctcccaggttagacatagagaggttttctatatgtttgtgacagcacaaataatatcttgaggatatactatcacaaatgaaattaattgaaatgaagaaagaaaaacattagaaacattaatgtataattacgagcattaattacattcaagaaagaaaaataataaaaacatttggagcccctaaataccggaaaggaaaaaaattatatacatgagtacgtgaaatcaataaaaaaataaaaaagaacagaactttacgaggacatgcatctttgagtcgtaaatataggtttagtggcatttaacaactcacgcttgaatctaatggcatgagagcaattaggcgaaattgactg

SEQ ID NO: 65250 - DNA, 5634 bp, Oryza sativa
tctaaaataccaagatccctattcttctttggcctcaataatcagcgccctccccctgtctcgtacttcagagagtctggcatgagcctgatccggcgagtagcgatggtggcgacagcgatgatgaagagaccgagtcccatgggtggagtagcggctgatgatcgacattgctgcatgtagtgtcggtaggatttgaggaggtagggcatcactgcatggtgggagaaaggacatagggagggatggaaaggtagccgaatacagatatgggacaaagatttctaggcgctgggagactgggagggagggcggagggagacaagatgaggattctaggcgttggtgcaacagatcgatggggacggggattcattggtcgaatataatggcaacaggtagagagaggataatgagagaagaggggtggtctctttgacgaggtgtttctcacaagtcctgattggtgcatacacgctacctgcattgctacacatacttcgggtcacgaagggtcatacctgtgtactctttcattgatttggagttcggatgagaggctgtgcacacgacgtgtgtagtgggggcaggagaacattggtcgtggactcgtggtcttacgatcgatctgtcaacttgatgttttttctatgtattccatatatattagtggcgaacctagcactaaaatttacctatggtggatcgattgatatgactaacgtattacacatttaattgatgagttaaatataattatacacaaactatatactataactgtcagtaaaatattaatttgccactataattctatatttgtcatgtgatttttataaacgaaaatttaattttctcatattgaactttttttttctacatgctgctaccttttgtgcctatgctttatagccttggatggtcagtccaatcaacatttctttatgaaagtagagaagtagtaaaccattgttacacttaccaaatcagatagccaattaatcatgtgattatcatctaaaatcaacatgctaatgaccaatggacaaacacctacttgctttgccggtggcctagctatggccagacatggcatgccacaagagaaggtccgccactgatatatatgctagattataggaatgtttaacgaattttgtcgacttacatttggaaaaacaaggtaaactttcttatgaggaaattaaaactttgacctcatatttttcttaaaaataaaacaaccaaaatttgaaacgttcaacccaaatttcaaaacttccacttcaatgtttaaaactttcatctcaaaattttaaactttctactcaaatttgaaacttcaaactcaaacattaaactttcaacccaaaatttgaaactttaaatccaaaattctaaaacctttaacctaaaaatttaaacttttaacttaaaatttcaaaactttcaactcaaatttcagaactttcaactctgattgcaaaacttttatctcggatctcaaaattgagttgaatgttttaaaattctgagttaaaagttttgcattctaagttgaaagtttttggattttgagtcgaaggtttaaaatttggagccgaaagttttaaattttaatatttgagttgatttttttgcaattccaatttgtaattgctcattttattgaaaatgtcattaacaatgctaactaatgtgattaacctgaattaagtggagtaagtgcgtacgtcgggtttcgctcgtcggcccacatggcggggttgggctctgcgctagtttcgctagtaactgcatgcatgcaagtctcgcgcgggaaggaaggaggctctcataggtgcgagcaccttccaaaaacaacgtgtatgccccaattagtcacccccgatgtttcttgtctctgagccttatgggcctgacaggtagggcacatgcatcgtgggcgcatatgcacaaggaaaaagtctaatatggctccctcaaatataggtcggatcttgtttgtatttctcaaccaaaaaaccaaatataacgactcatttactcctaaaaccatataaaacaactcccttgattgtttttaggttgtttttcgctgacgctgcatctacataacaacgcagtctataaataaatcaaaagagagacatggatcccacataaaagcaactacaacttcttcttcctccctcactgccatctctcctctgtcctatgagcactctagttgggagccgttgccgccccacactggccgcccatagcacgtcgctgctcggagggtgccctccacctcctactcctgtgcatgggcatttgcgctgcctccgagccggtggcaagggctctgtgagcattggtgatggaaaggctacttgcctacctttttaaaaaaattagccctaaatacaagcatgggtgtcaagtttaaaatttggatccgaatgaacaagtttcatcactagaagcctaatcagttgcgctgcatttgttttgcaaacagcaataaaccttgtgtgggagcgctgacaaacacctcgctttgatgcgccccctcggttccatttgtgagattcctttacattagtaccctttttttttaccaagccttcacactagtacttagtccctgtttagatgggactaaaactattaagtccctatcacatcggatgtttggacactaattataaatattaaacgtagactattaataaaactcatccataatcttggactaattcacgagacgaatctattgagcctaattaatccatgattagcctatgtgatgctacagtaaacattctctaattatggattaattaggcttaaaaaaattgtctcgcaaattagctttcatttatgtaattagctttgtaagtagtctatatttaatactctaaattagtgtctatacagagactaaagttaagtccttagattcaaacaccaccttaatttaggatcctaaagttaagtccttagattcaaacaccaccttaatttaggattcggatcctctgcattaccgcaggcaggcacagtagctacagtgataagtgggggaacagtgttttatgtaagatcaacgtgtgttttgatttttattctgtgatgaacaattggcatctgtgattattggttttgatatttggagattatcgtcgaagtggttttggagataatcaattttcaggagatgaacagggtttgctgttttgtcgggaccggtcagaccaggcggtggttgccggtcagaccggctcatgtgtaacggtcagaccggctggcctgcggtctgaccggccgacgctgtgtcggttttggtttcaggttgtttgtttggatatccgtgattgtttcatggttatggcttctagatggatactatacatatgtaatactgttgtttgctaacaatgagtcaaattggagatagcttggtctcggaatatggtttctttgattgtttcatgtgtaggtgactcgatggctcgggagagaatttgcgttgatggaccgggagccggcttggtggtaagacgatgtccgtggtggtcagatatcatgcgggatactaaggctagagttgatgcacgtggttgatggagcttccatatggcatacgatggagatattgtgtgcatatgggatacggagtcgaatttggaaggagtccaaatttggtgcgattggttatgtaaagtttctttcttgtactagagggtttcctaaggtgtttagtactcttagtatgagtttggttcgtggctttaagctgcctacctcatgtataaatagagggggagcgtgaggcttcccggtatcgcttttatattgctttgagagcaattgagttgctagtttagctagggtttcgagtttagtcgagatttttgtaaggagtgctgttggtgcactttataaacacaaagagaagcaataaagttgtcatctactttgagagttctttgatttgtgtttcaccgggtttcggcggtctaactggcatctcaccggcggtcagactggcggcatcgcggcggtccgaccggcggtactagggcggtcagaccggcggcggcgacatgagctggcgattgatctcggcggttcgactggtgttacaacctcggtcagactgacgatatccaggcggtcagaccggcgctactacttcggtcagaccgctaaaagtttttggtttttgggtataccaaccattcacccccctctggttggtttagttcttgtgattcgatcttacaagtggtatcagagccacgtttgctcttttcgatctttaccgatcttgagtttttgccatgcctacttctaataagttttcaactaagccccatgttttcgatggaacggatttttctcattggtgtaataggatgcaatcttatattatggctgagaattaagatatttggagaaaagtttctcatccttatgtgattcctgaagttattaatactactgctgcaaaaactgagtttgaactaaattgcaaagctcgcaatattcttttgagtgggatttctcgttcggattatgattgtgttgctcatcttcaaactgctcatgagatttggattgctttgagtaattgtcatcaaggtacaaataacattaaagaacttcatcgagatctttgcaaaaaggaatacattaaatttgagatgaaacctggagaagctttggatgactatctttcgaggtttaataaaattttgagtgatcttagatctgttgattcttcttatgatgctaattatccacaatctaagatttctcgccactttttgaatggtcttgacatgtctatttgggagatgaaagttacatctattcaggagtctgtgaacatgtctactttgactttggattcactttacacaaaactaaaaactcatgagatgaatattctttctcgaaaaggtgattctaagtctagtgcttcggttttgtcttcaacttctttggatgttggtgcttcttcatcgaagtcttctgttcttgctttatttaatgccatgtccgatgatcaactcgaacagttcaaggaggaggacttggttttgttatctaataaattttctcgagctatgaaaaatgttaggaacaggaaaagaggagaaccgaatcgttgttttgagtgtggtgcaattgatcatcttcgctcgtattgtcctaagcttgggagaggcaagaaggaagatgatgataaagtcaaagaggatgacatcaacaagaagaagaacacaaaggagaagaagaaacattgcatgcagtggttaatccaagaaatcatagcagcttttgatgaatcggaaggtgaagatgagagcaaaggtaagcaaattgttgatctagcttttattgctcgtaatgcaagttgtgatgttgatgaatctgaagatgataatgaagaaaagcttagttataatcaattagaatatgctgcttacagatttgctaagaaagttcaaacatgttctattgtgcttgatgagaaggataacactattgagattttaaatgctgaaattgatagattaaaatcttcgattcgtgacgatgataattgtcaatcttgtgaagttttattttctgaaatta

SEQ ID NO: 65251 - DNA, 10757 bp, Oryza sativa
  unsure (1)..(10757): unsure at all n locations
ttgacaaaaaatgtgttgaaaaaaatacaaagttgctttttgtgcaagttctttggtcaatgcttcatgtgcaaataaggcaaaacaagacaatggtgttttgatttctgaagattgttcaaagtgtgttttgaatgagatgaagttgaaaaatactttagggcatgttaaacacatggaagaaattgttaaacaagatgaggtgttttcttgctcaacttgtagaaagcaaaaaaggtcttttggatgcttgcaaaaattgtgttactcttactcaggaggtttcttatttgaaaagttctttgcaaagattttctgatggtaaaaagaaccttaacatgattcttgatcaatctaagtttagcacacacaatcgtggtttagattttgattcttatgcttatcatgctagacatcctcctactgttttgggtgttgctaggagaggtgaaattttgattgaatctgagcctaagaacactgtgtttaaatctgctggcatcatgtcttctttgaatgcatcttcttcgaaatcaaatgttgtgaatgcaaaaccttctgttattgcaaaaccatcaatttcaaaaccatctacttcacaaacttgtcgtgaaaagtacacttgttctttttgtggaaaagatggacatttggttggtttttgttttagacttgcccataaacacaaaaaggaaagcgaaattgcttttgcaaaacgacgttggcaaaaatcgggttttaattcgaggaccacggttagaccgacactgatcagtcggtcagaccggctagcggttagaccgcagttgaaccggcggttagaccggttgccaggcccggtcagagcgcaggcacaacggcggtcagaccggcctcggggtgattttgcacgaaattcaaatcggacttttgtgaagcaaaaaggtaagttttctggtaagtctgattctgattttgtaagtgcatatgtacctactggttctagtggtcgtgtgactcagtgttggattccaaaatttcttatttctaaccccaacacggaggcctcgacatcttctcattcgtaggtattttggcggcatactccccatgagtgttcaattttgagatgacgattgcgttgcaaggtaacatcactttatttttggattgacataattttgatctactctcttgtttattagctttttcatgctagtatttgaggttgtagttttggttaatactattggatgtatgtcaattcttgagaattttggtgatatcgttggtaattggatgtttttttcaaaatctttgatttcttcttgattttttcggggagaattggaggttattttgagttagtgctttttatgaattccttttggcatgatttgagggggagtttgtacctcatggttttatcaagcaacgatgtgacaatgaaaaaattaataaaagagagctttgtttatacatatgatattttcttatgcatgctagcaatactttgaaggtttatttgtcttttcatgagatttagattttgcttttaaaggagatgatgcatgatacttaaattctatacttgaattaagtaaatatgcaatgttgatgctagcatatggtttgatttataaatgctctatatatatgctttattgaattgttattcctcaaatagctttaattgctcattgtgaaaagagaataaaaatatgaaaaaaatgaataccgaatccttggaaacagtcttgacgacaaggacgtattcgatgtgagcaaaataatgggtgccgaatccctagaaaccgtcttgacgacaaggacgtacccggaataaaagagaaaaatataagtaaaaagtctcgagaaaaaaaaaggttaaaaaattctcttgttttgtgctaaagctaatttgagaaagagtgataaatgcaataggtatatgtgtttagtgtttatttttcaacctatgtgcttgttaagatgttgcattataaatcatatgaaatcatgaattttgattgttgattcaagcttaattgtaaaatctttggttcatggttatactttaatgcatgcttgttatattatagatggattcatcttctttttattgcaacacatgacatgatatgctatatgtatgttaagctcttatactttaataaacataattcctatgcttgatgaaatcattgtcaaaagggggagaagagatgagttttggaggaaagagatgagttttgggggagaacatatgagttttgggagaagagaagagtttttaagacgagcatgtttttggttcaattggaaatttctttcttttaaaaagggggagaagttttcttttggatttttgaacttttttttatttttccaaaaaccaaaacatttttaatgggtttgccaatgtgttcatcaagggggagattgtaagatcaacgtgtgttttgattcttattatgtgatgaacaattgacatttgtgattattggttttgatatttagagattatcgtcgaagtggttttggagataatcaattttcaggagatgaacagggtttgctgttttgtcgggaccggttagaccgggcggtggttgccggtcagaccggctcatgtgtagcggtcagaccggctggcctatggtctgaccggccgacgctgtgtcgatttcagtttcgggttgtttgtttagatatccgtgattgtttcatggttatggcttctagatggatattatacgtatgtaatactgttgtttgctaacaatgagtcaagttggagatagcttggtctcggaatatgatttctttgattgtttcatgtgtaggtgactcgatgccccgggagagtatttgcgatgggccgggagtcggcttggtggtaagacgatgtccgtggtggtcagatatcatgcgggatactaaggctagagttgatgcacatggttgatggagattccatatggcatacgatggaagtattgtgtgcgtatgagatgcgtagtcgaatttagaaggagtccaaatttggtacgattggttatgtaaagttttttttttgtactagagggtttcctaaggtgtttaggactcttagtatgagtttggttcgtggctttaagctgcctacctcatgtataaatagagggggagcgtgaggattcccggtatcgcttttgtattgctttgagagcaattgagttgctagtttagctagggtttcaagtttagtcgagatttttataagaagtgctgttggtgcactttgtaaagacaaaaagaagcaataaagttgtcatatactttgagagttcttcaatttgtgtttcaccggtttcggcggtctaaccggcatctcaccggcggtcagactggcggcatcgcggcggtccgaccggcggtattagggcggtcagaccggcggcggcgacaggagctggtgattgatctcggcggttcgaccggtgttacaacctcggtcagaccgacgatatccaggcggtcagactggcgctactacttcggtcagaccgcgatccatggatttnagggtaacttttatttccgctaaaagattttggtttttgggtataccaagcgttcacccctctctagttggcttagtttctgtgattcgatcttacattttaatgcacagaacagtaccgttacagtgatgatttactgtatatacagggatgaaagtactgtgtgccactgtattggttttactgtagcgaacgatctgattcgtccgtccttaatcggacggcccacaatactcctaatgcctggtactgtagcaacctctgaattttctcctccacagcagaggatcggaattccttaatttaggtattcagaggagcatttataaaagtatatgcaatgccaactgggcatgccattttgccctgcctcggtcagtgcaaattttaaaacatgcttcgagttggttaaacaaaaagaaactataccaaactagataatgatctgtcgagaatgctggaagagattgaatcacatgaacgtaaatgaatgtattggcagaaaatggcgttcgtaaacacggcaatttctatgtgataatctcatgttcttaaaatatcccaagtccccctaaatcatagcaatctatatttgagagctcaggttgatgtgttggctagaaaatatatatagccggacactaacaaataaacgctataatatatttgaaaaatatttctatttatttatatgaccacatctggaggaaaataaagaaaattcaatgtttccttgctacaaatgctaatattacttaaaaacatttatacaaaaaaaaaacagcctaaaatgcactacacgcaccaaaaaaaaattcagagtgaaaactaacaaagcaatatacaacatcaaatataatgtaaagaactaatattagtagaaaatataaattacataagcatttaaatttctatattgtttctaaaatacaatcctcagtggtgtaaacttttaattcaaaaaaaagtttataatatgtaaatttataaaaatacaaattatataactgaattttgctataaaggtgttgaaataatttcataggaatattttaagtgaaatcccttaaaggtgtattctggaataaagggttgcataaaagtttcataaaagcgagattttgtttgctttgataaagccaagtaagtggaggatactatttggttgtaattttggatacttctcttttagatatctttgcattcccattcattattagaaagtccagaatgttgattgggggttgaagatagatttgagaagaaactgcatacatggaagggcaaaaacatgtcatatggtgggagactagtcctttaaactcggttctttcaagcattcccctgtttatgttatccttcattgaaattccacgaggtatgcttgaaagattggattattttaggtcacttttttttatataatgatgaccgaaaaagaaaatatagactaactaagtgcaaagacatatgccgatcaaaatatcaaggtggactaagtgtccataactttgatatcaaaaatagatgcccgttaagaaaatgcctctttcggttggttaatggtgaaggtgcatagcaagaccttttgcgaaataaatagggtgaatagccagttcagtccttcaacttttgctcaggggtcgaattagtccttgatgttttataatgtccaaacaagaccctaaagattatcatgcggcttaatatagtccttagacctacttaaaacgccatgtggacatgccaagtcattcgtgcatgtaagataacatttaaatgtccattttaaccttcattttttatcaaataaagaaaagaaaaacaagaagaagaaatcataaaacaaaggaaaatgccaatttttttagctatcaatgctacatatttttgccaatggccaaaacctttttttttgttttttctcaatagtttttctttatttactataaaaacgtaagggtggaatggacatttaaatattgaatttgcatgcatagatgatgtggcatgtacacatggcatatgtttagagggtccaaggactatattgaatcacacaataaacttaaggtacttgtttggacaatacgaaatgtcagggactaaattgatccttaagcgaaagttcaaggatcatgtcgggtattcacccaaataaatacttaaagggtaaatctctatggtatgtccaacaagacatgtatttctcagttctaggcaggtgtaatgaaggtgaaagaccattttcttaggtttgggtattttagatatggcaataggactgacataaaattttgggaagacacatggtttggatcgtgtgctctcaaatatcaataccctacttatacctatgtggcttgaaagaagctatctaccgtagcagaggatatgagcacaaagccattgaatattcctttcagaagagccattgttagccaaaatctaatcgagtggaaaaatttgatcatcaggttagctaatataactctgtcaaatgaaaaggactgttttgtatggtcacttcataagaatggctaactttcggtcaactctatgtataacatgatcatgaactccaatattaggatccaaaataggattatatgagacttaaaggttccacgaaagatctaggttttatgtggtttcttcacaagaaagtaattctaacgaaggataacctggttaaaagaaaatgagggatacaaacattgttctttctactacgcacaggagaaaatccaacatcttttctttgagtttcatgttgctcgatttgtttggagatgtgtgtgtgtgtgtgtgtgtgtgttttcttttaattaatatccttccaccccataatgctaaaatatttttgggatttggcttagaggggtatctaggtccataaaaaatgattttaattggagctaatggtcaatttggcgttgccataatgatagtttttcatggtaaataattatctaaccctatccatgttatcttcatgtcttcgtattggctgcacttttgatctacgatgctatcacagggagagtaggatactatgcgcaatggtgttacactcttggaatcagtagccaagggtctcttatttcactatgggtggcgtagttccattagaattgctagctaaaaagactatgtggtttaacgctagtcaatattaaaggggagttgaggatatatttatctcatcaccttatgtcttatttttatttttttatctttacctttttttaacaaacttatggttatatgtcttatgacagaagtcagagatgcaatccattttcattatttagaaaaattagcaagatttcatgtccagatgtaaaaagaataagaccatactatatgtctacacccctcaaactattgcctaaaaacaccctcaactagtttacacccctcagctatcagtactggttaatataccccttgctgacaatataacccaattttaattgatccccccttatttttaacatccaaatatatgttcttgtacttgttgacatttatcagtaacttggtgtcatacaagtaaaaaaaaatgctatttttatattaaaatcataaaaatcataatttatatgctgtttttaagcctgttttgacagttgaggtgtgcaataatctagacttattcctattaaaaaattgttttacagaaatataaaataatgttaaatattctaagtaatttacatgacttggaatcttctttgctcaggtcttcttatatttttctttattaagctacaaggacctcatggtagtaatttacaagttaagtccttcctataatatagccttgacatgtttgaccaaaccttttcccaagaggtggcaactgcaaacacatcgggtaaagaaaaaaaatgaagaaagaagcaactgcaaacagatagggtgaaattaagagtacattaatctgcactgatctgacacgtagtatagtaaagacatatgaaataaaaaaattatacagtgtagaagtttgctatctcattctcatttcaagtgcttctatttataaagtctcaagctttcctgcctacctcattccatcctcctgcgctctcaagctttccttcctagattctgcattccgatttccatttcacacattcaacgtcaaggtattatagctagttactttagcctttcttaagaagaacaactcacaagtaagtgccattcatcacaccgtcgtacactatgtttggttttgtttgaagggcattttgctcctcatggtcttcaaacttaagtgccaacacttctgatattaccttagaagaatatagaaaaatcagcttgtctattaggtgttctccaagagacccaaaaaaaggatctcctcttgcatgttacaccttttacctttgttttaccttgaaattcatacattttcaattgcaatagcccaaaagatgttcttttaagccaattaaaagaaagaaaaaactgccacacttcagtgtttccagagtttctcttgggataggtggattactctctctcttttcaaaaaggagctgtactttcagttttgcacaattttctcttcgaaaaagaccctgcttcaatagttttggggcgttattttaccaatttgcagcctgaggttcaatgataatttcagaacaagttttgcagataaaagaagatagattattactagtcctcttcatttgaaaaacagagaaaggagaactttttgccataaatggctcaggagtaccagacaatgccttcttctgctcacgacaagaggtactcaggactgtcgaatggtggtgacaaagaacaattgccatctcaaggtatttcagttccccttatggatctaactagtgttttgtttgttcaggtgtttgtgtcactctttcatgtttaacggttggaagtgagttattatacttgttttccaatgtacttcctttgtttgacttgtatagaatcagaagttcctttgactactagatttgatgggaatgcaatgcaagtagatggactcctaaaaaatgtttctcccacaactaagattgtggtgaaaccaaatgaggagttgaagtcaccgttcttggtaaagcgccacctatttcttaagaggcctgatcctattatactagacgaattgtacagcttgactacaaaagtaaccgatgaagagtccagacagtaagtgtaatttgcgtcctttaaacatctactacatctgtttcaaattacttgtcgttttagctttgtcataagtcaatcagttttgttactgcagtcatgaccagccttattattgattgaattgcaggtctgtttgggtatcaggcaacctgccgatcaatttaaagcttgtagatatccaggaaacaataaaacctgaaggagtcatgggtataaattgcatggacttggctgttagaattatgtcaagacaggatgctgaaatttttaaaaacacaaaatgtctaggttggaggcattatgttgattcaaattggaaggtaagtttgcgtgagtgcgccttgggatgttgttggcggcatataattcctagttctactcttctcctagtgtcataataacaactatttttgttccttgttccacagcaatatatcaatgatcccaacaatctgaagaaccaagtattcccgtttgtctactatgtatgatccttcaagttcacatctgggatgaacccttttctatttctatccaaattgggtataactgaaaaactctcgctaatcttttggcatccaattggtcctgccaataaaattaaattaacaaaatgcacccagaaaataaccaaattgaatctgaacattgttttttttggtgaaaatgggggatatatatataggtataaatccttgtttaatctgatggccattgaactctatatgctttcaacatgcatgataagaagctctgcattctggattctcgacgagataccagtgaaggcggtgatcaggatccagtgaagcgtcatgagaaaatccgaaaagaagtctgccatgctcttaacgaaaccatggatgttgatttcaattttctctcttggaagcatgagtttcccaaagtgcctaggcaacagaacaggtgtgactcttaacacccagctttgcttaatcttcttcccgtctttattatgggtatatgttttactgcatgataagtgatcaactcatttttccctatgatttatttctagttgtgactgtggattctttgtattcaattttatgcgattatgggatggtcatcgactgattcggtggttttcaactgtaagaaataattcctggagagttaattttgattggaatacatattcaatatattatcgtcattaattttgtatatgcatcatcttgttaggaaacaaaggagttgcggaagaactttctagcatacatactctccagtttggatgatcattcagtcctgcctactaatgtctctgagttgatcaaaaagctccctggttagacacatcagagtttgcattttcttttgtgttttgttataggacacatgaacttttaaatacatagttttccgactatatatgccaataagaccttgtttgggatatgattggcccagctctaatgatatagttttcgtcttgcctaaacagaaacttaattatctgattgatcttgttggtgtttctttgtttaggggaaacaatgatgaatgttgagctattagaagctgcacgggcaggcaacgcaaatgcattttgtgaacttgttatagatcctgcaagaagtattaatcatgagcccttcagatctgcctcctgttcttgtcttctttttcggagcacatcatctggcagctattgtctctgttttgagtgcacatcctcacgcaattccgatcaagaaaagagtccaaacaagcataatgcattaacacgatcagatgcaccatcaacatttacgagagatacaagggacatgctacatgctattcagggtgtaacggttgaaggtgacggggtgctccacatcgctgcaagctttggtgttttggaacctgtgaaaaccgtcttggaagcgcagaatggagctttcgcaacggcgcttctgcaagcagagaacaacaaaggagacaggcccctgcactgcgcagccaccacaggtagactgtaactatattgtttccgcaaactaa

SEQ ID NO: 65252 - DNA, 5057 bp, Oryza sativa
  unsure (1)..(5057): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagagttcatgagaaccaagccgcccacgttcgctactgccgacgagcccatggaagcaaaagactggctacgcatcatagaaaagaaactgactctagtcagggtacgcgaagccgacaaggtgatcttcgcagtgaaccagctggaaagacccgctggtgattggtgggatacctacaaggaagcccgagaagacggtgctggagaacccacctgggaggagttcactgcggcgtttcgcgagaatttcgtacctgctgcagtgatgcgcatgaagaagaacgagtttagaagactgcggcaagggaatacaacagtgcaggagtatctaaacaagttcactcagttggctcgctacgcaattggagacctggcagatgaagaagaaaagatcgacaagttcatagaaggactgaatgatgaattgcgtggacctatgatcgggcaggatcacgagagtttccagagcctgatcaacaaggtcgtcaggctagagaacgatcaaaggacggtggaacacaaccgcaagaggaggcttgctatgagtcacccacctcagacagtgcctcagcgacttaagggagcccctccgtccggatggaagccccctgtcatggtgaccaaccgtcccgctgcacttagcaacttcaacaggccagttgcacttcagaaccgcacccctacaccaactttggctgcccctggagccaagaagaatgtggactgcttcaactgtggggaatacgggcactacgctaacaactgccctcatccacgcaaaacccctgtccgaactggcgcgaatgcaatgactgttcgcggcactactacccctgctatcgggcgaggtctattcaagactccgcaatctaacaggaccgccactggatttgggcgcggacaagtgaaccatgtccgagctgaagaggcccaggaagatcagggcgtactaatgggtatgttctctatcaattccaccccggttaaagttctcttcgattccggtgcatcgcattcatttatatctctgaaggctagtcaaaagcacaacttgaccctcgtgggacttagaaagcctatgatagtacactcacctgggggcgagataactatgagtcatgcttgcatagatgtaccaattcgccttagggatgtggtatttccctctaatcttatggtgctaataccccaaactcttgatgtcattttgggtatggattggttagcaaagcatagaggagtaattgactgtagacgtagagaggttaccctgaccacaccctggggatcggatatgagagcaaccatggatcaagaacctaggctaaccgaacgtgctgggggtatattcaccatgctacccctaaagggaatgcctgtagtacagcgatttcctgatgtgtttccagaagatttacctggaatgccaccagatcgtgacgtagagttcattattgacctgatacccggaactgcccccatatccaagagaccatatcggatgccggtcaatgagttagaagaacttaaaaggcaaatcagagagttgcaagagaagggatttgtacgccccagttcgtcaccttggggagccccagtgttgtttgttaaaaagaaagacggtagcatgagaatgtgtgtagactaccgatcactgaacgaagtaactatcaaaaacaagtatccactaccacggattgatgacctcttcgaccaacttaagggagctaaggtgttttcaaagatagacctttgatcaggataccaccaactgaagattaggaccgaggatatccccaaaaccgcgttttcaacacgctatgggttgtatgaattcacagtaatgtcgtttggtctaaccaatgccccggcatacttcatgaatcttatgaacaaagtattcatggattacttggataagtttgtggtggtattcatcgatgacattctgatctactccaaagatgaagaagaacatgcggaacacttaagattggttctccagaaactccgaaagcacaagttatacgcaaaattcagcaagtgcgaattttggttgaaggaagtcgcttttctgggtcacgtaatctcagccggtggagtagcagtggaccctgctaaagtggaggctgtcacggaatggaaagcacccaaatctgtgactgaaattcggagttttctaggcttggctggatactaccgaaggttcattgaagggttctctaagatagcccgaccaatgacacaactactcaagaagaaaaagaagtttgtgtggtcagaacagtgtcaggaaagctttgagcagctcaaggaaaagctgacctcagcgcctattttagttcttcccgacatcaggaaagactttgttatatattgtgatgcgtcaaggcaaggactaggaggagtactgatgcaggacggaaaagtggtggcctatgcgtcgcgacaattgcgaccacatgaggaaaactaccctacccatgacctagaactcgcagctgtggttcatgcgctaaagatttggagacattatctaattggaaaccattgcgatatctacactgaccacaagagtctaaagtatatcttcacccagtcagatctcaacttgaggcaaaggcgatggttagaattaatcaaggactatgatttagaggttcactatcacccaggcaaagcaaacgttgtggccgacgctctgagtcgtaagagccattgcaatcatctgagaatggaagggatggtccctgagcttagggaggaaatagctcagctgaacctacatatagtaccccgtggacagataaacaccctggacattcaacctcttttgagaacccaaatagaagaagcccagaaggacaacgaggaagtccgagagttgaaggaacgcttggctgcaggacgtgcaaaggaattttcaaccgacgaaaaagatgttctatggtataaaaagagaatttacgtacctgaacagggtggactgaggggattaattttaaaggaagctcacgaatcggcatattcattgcaccccggaagtacgaagatgtaccaagatctgaaggaaggatactggtggcccaacatgaagagagatgtggccgaatacgtagcactctgcgacgtatgccagaaggtgaaggctgaacaccagaggccagcaggtttgttgcaacctctcaggattcccgaatggaaatgggatgagataggtatggattttattgttggattgcccaaaaccgcaacaggatatgattccatttnnnnnnnnnnnnnnnnnnnnnnnnngacagcgagattcattcccgttaagacaaattatagcagtgctaagctagccgagttatacatgaccaggatagtatgtcttcatggtgtaccaaagaaaattatatctgatcggggcacacaatttacctcacatttctgggagaaagtccatgaagccctaggaagttatctcgcatttagcacagcttatcatccacagacagatggccagacggagagaaccaaccaggtcctagaagacatgctgagggcttgtgctctggattttagcaaggactgggagagatgtttgccctacgccgaattctcctacaacaacagctttcaagcaagcctaaagatgtcacccaacgaggcattgtttggtcgacgatgtcgtaccccgctaatgtggtccgagactggagaacgggcggtatttggacctgatattattcaagaagccgaagaaaaggttcgcttgatccgtgaccgtctaaaagtagcacaatcacgacaaaagagttacgccgacactcgaagaagaaacctggaatttaaggagggagattacgtttatctaaaggtttctccgatgaggggaaacaaaaaggtttaaggtcaagggaaaactggcaccaagatatgtggggccattccagatcaccgccaggcgaggagaagttgcatatcagttacaattaccgaagaatatcgcggaggtgcacccagtcttccatgtatcccaattaaagaaatgcttacgagtgccggaagaacaagctccgctggaagagattcacattagcaatgatctcacatatccagaacacccgattcggatattggatgaagcagaaaagaggactaggagcaaagtgtggcgtatgtacaaggtacaatggagtaatcacactgaggctgaagccacctgggaaagcgaagaattcttgaggacggagtacccgcatctattcgaaaactggtaagaaatctcgggacgagatttgtttaaggggggtaggtttgtaacaccctgaaaattcgaccgacaaaacaaaaactctaaaaatacggattttcaaaaactttttaaactaattgcatcatgccgatctcattcgtctattttatctggagttgatctcgaggattattaatcgtgagtaaagaatagttaattagaaataaaccctaaaaacaaattggtaaaataaatataaattaaaaataaagattaggtgtggatagtaataaataaaatattatcgcgaccatatttggatcaattaaatttcattgcgatggaataagaattaaccctaattaaagctcaaataaattatataaaaataaaatatgagtaatattaatctaatctagggtgaattcattagttgagataatacacatattgagtaaacttcatttatgcaagatttagaaattatagaatcaaattcatataggaaataaactaaaattgggaaaaataggaaaaagacactattcattagcctctaggtgttcgacgaggttccctagccccttcccctcccctgccatgcgcgcctcgcgccccgagccgtcgccgtcgc

SEQ ID NO: 65253 - DNA, 14830 bp, Oryza sativa
tcgctgtcgccgccgttgccgtcgccgtcgtcggtaagccgccgcccaacctttccccccctcgcgtccatcgtcgccgccgcccgggagagcaagagccgagagagagagatagagccgggagagggagaggaaaagagtgccgagagggagaggaaggaaagaaaaaggaagagagaaaaagaaagaaaggaaagaaaagaaaaggaaaagagagaaaaagagaaaaaagaaaagaaagagaaaagagaaaaaggaaaaatttaagagatttagaatatttaacatattagaaattaattataggattaatgagaataccgttagatgaactcctactatttaaaatacctaaagtactaagatttgattatagaactaattatttacgaattaaaacaattagatgaatcttaatagattgttatagattatttttagtaatgtctataggagatcaattcgcggtaataatttagatcaattcgcggtaattattatagattattttgggtaatccctataagtaatcaattaacggtagaaaattcggatttagttactagggattatagccgtgtaatatatttaatcgtttagtcatagactaaattaaatcatataatgtttctaggattttgtcagatagttagctcgcgctagaaatctctaacctattatatggatataatgctcaggtagattaaattaaaaatttgtgacaataaaacatttatacccgcaaaatagtttaaatcgaaattgggtttgtcatagttcacagatagtaaaattaataaaaaggaatcgactttcgcatgtgacttttatttggatttatttggatttttatttgaattctaaccgaattcaaatcaattcttgcacgtaactatagagcccgagggagttgcggatccaagcgaaggccaagacccgcaagactttgagcaaggcaagtcatcactattctttgaacatgttgatcccaattgcgaaattgttttgtttacaaataaaattgcatgcaattatgaacatcctacttgtgattataccatgccttgattattgttcacctttaaatctttgtaaccatagatacgtacgagtccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgacgacataatttgtgaaaggaaaataaagtaaaacaactgttttcgactggggcggctggaggacttgggtggtgtctggaaaaggctagtgccgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacggtgggggcagccattggtaggaccgcgaggcgggtgtctacagtggtgtcgccatcggtaggactgccatgtgagaatctaaaacataattataacttaatgcatgtgtgagtcttcccttcccgggtgcgccagaactcctctcactgctagaaaccgtgtacgcctagagtgcatgaggatgaaaagttcatggagcgggtactgccaatgcgaggttatcaaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacgtgtattacacttggctagactctaaattcttaacttgtgtgggaagggatattgcatgatgaattttatgctgttggagccacttcctgagaggcgggaaggtggacgtcctcagaaaaccatgacgaatcaatggtgggaagctatccttgggatcacaatggatggtggacagaaccgtcgttgtttaaatacaaactctggtactaaaatttgatcagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttatcagaagcgggagatgaagcctcggaggatccctatgtctactatcaggagggagacgaagacgatggcgtccagtaggtcttagtacggtcgttgcctgtggcaatggcatgccgctgcctgaattccgctgccttatctatttctgcttttggatgtattccggacctctcggtccgatgatttaagactatgcctgcgggcctatgatgtaataattcgtattagatactcgtgtatgtgcacttgatattccagctatgaattcgtgtgtaccaaactacttgatccagggaaatggtactgtttacacgattgattcctgttataaaaacgggggtccacagaagctatgctaaagatatcccatatcttgttttatgaggatagatatcccatatcttgtttgatgaggactcttaaatgactttaatgacatgttcatcagtggtagagagaaagagaggctctgctaatatgacattgataaacttaacgccatgtaagctaatggcaaaaatatatttgttggattattcatgcgtcgtcaggagggatctggtcaattttaccaatatgtttttcaagaactgattacaatctaaactttcttgataatctaaactagttacttttcagcttcctccaccatcttataacttttcgaaaaaccatcctatactatacatgtgtgtgtggttagtcttcacatctactatctatttatatttcatatatcacacctcaattgtctcccttcttgtttaaagttggttgtatctacaatgcgtttatggtgatgagacatgcaaatgttgcttgatgagaaataataatgagtataattttttcctatgattttctcgacccatttgaccggtaaaaaaaagaagggaaaatctggttctataacactaaaagaatgcaattttttatttatactatatcaaaaatttccagttaattctaaaaccactaaaagtttgcatggtttccctttaaaccatttcttcaatatctattagttatatattaccacccaagtcagtgtttattcattacatatctctaccagatcattgtttagttattattagttaacaatatgagcacaacttcaccaccaaccagcatacaaaatcactattaactaattatatgaactactaccttttacctattctgatccgtttagattgggccatgaaacccaacactttcaccatcgctatatataccataccttttatcactatcacaatgcaagcacttccagaagaattcggtaacaaccaacgaattaattaaacgaggcactaaacaacatattaccattctaaggactttttaatagggaaaattacaaaaaaaaatcaccctagaagtcacttaagtttgacattccatcttataagtcattttattgcaaatgtccaccctctactcggttttgtagcaaaaaccaccctagtgcacacgtgcttaaatgaatcgatatgttttcataaattgtcttgacacttttcttgagttttcacaaatataattactgatgagaggttaaatgttgttgcactaagtttcattatatgcagaaacaaaataatgaaacacaaagaataagtctaatgcaaacacttagataagattgacccggctatcttagcctatgagactattcatcaatgataacagactaattcagcatgaaatggagagggtgccacttgcttaatttactctattttagatcaagttcaagccgatgcaagtatctaaatttgtattgagggtggtacacacatggtgaaaatatgtgaggtatagctaaaaattttttttaggctgggttcctgggcaccccccccccccccccacatactctagctccgcccctgaattcagctaaacacgtgcgaacgggatggtttttttttaccaaaaccatgtagagggtggacatttgcaacaaaatgatttatggggtgtaatgtcaaacttcaagtatcttttgtggtggttattgtaattttccttttttatatgaacttttagcacgtaagcatgcatgaactttctatgcttacctgttcactactaaataaatgtgtacatgcatgatttatcacattggagcgtcctaagaataactaatatcatgaatagtacaagcatacacaacatttcctgatctagttcaccacgagcaaaattctgataagcccctaaaaacgcgtgggacatacgttctcaatcctgttcacatgatccaaagaccataattaagcggcccagctgaagtacaccgagtaacatatctatgctaattgcatgagtttgccatctcatacacagcgatttcaactaattgtgacaggaatttgttcgatcatgcctgatgtatttattagctgtgtttttgtggtgaccatgcatccatgatcagctgccagaaaacatatgtatatgatgtgttcttaactgaataatatatgcatagtagtggtgtgagacagggatgttgattccatccccatgtttggacgaatttggcatgagaaagcaacatctgcattagagcgtgactttgtacatatgtttggcaacatacagccagaaatgtgttcatttagtatattttgtctacttcatcatatgaaatggctggtacatagcatgatcagttttggttatataaggatttcaataagagtgaacgggtaaacacatgtctatgttatcttatattaaggttatcttagattaaggttagcgcattgcaaagttatattagatgttggaggaaactaaaaaatggtgatctataaagaccgtgtgttattattttggatagactagcatgataacccatgagaaacctgacctccctaatattgaatatattttgagtgtattgaaggcgtgaccatcaaccaatcaacaaggaggagagaggccatcttaatgaacaagaatgattaaaagttgtctgagttcacaagtcatcgaagattataatggtggatcaaagattataaatgaagatggggtgggcactaaatagttttgggtgaatatattgaggtaggaatataatataatataatataagattgaaatttgattccaaaataacgataacagttttttattaatgagcagcacagaactaaatattgtaacaaccgatatgaatggccaccacttctatcttaatgcttatcagtcatgctatcacatgcagccgcagttgtatatcattagcttctcgtcttaagtgaaactgttaccagatcgttagtttgagaatgtattttaactcactctgtatttatatatccaattatccactattatggattggggcatcaaaggcctccgcatttgtcgtgtgcctttatgtacatactagtatagatcttgtggttctcctaccatctctcgctttatccaccggcagaattgagcaactgaaaaatttgctatgggacatccaaaaaacgtgtaattagctaggagacactgcaaaaacgcttatttgctataggacaccaccaaaaactggtaattagctactggacacctataggattattttattatatccggagaaattgcagagagaaacaattgtgtaagtacgattctacccttcgatttttttctttttattttttatctatccttttctactccttcttccttattcttctctctctattctttctcgctttctctctttgctcttcaagcgagcccgagggagcgccggtgaccgcgcgacgaggcgcgggctagtgtgggcacctcggttggaacggcgttgcgcattgctgaagtatgatggcctgtactcgggcgccagtggcgccgggatgtactagcggcgaccgagcatgggctccagcacaaggaggcggagccgggtggggctaaggaggaggacgcgcccgccacgtgagccgatgacatgccactcggcgtcatcgcccaaggcaaacaccccgccgggattacgcgccgtggcaccacggcggcggctccgacggcagtccctggtgctgtcgacgccgacagggatggagcggttgttcgcccaggcgccatggttgtggttgtggaagaacccgacaagggagcccctggcgcgccgccgtggaggtcgttgaattggcagaggaagcggcggctagtgagcatgcggcggaaccgactactgacgagggagacgtggtggaggcaggtcaagtgcggcggtagcagtaacacggcgagtgtcactagccacccctccacgttctcgctcgactcggccacgcccaccaccgccccgccacgccgccctcatccgccgcgtcgccgctggggcgtctcgaaggagaacgcggcgtctcgccgtcctcgtgtgggtatgccatggcgtgttccggctggtcgacgtggcgctgcgtgggagagagagagggggcttaaatttgagcttacatgtggggcccacgtttggattcatttgagcaagggcaaacttgtctttaatgattgtttttctatccaatttctccggatataataaaataattttgcgggtgtccagtaactaattaccagtttttggtggtgtcctatagcaaattagtgtttttgcggtgactcccagctaattacacgttttttggatgtcccatggcaaactttgcctaaaatactccctcaatttcaaaatgtttgacgccgttgactttttatcacatgtttgaccgttcgtcttattcaaaaaatttaagtaattattaatttttttcctatcatttgattcattgttaaatatatttttatgtaggcatataattttacatatttcacaaaagtttttgaataagacgaacggttaaacatgcgctaaaaagtcaacggtgtcaaacatttcgaaacggagggagtattaatcatgcatgcctgatgaattacacgttgccattttgtagtgactatgattcctcaatgagctttgagctagtgaaagacatgctcctgtagaaaaactaatacaaatcacaaatggtgtatttttcgttattaaaacgaatgatatttatcttccgttgctgctgggaatacaaaataacttccacaacaagctctcagttttatctggattgaaaaggcctattttgatattttcaactgtcagaaagaaattcaaagaaacatattgaatggccaaaagactagactttctatcagctaaaaaaatatacagtagcaaattggaattgcaatttctgacaataattagtatagcgtaatggttaggcctgtgggaacttgctaattgaaatattcactgttatcttcattgtctcgtcgatctcactgcacatacacatgcaagatacttcgatgtgcacaagtgtttggtcagtaattccccatacacaaatcttaatgaacacaaagaaatttggatttgatgtgtactgtagtatgtaaacagatgtgctttcctagcgatagtagctagtatactgatcatgttccttctgcaactgacgcataagttccatccatccagctagacttggtaaaaattaaagacaatagataagcatgcggcatacatgtgaacctgactgcacagaattggagatgtatatatatatatatatatatatatatatatatatatatatatatattacacatagagtaacttgaggagatgctaagctagagaggggaaatatttatgctaacggagtattatagtgaaaatttgagatttgtttttgtaaaataaacattctaagtagtttggtagtgctattgaaaaagtagcatagccagacagttggtgagaatacacatcaatttttgtaattgaagagtgatgtttaaatgagaggaaatatgctgggaaagttgaagcggacacaactgtaaaagatgttagttaaaccttaatcgactacaagattaaaaaacactagtgccgatggctagcgagaatgaagttatagtcttttagaccagttagagatgttggtgaatgctgaagctaccataattataagtgtcagtagtaatgttgattgaaccttaaaaaaccacaacattaaatcaacattggtgctggcggatagtgaaaatacaacttagtcttttatacaattgtgttggtgaaagcgaaaggaatcacaataactagtgtgaattgaaatgttgtttcaatcttaatcaataacaagatagattaaattaatagtggtgctagtgggagagagaatttagtttaattgagagtggtagtagtgggagaagagaatttagttttgagccaacaaatggcataacattttgatattatttccgtaaataaatccaccacgatgattagagtcagatgatgcaccttcccctatggaatagaaaccacctcttttaagcatgtaggtagggatggcaatgggtcgggtcgggtacgggtagagcaaaaccatgcccgacccgatacccgacattgcccgcccaaaccctacccactagagttagcgggcaaaactccatacccataaccatgcccagcgggcgcgggtatgttcagtgggtatccaatggatctcacataaataataacttgaaagatatgtaatttaacaaagagaaataaaatcaataatttaccaaattgtcggttatcaacaataatttgaattacatcacaattaattatatcccttcggaaatattttttccttgataataataccctccacgattttactacggttaattaagatggtattataaatagatttgaacccttcgatcaaataagattaacagttcagattactttctactaccagtagagagcaccgtaatgcgcctctaattaattaatagtgcagtaatgcagtggttaggcctgcctgtgggagctgccaatagaatgggatagctattctactgtcatcatcctttggctgtgtttagatagtggaaaagttgggagttggtagtttggaaaaaaaagttgctagtttatgtgtgtaggaaagttttcgatgtgatatgatgtgatggaaataaactaaacatggcctttgtctcgttaatttacctgtgcactcacgaaattcctattccacgcatatgcaccagaagtgctgtgtgtttctattccctcgtgcgtcccaccagctatatgcatttccctttttttttctttttttggatctggaaataaaattagccccatcaactacgccatatggtatacatgtatttcccttgcgcatgattcccagatctagagaaacaatgatgagttttttttccaggtaagtgtatgtgtttcatttatttggtatacatgacatttttttaacaaaaagcaacaactcaaatttgaaaaaaaaaaaggtccaaataaaaccttcatctcaaaattcaaaactttgaactcaggttttcactttcaactcaaaatttgaaactttcaactgaaatttaaaaactttcaaataaatatttaaaacttttaactcaagatttaaaactttctatccagatttaaaactttcaactcaaattttcatctcaaaattgagaacttctatatcgaaattcaaaactttcaattcaaatttaaaaaacttttaagtcaaaattcaaacttttatctcaaaattgaaaactttcaactatctttttttaagttgttaactaagttatttatgtatttttaaaaattagagctaagcatcatcattagcgttaatagtgatttgcgtgagtgactgggacgtacgggcgctttatgcagcccggcacacgtccactagaaacccccgtacactcatgctagatagtacttcaatatgcatgagtttaagctgatcagcaatttcaatcatgcagaaactaatgccggcgaacacaaagaaatgtggattatttttctgcacactgtaaacgaatatgctttcctattgaagagagaaaaggtagcatccttgtcgtattctttttcgactaacacatataagttccacgcatgcatacagccggtacctaagtaaagacaataggtgtgcctgaatctgatcgctctgaagcttcgagcagctacagcttcagttctaggatctagagcttcccaaaacatttcaatttttcgtccaaattacaagagctttagttctatggtctagaaaatgaatttgaagacattagttggtttcccccgattatttggatatattcttatcagctttattttaaccagctgtttatctgaatataaagttaccagaacaaccccttggttggtgacgaggaaagtgccaagaaaaaaagaaacatatgtatggaacaaaaactgctgatcaactgatcaagaaatatgaactcgaaatccaaaacatatgtagtactagagattttaacggagtttagcatcggaatattattggtaggaactataagaaaaactttgtatatagtgagtaatggaaggcagagaaaatggttaatgatttgttggagtctgaaatcaactacaaatccaaaatagattagtaaaaactgctaatacaccacgaatagatgagtaaaaactgctaatacaccatgagctactatgcgttgccattgtattgtattgtgttgcatgtcatgcatatcaataaaattgtacttctcttcgtaagttccactgactacttctcttcatgcatgtgacaacaaacactcgtgttaaacataccgtgtgacagttaaaagtgaaccggggaggcaggggatgtaaaaacaacatgagctagctatatatatatatttcatcaccatatcaaggtcgtgcggactcattcacaacgtgtgaccgagataactatctccaatataatagcgtttttttcacttgtagtttctctgtgtagttatcctaacggtggctagcttccaccttattagcgcacttcatacgaggagaacaacaaagccgagataacatgtttcgaaagaaaacatgtaattaatatgattgaaagagaggagcgggtggatgacatgtgaatgcatatataattaaaatatccattacccattagaaggggatcagctgaaaagcattatagcattaagatatttggctgaaacaattcagtattttatatgtgctactaacatagcgcgactagataagtgaaatgcgagaaaaaaacaaatatggaaaatgaggttttggaggaagccaaagaaagacaggtgaaatgcgagcaaaagaacaaatatggaaaatgaggttttagaggaagccaaagaaatatatttaacaggatgatatgatggggattgggcggaggccagggctggggaggagggatacttgttataataatagcattactactcccatattcttgtcaaaaactaattataaggaattttttgtgatagattggatccaacagatcttaacccctacatatctagtgctatatgtgaggagattttttatgggattttgactgggtttggcatcgggattattggtaatattgtttgcccaacaataaaagagtactgttctaacagtatgaaacatcacaggatatgtactgaaacattcgaaataacactacgtgcaacatttccaaatcaattgcagaacatcgaaaagtacttactagaaaatccaaataatactgtatgcaacttaaaaaatctatgataacaaatcggggacgactccgcgtcgaacgtccgatattccaccaaatatcggacacccgtctgtctgcgcgcctgtcatgcctcctgctgatgcagcatgcatcttccgtctatcatgcacctctgtatgccacatgcagcctaccacatatattctagtatatgcgcctgtcacaccacctcttccttttcctctttccttctcacgtactccctccgtccaaaaaatgacaaaccctggtttccgtgtccaacgttcgaccgtccgccttatttaaaaaaattataaaaaaaattaaaagacaagtcacgcataaaatattaatcatgttttatcatctaacaacaatggaaatacgaattataaaaaaatttcatataagacgaacagtcaaagttggacacggaaacccagggtttgcctttttttggacggagggagtatagtatactagcacttttttctccttttttctttcaccaaaatttaatcaaaattttcttttaaaatatacatctagtttatgatctaattataccattaagtttgttatatttgaatttttttataaaaaatctcatacagttatatttttattaaaaatatatgtataaaaatcaattgttgttcacaatttatataaaattgtttcacctcactaatgaaatgcgttccagagaaatgcaacatataaaatatattgactgtaacaatgacaaccattgtatgaaacattaaatacgaactggtgatacataacaaaatcatatgaatatacaaaatatttataaatacttaattacttgaaatattttctttatctcatccatgaagcacagcgttgtaattgttgaaaaaaaaaaccctgctgaaacataaaaaaggattatgtgcaacatttgtacatgaagtagtgagacacccggaattacttattgaaacatttatataataccatatgcaacattaaaaaaaattaaacgtgcaacatagtctaattttaaatgaaacattctcttctcaccgagtgaaacatcgagttttaatggttgaaacatataaatatatgttatcgaaatataatcatgtgatatcttgttttgaagatttaattacaacgaatacttcgatataattagagcttggatcggataaatagttttgaagaaaaataattttaaagaccacgtttcatttacacatcggtgtgaccgtatatatgtgcttgcttgcatgttgtgcatgcgtgcatccatggatgacgtaacggagtgagctgccgtaggcgtccgacgttttttatctgatcggacgttcgaagagaaacattttcataacaaatcagctataaaaaattttttcatcagaatactctctccatcctcttttatttgacgtttccgacaagtttgataaaattaaggtttgcacgaaatgtcttttttatccttcgtgaacttcgtctcccccaatgctgcagtgctatcgtgagcgagcgatggcaaagaacagaacacccacgactgacaagctcaacctcagctgcccctacataatcgccgctgccccgatcgatgtgctgcaccatctcaatcgtatgatggtagagagatttgtgccgcggagctgcgcgattcgcgagctcatcaataccacggtggccactgcacagctccccgacgatggaaatgaaacccaatggcaacagctcttgctacgtgatagtgatttaaccccaatgacggcatctctcctcaggcgaaggtgaggaacgaaaccccaactcctcatggtcgcctccagcgacgcatatccacccaattaggaatccatagggggtaattcatactttttctatactataaaaaatatacttgagttacaacgggtgaaggctattttaatcaattattgttagaattttttttgtctaaaaagtatatgcgattttattttgatagtattgatatctaatttgggaatcttattgggatgatagtcatatccagtaagttgctttctaattatctggcaagaattctaaagcaattatgagtccgactctcgtcctttgtaaagccatataccacccccaaagggtatgaaaataccggatgaccttagcttttcaatgaatcctcatctcgtgtagcgaagtcctgttagtaagaccccgcacaaaaatggattatataagaatataattccgaatattcctccgggtgcgtatagtagcattgcgattccaaatcttttttctttatgaatagaaaaaaatcattgtaaagttgatatgtgagtttactaaaatgatttcttatacgactccttatgtatttccaaaagtgtacgaacttaaaaactaactcaatacgaatgacgtaccaaaattccgacagaaacatcttcaatttttataatagtagagactgaaaaaatacccatgcgttgcaatgggtaaaggcatttttttctagtgatacaactattaagagccaaggaataaattgaaacataactattgctatacattataattgaaaaggcgttgactcctgcttgcctctcttaacttccataagacagttacgtgcccgtgcaatgctgaagccgatcccgcacaatgccaaaactgttcactgatcatcccatcaaatcgattttttatcaatctcccaaaattgattgagggcttttgatccacttgatcagttctttagtttttcctaaaatcagagcgaatccgtaaactcaggataaaaacggcggggcaagatcatctggataaaaatggcggagaagatcatcggctaccaatccttcaca

SEQ ID NO: 65254 - DNA, 16526 bp, Oryza sativa
agctccggcggtggcggcgaacgccgtcgcgtcgccgccgggagagaagcacaagaggaggaggaggaggagcaaagtcatggccatggccacgattttcccacttcttggatcattttgctgcgtcatcttttgcttcggattggtcagaaggtacaagaaaggtaaaagctactctatttcatattataagtcatttgactttttacttagttaaattttctttaagtttgaccaaatttgtaaaaaaatattaacattttcaatataaaacaaacatattatgaaaatatattcaatattaagttcaatcaaactaatttggtgttataaatgttattaatttttctataaacttaaacctaaagaacttcaactaaaaaaaagtcaaacaatggaaggagaaaactgtaatttagccacgcaattgtgcaagaaaatgagcggtgctctactaccagtattatcgcactagaagtatctcaacatttgatttatgagttgtaccgctcgtcggaaaaattattctatatagttgataggttagtacaaatagatatggtgtatttgattagaaaaatggtttagattaattctactaccgatagaaagcatggtagaacacctccgagaaaattagacggcagcggttttactgaaagaattgtttcaattctgaatttaggtgaagtgagcttgcagggtgatatgaatatgcagacagatgaagaagcattggcctggggaagagaagcatgtagttcagagttcacatcgttcaaattatcacaagtgttagatgctacaaacaacttctctgaagataataagcttgggaaaggaggatttggcccggtatacaaggtaacagcaacatgccctatcatacatagactcgtagagatatggaaatcttaaaatcagatatatctctttttttaagagagtcaaaaacatatggtccagcatctggtagctggttgctaatgaatatgtttcaaatcctcttacaagtcatacaatgaaagttattttcttagaaggatgagtaaaatgctgatatacagtacataataaatgtaaataattttggcgtgtacatctggttggatgtagagtccaggttttacccacttttttattaaaaaaatgtacataatcatttatcactgataaatctgttttgatgttttttcctagggtcagttttctgatggatccgagatagcagttaagaggcttgttgcttcacattcagggcaaggtttcacagagttcagaaatgaaatccaactcatagccaagcttcagcacacaaatctggttaagctcttgggatgttgctatcaaggagaggagaaaatactgatatatgaatatttgccaaataaaagcttggacttctttatctttggtattacttctcataatatcctagtgcaaattcatagctaaatctggctgttggagttgtttttatcaactacttacgtttattgatatgcagatgaacgaagaagagttacgctaaattggaataatcgcctagcaataattgaagggatagcacatggacttctttatttgcacaaacattctcggctgcgagtcatacatagagatcttaaagcaagcaacattctcctggactgtgaaatgaatcctaaaatttcagactttgggcttgcgagaatattcagctcgaatgataaagaagaaaacacaaaaaggattgtcgggacatagtgagtttttcttacaattagcacatccaaattatatcatcaatttacataacacaaacttcacatatagtttgtttctttataaattttacctatgatatttcagtggttatatggctcctgagtatgcttcggagggactcttctcaattaaatctgatgtattcagcttcggtgtcctaattctcgagattgttagtgggaaaaggaactctggttttcatcaatgtggagatttcttcaccctacttggatatgtgagttctttttcctatacataaacacataacattgtgttgtcttgtagtaatcaacctctatttattgtgaccaaattacttgaaggcatggcaattgtggaaagaataaagatgggttgaactcttggatgcttcgttgtctactgaattgcatgcatttcagatgatgagatgcattaacattgcattgctgtgtgttcaagagaatgcggctgaccggcccacaatgtcagatgtggttgtgatgctaagcagcgagaatatgacactgcctaaacccaaccatccagcatattttcacataagggtaacaaaggaagaggcatccacagctcttgaatctcccagtcttaatgatgtgacaatgtctatcctatgtggcagatagttttttttttttggtttgtctcatatatgttttttgtgcgattgctttgatttgaaggggatgtgttctatgtgtcatgtctaataatatttgtcaatcatagacgagacaattgtcaatgactagctagcttagttgctgcaaaacttacatgtctgcatatgagctttttttttccagtttttgtttgttcgtgaacagagaggatgtaaaagaagaaattttggccataccaaatcccatctttatgcatcagttggcaattctgaacaactgaaaataagatgttttaattgcttataccaattgtattcttaccagaatgacaaaatgatgttattttttaaccaagcagtatcattcattttattgccagaaagtcacaatgatcactcatcaatatataatatttcattataagaatatctggtacattttggatattcatacattccggtcgtcaatttgaccatttgcgtatactaaatctcatagcattgaacaaaactgacaaaagtgtgggctggtggccagttgccatgtcaagagttggggcaagccaggcgatgcggttgcaatggggcaaaccaattaatgtcaaccattttaggttttgaaaccaattgcctcaacatttcagcttccaccaacatgtcgtgccaccgacagtggcgtcaggcgtcttactagtaatgtggtgaaaaatgtcactatcctcacatttttctctttattcaggcagcagcagatgccaaaaacatgtcctttagacaaaggatcgatgaataacacaataggtctgtccatatatatatatacctgaagattagtgtaaatatcactacgaaaacaaaggcaacacactgttgtctggattgttcatttctaagtgactgcaatagcttacagtcactataaaaactgcattgatctctcgttagcttttgtgaaccacatcacgtacatgacaaggagctcgccaccctagctgcctgctttcgtacctggtttttttgaggatgaacagcatcgaaggatttttgaggatgaacagcatctcgaaagattttgcacatgccggccggccgtcagtattgcaagcttcctaagagcatttgcaatgtgggtttttgagaaggtgctaaaggaaagagtaagagaaagtcctaaatattgccgatgtgtagggatccggctcctatattgtgctttgtgctgcagtgcagaatagcgatttgcaagttgttaatgtaaagcgtaatgtacagaggtactgttgatgtgccctgtagcgctcgatctcgttcgttcgctataaatcggacggctgagaataccctctcttacttcgcacattgtagcatcctatactgacaaacagtttcatgaaacttaggcaccttgctttgagcgaatatagtgaaggagaacgtttttttttcttattaatattggagaagaatttttttctattaatgactgcaacgaaacaaaataatagccactaaactgctcaatctaatccatttctcgtgtaggaatggtaatgcaaacgcgggaggtgaataacatcgaaaacaaatcgtccaatacgttctgctactcgatatattcctcacaatcgggcccaagacagcccagaaagagcttaggtctgggccttctgaagtctcgtcaaggaaaggccattaggcccgttatacaaatacagcccacgcaagccagtccggtcggattgggggcttgggtttttttattttatttattaaaatatttaaacaaatagttttgtttcaaagttttataaatctacacccctaacgcccaatgtacatgtgtcacgtcataaaaaaacaccatctctgaggcgtcaggggtgtagatttgtaaaactttgaaaaaaaatttgtaaatattttaataaataaaattaaaaatttaaaaaattcgggggcttggggcaccaatgcaacatattgagaaactaaacatcttttaaaaaaaatatagatgtgaatgtgtaaagtgtgacagaaatatttttgtatcatgcatggttgatgacttatgtgctcaagtagagaaagtttaacacaaatgatgtgtttttaactaaataatagctggtagtgtgagcgcagctaggatgttcacattggatgaacttgtatgcttgcgccatacacgcatgagcatccgttgagcaacgtgtggaaaaatgtttctttcccatacatgcatgttcatctattttcatcatgtaaaattgattggctatattttttttagataatgaatagaaaaccatcctagcctttgcgagctacaaccaattattacaccaattcgttcaaagcgagtgcaactcaaagaaaaaaaacattttataaaaaacactcccaaacatgaagcaaacccaaactaataaaaaacagctatataaagagagtaggagtgaacggaacctctttgtaaagttggctataacgtaacgtttacagcgaaagcccattgcgtttttctgctgtttcctagcgatgcaacacaaaaacgttcactatttgttagaaatcgtatgcatagcattttcgtttaatcatgtgcatgccatgtcgatcatggaccggatacggtgacgaagaatcgaggagattgccaccggccggcctgcatccctgcacctacgtttgtatcgtgcaaaacaagccgttcaatcaaacttaacgacttgttggtgacatttctttaatgtgagaaatgtcatgccatcatgttatttttcacaattaatacacgccaaaaccatgcatgttgttcttggacaaactatagaaagaaaagccgtataaatataaacctatgttgctaaatttgttgatccaattggagagatgaggcattaccatcgaaattgattgattgttaatgttgaactctgactgatattatagtaataaaggtctttttctgattttttttagggatcaaggtatattaggttgatgaaacacgatctgaccatcatagtctaaacctgatattatttatcttgagaagttgaactattattagagcgagtgacgagtgagatgttagcaggagctgaaattatgaaggcactattggattcaaagcaacaactttatttccttatgagcattacttcaaaatactatcccatggttgcatcataaaacaaaatattctcaatagtatctagagtcactcaaattggataaagtgaggtaatataacaccaagaagttcggaaaaattacgaagatttattatgtataatcttaataaaaactctatacgaattattatgtataatcttaatggaaattgtatacatttggcattttgttcatggtattttacatatttctccctctagacgttttagattggaggcattattgggtagataattaaatatattgaaggatttgcatcttatccatttttgttgatgcttaatcacttttttgttctattatatggaaataagcacctacactacatgctccctccgtggacatatgtttgtcttaaattcgcagtaataggatatgtcacatccggtactgatttgttttatattggacagaggagtactacacacccataagttgcaccattaatacacgcttaattagttagaatttaatttgttcttttttacaacctatagtttttaaatttgagcttgcatgtttgtagggtaccacgttttgatcaaaagttttaattttttttttcataacttattgcatggcattctcttagtaggaaatagacaagcccaagataatcaatcaagtagttttgtttgccatacatttatgatatatccacttatttcccgggcagaagtagtccaatttttatccattggattcagtgattcagtccaaatgtgtgataaggctttgatgtatttcaactagtctatctatctattatatactaaaagcctattaaacttcctgcaaacgctctcaagttatcacatggcgctctaataaattagagaaaatcctagaaattctaagaaaaaaagtaaaacatctgccccgtaattttcattgattggctatataaacgtgaaagcctgtcacgtttttctgttgtttcctagcgatgcaacacatgtcgttcaccatccgttagcaatcttatacgaggatcgatatcgtacataaaaaacgtacgcatagcattttcatttaatcatatgcatgccatgtcgatatggactggatatggtgacaaggaatcgaggagatcgccgccggctggcctgcatccctgcccctacgtttgtgtcgtgcaaacaagccgttcaatcaaacttaacgacttgttggtgacatttctctaatgtgagaaatgtcatgccatcatgttatttttcacaattaatacacgccaaaaacatgcatgttgttcttggacaaactatagaagagccgtataaatataaacctaattgcatagatgagtcattactatcgaaattggttggttgttaatgtataactctaactgagattaatagtcctgattttttagggaacgaggtgtacgaagtcgatgaaacatgatcttgagcatgcaagtgacatgttggtggaagctgaaattaagaagacaatagttttgaaggaaacaactttagttccttccattagttagaatttaatttgttgttttctatactctataataggtgttgaatttgaatttgcatgtttgtaagttccccgttttaatcaaaagttttaatcttttttcataactaattgcatgacatcctctaaataggacatagacaatcccacaataaataaacaatctaaaatagtttgtttgctatacatatatgatatatccacatgttttctgcccttgcatcacagcctctaaataggacatagacaatcccacaataaataaacaatctaacatagtttgtttgctatacatatatgatatatcacataatttccgggcagaagaagtccaatttttatccgttggatttggtccaaatgtgttatgagacttttgatgtcttccaactagtttaactaaatatctatgacacactaaactgcataaagcaaaatagttgaaacactttgtagataactaaaccatcaaaatagttctaaaaaaatataaaaacttttttaaaaaaagggtaaaaaatggttcgttttttaccactcagattatttttccataaatcggatttcaaaacatttgcatttttcaagcttaattttatcgagcaaacactcccctttttttccatagactcctcttctctgttcgtgaatccaagatccgcttctttctcctgcggttgctctgcgctctcagcaccaaccaaatccccctccaattcctcatctttcttgaccaattcttgaaatcaatcagacgcaataatcaaccactattcttattatagttggatcataattaatcaaggttccgtgcgtcgccactgtgatttgtgcacttgcatttgatcgaattcgttgccgttgattgcgtttcttgatgttgtgtgttgcaggtttgaggtggatccatggcgatcaagggcggcggcgggtcggcggagaacagggggcggagcccgctcgccatggtggtcgccgtcggcctctgctgcttcttctacctgctcggcgcgtggcagcgcagcggctacggcaagggcgacagcatcgccatggccgtgaaccggcagacggcggcctgcggcggcgtggggctgagcttcgagacgcaccacggcggcgccggcgtggagaacgagaccatggcggcgccggcgccggagttcgcggcgtgcgcggcggcgatggcggaccacacgccgtgccacgaccaggagcgcgcgatgaggttcccgagggagaacatggtgtaccgggagcggcactgccccggcgacggcgagcggctgcggtgcctggtgccggcgccgccggggtacgtgacgccgttcccgtggccgcggagccgcgactacgtgccgttcgcgaacgcgccgtacaagagcctcaccgtggagaaggcggtgcagaactgggtgcgacacgagggccgcctcctccgcttccccggcggcggcacccagttccccggcggcgccgacaagtacatcgaccagctcgccaccgtcgtccccttcgccgacggctccgtccgcaccgtcctcgacaccggctgcggcgtaagcgacatcatcgccgaccacgcgcgccgccattgattcattccaccatagctcgctcgctcgctcatggaggtgttcgtccgtgcgtggcgtgttcaggtggcgagcctgggcgcgtacctggacgcgaggggggtgatcgccatgtcgttcgcgccgcgggactcgcacgaggcgcaggtgcagttcgcgctggagcgcggcgtcccggcgttcatcggcgtcctcggctccatcaagctccccttccctccccgctccttcgacatggcgcactgctcccgctgcctcatcccctggtccgccaacggtaagccctaccctcaccgccaccgccgccgaacacgactcccaatgcacacatatactacctctgggggcaactccaaaatttaagattagggggtgtggggtggggaagaggccataagaccgaataaccaatatcgatagcaaatgatgtcaaatagtcaccgttaataacaatcaatgtgtaaaatagttctttaaaaaaaacttaaattttagctttttaataatatcattaaaagtttggaactagactttattactaaatccttttaatgtaaactaatgaataatctcacaaataagaatcttctattttactttaaaaagatgagaaatcacaaagtaattttgtagatcatgtttcttgctaatgtttttagactttctaactaactaaattgataataattgtaagctacacaaataaactagataaatacatatcttagttagcctcaatatagagtaaaaacaggaggcgtgatggtggcggtgttcgtataggggggtgttgacctcctctggcacccccatagttgcgccactgactacctcaatttcaaaatgtgagacaccattaacttttcatatgatgttcgatcattcgacgaatttaaaaatttagtatatatatgcacaagtataagttaagactatagtttctttagtggtaaaacaagtcagaacaaaataaattaaattatagttatatttttttaataagacgaatagtcaaacgttatatgaaaactaaatggtgaatcgtcatacatttttaaatggacggagtatatgctgctccctccgtcccataaaaaccaatgtgacacattctagtactatgaatctagacatatccatgtccagatttgtagtactaaaatatgtcacatccagtcctagattttttttttttttgagatggagggagtatgtagcaagcgagcatgaactttgatgcacatgtcgccggctcgcgcgcgcaggtgggatgtacatgatggagatcgaccgggtgctccgggcggatggctactgggtgctctccggcccgccgatcaactggcggaccaaccacaaggcgtgggagcgcacggaggcggacctcgctgccgagcagcagctgatcgaggagtacgccgcgatgctgtgctgggagaaactcgccgagatgggcgaggccgccgtgtggcgcaagcgccccgacgccgctgttgtgtcttgccccacggccacgccggcgccgccgaggacgtgcgacgccgccgccgccagccccgacgacgtctggtacaagaagatggagccgtgcatcacgccgccccaagcggccggcgaggtgatgctgcggccgttcccggagaggctgacggcggtgccaccgagggtggccgccggcgaggtgccggggctcaccggcgagtcgtacgcggaggagaacgcgcggtgggagaggcatgtggcggcgtacaggaaggtgaactaccggctcgacgccggccggtaccggaacatcatggatatgaatgccggcgtcggcgggttcgccgccgccgtcttctcgcccaagtcgtgggtcatgaacgtcgtccccaccgccgccgagctctccacccttggcgtcgtctacgagaggggcctcatcggcatcttccatgactggtaaattcaacctgcatttccatttattgctttccatgacctgaatattactacctcttgtttctctctgtataacgttgattacttttcacgtaacgtttgatcatttatcttattaaaaaatagtataaatatataaaagtataagttaagattacatatagtttctttgattataaaagacatgtcacaagaaaataaataacatttatattgtttttttataagatgaatggtcaatcgtcatatcaaaagtcaattgtgacatacattaaaaaaacaaagggtgtattatccaagaatatgtaaatatttttctattgattatttttcaccttcttctccttcaggtgtgaggcattctccacttacccaagaacatatgacctcatacatggcaatggtgtcttcactctctacaaggacaagtgagtctcactcacattctgttcatatctgtttcttgattgcttcctcagtaagaaataagtaaggttttgaaatacatgtagtcaatgcatttaaactttgactatcaatatctctttgaaatttttttggttcagttctgaaaatgctatgattgtatttttctacaaaattactttcaaaataatataaccttcatacatttttatgataataattaacaattcaactagtgtcttgtaaccatgttaatgtccaaaatgatatacttatttatcactggaggaagtatatgctaatcatgctgctatgctctgttgagtgatctctgaagtgatgagaaattatgaattcttgctgtttgatgatgttctgtgcctaaacaatttgttggttttaatgtgtgagagaaggtgcaagatggaggacatcctgctggagatggatcggatcctgcggccggagggcacggtgatcctccgggacgacattgaggtcctcctcaaggttcagaggatcgcgagcgggatgcggtggaagatgatcatggcgaaccacgaggacagcccccacataccggagaaggtgctctacgccgtcaagcggtactggaccgccgacgacaagagctcggagccggagccagagccggagaagatgaagaagaaggcggggagctcttcacaagagaggagagctccgaggaggaggaggagagtacagcaagttcttcagaagagaagggttcagaggagtaagaggtgctgatcatgtgtgattattttcagttgttggggagttcaattcttttcagtgtgataggggagatcaggagttgtgttctttcgatttgatgattgtcttaggatgaacaatatgatgttcggtagcaggacttagcatttccatagattcaagaagcatatactttgcatgtctcatggtttcagctgtgcttgttgatcatttctcatagccataaacatgcagtttgcaacagattacaaatatttcttcaacttgtaatgctgaaacaagctgcccatgaacatacaagatcagattttcatgacttggtgacagggatcatataattatcatcagttaacactgctatcgaattgcatcatttttctctcttcctggtaaacaactctgtaatatggcaacatatatccgtaaaaggactggaagtggaaaactatagtcaaacgtgatctaagtttcagagcaagcactacaaatacaaattacaacagagggcaactatcacagtaggtatcagtaagcgcttcgcagtatttacaggagtgtgtaactatcaccattcaccaagtatcgatttatcgattcttttttagcaactgtcaagtgtcaactggccggctagcccttttttcgacctttcttgctgccgctgctgttttcttcttgagaagattgcgggaggctgaggcgaagctgccctggcaaagaatccgtcaggcctgaagaagtagccggggtgcttccacttccagctcgggatcgttctcgctctgttgatactgaggtccctggaaagagctgcagctcctgaggccgtgacgcataaacctggctggcaccagcagactgatggtgctgattgtgcaacggagataatgtgtttgttgggtgcaccatagctaaattcggaccattgccccatatgtgatgtggaacgggttgagttgctgagttactgccattgttggctactggttgtgacatcgcaagattgctttgattgaggtggttgtttcccatccttgcacaaatctcattatgcagttctaatatttgggctctgagcatgatattctcttcttgcagctcattattctctgaaccaacctgttaatatgttcattttagtattagctgcaaaggcaatgatgaatagtacctaaacaactatcggcaagtaataaatcaagcaaacagttgaattaacccactggaaatatgagaggaaaaggtgaataagaaagtaatgtctgctaattacatatttgcagtttccatgaaggcatttcaactgcaagtacacctatgtgtgactgttacaggaaaactacattactatatgcaacttaggttctacttataaaacacaccaatttcattaaaacaactcacgtattgacgctcagttagaagagcggactgttcctttctgagagattctacttgagaaacaagatcccgcagaactcgtgcagcatcacctaacacagtagcctttccactattttgtcgttcaggatctgtaatagcagaagtacaatgatcagaaaaggtatatgaatttgatatttgaagtaaaactaagagcagtaaacacaaaaaactgtttggtcaaggtaaggttctccaaataattcatcatgtgaagaaagttcagtgcaacgcactaaaatttatatgcaccaatcagcagacaactttttctaactgtttatcaatttgcacaattatgtcctagatcagcaagaattatttaaattctaatattttattacatgtgcaccatatcagctctgcatatatttctaattatggagtacaataaatgtagcaaaggttaacattgtgctgttttgacaaattagcatcttcattcatgagcaggctgctaccgaattgtcattactccatatcagatgaagttagcatggaagatgccaatgagcaataaacacaaaattatggataaattcatggtttattcgcattgtgtacttgaacagtaagtggccgttcaaagatagggttaattagatctatgcagtttaaagcaaagataatgcaaataaatagcaatcttggatttcagattcacactaaaaaatagcattgcatcaatcttttgtagggaccaaacaagattctcttgaaattttgttctcagatggaccactcaaaagggggcttcgaataaagcaggaaagccagaacttcacatggggatattttagcaaattgaacagtgtaggacccattctttttgggatcatagaatggcaggataggaatggcacagtctaacactgcaaactccaaaatagatagagacaacatataactatgggacaatagcaaataattgaattcaggaactaacgtatgtccacttaggtgttgtattcctaatttcatactctaaacaatacgcacatacttacatcaggtacctgcgacctgctaaaacacaacctaatttaagttgacttcgtattctccgcaatgtacactcagttacatatcattaagtaattaaaggaaagatggattcaagtaatagaatgcaagttgctggtactaatatttattttctcgaaagagcatagtatatctactataaagatatgacattgattgatgatgatgggactgtgctaaccaagcatactgctgagctcaacaaaaaggtcattcaactggtcacgcttaagtttctctcgttcagctttatgagttttctttggagccttttcctgagatcttttgtcaagagacctgcacagaacaaaaataagcatcacggaaatagaagtacatcatggtaggaattgcactgctatgggaaataaatgtgcggaaagcatgaacagcaacaagattcagaataatctgaaagtgcacatgtaaacataggtcaattttaactcactgataaacttaaaaggcgaagcaattctgaatcatggtggatatctgaatatgaaactaagcatcatacatattttgattatcaaatatcatgtaacgtaagctccttaaatgataccaattgtcaactgaattgatgttttgaatatttaatattattgctactctgtcagcaacttactatgggcaataatttttaatatctactctttatgcgaaaatcattacagcacatataacagataaataacttcaaatctatcatccatagtgagctcactcccccgtcatatgacaggatcacagggtaaaggagaatggacccaactgcacgatcctgtgtttagtggttactcttgtcataattcctaaacagtctctatctcaagaaggtttcttgtcaactatgtttctaataaaggaaactctatcgtcttggatttgtccatttgtgcattgtatataacctttctctttcaaagtgacttcagagaacaagtctcaagcatacggagctatggttagcaaaagaatatatgcatgaaaaggagaactaagacgaaatagatgatgagcagtgctatacatactaaaaaaaaatcttaccaacaaaattcttggaagttatagaaaatcaagattcaatcatagtgtgccacatctgtgtttgtaaaaattcagtaacattttctttatgtgtagctttttcctcagttggttgatcatgatgaaggcaagtttcttgtgcttgaactactggccaaattacgctttcatgcacttttgcaatggatatttacaaattacagctagtttcaatgtgggaaccaaaccatggagataaaaaaaagagagagatattatgattgacgggtagatgttggccctgtttagttcacatcaaacttccccccaactcccaactttccatcacatcacatccaaaactttctacacacataaactcctaacttttttttcaaactaccaactttccccaaacttctccccaatttcaggaactaaacacagtcgttatcattgttccacaacaatagcccaaaacaagtagtacagaaaatgtggtgataaatacattcagattcggcaggatattagaaatgagaatgtaagcacgttagccaaaattagagcataaatacaacctaaaagtgtctaacgcgacgacaatagcctaattgtccatagcataaaaagacattggttattgttatgaagcttaataaatgggaattggataaaaagaaagtaaacagttaacaacgaacccatcaacagccttgtcagaagcagcatttgagctgccacccagtgaccccgagctctccgtgtcagccaccatgcccagattctggttcctgcatcacacaaaggtaatactggagctccataaagaaacaaggctcataacaattcgaaaacaactcctgctcctccacacatcatcaaactattataacatcacgctcacaccattcaaaaaacccaacagtgataacacagaaatcaccagaagctacacttttttatacctacacaagaaaccaaactacaaatacacaagaactaaccatgtgtactaggagacaaagctagcttagcccgaattcttcttgcaagaaacagtagtactaaagatctgcacataatcccaccaagaaaccgttttcttctctttcttttcccccacatcaagaacaagaagccagcatgattagttaaccaggaggggggctgacctcacttggggcatggggagg

SEQ ID NO: 65255 - DNA, 17114 bp, Oryza sativa
gccacccacccgcacacttgggtgatccggacgccagcgagctgacacatggcgacgacgacgacgaatcccgtcgccatcggtcccacggggaattcgcggatcgagaacaaaagctgagctcccgttggattgggatgatggatcatggatgggatggcggaggaggattgggatgatgacaactttctttgcttgcttcttcgtccctctcttggtgataaaaattcgatctttattcgttctgtccttgctgtaaattgttgatgccattcttctttttttactacttcctcagtttaggttatacatctatgtaagtaaatatgagcattgctagtaagaaaacttgaaacagagatagtactacctttatcggtagtatattatttatgggttaaatccgatttatcttcttaactattcaaaagtttaaattatccttttaacttttatattatacattttacaccacataattatttaattcgaacaaattaccccttttctagctattaggtggttttggctctcatatgtatgtgcaaagccaaaaccaaatgtgagactagtcacctccttcctcgtgcatctaccctcctcactcgatcgtgcaaagcaaacctcaccaaccacctccaactctaaggcaatgtttggctaatgggaaatgaaaatgatttcccacccaccaaaaggcatctttaaatactaaccattcattctccctctttcatttaatcctaacccttcattcatttcccaatcccaatcccaccctctattttccattatccaaacacactctaagttcttaaagaaaaaaaaaaactccaaaactagctacacacgggccatccagccccatcatttggtatattggagtaaaaagcaaaacaacatatttatcgaatgaaaaataatttgtgaatataacttttatatacgtgttcttaataacgatttaaaaacaaatgaaaaaaaataactacgataaaaataccttaaaatcgactctaaatttacggttgaaaattcacaaagccgccaccgccgtttcgcatctcatcctgaagctggtgctgcacagcataaaaaccaatagtgtgtggcgcgcctactctcatgctaaaatctagccggcatgcatgcaaagatgcaatggtgtaagggcaggattaaggccctccttgtttaggcttataagccaacttataaatcgaaaagtttaagcctaaacaaacaagcagctttttcatttgtcttttttgaagctgtaagccactctaacactattaagccaaaagctaggttagagaagcttttttggcttatgtgaggtagatgtatgactcaactactaaatttaggacattaaatctaccggcttataaatcatataagccaataaactgacttgaaagtctaagtcaataagtttaagcctaaacaaaagggcctaagtcgttttgcctgtgagctgagtcaacctgatcaaataactcacaaggtgttgcttccgactattcagacttgagagcagtttactactcgtacaagatagtggccttaattaactatttgttgatggatgcttacgcaaagactagctaccttacttccctaaaacctgtattaattatgcaacatatatatgtagaacacttttatgcgcacacagcgtcgatttcgagagaaagaagctgacaaattggtcttacgatttgtttctaagggcaagttttataatataggttgttgttacctctaatttcatctctatcaccaatctataattaagaggtaatctatacaataaaagttacctccaatacacaaaacccaataacttgctacaggacactcaaagtatgtagcatttatcatgagacacccaaagaacgtgtatcttctcgtggacattgcaaaaatatggtaattagctgctggatatatgtctcattattttattatttttggtggaaacggagagagaaacattggttaaagacaagtttgcccagggacccacttctcaatctctctttctttgttcatcttcttatgtggctaccttctttctcatgcgcgtgttgtggcagctatatagcacgtgcaacagctggctgggctagagcacggggcggcgcgccgccactaggtaggggtggacgaaaagctcgtggctcgttagctcgttcgactcgcgacaagctcggctcgactcgtttcatttttctaacaagccgagctggcattttagctcgttagagataacgagccagctcgagctagctcacgagctgctcacgagccttaacaagcccatacctcatcaggctgccaggccacaaagcccataggcccatttatttagaaggcccaatagacaatagtgagcactaaaagtgaaaaccctaggtcattcccttatccctcccctgttcccttgcggctggtggctgagttcccccacacccgatgccaccgctctttgcctctcccccagcgcccgacgtcgccgctctcccccagcgttctcctgcagcgcctgacgccgccgccacctaccaacccacccacctgcggcgccgcccggcagtgaacatgagctcctccctatggtgtcggtgagctcgagctcttctcctccgccatagtgctcctccttgtggtccaagtgccggcggaggtcaagctcgtccccttcaccgtcgtgctcctctccgtggtcaccggcgagctcgagcttgtttcctccactgtcaagctcctccctatggttgcagtaccagtgaggtcgagctcgttccatccaccgtcaagctcctccggttctccccgtggttgccagcgagctcatccccatggtcgcctcccttcttgcttgcccccatagctcgcgagctaaatcagctagctcgatcttgcagacaagccgagccgagctaggtttctagctcgttaggataacgagccgagccgagctagctcgttatcctaacgagccagaccaagccgagccgagccagctcgacatccacccctaccgctaggagtcctccccggggctccgtttcaaatcgggcaacagcgaagtgggcgccaccaccgtcagccaaatcctcgcgcggtatacgtgccccgtccaccatttttgccatgggtagatcgagagggatggctccgcccacacggacgagtggctcatcctcctcgccggaaggggcgtcgaaccctgaccctaatcttctcgaagttcaacaatttcctcttccacacgctttacaccgccattttctcatgccgcgagctcaccaaattggagctcaggagctgccacctcccggctgccctcggacttctcagggttcccaaatcttactatgctaatgcaacatcctgaaaatgcgtcattttctaatcctgcatcatgccgattattatgttcttaataacttcctaaacctaggataatataattagagggacctcctagaactaactcgcacaaaacctctctggtatttaatctcttttgtgtttttcatttaaaaatatatatttggttaaattgaggtgtttcttgatttggtttaaaaccttcttttgattaaattttttttattcaaatttagtttgaaaacccctttttattattatgaattgtggtccaagaaattctccactattgtcctagaacctaaaccaaatgattccaattttattggatttaattgtcgacccatcatttgattttaaacctatcctttgattccaagcctattcttatttatcgccaaatatctaaattcttccttttgatctagccgctaatttaattcccgtggcttgatttccttctcggtacaagaaaaatattattacaaatattgtgaataattgctcttgtgctaagaaaataaatttatatccttgtcacctaaatttccttttagcctcaaacaattccttgaaacccatgccatatattttagggttcaaatcctatccttttgcctccacatattttcctaccacattccaaaaaatattttgaggaatactattaatttacttttctatttgagtgcttccaaataaattccctcaaactccacctctaaatattgcactcaaataaattagaaaatctcctttgtgaattctctcctaattcaaattcttcgcaaaacctagttatccaaatcaagtatacaaattagacttatttctttttgtcatcgggccgaaactccgttctttcttccttttggcccaatcctttttctttctattttcctccttcctcttgggctgccggcccagctaagccgagccggcccagttcggcccacaacccaaccgcctccctcctcccagtgcgcgtgcggcgcacgccgccgcaaccgtcgccgctaaggaatcaagtcggcgccgtcatccttcttcccacgccatcgccgtcgccgattctcccttgtcttcctcctcttcgaaccgcctctcatcgcctatataagaggatgaaccccttctgtttatcccccacaaaccgagcttgaagctctcctctcttttctctctccttgccatggccggctatcactgtcgtcggccgatctccctcaccggagcaataccggccaatccctcgcgccatcgagcttgcctcgatgagaggaatccatttttcccctttcccctcttcctccacctctgaatcaaacctcaccggagctctctctctcctcccggttcacgaccttccatccgccgttccggctatttcccttactcccttttccggccactgccatccctaggtgccttgcagtcgggaacaccactggccgccggcgtcaccgcctcctcgccaccggagcccggcgccccctctcctcctcctctctgttcgaccgaggagaaacagaagaaagagacgggaagaagaagaagaagaagaggagaaaaagaaaaagaaaaaggaatccctgacaggtgggcccatgaacagtatactttcgcaatttactctatttaattcaaattccaatatttagaagcccatatctcctaaaccgtagatccgatctcagtaaaacctagacctaaattcatctaaattcaaatgcttcattttgatgcctaatttgttattttataattttatttgaatttattcaaatatcatttgaatttatatttgcctttttcaaatattttcttttaccccaaaataccctttagccactaaaaagccgccggttggaactttatgccttccatggggacgtttgcggtctattggccccaacgtcgaaccgttggttgtaaatcccggcaaaaccaaacccaaggtcgaagtgctgctcccggcatcccacgccttgatgcgtacaatggtcggagcttcactattccctcgacctccacagcacgccgtacagttagctcttgagctctgtgtgatcctagccgctccgccgccactcacggttgtcggagtaacacttccgcctcgctagacctgcacaaacctcccatccctctggccgttatattgtctatcgacaccggctagagaagataccaaacctagtcgtcatgctttagctacgactagcgaacacccaaaccctagccaatatttatcttacctcgatatcggcttagacaactgaaaccttaatcagcctgccatccaaatcccacatcaactacaatattacttatccaccatatcttagccacctactctccatctacccagaacctatacataaaatatagaacctggccgatatactgccctactcctcaatcggcctaaatataaccgaaccctaggtataatcctacccaaacccactatcagccaataccagtcacatatctgctcaaccagttcaattatccactatactccctatccaccaaccaatcagagtctgcacataaaatataggtgaccttagccgcttaattccctctctaccccagccaccaactctttagaatccacatataaaatatcagcccagtaatccatatacctgcataaaagagataagctataccctaaaccctagtcctcctaaccgtttatctctttcttgctattttatggcttttattgaatttggatcttcctcttcttcagtagagtctattttatatggatggcaacctgtggtatttcaagcatcagataatcaggttgcctatttcggatttatttgcgttggagcaaggcaagttattattcctccccttgagcataattaccctatattctatatcccttttctatgcattagtcattcatgattttgaatgcataacctgaacatatagcaaaccagatatgctagcttttgcttagccctgcctagttagattatgcacaaaatttaatgaacttagattgggatagtatggtagaaatggttgatttccgggtggctagtactgttccaaccgacataagattgccaaagtacatgtgaagaacatacgagtacgaccgcaattctcgtatgggcatagacctagctgattaagttatctagcaaaggtggtacctctgtgtagtggttcttatttaagtcctcgcgcaggaggcaaatttacgccgcgaagggcgattgtgatatttaccgaggcgcaggtaaatatatgagatgaattgtgatatcacgaactgtttgtaaaccctgattgcgatgacatggtgtcatacaatcagttctctctaaaggcctcgggaacgctagaactcctctcgctgctgataacgttacgttcagagcgcatggggactagagttcatggaacaagtaccactgatgttagtgaccgaaaagctttgccatgacaaggctaatgtgtttggcacgtcatggattgcgggtaaagcgtacatctactgtagtatgaatattattaaaactatttgaatagccgtggtcgcggttatcgggcattgggactcacaatggcatcttggttacaaacataatttcaaactttattaaatactgttgcatttaaaacattatagactttccttctatattctctgctttctgcaagtaaatctaaccctactcaaatattattatttcatgcattcgttgttgattaatataatagcttgctgagtacgttgtactcacccttgctttaaccccacctttttcagagtcattttagagttcttaccgaagctgggagttcaatcatataagttaatctcattttaacttagttctcaagtatagattagatagatggtttaagtctatagcaaaacactagagttgagtcatcgtatagcttctgctgtaatagttagccacaagtttgtaaataccctattattttatgtaaaggaatctcctttggagccttgtcaaaatatatgcaatgaagaaccagattgttgaacctatatcaatctactgatccagggcttgattcagcctaaacatgtcggttaccgaatcattagtttcgggacccgacagctaaccctcaccacggttgtttttccgccgcatggggagaggactcgctgtggtcgagaacaacgcatgtgctcctcggctccagccgtggcccgcagatcgatggcacgacctcgtcatccgcctcaacaacgcgcccatggcggagcagagccctgtgggagaagaaaagaggagaataaagaaaaaggaagagaagtaggaagaagaatagtgtactggggcattttggtactttcaatgctctttctctctccgtttccaccaagaataataaaataataaggtgggtgtccagcagctaattacctcatttttgcagtgtccatgaaaagatacacgttctttgggtgtctcacaacaaatgccacaaactttgggtgtcctgtagcaaattttgccataactttagtactatcacatttttattgaattttgtgtagagattatccagaggtggctccttcactctcttcttccttctcttttccacatcagcaaatgagtctacatgtcatctaggggcaagtgtttaagggcttatagtacttgccctaactgggccaccacatcagcttaaaaccacaaaagaggatgtaatttatctggattaaatagttaggaggtgtaaaatatatggtataaaagttaaggagggtaatttatagttttatgataggtgaggaggttaaaccgaacttaacccattatttatcagactctcagggatgtaaggtaggaaaaattcagagacatgcataaaatgaattaagtgacatatctatacttactataaagttataaagttatagtccactaaatctaaagctcaatatataaccatgtcacatcatcacccactaataataatacatataacctcatacaagcatgcgacatcatctacaatttatttaattctacaaattaacatacaagcatatccaattatcatccctcacatcatttgcacaatatttgaacaaatctatctatcatttttataatatttaatatatatttaaatatgtttcatattaaagtgcaagtattatttgattatttcatgataattgctgataaaccctgatgtttcattctgtctgtcatcttttgaaaaatccacagagttacgagctttttaatgagtcctatgacagctcatactaatattactagacataaaaaattgtctcatatgtactatttgcgagggacctagatcgaattacggaaacatagaaggatcttttcgcaaaaaaaccaccccacgcaccgtttctatccaacgtggcatagccgagcgggcgccccttccgctgctcttaatagtttctcattagatgatatatgttgtagacagcttttcttgcactccggtactataatacgcgccagcgtgtcactagagcaaacatagaaactgaaattgttccagttgataatggtcatgcgccatttcactagtaaagaaaaacaccttaattatatttttaaaccacggtaagaagaaatttcacaaactttttattcttattaggcgctatatatttaaaatgaatgaattctgtagaaaaatcacacatgaaagtacatgacatagtacataatcgagatttcatctccattcaaataacatagttctagtttttttaaaattaagacattcccattacagccccattcttttttactaatgccgaaaaattaggtacggattattaatgccaactttaaaagtacaattcaattcctcagaaattttattgcacataccaattctcgatagacattttatttcaagctatctattaggttaataatatataatatttaattcatctgatttaagactttgttcttttttgatgctggatttttatttgcatgtttcccaatctcataaacgatacatttcacacaacaactttcttaaaaaaagtttcgtagactacttttctaaaataaccttttcactttgtaatagttttttttcacttgtttatacccacaaataactatcacaaaatcaaattatccatagatccatcaattttatctctcccaaacgggactctatcaggtggtgtctgagataaagttgaagttaacgcatgcaaaacgagaaatccgttaacatattgttaattaagttttaattattataaacttgaaaaaatagatttagttaatattttaaattaatttccgtatagaaatcttttaaaaacacactatttagtagtttgaaagacgtgctaacaaaaaccaaaataaaatctacatcagggatgtaggtatcgaattttctcattattcgggctataataaaaatgaaccatgggtgtgtttagttctttaggtgtaaagtttttaaagtatacggacacacatttaaagtattaaacgtagattaataacaaaataaattacagatttcacctgtaaactgcgagacaaatttattaagcctaattaatccgtcattagcaaatgtttactgtagcatcacattgttaaatcatagcgtaattaggctcaaaagatttgtgtcgcaattttcatgcaagctgtgtaattattttttttttcacgtttaatgtttcatgcatgtgtccaaatatttgatgtgtcgtttttggctaaaaattttttggaatctaaacaagtcccgtttcaactttcgagcggtaaacattcactacgccgaacaaaaaaacggcagcttcacacttcacagcagcgagactgacaagctgacaggccagtacagcacacctcctccagtactggaccagcaaacgaatccgcataatctgagaggtttacccgcataaatcctaggaattattctaccgactgtattattgatctaacgatctgagagaaaaattatgccctacgagcacttgaaccccctccttatataggggcaggaaccgaaattacaatgtacagcccatatgccttacgaacgactaggctaagtaactgactaagattacgggatatttccttaatatacaagttaacaaaaatacccgagtcctttcctaaacatattatatctgtataggctatcccctataaccagttggatatacatgctatgggggtacgtggtatctataatctccacaagagtatatttaattcgactgttacaattcagggactggattaaatacctgaatttcatgaatcgctaggatttgcccattcatgtgtcacgaagatgtgggtgattgagagttaattactgacacatgcattatgttagggttttggcggcgctcaggcgattttgcggcggcggccgtaagtctcgtcgtgagatgtttctggatggagctcgtcttcgatccacgtgtgttgtctgcagggttatcgcctgctttgaggattcgtcgtccggcttccaatcagattgtttgaggggttttgatctgagatcggattcatattcttatcatcaatggtgtgtccggcctggttgcaaggttcagtcctttccctagaatttcttagttcccaatcgtaacataccaggagatctttgcctttggatatggagatggattgtgaagaaggaaacgtcacgatctggtccgggtgccgtattcgttctggattcgttcttggtctccggcccttatataaacaaccctgggtcagatctgtcaagcacaaccaacaattgctgcttctgcatctaatctgacgaattagggctccggtttctttgtcgtctctttcgggtcatggcgtcttctagcggtgggggtgataaagggatcgtcactgggatggtcacccacccgaagcccctggtcgacgcgatgctctcccatcaagagacgtctactacggccaaggagatcatcttggccccaaataagcaggctttggagtcagcgagtcagagtaaagataagatgatccacgctaatcccaagaccttgccagcgacgggggctagcgacacctactcaactgggccgggtgcatacacagaaggagatgtggaggaggaggatgatgaagcggtggaggtactgctagaagatgatgaagtacaactagctgggcagtggacagttttgtcgagattctactcgcttcgatcacccaatcaagcggctctatttgatgacatgaagcgtgcatggagattgcgagctaacatgaaggtcaagtccctgagagataacatgtttatcatcaccttcagctcggaaggggattacaactttgtgctccagggcggtccatggcttcaccgtggagacgctctgcttgttgcaaaattcgatggcctgacgagcccgtccatggttccccttgagtttgtgccaatctgggtcaggatttatgacctccccttggtgcttatgacaaagaggaggggagaactgtatggcagcaaacttggacatgtgagggaagtagatgttggtgaagatggcagaaacaagcatgacttcttccggatcctggttgatttatcagtcaagaagccgctgaaaacctcgcttgctataaaattaatgtgcagggaagtgaagctgtctgacgtttcgagctacgatatgagagggtgccctttttctactttatttgtggttacatcgggcactctgataaagactgtgacaaaagaattgccaatattgatcaaccttttcgttactcagctgagctacgttgttctccgctgaagccttttgagagaagaatgagcacaatccatggccaacaaaagtcaggagtggcacgcaatctggccttccgtggagcagggagtgcaagctcgtcatcctccaaacaggggaaaggtaaaagcagggaggagattattcctgacagggtcgatgctcaggatggctttgagggaagagaagatgtgggggacggggtggtggatgaactgctagctagtcagactagcaatctgaacatgtcaggtgagaatatggtgcagaaaggagaaccggtgggtatggaggaggaacaacgccatcagctgtcaacatctaaccttgtttctgatactgatatgattctagcaatacagaacctgcagcaaccggcatcctttggaggagagtcttccgaggacatcagtgataccaaccggaaaagagtgcaaccacagagcgggagcaagatatccgacagagttcaacaggccttagtattgtatggtcaaggatctggtagagaacaggctaagcaggtggacccaaaggagccagcgagagctctcaaacggtttcggaagacggaggtggaaagtatggaagttttggaagcaaccagtcctggggctactggtaaactgacgggacccgctctcagggcccgtcaggagcaatgagttgcctatcatggaactgtcgtggtttggggaacgctgcgacagttcgcgatctgtgtggcctagttaaagaggccgattcccaaattgttttcctaagtgagactagacagaaggcggatagaatcaggcgtttacggaataggttgggtcttagaggttttgctggagttgatagtgatggaatgagtggggggctcgctttgtactggcatgagtctgttaatgtggaaataaaagctttgtgtgagagatatattgatgcttatgttcgcttgtcgccggatggccctctgtggcatgccacctttgtgtatggtgaacctagagttgagaataggcacaatatgtggtcgatgctccggtctctgaggaattcatccaatttaccttggcttgttattggtgattttaatgaagctctttggcagtttgagcatttttcatctcaccctaggggagagccccaaatgtgagctttctgggatcttcttcagtcgtgtgcactttttgatttgggattcaggggcacaccctttacttatgataataagcgccagggaagaaacaatgttagagtgagacttgatcgtgccattgctgacaatgcatggcgtgataccttccctaatgcgactcttgcacacctggcctccccccgttcagatcgctgtcccatatccttgcaactgtctcaggagatgaaacagccagccaggaagaaaatcttgcattatgaaatatgttgggaacgtgagccgtctttgccagaagttgtgcaggaatcttgggtggaagcagggactaaatctgacctgggtgatattagtgctgctctacgtaaggtcatggcatctctgcattcctggagtaaggtaaaattcaagaatattggccgtgaattacagaaagctaggaaaaagcttgctgagctgctggaaacatatgcagatagtgctgctgttcgccaagcctcggatcacatgaacgaactactttatcgtgaagagatgttgtggttacagcgctcacggattaactggctaaaggagggcgaccgtaacactcgcttctttcatagtaaggctgtttggagggcaaagaagaatcggattcagtctcttaaagacagtgctggcactgtacaccgttcggcaacagcaatggagcagctggctactgaatattttcaggaagtgtattctgccgaccctagtctggatcacagtatagtgtcaagtttcttccagtcgaaagtttcagcacagatgaatgaggctttatgcagcgatttaacagaagaggagatctctaccgccatcttccagatcggcccgctgaaagcgccgggccccgatggattttcggccaagttctatcaacgaaattggggcacaattaaaagtgaggtagtcaaggcagttcataatttcttcatcataggagtgatgccggaggggataaatgacacagcaattgttttgattccgaagattaagcagcccacccaactgaaggactaccggccgatcagcctctgtaatgtcatttataaagtggtaagcaaatgtctggttaacaggctgagaccgttcctagatgaactggtttcgcctaatcaaagtgcttttgtccctgagcgtcttataactgacaatgctctagtagcttttgagtgtttccatttcatacaaaagaacaagaatccaaacaaggctgcatgtgcttacaagttggacctgtccaaggcttacaacagggtagattggaggtttttggagcaagcaatgcacaagatgggtttcgctcaccggtgggttagttggataatgtcgtgtgtaaccacagtgagatactctgtgaaattcaatgggaccttgttaagtgcattcgctccaacaagaggtttacgccagggcgatcctctctctccatttcttttcctgtttgtggctgatggactgtcactccttctagaggaaaaagttaggcaaggagctattttgcctctttcacgtttgccgacgggcaccagggatctctcacttattgttcgctgatgataccctactgttttttgaagcagtgaaagagcaggctgtggcaatcaagcaagtgctgaatgactttgccgcaagcactggccaattgattaacccgtcgaatgctcaatcatgtttggtgcggcttcccctgcagcaatccaacaggatatcagatcgattttgcaagttggtgataatggtttcgatgacagatacctggggtttccgacaccggagggtagaatgaagaaagggcatttccagagtttacaagagaaggtttggaaacgaattctgctgtggggcgaaaaccatctgtcatcgggtggaaaggaagtgcttataaaagctgttcttcaaaccataccggtttacgtcatgtgtatttttaaaatccctgatgcagtgtgcgatgagctgacaaaggccattaggaacttttggtggggagcagttgggggcaaaagcaagacgcattggaaatcttggaattccatagccaagtcgaagcaaagagggggtctgggctttcgtgatactaggctcttcaaccaagcgcttttggcccgataagcttggagactgttagagaatctagatagtctctgtgcacaccttctaaaggcaaagtactatcccaacggttccatcgttgacacctgttttagcgggaatgcttcacctgggtggagaggaattgaacatgggttggagctactcaagaaaggaattatttggcgggtgggtaacggacagtccataagagtatggcgagatccctggttaccgagagattattccagacggcccatcacccgcaaaggtaattgttgtatcaagtgggtgtcggatttgctacaggatgatggaacttggagggttgataaagtgcaggaacacttttggccgatagatgtagaaatgatcctgaagattcgcacctcagcttcacttgaatccgattttttggcttggcatcctgatagattgggaaaattctcggtcaggagtgtgtaccacttggtcgtttcgcttgcagagaccggtgattgctccagttctacagaggtgctagtaaataaatcttggaagcgtatctgggcgtgcaatgtcccacaaaaagtcagaatcttcgcttggaaggctatatctaatagtctccccacaatgaagaacaaaaagaagaggaatctggagttgttgagcacttgctgcatatgtggagccgaggaagaggatgttgcccatgcgctttgtcattgtcagcaagcgaggaacctgtggtcggctatgtattctgcgagagccatctctcatgacgtgaatagtgcttggtccgggacggattggatcctgaaccttttggaggatgccatgtttctcatgctaatgtggcgcatttggcataacagaaatgagatcacccatggtaaatcaattgcgccagtggctgtctctcagagattcatctttagttatgttagctcgctaactactattaagcagtaccctcaagctgacataattaaaggtaaacaggtggcacacccggaccgcattaggcttcccagccaagctccccccgcagtcagttcgcctaggcgctgggagaaaccgagcacaaggtggatgaaattgaacgttgatggatcctttcaggcttcggatggtaaaggtggaattggggctgtttttagagacagctctggaaatgttatttttgctgcctgtgggtctatgctggtttgtggtagtgctatggaagcagattactcgcgtgcagggagggtattgcaatggcgcttcaatggacgttcctgcctttcattgtggaaactgattgcttagaggtgtttaatctaattcaatcaaaagagaaggtgctgtccgagttagcttttgttgtcaaggaggttcaggtcctcatgacaggcaacagggagattaaagtcaggaaggagtcccgtgatcagaatagtgttagtcatcatttccttgctaacaagggaagatgtgaggccttaacttctttctggcctgataacacttgtaatctcatttcacatctcatcgatgtggactcaattgagtaatatagctccctgttttcccccgcaaaaaaaaaaaacctgaatttcattagctaaagatcagctcgacgca

SEQ ID NO: 65256 - DNA, 919 bp, Oryza sativa
aagcacttgcgtcaccagccactgtggcctagggccctaggcgtcgtcgttgtggagatctacccatggacaacgacgctacttcgcccgatcgatgcgatggagcacccctccgtggccatcgcgttccgccggtgccgtccagcctcgacacgctccggctcgctgccctccgtcgatgccctcgtgcccgacatgtcctccacctcccgtgttagttcctcaagatgctgtcgttgaagaagatgcgaaaggtgctcgatgagggaagaggaacgttgtgagggttctttgtaaaatgtgagtggaggaggcgggcgtttatttggaaaagtgctacgcttgtgatttggccccaggatcttgatcgaatggctatgaactctcgtgtgcattagtgcagctacatatctgtgtataggatacattatatatatatatatatatatatatatatatatatatatatatatgggagcgtattctatgcacacaggccctcgcgtgtacataccgtgtacaccaactaaaaattatcacaaaaaattttaggaaaattcatacatgtactttcaatagtattacatctacgtgcaaagtcgcatcttcaaattcattctacatagagaataacaaaaaaaagataaaattttgacaaaattgcaaccttaaaactgtcagattttttgtttttttgttacggctaaaatataatgaatttgacgttaagattttaaccctatgtgtaatacaattgaaagtatgtgtatgattttttctagattttttggtgacattttttagttggtgtgcacgtgtgtacacgtgagggcttgtgtgaatatatatatatatatatatatatatatatatatatatatatatatatatatatataacttttcagcctcagattacc

SEQ ID NO: 65257 - DNA, 956 bp, Oryza sativa
agcagtccgccgccgacgacctctcctccctcctttccacctccacctccgacgagccctcctcctcgaagaagaagcggtcgaatagcagcagcggcgcgtcgagcatcccgacgggggtgcggctggagggcatcgccaagtcctacaagggggtgaccgtgctcagggacgtttcttgggaggtgcagcgcggcgagaaggtcggactcgtcggcgtcaacggcgccggcaagacgacccagctccgcatcatcgccggcctcgaggaccccgacgccggcgccgtcgtcaaggccaaggacaacatgaggatcgccttcctcagccaggagttcgaggtgtgcgcgtcgcgcaccgtcagggaggagttcctcgccgcgttcgaggaggagatggaggtgaggtcccgcctggagaaggtgcaggccgcgctggagggcgccaccgaggacatggacctcatggggcgcctcctcgacgagctcgacctgctgcagcggcggtcgcaggacgtcgacctcgggatggtcgaggtcaagatccagaagctcatgcccgagctcgggttcgctcccgaggacgccgaccgcctcgtcgcctccttcagtggtgggtggcagatgaggatgtccctcggcaagattcttcttcaggtacagataaaaaagaaaatttgagctctacatgtagcaatcaatggttgtcatattgtgatggagagaaaaatgagtggtattatggccaattggtgatgaatttggtctggattgttgaatttgaattgtagtttttagtgtctgtgtgcatttccaatgctgaaattgattgtgtgcaggatcccgatttgctgccgctcgattagcccaccaatcacgttgatttggacaccattgagtggctggagagttacctcaagacgcaggaagtgccgatggtcctcatttctcatgaca

SEQ ID NO: 65258 - DNA, 4760 bp, Oryza sativa
  unsure (1)..(4760): unsure at all n locations
tcctgcagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctgaagttctgaattctgaccagatcaagctagcaaagtagagtagtagagtacggagtacctttaattctgtcatagtgcagatcattaaaaactttcttgcacatcttgattaacctccaaaactacagctttggttagaacttgaatatgggtgttgatatctgattttggatggcagtaagatgacatttgttaggatgtgtttgcccatgttatgggaatgaaaaacaaaatgcattaggcactgtggcctggaacatcagatatatagcaaagatctagtttcaagtcttatattaatcagattggaatcatgatgaaccttctactgagataattcactattcagcttagtgttggttgtatttatagttggtttaccttatgctcaatgacacttgaatttgctgcttgatgtgatttatgtccgagaaccattccagaccacagatttatgcaagcttgactgaatcctgtatttggatactgatgtgcaggtatggaccaatggagtatgggagcagcaaatctacgtcacactcagaggcttaagttgttgcatttatgcctcaaaccctctaggatgcttgtcagtagatgcctctgtctttggctctttgctaacctgaaccatagatgcaaatacagttcatgaagcatccatgtgatcctctgatcctctcttcaactttcggaattttgtacagtgttccgtactatcttgacgaaacacattctaaggaggttatgttcttattcattagattttagcagttctgttcttcagggttacttgtaaccattttgtgttaacatgttctccgctccaactgaatctaacctactttgtgcagctgtcttggtttctcatttgtttagctattgctggatgttatcttgagaaaacaacactaaggcaccgttcgttccagggtgtttggggagattgagtctcgttttccgcgcgcacgcttttcaaactactaaacggtgcgttttttgcaaaaaatttctatacgaaagttgctttaaaaaaccatattaatccatttttgaaatttaaaatagttaatacttaattaatcatgagctaatggctcacctcgttttgcgtatcttcccaatctcctcaatccccttcccctcaaacacaccctaaatcaatgaacatgcttttttaaaatgttaataagcaatcaagagatgatatagactgcagttagtgttcaattcccaagtagccatctgagtagaggatctaacaggagatcatccttggacctgaactattttttcccgttggaaattcaatcccagtttattggcttgtattcacctgacctgttagcactccaaatatgttttgggatatttgggcatttgcatttgccgtgctcttattgcgatgtatagctacaccttgccatgaaagggtacaaattttagctcctttttcagggaaaaaaggaaaatctttgttgtgccaatcttccttgccatgtaacaggagtaatcgttaattcacagggttttctgtgtttctgattttcggttgtatatgacaatatgtagctgcacggtagttcatcattgaaaacttctccaacagcataaatagggcttcctgtagttcattcatgtgattcttaggatagacaaaaacagagcattttgatctgcttcctttatcttcagtataaccaatcagtataggttttacaccatgatataattgcccagctgcagtaactttttacaatgtgtggttcctccgtatgggtgaaagctggaagaacatgaattggtattgctacttgatacaaaataaagcatgcctccatcagaaactgcctgcattatgtacaaggtcatgtatcatttcctgctttagttacagcatttggtcctcctatgatgctactgctaggattacttcctttctgatgtatgtacaccagttgctagtgatatatggagtataatagcattacagcaggccatgcgcctgccttgtcactggtgtcgcaaatgaggtgtatggcaccgtggatgataccatgaatcaggattctcacttccacctcttcgcgtttttcagcgatttcgatttttgcttgctttgctggaatgcctgcatcttctgcttctttctggcaattttctctgcctgtattacagttagaaaaaagaactgtcagttatagaagctaaacccaattaattgtagttcgcatccaaattcacatcgtgaaaagacagtagagatattcacctttgacatttttgacttggcctttactttgggggctttctcctcgagctcttcctcacgtgcaagttccctctctctggcctcaagattcctttcaaggtaatactgcaaacacaaagaagaaaataacatcatttctgggtgttccagtatttttcagtgttccggcaccctaatatgaaaaattcagactcccctctgttttttgtgatgcctctggccctctgtaggatttatatcttgatttctaccattagtattgctgaagttactgggataattatgatctatatcttggtggcctgaatctatatcttttactgagcactagtttggcacgtgatgaggtaagagtttttatataagatgaagcatttaattcggattatgtggagaaaactatagattatgttgctgcactatgggaaactattataatcaagaagagttaaccatatttcactcgaatacagcaaatacaggttgcaaagtaatattgagtaacttatatcacaggataactcacattgtaatctccttgatagtcctgaatagtctgatctttcacttcaataactctgttaacaatttgctttacgaaataccggtcatgagaaactgttataacagtgcctgtgtattctgaaattgcctcctgccatgcacacacaagcatttactgtaagtacatgctaaacaaggaactgatggatcataagaaaaaagttttgctatgcaggagaactgcattacaatttttttaacatacgagaattgcatctaacctcaagcatttctttcgatggaatatcaaggtgatttgttggttcatccaatatcaataaagtagatggagtcaccaagaacttgcagaaggcaagcctcgcctggggaaataacagataaattgtgagtaaatatacagtaacactacatcatacaaataaaagaaattcactggcaaacgtatattaccttctctccaccacttaagaattgaacctttctatccaacatatcatccctaaaattgcaacgaccaaggagacctttgatatcatcaattttccaatcctctgctgcttctgctacagtatccagcacagttttctccaaatcaagtgcttcagcctggtaaagatcatgtacatgaatctagtcaggaaaaaaatatttttttactactgaaataatgaaaggttgatgatgcgctgcaattaatcaataggcttacaaccacttgacctgatagcttaatcaaacagtgaaaatcaaatatatactactgtacagtattactgtcatgatgaaaccatagtgaaagaaaggatatccatttcagggatttggtgtacctgattttgctcgaaataattaggcaatacattatgctccccaagaagtacttcgcctccttgtgtcttctccatccccaaaataagcttaagtaaagtgcttttcccacatccattggggccaattatggctatcttttcacctctctcaactattagatttgcattattgaacaatttctggagatgataccaaaggaggaattaagagcattaatacaaatagttggggtacggttaatcaaaaagaaattgactctgaaacagtttccaatagaatgaacctaacctcttccccaaatccaaattcgagattccttattgtcaatacagttctaccgctttgcccacgctctggaaatctgatcttcaactgcttcctttggaaaggcttctcaatcaatccttccttttcaagcttttccaatttctagtgtttgaaattagacaaaagttattagtaagtaatgacagatggctgaaataagagatagattgtattgatctgaagcatgccgcaatcatgcaattgtagtggttaccttctgctcactcgatgcacgccctgcgttaactccagccccaagtctgtttatcagttcctttgtctgctcaatctccttctgctgcttctcccatgcggcatattgagtctccacccaaatcgccttcgccaaaacgtattccgaatagtttcccttgtacgttttggacacgccgaattcagtttccactatcttggtacacaactgatccaggaaagccctgtcatgagaaatgatgaccatcggcacttcctgcgtcttgaggtaactctccagccactcaatggtgtccaa

SEQ ID NO: 65259 - DNA, 45909 bp, Oryza sativa
aaagagattgatggagttttttaatagttttttcttttgaaaaagttttatcaaaaacaatttttgggcgatttttttagaggagggaaagacttaacagtctcattattttgcttatgcttatacttataagctaaaatttaggtgagagaggaagagatcatggatggagttttagcagtttatgaaaaaaaaaagaaaaagttttatcaaaaacaaaattttgggtgggtttttctgttgggaggggaggtgagagaagggttattttttttttcaccttagaaaagaacctttttactttcttttatgttgattttattcacatatgccacttttgttttgtagtgggaagtcatattcttatttgtggtagataggagaaaattggagaaatggtttatattttttgcggtttgtttcgtgtctgaatattatatgacgcatagaaaagttctccaaaccaattgatctttttttacgtgggctggacacccaacgtgtaattgttacttatcgattttttttctcccattttattgttcgagcacttgtgctattgaaataacgtacgacaagagggatttctccacgtaattttgtacatgctagttaaactggatgggttatacaactcatagcttctatttcttatatatatgcaattatgcatacaagtgttgatatcaatcaataatgttataatttggtccaaccacaccctaatggtatggaaatggttttttattaatatggtaatttctatgtcatcggacagaacgtgatgtcatgtttttaagctatctttatctttacaatataatacagagtaataaaatagattgtacatctattccctgtttctatttttcatggatcaatgttatttctaagctatttgtgatgaagttcttaatatcatacaaaagaatagtagcacgattttttaaaggataagttggtgttacatttaatcttaaaagggcattgtagatatacacatatctgtatgctttggtcccaatagagatgattcgatgtttaacacaagttaaagtaacgctttgcatcatgtcgatgtctatgtgtatgtttcagtgctaatcaaataaaaactttgttatcctaaaaggaagctgaagaaaaatatctcaataaaaccaccatatcaagttgaattccactcctaccttctaaactcattgtcaacatttcatcgtgtcaaaacctaaaaccacataaaccactgtacgcaagccaacacactaccacaaatctccgaccaatttttctaccgattttcatttgatcacgacactactctctagaacaaaaaatgagccgttttttcttgcctcaaaagaaagaaaaactaattttccaatcatgaacaaaaaattggacgtggaagtgtggaaccataaggaaaattttcttgtggcctaggctcaacgggaggaagacgacgacgccaattgccatcgtcagttcgtcaccaaccaagccgttgctggaccgagcgtgtggccctccacggaatcgtgcgagctcacgcggccacacacgtgtcacgcggggataaagcacgcagctttgccatccattgctacaggctacagcccttgctccctgaaatgttcagaaaaccatgagcttacccgcacaaagagagagaaagagccagtggtggagtcaggaatttaaacctgcgagaaagagccagtggttaagaaatactgttcccagtaataaacctgaaaaaaggaaggagatattaagttttgatttgtggtgtggcaatgaaaagttgaaaacaccagggcaaaagcacaaacattttcattgcctgagaacatgcataaacaggattgaggacaaatcagagagactatatgggctcaaaaggaaaaaaaatgatgcaaaaggaccgagttgtaaggaggtatgggtatatctgcaaggaaaaactggacgcagggaccagaacgtgaattctaaaatgatgatcatttgtgggtatatccgcaaaggtagagactgagggtgcaattgacaaggaaatgtataaaaaggaccgagttgtaagagttggaataggcggaggggcgtatctgcaaggaaaactatgggctccagggacctggttggaaatctcaaaaaatttggaccatttctcgatttgtgcgtgtcatccttgcgcaggggccatgctaatcttctctgtatcgttccaattttatcggatgtctccgaagagacaacacaagcggcagcgcgcggggttataaggtgggttcttcattgttcggtaggcgaggtggtactaaacctgtctcccctcaacgctcccgcgacccaccgatccccatccaacggcccccgcagcgcccagcggcatcccgcgcggtagtacacgctcgtgggccgtatcctccgttacggcccaaacaagcagagagcacactaggcttctctcgcctgcggcctcgtagctcaagtctgagccccatcatccatcgtgaccattcatgaataaaaccggtttgtatatgtgctccttttttttttgtccggcttagttcgttcttgcataacaactgaggttctaagtggcacgaaaaagggataaaacaattaacacatgatgaattaattattaactattataaacttgaaaaatatgttcatttgaatttttaaagaaaattataccgtttaacaagtgtcctaatgaaaaacaagcaagttaagtttaggattgaagtaaactgtaaactatatgtctgaccgcttgcagaactactgattgaccagcttgattgcgtccaaaatcaaatggtagagcgagagccgaaggcaagcccagctggtttaattagcaatcgcctatataatcagctagcgcaacaactgttagttagttggttgttgatgttgtgcttcaagaaatcaattaattaattagtctgttcttattgcttagtgtactacacactcttagctggagccctagccatgggaagaaattaattaaatccccagataaacacatgaccacgaaactgcattgctgtactaaagctctgaactagctagcaacgcgtcttagatatattccaccaagcaaaagccacatcatgctgtgctgtgccgtgccaaattaaaaccacatcgtggccttcaagtttctgctagcttcgtccttcgttgctaatcccagccagttaatcaattaattcgtcagatagatagatatatatacgcgttcatcagcgtacgttcttatagctagaactcatcctgctgtgcaaaacctgcatcactagctagctagctagctctgaatcctctagttgtctgatctcgatcgatcgatcgacaactatctcgtccacatcaagaaagcaaagttttcttgagctacgaatcaatcgatcgatcgatcgccatgggcaacagaaacgaggtgagtgagaaaatctgaattgatcatgcaatttcagagccaaattgaggtagtagcttagctacatgtgtgtgtggttgcattgcagcagcaggaggaggagcagcggcgggcgagggtgccggcgttcggcgagtgggacgagatgaaggccgccggcgtgctgccggactactccctcgacttctccaagatccgcgccgtccgcatgcagctcaaggagggtgggcccctcaccacctggtcctccaccgccgccggcggcgtagaggtcggcggcgagacggagcggcgctcatcgtcggccgccggcgtcgtcgtcgacggccgtgatcgccgccgccgccgccaccgccaccgccgacacagcagcgacggcggcgccgacctccgccggccgctccggcacgaccgtgctgcagctcccaaggtcagctaattaattaaactgctaattttcatgcgttttggtgttcttctgatggtttactaaaaagtgaagattccaaggtctgtgttactactaccatgttaatcattttaagctgcacggttataaccatatgaacttatccgcgattaagtgaaattaataagcatgattcgttcaacacactggtcaatttgttttctcaacacaaacgtacactgtaaatgtcaacatgctgcccgttagttaaaaattcagaatgttcttggggcaaactgacgtatgttaatcccgcgtttaagatatttttatgtatatttgttttttgaggaaatgtttatgtatatattttactctgctgaaactgctgcaaattgattaaatgcgacatgctgcgcacttcatcgctccttttaatatttctgtctgaatgttctttgggacatctgattgaacaatgtactatacttaaaaaattcagaacacacaagtcgtcgcgccagattgtcatgcttaatttgttgaactattatttgtttaattttgattctgaccattgtttagttttgatcctagcaggagaggagcaagctgggctacctgttctgttgcattgctggatgaagggcattggcagaaaaaaaaaattcaaatgcaagaaggcaattcaagaaaaaacttagtgctcatacatgtttaatttctccctcgtatttctgccatctctcaccgatcgatctgttggtgatttggtggatgttggtgttccatatataacagctcgttgcatctgtaatgttaggctgtctaggaattctttgctgtaaaaaaagaaaataaattcttggttaattttgattttgcctgggatgaaagccattgatttgtagcctgtacattgcacatgttgtaaatagtgaagtcgagagttattttcacaatttttaaaattaaaatggtttcttccgatctctttgataccacaggcgggctaaaaattagtagtcgtttggattctgaagaattcatcggtgcagtgaacaacaagcatactgatcttataggattcgtaaaggaaaaggtgaaatgatttcagaagagacgaacaaaatgaaacggaaagttaaaaaaatgtcaaattaggggtaataccagggacgatattgaataatgtaggtagccaaaagctatctgtaatggaggaaaaacgagagactgcaaagtggcaaaaggacccacctgtagaaaaggggaataggcaagggcgtgatgagaagatcccgggggcatatatgtaaggaaaaccatggtcgtcagggactaactcgtgaattcacaaaattgaccatttgtgggtctgtctgcaaagggagagattgagggtgcaactgaaaagaaaacgtagaaaaaggaccgaattgtaagattcgtaataggcggaggggcatatctgcaacgaaaatacttgtaactcagggacctggatggaaatctcaaaaaaatttggaccatttctcgatttgtgcgtgtcatccttgcgcaggggccatgctaatcttctctgtatcgttccaattttatcggatgtctccgaagagacaacacaagcgacagcgcgcgggtttataagttggtcgcgttcgagttagctgggcaatgtggtactaaactgttcctcccgcctctcgcgctcacactcgccctgtgggccgctcaccgtgcacgtacttgggcctcccgctcccccgcatgcatccagcccatcacagcgaagagaatcgggcttttcttctccccatctccctacacaaccaccaaatacagccaggccgttggttcatgatccggcggcagatcgacatctacctcttcacggtctcacgatgcaagcgcatcatcgaaacgtgtaaagcacccataataatactgataaattattcgcagtttcacacccagattactccataaaaatgatcaataacacatgaattatgatttatgatttatgcttgcttataattacatagtagatgacaaggcttactctgagtaactctctttttttttttttggtttcatttgctgaattaatctgtgctactacagatgaagaagctagagaacattttaggccgactgcatatatattgatgcattacatgagtaggctacggatgaggtcgggcacatctgcgccgttgatggcgagatcggacggctggaggaggaggagctcggcgagcctctcgctgagggcgtccgcctcccggtgaagcctccggatgtagcggcacgcctcctgcagcacctcggcacttgacgcctgctttgattaatcaatcaaattttagcgaggaatatatattaatccctacattataatgggatatataaattgtacttgcagatggggaaagggaaaaaccaataaaatgatgtgattataaacatgcgcatattacacgtcatgcgtgtgtgtttacaataacaatttagtgggatcagtgagacatggaattgtggtctccagctctttcagcggaatggtaacacggggatatgctagtggggctggcgataagcattgtgtgcgtgtgcattttccgtacaactgacgaagggaaaaaaaaataaacacatatatctacatgtggattatcacgtcctaaaaattcaatatccactagccacgtaatgattaacctagtagctcaagcgagtgagttagtgacaggcacaattaatgacggatataaacccaaaagggaggatattatatattaattgccaatgcaatgcatgcatgtatatgcatgcttggtttgtaactgatcctttcgcaattccgaccttatggatcatcgattgcatcgtctagctatggagtaattaaactagggatggagatcgaactcatgttaatattttcccttttctaacgtaaaatactcccgcaatcctaaatagataaaccagttcatataatatgataatatattctaatactacgaatcaaaaccggtttaatttgatcgagatcgatcaaagatcaccatcttaccttggcattggcctcgccgccgcgggtggggaggacggcctgcagcttcgagatgagctccgccatctgctcatccgtcggcggcggcgccgccgccaatctcgacgatgtacggctccgccggctcgacgacattgctaatcgagagagagagagagcttgagcttgtgagcctagctaggcaaagctacagtcaaaggagaggatcgatcgatgagcagtactagtacatgggcagtccagtccatatataagaagagcacgtacgttgtgcatgcgtacacgttgcgttggggacaagctcacatacggtgatagagacatgcatggggacatgcatgcatgttggtagctagcaacaataaataataatattagccatgtcagtctcacacggttaaagtgttagtcaggacatgtttagtatatctccagcttctaaatttagcttcaggagctggatctagagtagaattgtggagcggcctaaatcagctccacctctctagttcattttgtaagagcgctccacccagctccggggctgaaactgtttggctgaactccggctccagaagaggtggagctggagctatgccaaacagtctcttatagtatagtttaaggataaagatatcttgtggttgtagcccgttgtaattaaaatgatcgatatccgttatcatgtctttttttttcttttctaatatttgtatgatgtgtaaattcagctatatttgcagacgtccaaaatagccttggattaattgtaccattttagttcaacggtatgagatcaataaagtttcttttatcaaaaaaggtgttagtctctaagagattgagctagccatgttacatgcctaactgggagctgctacaataagtacacgtagctagccagtgcatatatgcatatacatgtgtgtcgttatgtacataaagttgtgagaagtgaagaaagcaatgccagcttcagcttcagttggcactgtactgatccagtggaccagtggacggacaactggtgcacttatgatgttggatcgatcaatcggcaattgtgtggggccaaaggcagaatgtgtcataagttctttaatttatttttaattatttccccaagtttaacaaaataattaattctcagttgaatgatatatgaagatactccatttttttcccatatggaaaatggcatgtttaaacgatgtcatttgatttgcatgtatatataggtatatatgatgctcatgcaaagaacaaaaggccagtttggttagtttgttcttgcatggatgatcatatatatatcttatttgctctcgacgatcctttcacgtgctgccatgcataaataaatagtttatcagatattagggcactcaacaccaacaagatgtcgatcgggtaagagtggaagatcatatgaaaataatcaaaagtatgaactgcattgtaacaccctccaatatgcagttaagatcgagctgacacgctgcattatgcatgtgctgatcagatcatccggagatttgatctgtgattgcgtatcatggtcacagaattaagcatttttgctttgtcaggtggactcacacgctcacacacaaactttaaccaacagattaaattaaatttcagcttgttggtcaagacagcccggagatgggccctcccaaaaaaatagtaactgagaaaatcacatggtatcagtacgaagttttagaggattttattgccgattaaaaatttaaaataacctcgtctatatattcttattcatgtaagttgagtattgccctctctcgtaaattaggattgacatacattatttttctattacaggaagaacgcatattcgtaaccgcactaacgcctccacgaatgcaccccttaacaatatatgctcaaagagaagagatagaaacctctctagccttactagaaatcccattgtgaaacgggatggacctgtggcaactcattctcgctaaaaatattatggtttgtgagactgcatcccataacatagtactttaggcatcacgatttaaaactctggcggtggagctatacatacaccacaactctactcgaatctggtgcttccactaatatgtgaatcttttttttattgctcaaaaaccgcatcatgtatgcactcaccaaatttacacctctatgaatcatgaaagtgtctcttaacacatgcttaaagaaataaaaactagtgacaattccctagcctcttactgattaaaatcctattgaaagtgtacatctaggctagtcataacccaaccttactaaaattatattaaaaccgcacctgcatgtatgtagtatttctaataaccggtggtggagctatgtaccacgacgatgcttccactgacacgtgaaatttcaagattagttagacgcggaattatctcttccttatattctgcaggtgcttccactgacatgtgaaatttcaagatgaatgagacgcgaagttatcccttcctcataatttgcatgactctatcctatgactcctgtcacatcctcaaacatggctaacttcaaagggattaaccattcacatgcatagcataacttgttggctacatgcatgcatgaaagcatgaagcaccataattggacagcgcatatgaacaaatcaagaaaagaaaaccatcaatccattgtattgcgaccattcaacagggatggaggaagtgaattaattcccaaagttgattgattgattgggccgtctttccaaacctgtgggtaggttgcaaccatattcttgatttactttttctgaagattatgttagataaataaacatgcatgtgccagacgtccaaggttatccatttttaatttccttttaacttctatatgtagtttctttatggagaaggttatgctccaattgtatatgttgacttcattccttacatcaaattggatgcttgatcgtgaaggttatttggttgggagaggagggtgcatctgcatttttaatatatgtccttgaattagcatatgtgttttgtgccatttaattaacataaacatatatgtttttcctccgcaaacacactacattacacatggcttttcctcggtgtcagagacaatattgctacagtatttaattcccaaaagggttttgattaagtggttgttaatttggtcgacagaccaaggatgcacaaaatgcataatcttgtcaaactttctgtggggtacgtatgtgcatgctcgttacccacgtaaaaactcatttttatagtttatcttttacttgctagtacaaaatttgaaacaagaaattaagtagaattaggataggcaaaaagaaaaaactcgtttgtctgtccacttgcatccctacttttctaccactcttatcttaagatatgattagcgaaatgatggcacatattgtattagctaggaaaaaatgtcactttttttagtgaatgactttagggtaaagatgaaagagaaaatacttttataggtgtggttgtgaagtacaaatgagttgtctggttaaacttgtttaacatgaagtgtggcaaggagaggcaatgttttggcattaccaattatactctgatagacctaagcgccacttaggataaacacatctaaaggcccctttgaatcgcaggattgagaaaacgtaggaataggaaaaacgtaggattttgataggaatgtaagtgtaaaacagaggataacaaaacgcaggaaaaacacaggaatgaccgtttgattgaaccacaggaaaaacacaagaattggatgagagagatagactcaaaggaaagttagcaagaggttgaagctcttgctaaatttcctccaaaatctctataggattgtccattccataggaatttcaaaggattggataggattcaatcctttgtttcaaagggcttcataggaaattttcctataggattgaaatcctctaaaattcctatgtttttcccccaaataaaaggggccctaagtgtatacgacatcgctagctagttaatcactaggcacttgaaaataacttgttagagcatcattaagagtatcccaataatcaattcccaaaacaatgttttttggatctcataaactgaatataggaagtgagaaaacctatctctccaacagaaagcttcattgatttcctataatgaaaagtaggccatccctttaactaccaatagagaaaattagtttttctaagccgaactcctcccatacgcgcacatcgcgctatgcctgcgcgctcgagagagctattgggaacaaaaatttgctcccttgaagtgaggaacgagatatgcggagttggaaacctgaattattgagaaacaggttagggattctgttggatgcaatttttaaccaaattttcctaaatatgaggatagggaatagaataagtaagctgttgcccatgctttagcttaaaaagaaatccctggatgacttaaaactattaatgtcagaattttgataaccctatgaattgcctcacaaacggcttaccagtcatccctcatttgaaacatactaattcttaaaacagaaacataagaaactatagaattatagtgacttagtaaattgacaaaacgctctcctcacgagagagggatatactacacaaaagaatttttttaagccaatcgaaaggaatatcataggacttttcgagtagctattcctttgatccaaaaaaccacacgaaaaaagtcttttagaagattgaattcctccaaaatttctccgagaaccgaagggagatgggggtttgttccgtcacctctttaatttgctttatccttacgtacacgatactcgttaactatgtgcatcgatgatacagaggccagacctaacgaacaatgggcggaactaagattccatggtttcgttggatatatatatttaatggtggagaaataaatcagaatcatgtctggtcctccatgataattgctgcctgacatgggacgacatgcctcaacttgggggcttggttttcagctgctagctgctagcaaacgatgtactctctctgtccaaaaaaaactaacttacgtgagaatataatttcacctaagataataaattggataaaaggttgtccagattcgtcacctagattgttttttaagacggggaaagtaatattagtagtactccctccataaatgcttatattttaggacgaagtattatcccgcaaatgcatcagtagtataaactctcacaaagtcacatggatgggatggtgattgtgacaagtacagttatcagtgcaggcaagtgaagatatatatacaggaagaaatgggattaagacaagaatcaatgtatgtagatgctgttatattagtagttaatttcatgtcaggaatggtttctgcaatgtgcccacatgttgtgaaaatacttggaggatatctctgatgaatcaactgtgtcaatcagcaattgtatcatatatatgctctccaagtttccttcgttttgaaatttgaaggatttgtctagttggcgatttgtgatatgtaagaatcacaaattcagagtgtattcaggccaacagacaatctaaaaggcacatgatcaaattttgagatgttaggtgcagaaatggagatggtaatatacaatattttcgtaaaataagatactagtacaatgtattttttgtaaaagcaatgacaaattcagtatgatgtgtagttgtgtacagatccaagtgtgctggaaagattaacagaaaaaaagaagagagaattatccacacttctattgaactgttacagcattttgctaggataaatgcacacaacatacaaattccattccaggggttccctcgccatgctttcaatattcaggcctcagcaatcaagtcagggagaagcttgaacctgttctgctgcataacagagaaaactgaatacacatggacaggcaagtatgtgcaaagaatgaagaaattcaactacaaatttaactatgcattctttctctttctgtaaggactgaaattttatgattttatccttgtagccaattgatcagcagatcaagtcaattttatgattttatccttgtagcccttactacttgccaatgaagtactgtgctaaaaggtccgcgatagagtttttttgggaatacgcaagcggcgcatctttgtattaagaggaataaagtttataaacaacggatccgaaaactgaaaaaaagaaggggacaggttacaggacacagaatggagctaaaggcctaatctccgactagattttgcgaccgtggaaccaagctaggaagaggcaattctggcaccgctgcatttactaagtgccatagttccgcctcggcagccataaccttcgccacttcgacccaaggcttctgttgttggttgaagaccctgttattcctctccttccatattgatggagaatgaagacttattgatggaagaaataagagatcaagaaataactactttcatttgcattatctgctaacaacgtcgaatctaacagttgagagaagccattatcattcagtaaagactgagttatattacttatatagttctagcgagattaatctctacagggttgatgagaatagagaaccaacagcctgctatccgatggtgactcccggattatcattagaacaagacagtactgtactaacacctattagtctataacaagcattagcatggcactaactttgttgaaggtagcagaagtaattaatcaatgaggatactagctcacaagctcagtggtgagatcaatcattaaggaaatactacagagatacaagatgaaactacatgttcacttatatgttatatttttggcggacagccgaaagattggccgacaaaatttcattaagatttagggaagattattacatggttttgtcatgacattaaatgtcgagttgatggtggttaaatgaaatttagacaagctaattgtttaagcgctaccgaagcttttacatgaacaagatcacttttgattaaccaaaattaaagaaagatatgctctcctgtctaaaaattggcaaactgataatcttctgacaaacaggacaaaactgaaggcaagaaagaatcaatattatttggatatcattttcattctaagtttctaactaacaagttgccattttgtaaatcatattctaataaaaatcataaacaagaaaatcacctaacataactccagcatcatgcaaagcactttcttctctgcaaaaacaaacataagttaacttagttgatcacatgagctatttctttggaatctgcattgaagtcatagcgtaagaagttttccccttaacatttctagcataagattctcacccatctctcaacttctgatgctgattcagaaagtctcctcctaagaatggacttttctgcttcacagctctctaaatcaacatctgcataagataacaaaatgtccagaaatgtgaacacttcaaatccgaattacaaacatctacatataaaactctgtttatgccggctctacacatatgcactataaaatatatggataaaatatactgcatatggatgtgttgatataaaaatatagagaaacattggaaaatgtaacatagaacaggtcaaaaaatatatatatcagaggccttaatcaggacatgcgtaataaacatggcatgataaaagcgctagacaacttgcaagtacggtatcagaaatccgaatatggtaagacattttggtgattgggcagagatcagaataattgaactaagaatatggcatgaattaatactacttcattattacgtaaaggtcagaactttagatgctaacattatagtttcttatcacatgacagggttgctttatcagcgtggtacacacctatctaatctctatacatacccaatgccaacaatattcaaatttccacctgcctgttccactactagagcaaattcaacatttgaatggtacaaactaaaagcttgaaatctaaaaacatatacattttattaaaaataaattctaaaacgttgtaaagatgatctcatctcaaggacatgcattctaaggaaacacataacactgtatgtcaaacattatgtgttacataatgctaaattgcatttggtttgcattataagattttagaagcaccaaaagagataaataggagataaaacaagaaacgtttaattcttttcaattccttaccataatagtatgttgacagaatgctgatacgctcaataggctgaaaataaccaaaaaaaaaatgttaatgtttcatttcatcatttgtcatgtatgtaatacactttgacacgaagttcaagaatataatagaagtgataagattgcgtaagggttcaagtatttctaaagccatgcgtgttcagtgagcctgcttggacaaaacacacactaatgaggcaaaaaaaaaaaggaatatctatctgaccaaaaacttgaatacattattttaactacaaaccttttacagaggatttgcagcagagaaatcattatgtgatttaaggaaaaactaaaggatgttttatgcctacataaaagaaaatgctgtacattgcaggtggacgtatacataccattacaaatatgccttctctacgagttggaagttgctcaagttttcttaatgtatcatcaccttttgtgagccttccaaatacagcatactgaaattattatgaatcaatgtttaatcatttaagcacctggtatttaatcatgaaccactgaagaaattgttgaacacctgtccatcaaggtgtggtgcatctccaagaaggatggaaaaggaagaaccaccactgtttggatcagagtgccttggagaagggggggaaaaggtgataggtgatgttatatcattgcaggcatatgaaaataagtgatttcataaaaaaatcaagataaacgccaaggaaattagttcatgatattttctaggactactttgcccaataactatcgcattcattttgatttagacaaatagacaaattaactatggaatatataaaggatcttcttcaatacctatccttttatcaacctggtaatcattgataaacttttgagggattacagaaggtactacatgctcatgttgttttggctataaccagaaggtagcaaaagtgatctgttaaaacatcaacaatgtattcacaaattgacaaaggaaataccttcccatggacagaatccccctgacatgcttgacagtactaaattcaccaacaaccgatttctctgcttcctcttgctgctcatcattcatgggggcagttctaccacccacaacagaagcaacttgtgcaacaaaacccttgtcaacctgaacccagtcatcgaccctttacataatgaaactgacaaagtcgtttagcaaaaatgaaaggttagcactaagaggtaattacccggaaaaagtgatttgtgttgtagcacccaagcctcacaagtttgtaaatgtgttcaactgtcttaggagcaacatgaggaaagaagccaaactcaatgtcaccatgagttgtctgcagatcaaattgcctaatcagaaataagaacagatactaccaactttggatgctatagaaccaattttgcctagtgtgtattagctgcaccaggacattagccaaggcatttcataacaaattgaaaaataaaatgatgtgatattataacaccaatacgagatatagaatctgaaatggaagaacatatccaaaatattaagatatcctgttattttaaatcctgattaacgagataattagcttcagccctgtcaccggcttaaataataaagatgcatacttcctcttcctcgtaagtgttcttgttcatttttaggaaatcagaagtttgtagcaacgaatgccacatgagactggttgcctgatcggcgtcctggcattctcccaattgcacactaggtggcatacatctaaattttaacctaatcctagtaaaatctcgcaataagcataggaacggacagttcaacactgcctgcgcatgaggattgacaccttgtaccccttgttttgcaacatctaattgcaacacaactcttaaatttccaacacagcactaaaccgattctccaacagtcggacgaatctggcgaacagcaagagcaacggcgtcggaattcagcgtagatcttcactcacaactcacaattccgaaatctttgatgagcctacgaatctgaccgtgccaaaatccgacttttggccccgttttctccatgaaccccggtaaaaaccgctcctttcctccctgatttagaacagcaactcgggaaaatgagggagatcgtggcgaacctggaagacgacgcgggcggatccgaggtttgggtccgaggcgtagaagctggtggcgccgtcggtggaggcggccgccgcgatgaggaggaccacggccgccgccgccgccgcggcgtggcggagcaaagccgccatttttttcttcccagttcccacctcctctctctctctcctctggtttagctgcaattgtgtatactgcagaactgaggagagacacaaagacaagtgattttttttaaaaaaaaatggttatccacaatttcacaatttttggcaatctttttacatctcagttccctttcttcccatcacaacccaaacctccaggacagccgccaataggtagggagaatagtgttggctgacggggaaaagctcgacggcggaggccgctggccgacgtggctcccaacaatctggagcgcgtgcgcggtgcggcctggtcctacctgtaatggcaatgtcatctttacctacgcgcatgagggctggggcttccgccttgtcaccttgggcaagctcctatcccggcccccaagctcaaagccacccccgccgagctgctcaaaaaccgatgtgttcagatatccctgagctctgcctctccttcatggaggagcactggtggctctaccgcatcgtctttaaggtcaattccatcttcgcgccgccttccactatcaagcttctcgacagctgcaagccttctccccgcccatcgctagttgtcgtcgtcagggttctacctaccgccgctgcccaacggccgctgcccttctccctatcggtcgccagccaccgcacacctcttccgtgactcaacatccaatgtcctcttcatgcgcacggacgctcatggagccagtggtgctcgggatcgtgctcaggcatcacaatgtactccatctcctgtctcttggagatcttctcgccaatcccaatggtgtggctgacacgcgaccctgaccgagagagggaagagcgcgtgcgctacgtggatccggtctgcggcggcgtgcggaggaagagatgcgacatgagccattggatctcatgatcgtacgatttagtattgcgtgtatatgtcagggttggagtcaccgtcaccactatgcttttttttaattatattagtaaatatatattattccttccgtcccattttaagtacagttgtggttttttttccaacgtttgaccgtctgtattatttaatttttttatgattagtatttttattattttagatgataaaacatgaatacttattttcttaagtttttcataaaattttcaaataaaacagatggtcaaacgttgaacacttcaacgtaaactcacaaaataggatggaggaagtatgtgctaatttaccgttctgatttacttgtcgagggaaaaggttcccaacacccttagcttcaaactcacccgagttcttctccctccatccaagctcaagctaattagccaaacattgaattcaacatgaactcgggttccaataacaagttggaaaactgtcctaaaattccaactgatgtttttgcaaggcattcttccatgggcccttggagcccaacgggccgagccggcccaaatccttctctcttaaagccgaacctgatctcgtcactcattgaaactagcagctcttcaccgtcagcaacaacagcatatcattcattatttttgtcttatttttctcctctttttttgcagtgaaattaaagcttctcgatttcgtcttctttttggccatctctcctttggccttttggcaacctaggtagcctctcgatcgatcgtcatggcgtagaaatcatttccatgtgttgtacacggtgcatcatttgtctgcactcgcggtagagtacacacgtacatacgtatacatgtattttatgtttgtatgtatgtattgtgtatacctccttttggtttttggtcaaaattaaatgatttgtttgtacgtccttgcacaaaaaataaagccattcacgtacctgacatgcatattcttcctagtatgatgatgtgtgtacgtgtatatatgctttaactttggagaagaaatatttgtaacgaattttagttttaaaaaaactatgggtttgtttagtttggaggtaatttttaccctactaaaatttggttacttagtaagtcttgacactatcaaatttgattgtagcatataatttgaactagtatgaacaaacattggtagcaaaccaaatatttgtttgattttagataatggaatagaatatccccgtctttgctcaacgacagcaagcatatcattttgcttaatattcgtttgatactactgaagttgccgaaattttattcatgcagaaattggctccaaaaccaaacatgccttacatatcttgcggattttcaagcgtaacttggcgtgcagataatttttataattaagttcaattagatttgatatacactcttgcttgtgtgttctctacaagtacattttattttgtaatataataactatatacataattaatcatcatcgttcagcgtcaaataagttgattctttgtgtgcctttctgtatgtttttatcagcctcatctttttattatgcttatacttattagctaaaatttaaatttttaatctaaaatttaaagttgattttagggtttttcatcgtagtttattttttagcatttgtttttagatcgttaagaaaatgaatataaaaattttattcacaaattatttttcatttttcatttacagatatgttgttttgctttttttttctccaatatgccaaacaatgggactatatacagatatgtaagcgggccgacccacaaatctacttatttgtcaataagtggtaatccgcgggttttcacgtcatagtctggcttgccgcacctagagatataagtgggtcgatccataaactcatttatagatcaaattagtaggtaacccacgggctatccactaattttgcctataagcagcttagcctgcttacagcctgtatatttttattgattgattttgcatgtatatatgaatgcatggtatatgatgcatgagcacaaatgtatatggttgcaatgcatggtcagataatctatgtcatgtagcatgatgatgtacacgtatgtacttttggggctaccctctgtggtccacggtatgacgaatgcagaagtccagaaaacgaaaaatggacgcttaaattagtacgttacacaagtatataccaaaaaatgcatgtttgcattgtgtgaaggaatttcagacttttttcagggtgaaatgatatatcaatatatgtgttcagtcatatgcctggtcccaaaattggaaaactaaatattttaccatgcctagctaggcttcttcacttgttaatttgtttgtttgtgcaagtgcactccaatcatcagcagtgcatgccttcataattaatttacagtctagattgcatgcattgctagctactttctggtttcagattgatatgtaaagctgcattatataatcctgttatgtgaatacatcatctgtggtgtgcatgtttacatttggggccacttcatataaagtccatgatgatgtgaccaaatggaacactccaaataggggaaaagggtggttataggctatacggccagcaattttggaaggaaataaatgtaaaccataattgtttaacaaaggcctcttagaggaaaacacttttgctacatcctcacacatgtcgacgttgaaagaacatcctaaattttcattaaatgtccaagaacttcgatgtgacaacgcgcataagaaaaggaaaaggggaaaggtaatctagttcctccgcgtcgtcgatcaaatttttcgtgagtacatgatgcagtgtaaacctatagccctttataaatggacaaattattccttctctcaccctctctcaccatatgaattgagcatccataataatgcaacaaaaaagctactgaccaactgtttttggaatttcttggacactggagggataggatcaatttggccactttttccccagaggcatttgtgcccttgcttgtgtgggcccccagctgcttgcacaccttgcatcatgcatcctttcaccatttgaaacccatgagcattttggcatgctttgaggtgttcttggtctctaagcaatctccctttttttttcctctttacttgccttgccaaactacaaggcctactcttcttctctcttagttacatggaaaagacaggccagggggtgcctaggctattaggtgtgtgccttgtgcactctatggtccttagttgtcatgaccccaagaatgggctcaaaagactttagggagaaaaaaggtgccatggagtgtagtactagctacttgtacgttgtttttagtgggatcaagcctctttaattttatttttttccgaaatggagtggcagcatgctgcgtgtatcaacaaatttgaaagcaaaaataatgtccttatttgtgaaacttaattttcacttaagagtagtacatacgtaagacatgttcaagatatatataggaataataaaattaaaaatcttgtaaatataatggcacacaacgttatcttaaaaaaaaatgctccaacacttgaataagaaagagaaaaaaaatatgtttaaaacttatctagaaaagcaaagaaagggtgagtcagatcaaatgcgggtataactcacgaaattgtaaaaatctgtgtgtgtgtgtgtgtgtaagaaagagaaaggcagatacaaagagagagatatagatttggaactatccatgaaaattttcatgatctcacctcattttcgatttccaccaaaccatatataggggaaaataccaaaagagaatgaggaaacatttctccattttcttttactgaaagtattataggggaggctctcatcgtcaaatttattaaaagatgttatatgtgtgtgcatgtattctagtgacggttagttaaaaaaaattatgtacaaagattacaacaatattcctccatttcgaatattaaagaaaatattttgtttggattaatacatgcaattctcccttttcttttctcatttttcctttgatccaaactggttctaatgaagtattacttaataatatttttaggagagtactagctacttaatattagccattttttaggaattgtttttttaaaaaaataccttatgaatcacttgaagtttgacatttcaccctataaatcattttgttgcaaatatttaccccatacttgttgttgttattgtttttgttgttgtcagtccacacatgtttaactcaatcaacatgttttttttaccaaaactaaacatttataggagtacacttttcttggagattccactaatagaattgttgctgagagcttaaacattatcgtaccgagttttgctatatgtataaaaagtttaatgaaacatgaagaataagtctaatgcaagcacttggataaaattgattcggctaacttaacctgtggttactctacatgagcgataaaatgtctgattcggttaaataggtgcgcaattgggtggtttttataataaaaccgaggaggtgggggtggatatttgtaacaaaaataacttaattatggaatgaaatattaaattttaaatgatttatgggtggttttccttttattttaggaaatattagcgtggttaatatgcgtagacatatttggtcaataaccagcagtgaatttgtgttcatgaattgaaaggcaagctgggtaagacactcagctcgtgtcatcatcattaccagtcaaagtgacttaagactgcacttacgtgcgtactctttaactgcggcacacctaattaattcgcattaaccagtcaaagaaaattgagaatatctctttaagtggttgattagctaatattttttttaccctgctgtcaagtgtgcatatatatatgcacgctgacacgcagtcaaaacataccaacaattaaaatgttgtatatttgcctctgtcaatactcaagctagtcactgtcattaaccggtcaaaagtgaattaagagtgacactcacgcactagttaatgctcctatagcccgccaagccgccggcaagatattaatataatgttgaacttttttcataattgtcggtctttccaaggctgacacttgtcatgatctatcatgatgctcagtaagaatggattattggcacaaaattattttctaattatttatgccgcacttcggaaagtgcattttttcaaaaaaaaaaaaagtcaacatctgcatttttctagactttgttttaagctatatgttagatttatctttttttaacggaaagatttcattaaaaaattaaattacaaccgatctctgcaactatttgttagatttatgatatattatatttaattctttcatatataaaaggaagataattcatcgaccttctgccttcatccacatttctctagtattataaaaattgaagatattttttgtcggtacttcgataagttatccgtgtttgagtcagtttttaagttcgttcgtttttgaaatacagttccgtatttgagtcggtttctaagttcgttcgcttttgaaaatacagaaggagttgtacaagaaatctgtttaaaaaaacccgcatgctagcttgagacaattggacacttaattgcagctcatgatttatatatatatatatatatatatatatatatatatatatatatatatatatatatatatagtaaatttgtttggtgctccatggtgcccgtatataacaataattagattaaaatagtcttcatccgttgtaacacattcacgggtattttttctagtcatctaaaaaattaggccccagtgcattaccattgttacacggacaaattactccgtctagttgcaagaacatgtaccattctagacgcaagattaaaaaattatgagcatcaatatattttaaaatatttgacatgatgttaacatgtgtaggtttttcacctcgatcaaaggcaccttcataatcttacaatttcatcatagtttacatttgcattcatttacatcagtcatcgtttaaagttgcattaattaggagatttaaattgatctctgaataagttagtatatctcttcatttttttctgttttggacatcgatgtctaacgacatgctttgatcaggacggaacagttaaaaccatccaggatgcatcatatgtacgccatgcattttcaatttaattaccaccacgcatgaataaatgattgtgactagccggctttgctacaagattaaacctaagcttgtttttttaataatgacctaagcttatatatgaaagctcctaatatctgatgtgacggtggccgtggaaagagaggtttcatgaatgattgcgtttaattttttttgtccacgaccgaaagtattgacgctgtgttgaacggtgtggatcatcacccatctctgatggagatggcacattggagatcatcagagagtgatcactagtcaagagctagcagcaggaacagaagaatacacacacgacattagtggtaccagccatctattttctatataaaagggggaagagaaggagtctcggagacgcgtgcatggatagatgagttcttagctaactgtaagacacgtagctttctccctgattttgacatgcatatgtgtagtttacgtggtttgttcacattttttggtcgtcatggttttttgtttgttgacgatgtcaaactgttctattaaccactagattggctttgagatcggcggtatggtctaaaggtttgctttgagattcgttattaattatatggtttattttctgggagctaagtaaatggaactgatcatggtggatagtgactgcatatacatgtttccttctacatgacacaacatgagatgattagtagccgatcacttcaaactttaccttccaagctttaacgaagaatacttagggagtgcatgcatcgagacaatatttgtgcatgtctacgggaagataatctagtctggattaacatgtgttatatattaacttattttgacccatagcaagttttcttaccctagctagtagctatctattttgacacatgtccttgatcgatcctagatgaatgaagcaccggtcaagatgtactacatacacacgcacatgcacaccaaaacaaaatgaaatgtttctaatcaataggaaaaaaaagttttccattggtcaacctctttagctctagtttgggtttgatttacaccctataatgtaatacccagtggttaattaaatccgttgcaaattatgtccatataactgttcaagcgagcatttcttttggggcgccactccatctatcaattcttttacacatgccatcctcatgattaaattaattaattgtagaattctcgcatgcatgcatgatttcctttcatgcatcgatcatcaaatcgcattggcccacacaccatgtgaaatgccaaatcactcaataggctcacaaccatccttggacatgatttgcatttttttatagtaaagacattttctaaattaaacaatatcaaataaattaaacctgaactaggattgatagactaaaattagactttccttacatctaattaaacaagttaaactattcatatccccacaatcaaaagattaaataccttcttggaacgggttcgtatcctctaccataatggtactaccattataaacactaacatgtggggtaatagaatagtgtgacccatgtaacagtgattttggaattttgcatatggatttttttttgctggattttaatcaattgatttaattaaaaaccctgcaaaattctaagaggtctaaacttaaactactcattcaagcattaactgtaattaaccatgcacatatagtaacagcttctagctgcgtcaattgcgtccctctccttctctcttttcagattccatttcaatatatatatatacactatggcacatgtgggaaataaggctgccaaactctcttgcaagtggcaagcccttattagcagggaagcaacagcagccaatccaaaggccctcgtcgccaaagagactggttccgttcagttcatcgccgtagaaaaggcaacagcgaaagcgtcacccccttcttccccgttttgagtggctgccaatagacctccggttgctgtcaatggcggaaaaccccccctaaaggttgcaatcttcatgcatgcggtgatctgctggagctagcaccaccggcgccagccgcctgtcggtgtcacgcgcagctagcgaatagcgataacacatatataccgacggggttgtggctgtacttgttgatatatctttttctccgcagcaatgtgcggggtgttttaaaagtaacccttggcacgtcgcccgttgtggacggtcgttagaacggtttccccatcgtggcaatggtgttgtcactaggacatctctccaaggattgttcttaattggcgcgtgagcttttacttcgtgtagagaagtttagggtgctggctcgaaacggggtttgctgcacattgtgtgatgtgaaaggtggctttgttagggtgtggctgcgcatcgagggtgttgcctaactagaaaggttttgcttaggtttgcaattttttttaggctgaccaagataggtgtcgtggcttgttttagtggtagggttacttagtttagcacatgagaagattgataaccaactttaccctactcatttacatgcagcatgtacgtgtgtgtatgcatatagctgcatgtgcatatatatctaattttttgaatcaattaattagttattttgttgataccaaagttatcttaacttttaaaggaagctaaaatatatttaacctgacttgctgaatgtcgtgctttgcaacggatgaaagaaaatatactataatattatataaaataaataaatatatgttttccacaaaatatggtgttcctatccttttgctctacgaaatatttatcttaatttgattttacatgtaattatccatttagatttgattgtcttttaatattatgaagttggaatagtaatttgcaaaaattacaaataaagtaggtgagttggcagattaacaaccaccacgactactttttttttaaatactaatatagattatccactaacaatgctttccaggtggtaataattagttcacgccctccctctaaataattaagcgtcccaactgggatttcaatagaaatttagtgagatcaacgatgtatcattggtgtttcattggtgtttctatctctttcaatgcgggttgattaggggacacatttatatatgtgagcgcgttgaggactgaacacaagttctctacttaacttggttatcaaataattagaaaaaagcttgagcgtgttgagaattgaacacaagattatattgaggtcaaaatcataaactcatcaccactacactatcaagttcatttcttctctactgtgtaattaaacttttgttatagtgtgccaataaaaaggaatagggttaaagctggccttctaccaaatattctcatatttgtttcatcgtataattgtttaacattgtgtaacgtactaaaatcaatagataattcggaatgatatatatgctgtctacctcaggttgatccaggaagataatcataattagacgaccacaacgtgagatatcttcaaaacctttggagacgcgtgagtacgcgttagacaaaatgaaaacttaattaccatgtgctcgtaaacgttagcatcacgaggactaagattcaattacgctcatgtactctccctttgaccatttcaacttaaaattgatgttttctctaacttagtacttaattaactagtaatttaatatcattaacatatactccctctatccaactgaataaggcgtgatcagatttaactcggtctccttaaattttttatatactataatgtttatagcaacaatataataatcatatgagagcaaattcaaatgttaatataataatattatttttatcaaataaaatttaatttataataaattattttttgttcaaatgcttaaagagctaaatcttattccgtgggatgaagggagtaatagtttatctaaataaagatcagttgaagtttctcactttatacataatgcatcatgtacgtaattaaaccgagctctgtgatgaaaattgtgcagtagaatttaattcctttaatttcatttggcctctcctttttggagttcgaggtaaatgtacgcaaggcaaaatcatccatggtacaagtagcagaggaacaaaaacggcaggcagtacagagtacactgtcaaattctaccctttttgggaatgaaaccccatcaaatttccatcgtggagaaaagggctctgtgcctctggtgcctgtcccttttgcctatcacaggataaaaaaggcaaggaccacacagcaactactagtgtaaggttggcatacaaagctgcaaattcaattgccccaatttactactactagcattgaagtatctaattaaaaccccacattaatgtgggtaaactctttgcgcacataaacgcaaattattctcgagaggaagaaccaacaaaataaacgttggaaaaacaaacccgcttaataaaaagaaccggttacgtaaaaaattcaaaaaggacgtacgtgcggagattggttatgtggaattagcgattgaagatgtgcgtcgtggttattccaatgcaacctttttggagttaatgttaatatctttacctgtcagttgattgaacttaacaaagattgactaggaaaaatatcaaataacctataatatgaaacggagaagtattttgcaatggatcacattatactagtgtatagtgttggggttggggaggagttgcatggtacacctagcctgagaaccaaatatgatggtgagacactgagtcagtacttctgtactgccttttgctccatccaaaatgttttggctcgagagaagtgtacacaatttacgagagtaacaccagctatcaaagtagtcctaagtattcacttgcatcatgtatgagctaagcttcaccatcgctttcaactaacgaggggtaaagtggttagtttcatcggttaatcaaacaacattggagaagctgtaactctcgtagatatatttgttctattggcaaagcctgatacacactcaaatgagttgtgttgaacctctcttctctctgtaaaaaacaaacaatttctagattttaatttttctctcaaaatagttgttttttctctcttttacctatcctctatttgtaaaatgagaagttttatccctttaatactccttacctactcaaccaccaactacttttctattaatgattttggtcatttttcctcctactaaagttgtcttggaataagagttgcttttattttggaatatacacagggactacatgtgtctaggagaagctgatgacattgtccattactagtacagtagtacttaagcttttcctcttgttcattataaaatactttctaaaattattgaaaacgaaatattattttagcctttcttactagcatactttgtataaattctgaaaaaaaaggcttgaatatatgaaatatatagacaagcttggatttattctatatttcttgatggcttaaaaatgaagaaaaaaagaggggagaaatcttcatccagtctcttatgggtgactgctaccgattcaataagagtttggcctaggaaccattgtttaagtcggtgttaatcatatctttttcattggaatatatcgcgtaaggttcctattgcatgattaaaaatacatcttcccactgccacaattgataatgtaaatattccattatggcttgacgaactgttaattgtgactattaatactatgcatatgttgtatgttgtcgtgtagctctttgaacttctatttaacgccttctatccctttgcgacttttcaatcgcaagactgggatagagggttttccttttgctcccatgtaaccctccttcgtaggtaatgttattcattcctatcttctataccacttattttcataagtatttctcatggaattcaatctccccctctgatctcctttcattttctttgctttcaatactctggaaaatctcttttaatatcccatggaaagtctcatctagaccaatgttgtatatttaaatttgtgtcactagcatgttgtttgtgcgttacatgagattttaattaaagaaaattatcattaatcagttattaccatcttttctgtatatatcatttcttaattgctgcatatatttgttactgacatgtgaatcctttgaccttacaatatactttttcctccccacagaaagtaaagagttgttaggggtggttgacatgtgtgagccctctagccccacctatcttttatgttttatgctctcaaaaaagtagggagttggtggtgccaccaccacttcctccttttcagagagtatagatatgaaaaacatggtctagtatgtatgatattttgccatgttggagatcgatcgatctataagatgatttaagatagttttaagcttcttactcatatttatatttttcttctactaaagtttgacaatttacatttaaccataatatcatagcatagccatctcgatgttttcattgaaacatttttagacacacacatgccgtttccttcccaatcaaaataaaattctaccaaagtattttgttgatacttatgcagggaaaaacaaaacatcaattgttagatcaaacatatgtttcgattcattgatgtaagatatccagccacaaaaatatcaattaattcaccagctttcattctcttgtaaaaaaatattaactctttgatgggagatatgaagttgaacagtaaaaactgcaataaataaatgcaaaccttatgcatataaattctaacatttaatttaacaaatacctaccaattatatatatccctaacattaatacataaacaccatgtatatgtgtttaatgttagagatacaggtggtgatgtgtaattttgtctataactattaatgttagggatacgtctagtttgtattttgtttgatagcatctttaaccgtacattcatgagatgcaggtaaattaaatgtttgagttatatcttgtttgtatttttaagatatgtagatttttagtgttggagatacaattgttatatatttaaattcattcatgactagagatacgattaaccagatatattcatccatagagattagtgggtatatttggttgatcacatctgcagccatcaaagaatttaaagatataacagttatatcaccaacattaaaagcctacatcttcttaagcatatctttaaagatacacaatccagcaaaaaaaaatacaaacaagacgtatctccaacatttaatttacctacatcttttaaacgtatcgttaaagatatcctctgacaaaattacataccagacgtgtatctccaacattaatagttgcacacgaaatccaaaaatatacacatcacccccctcccctacatctccaacattaatagatgaatttccctcacatctcccatgtgtgcatgcatctttttttgttgtttgctggttgtatggttttttggtattaggctaaaactgtggttaaatcagtggtataaaaaggggtagagggagggtggcctccatcagtcaccacaacccccccccccccctctctctctctctctcctctcctccatatttttctttctcatctcatcacacttggagtttgccaatagaatacaaaaacagcaggtgaggagagaggagagaaaaaaaaacagagctttctctctctccctccctctctctctctcttcttccaatctgcggcgcgaggcggaggtggtggtggtggtggtgggcgccgccggcgagatgggcccgtaggcgccggtgtgggcggcatcctgtcctcgccgaccacccgcccccgccggtgcggcctcgccggcaagaagtctttgtttttcttttctttttttttttcatctttgaaggtgcgtcgccgactacctccttgtgcttcaatctcggttcgaatcgaatggaagattttgtttttcgtgagaaatttcggggcttgagatgaacacatgggcgctcgagccaccccggtgcttgtggggagcagacagatttttctttcttttttttttgggttgttgttgttgggtctatttgatgcagggattaggttgtgtagatcttgtttctgaaacgcttgcagtttttttttgcggtttttttttctgtattggttctgatcgttttgtgtgctgtcgttgcagattggatccttaatttaggggcgaaaagaggggagtttgcaagaggaatcatccctattgggttgtttcttgctgctgggtaagatccaatccagcctctaggttaggtttgtttgctgttggtgaggagattgaagggttggctggtcatgttgggggaccagcgcaggaaattcctgctagagtcagcgagctcatcatctgaagaggttgtttcaagaagccggaaccttgcggttgagagctcggcggtggcggtgacggcggcgggggtgaggaagggagaagaggtggaggaggaggagctcttgaaccgtagaagcaagaagaataaggttgccagtgattcggggaattccggtaccggagtttgggactcagaaatgcaggatgctgatcagaatggtgaagccaacacaagcgagctcataggcgcgatcgggcgggagctggccattacatgcctgctccataccccccggtcttattatggtatgatagcatgcctcaaccggtccttctgctcccttatgaggtccgggcagctgtatagattgcggcgggaggctcgcattgttgagcacatgatctactgctcctgcaatgtgcttgagtgggatggctttgatccgtgccgccagcgctggttcaacatcccttccatgcctcccatagagtgcttcacgcttgctgataaggagtcccttgctgtgggaaccaatatccttgttttcgggaagaaggtggaggcccatgttgtgctgaggtatagcctcctaagtaactcttggacaacaggagatatgatgaactcgcccaggtgcttgtttggctcggcaagctttggtgagaaggcaatcgtagctggtggtatcggtgataatggtacattgagctctgctgagctctatgattctgaagcgaagacatggaccactctcccaagcatgaatagggcgcggaagatgtgttctggtttcttcatggatggtaaattttatgttattggcgggaaagctgataaccataatgagatccttaattgtggtgaggagtttgatttggagaagggcacctggcgtttgatcccagatatggcatctggccttaatggcggcagtggtgctccaccacttgttgctgttgtgaataatgaactttatgctgctgattatgcagagaaggaggtgaggagatatgacaaggttaataatgcatggatcactcttggatcattgcctgagaagtatacatcagttaatggctggggtttggcatttcgtggttgtggagataagctcattgtgattggtggaatgagtgcacctggtggtggagtgattgaaatttgttcatggatacccaataatggacagccagattggaaaatcattggcagccgccgttctggaagctttgtgtacaattgtgctgtgatgggctgttgacataccagggctattacattattgactgtacatcttgaccaaaaggaaggataaaagaggcaaattcttctgagcttgtttagtgattgtgctcgatgggtaatttctgccttctctggcattttaggctgagctgaagattgggtagaatttctcatgtagcttcttacttgcttatgtctaatctcttcattttaattccatttggagggcctgcaaatggtttccagaaagtgggacatgcagcgcagcattagattaataatttggtgcaacctcaacattttgatctaccttggataccttcatgaaagttttttagctccagagagtagtgttacattggcaaaccatttgcccatagattgtaagaaataaaggaagaaagaaaaaatgtccttgttgacgattattgccttgttttctttgcctcttctgggttagctgtgactagcgaacattgtgatttttttgtttatttatgaattgagttgttagatatattgagtgataattgcccattgactatctaaattatggtgtctgagttgttgattctgtgagattcacttgtggttagaagaccatcattggtcttcgtgtggcctaacattctagttttggaagacaaaaggctgcatgagattaaattgacattctgaacttgttcaatagacttatcctccgtgtagtatttattgtatggtgcctgttgttaacatacttgagtttggaacacagtgtgttccctcattttgtcactaacatttaaacatgttcagcttagtacttatatatgaaattatgaacagcatttgtttgttccatcttaagactttgttatgatcaatttaaggaaactatgttagttaagggcataatagccaggagtgagttgtatgtttgttgagttaatgcctaacggggattaaaccttaactacttcagcacatttgagctacaagtttaggctaggactaacatgcagcttatcttgagcttattgaataagctcctggataagcttaagctggtgaggaggtgtctggttgacaagcagaaggccttatacacttgcacattggaggaaattcagaaggccttgtacacttgcacattggatgaacttcagaaggccttatacacttgcacattggaggaacttcaaagggctactcatgataagtgctttctctttttttattatagaaaaaatatcatgcttgtcgtatgcatttttctcctcatctgttcaaaagcaaactaaatatgtgttagattgacatttttattgtctaatgagtccccaggcgacagattcttcttacatggagtcctatggtgcagtcttttgaagcacatcggcagtatttacctgaagtatgataacattgaactactcttccatatgggcttgacattacatgtgaatagtgagtactgagcagaaacaacaattgatctactgtaacaactgaccaaatcagtttctgttcattttcttttaataataattgtatcacaatcccttgcgaattgaaaacaataagtataccgattaccctgtgttgctaatggggcttaaaaaataacagcctacaatactttgtctttgcaggacacattatgagattatagataatcttcactaagcttatgtatttatttggcgtagttatttgaaataaaaatcacatttgtccttatctgcatatctttgtttcctcctttttgttcgttcatatataccatgggcattttgtggtagtctgtgagagattcttttgcgaatgacatttgggaataaattcttcatgtctgcctggctaattttcttgttattcttcttcttttcaattgacttgaggccaatcatataggtcattagccacagtgaatatttacaaaatttaacatctgtgtgcatgggcctgcttaaattcaaggttgcccaattttttttctcagtgttcattcttatggaaaacctttgtgatgctgaaaagtacatatctaacactttaggctatctcagagagcttcaagtcggatgtcatatgtggaacatgttatgagttagcaggtagtttgtggaatgcagtattcaatgtaaccaagttagcagtaggaattattccaaatgttatggcgtaatcctgactaataaacaaggtttgcatgaacagaagaagaaaggaatatacttatctattttattgcttcatttcatgctctgtgtcactccaatgttttgtagggaatacagataagattcaaagttaacagttattttagtgggtatcatgcagttgccgctttgcttttctacacagttaacctgctataaattcttggttcggtcctggactcctgtcagaagcaggttttgcatatcttgaagttataatttcctctttagtgctgttatattcttaggtaacattaaacttcatattgatgacactatactcaactgaagtgcatcgcagtttcagttgctaacctgctatatatcaatcgtcatggtatgttactcctatttggagctaagatattacccctttctttgtttaggttttcacgccttctacagcatatgttgagttaaaattcatgaaaaggaatccgatgattgtgtggtgtctctggcatgactaggtcagtagatgattaccacttaacataataacatttattttgtttatgtttatgctccagagatcctgctacatacatcttttaattacccttttttgcatggtatcgatggcattgtttatctcatttctttaattattaatacatgtcaagtaaaaccacttaatcctctcttgtgatattcagtatcatacatccttccatcttccgagtttaaattgtccgtcaagactgttgatagatgtatcattttctgttggctggatcaaaatactgttaacatgtttaatcagatttaagtacctttaaccatttagcaggttaatagtagttagtatttagtaacatacaaacgtgtaggaacttcatggctttcaggctgtcttgaactgtgacgtttaatttatatttttgtggataagccatttctaaatacaaagtgacttgggaattggaagcaaggtgtaaaacattcaatcaataagtactgctagttgactagcaatggtacattatatttgaacttgaagttcatctcgatatttctggagtcattattgatacttacttaatagccctacttcataaaacttgatcacaatatcttgatatgaggttaggaaattaggatcataatataagacattctcatgcactttgtggaaattagggtgtcggtttcatttggtttttgctatgtgtagtgatgaatttattatcccttccccaaataccttttgtgcctttggctatttgtccgttgttgtgagaagtatcttgaagtggtttgtctagtagaatagacatgatatgattacataaaaaataattcaaaatataaatggaattatagtatagttcatcatgttaactcttatactagagaataggtcatttctgccatagtatttatctgcatcattactgcgagaggagttttctttttcatatagaacaatgggaaacacttagttgttcaaagcaactgagaataaagcttggatcatctagggtacaaaaaaatgtctgtccacctatgaatttagtagtgacagctgcattgctttctagactagttccttgtttgcttgagttaatgagttcagttatgtagctcaaactagacccctatgtttgtagaattttactaagcattgaagcatatacttacaaatcactgttgatattttatgataatatttagtacatgttattcacttctgtggctacttgtgcctatcctctagttcctagatattctagtccaatgaattttgcaccattttagttatggacaatggagtaggtattttatgtccctctccagagaatggcataggacctgctttacattttggtaatttgcagacctgctggcaatacatgaatttctactttgccatcatacttcggtggtaattattctgctctaagctattatgagattaaaaatgtcaaaatgcaaacattgaagaatagtcttgtctgcatagtctcataatcacaccctggtcttctataatttgccaaaattattcacctgagctatcagcagttttcatacccatcatcattttgccagcagttcttttttttgttcaaatataagtcaacatgccatgttacatttagttttttttttttaaaaaaaaatgatgttgcctatttgttcacattgctttcttttagcatttgaatctaatgacatgttttccccttttgatgcctaacagaatttgaatttactttttgtatatgtatattgctactgcagtattgttgatatttctaatatgtttggttttcatccctgttcaattatcaaagcaatttttagattgtcaagttggttttacaccgggggcaatattttcattgctttgatcttttgattcatggagaagttagaacttagaaatgccttctttactagggataatatcagtggagaacaaattaaagcacggaacaagcatataaaatgttcttgaagaacttttccttggtgcttcacctggagaaccaagaaaagcagaagcagaaaagacaagcaatcaaacaaacggtgttactcagaagtgcaacaagcctctcaaagtagaatcaaattctttcccattaatggagatatttttaattatattaaaattttaattataaatatttctttgatccagagaatccccattccgttcatatgtgctgcaggattcgatttggtagaatctccaacagaaccactccattaggagcatatgtcttggtggctacatgatgatgaaagctccaatatccaagatcaaatttcaactctgtaaactatctacgcgtggggatcgaacggcggtatgtaaaagcttcccatttacttgattgaaagcaaatttatatacagttctatgatgtaactatgccatgtgtcattttagaaattccctccaaaggaagctgggagcataaagtcattgctatggaatttgtcctgccctatattgttcttgatacgcacctacttggagcataaaggtgctaatgtcactgctttatgggcatgatgtgtctatattttgttggtatgaagtccaattatgtgttttccctatcaatttgcacaggtcacaacccacaagattagatgcaactcactcagctgaggggcatgtgaatcgcttttatgtggacgttgcactagctcttgagaagacattagcattaccgaacatgtcgaccccaactgaacatgcaagtgaatgtgcatcaggctcgtctcaacgctacagtttctcttcacttcacttcacttgtcacttgctggtcgagtcgaaaggctatgccaatggagacctgtaagttgtttttcaggcttactactttcttggtgctgtcatgtcaagaaattgcatactgcaagttaccaaacattaactgttgggaaagtggcgccttttgcgttagcactaatcacaagttggcagaatcgtggcatcttctgctttttgcagttccctcacttgcggtccataacagagtgcacaactgatctggtataccctatgattcttcaggtgtttccttttcttttccttttgagagtccttggtcttcatcgccatgtttttgttcattatgtgcagcaaatttaagcgatgccatcttagcgtcaactattcgactgctaggttattcttacatattcttctatctttccatagggttacattttaagaacttgcacatagatcaagatgtgttaccgtatgaatggcactctatctttcctttgatgaccttagcatgctccaattcctccagcagtccaacttgctccacctattaaaagaattcgttgcggaggaccttccaatctcgagattcctcgtttccatttgtccatccaacattcctgaaacatggttctggtttttaatagttaggatctttgtttttttactcgaagagcactctggccaatgtgacattcttgccatttctcatatatatgtttggcccacatcctaatatatacccacttgtcttgagagaattgcataagtgtggaagatgctagcctatattaatataatataatgcccattcagatattcttttaggagcctatgggtatagtacctattcatttgacaacaattgatataggtgataattttataagaagatgatgacaatggcagcataataatttcatgatcactagtttcagaaagtgaatcctaaaaaactagagacaattctatgtggtgtttaaggaggccacgattttattgcctgcttcatactcccaccttttttcgaatagttgacactagacaacatgactcttatttcaaaactgaccaacaaaaaaattattatattattctattttgtaggttattaaattattaaaaaatatattatcgtattaagattcgttccacaccatacttccatattattggaagttccaagtaattctaaattcgttatagagaaaagagtgaccgtacttaattgaacactagtgtccatacatgctatgccaataagttttatgggtttgaagaccgactgatcaagtttaaattattgaacatggacagcatattttgctaagtccatgaaagttcactcatagcattgctcacttcatgcaagattttgtttccatttctccttgcaagattttgctcggatcacgcggtttccgtaaaagacaaaaccattcctcacttcatttttgttttgtgctagagtaggaaaaagaaaggagatgccgaagtggacatgagttctgtgagaggtaccatctctcacctgtgctgtcctgtccaagaaagaagaagaagaagaaaaaagagaagaaaaaggggagaagaaaaacggacgatcatgaggtagtccatgtcatatagaatcacaacaagtaggatcaccaaactttccctgttggaaaatgatatatgcttgggcagcattgacagtggatgtgaaggcaagttggcaaatggcaagcatagtggcgtcttagccctcctcctctggctgtaattattccctaatttttgtatcttctctttttcttccctggatgcataatcattgttgtatactgattttgaaatgcaaaaaaaggagaaattttctgaacctcattaatgtttgtgagaattttgtacatggctctgattatcacatcaggatgatgggtacatcagttgaaatgcaaaaaaaaaaaaaaaaaacaaaaaaaacaaaaaacaaaacaaaacaaaacaggaggataaattttcgagcagggtgttgaaatgcaaaacgaacaggttgtttctttttttcacgggaaagaacagggtgtttctgaatcatcaggaacagggttttaatggaattcgatggattttgacgacacttcttcaaaatttgtcgataacataacaggagtgaattatctagcgaacgccatttgtaggaaaatgcgctgtatgattggatttagatcttttggtctgaacatgtaaatattacctgacacgctactaaattaatcttaactacataatccatgttgcaacttccaatccataaaaacactaaaaacagcattggtacgagtgagtataaactagttcaagcacactggtacgagtgaggattaccatgaaacgaatccataaaacagcattgaccacaatgccgaatgcaaaaacatataaaacaccaaaattaaacatctccaggcatatctttaattcgagctacctaacatggtgccaaaaagagctaacataaaccaacatctgaaggccaacctgcttgaattctgaaacccagataggcaagctacagaatttgggcccagttactcagcacagaaagttttatgatcattacggaaacaactagttgcaaacttcttctcattcctcatcttcctcctcaccatcaccgccaccgccgcttgccttcttctggttcttcctcttcaccctaccaggggggcctccaccgaatgggcttgtcagtgagaagtcaatgtgtttctcagactcaaccctcaccatgaacgacgggatgttgacaatttgcctgccgaccctgcacagtgattttgaaactttaatgaatgatcttcaggaaggctatcaacttggaaaaaaatattaacaatggcaacatcatgttcaacttatggtcgacaagtcgtcaaacagtaactttagagtgcattaaagaatgttgtggcagtagcctttttcaggacaaaatcatgtgaagttgccaaatgttctcatcatcgctgtacatagttcaacctaacaaactaatctagaattataacactgcagaaggcaagtaacgaactacagcaacagcaagtggtacgaaccaaattgcttgttcaaagttaaacatcacaggtaatatgtacacatgaaaagagtaacacttgtgctcaaggaacattgaatcctgtttagaaaaatgttgtgcaattaagttcaacactctcaaatgcgacattgacaagcacaagaagagtatcaaatacacgaaaaagactaacttgaaagcatctgcacactcaaattataggaagttaacaggagtacaggaccaatactaatatattatgaccttcagctttcagctcatagggcatgtgttgtgcctaaaatgacattttagctctgcctacacaatgctggatcaagagaaatgatgaatatacagtgaacgattactatgagagaatgatacagcttccatgctgctgtagaagaatcatatagaagcatacttgggaatacaaactaaagagagaacatactgagccatggaaattgtaatacctagagcttcatatttacccatttacaagacaggagatctgtagtagttaaatcatcatacctgatgtggcgttgcctgatcaggacacgagcatggtggatggacttggccatgccagccttgaagacaagagtctgaagacgccttgcgaggaagttctcaacagtgagggcaaggacataatcaagcttgttctgcccatcagcaaggagcccataacggttcatgcggcgaagcagtgcctcaccctcgaagatgcggcgtggattcttctcatcaagtgtgagcaggtgccttgcattgttacggatacggctcaaagcatactgaacacgccacagctcacgcttgcacctcagtccatactcacccactagcttcagctctgcatcaagacgctccttctcgtaagggcgacgtggcttcttgaatgtcttaccatctgcaatgaagtaataaatttgttcataacacttgacagagaaagaaaccactgtagatagtatagttgttcataagaaccaaacaataacatagaaagaagccctacagtcccaaattccttatatcctgaccccaaaaatatacaaagcaagaaagcaactgcacacacaacccagaaagacaatgcaacaacacaaataaagaaaactacagtagttgttgagattacgcccaataatagtatggatattcaagacaaatagtagtagggatcttgtgtacagtaaatactataagagcttcagatatacaaccatgtttgacaaggatttataaaacaattcataacattgtgtctgattaacccataaatagcttacatgccagatttagttttgctgtgttatccctggttagccatatcatacatacctaaattatttgttctactgtaaaatggaattcatgacctaaagcgacaatacttgaaagatctcatcaggaactatcatataatatatttaagaaaatatacatatagaatacaattagcatactacaacttacacagaaattttaaaaaaaataacaaatatagttctcgatggaccactctatgtataaacaaacagttagtgcattacaagtatatagtcctctatattaagctccatgattcattttcgtaacaaaattcacaagcttatgcataactccattccaccaaatgagtgatcaaacagaatacttgagaacaaaaaaactctagctaatgaaactcatatttccagtccttaaaacaggtaaattatcaaattttgtaccataacagaaacaaccattttcaagctacatagtaccaaatgccaaatgagtaaacatgtcctcattcctcagtactaatcaacacatcttagcattctagttaaaacccccccaaaatctacatatctcgaaattaaatccgcaccacacaagtttcaacaacagaatgcgcagtcagtcgaaatcagcacgaactaatcggcataggtacggatccaacgcaatggaaacgagaatatgaacaaagctacgggaacagaccgcgtcgaggcaaatcttgatccagatcatctcgccaaccgaaccagccatcccctcattaactaaccgccactcgctaatcaactaacacaccgaagcaagaaaagagataaaaaaaaaagaaaagaacattctctcgctgcgccaaatcgcactagcaccaaccaagacgacgcgccgttcttggacgagagagagggagaggaggaggaggagctacgtacagttgcggtagaagctgacgtggaccatcgtcgccggaccgcctctcccgcgtcgccgccgccgccgattgctggagctatggtttcccgaggggaggaggagtgaagaggagagcgcttttatatgcggcgacgagaggaaaccctagcttgagggctaggttaaatgggccgagatttctcggcccattaacgcacgggtggcaattaggcccacatatcgagatcataaatgggccttcggtgagaaggcccatatttgcaaggaaaaagtacaccaaaaggtccctcaacttatcatccagatacaaaatcgtgcctcaaccgtaaaagcagatacgtccctcaactaacaaaaccgttcactttatattcttggctggttttgaccccggttttatcctacgtagcaacagagtcagcatgagtcccacacgtcatgtgaccacgtcatcatctctctcccttctctcccttcctcctctctctcattttttacaacatacgggcggcgcggtggagcggtggcgacggctggccgggcgcaggtggggcgccgcggcggtgggtgtggaggctaaggcgaggccgggcgccgcggcgacgggcgcagaggtggaggcaggcgccatggcagccgtaagcgagcttcttggcggcgacggacaggccgcgaaggagcgggaggacctccggatagaaaccaaaagccatggaaggcctgcaccgagaacgactcgatcgggctgcagga

SEQ ID NO: 65260 - DNA, 1510 bp, Oryza sativa
ttctgaataatgccatcagtaacaggtttttgatggaattcgatggattttgatgacacttcttcaaaatttgtcgatcacataggagtgaattatctagcgaacgccatttgtaggaaaatgcgctgtatgattggatttggatctttttggtctgaacatgtaaatattacctgacacgctactaaattaatcttaacaactccataatccatgttgcaacttccaatccataaaaacactaaaaacagcatcggtacgagtatcactagttcaagcacactggtacgagtgagaattaccatgaaacgaatccataaaacagcattaaccacaagtctatgccgaatgcaaaaacatctccagatatatctttaattcgagctatctaacataatgccaaaaagtgctaacataaaccaacatattaaggacacaacctgcttgaattctgaaacccagataggcaagctacagaatttgggcccagttactcagcacagaaagttttatgatcgttacggaaacaactagctgcaaacttcttctcattcctcatcttcttcctcaccgtcaccaccaccgccgcttgccttcttctggttcttccgcttcaccctaccaggggggcctccaccgaatgggcttgtcagtgagaagtcaatgtgcttctcagactcacgccctcaccatgaatgatgggatgttgacatttgcctgccgaccctgcccagtgattttgaaactttaatgaatgatcttcagaaaggctatcaacttggaaaaaaatattagcaatagcaacatcacgttcaacttatggtcgacaagtcctctaaaatagtaactttagagtgcattaaagaatgttgtggcagtagcctttttcaggacaatcatgtgaagttgccaaatgttctcatcatcgctgtacatagttcaacctaacaaactaatctagatttataacactgcagcaggcaagtaacgaactacagcaacagcaagtggtgcgtgccaaattgcttgttcaaagttaaacatcacaggtaatatgtacatatgaaaagagtaacactagtaaaggaacattgatgtaaaggaacatcatgtaaagtaacgaactacagcaacagcacgtggtgcgtgccaaattgcttgttcaaagttaaacatcgcaggtaatatgtacacatgaaaagagtaacactctcaaatgcgacattgacaagcccaacaagagtatcaaatgcacgaaaaagactaacttgaaagcatctgcacactcaaatgatgggaagttaacaggagtacaggaccaatactaatatattatgaccttcagctttcagctcatagagcatgtgttgtgcctaaaatgacattttagctctgcctacacaatgctagatcaacagaaatgatgaatatacagtgaacgattactatgagagaatgatacagcttccatgctgctgtagaagaatcatatagaagcatacttgggaat

SEQ ID NO: 65261 - DNA, 5736 bp, Oryza sativa
gaatgtcttaccatctgcaatgaagtaataaatttgttcataacacttgacagagaaagaaaccactgtagatagtatagttgttcataagaaccaaacaataacatagaaagaagccctacagtcccaaattccttatatcctgaccccaaaaatatacaaagcaagaaagcaactgcacacacaacccagaaagacaatgcaacaatacaaataaagaaaactacagtagttgttgagattacgcccaataatagtatgggtattcaacacacaaatctacatatctcgaaattaaatccgcaccacgcaactttcaaccacagaatgcgcggtcagttcaaatcagcacgaactaatcggcatagatacggacccaacgcagtggagacgagaatatgaacaaagctacgggaacagaccgcgtcgaggcaaatcttgatccagatcatctcgccaaccgaaccagccatcgcctcatcacctaaccgccactcgctaatcaaccaagacacataagcaagaaaagagggaaaaataaaaggagaacattctctcgctgcgtcagatcgcactagcaccaaccaagacgacgacgaagaacacaacagctaaggccggccgttcttggacgagagagagagggagaggaggaggaggaggagctacgtacagttgcggtagaagctgacgtgaaccatcgtcgccggaccgcctctcccgcgtcgccgccgccgccgattgctggagcttgggtttctcgaggggaggaggagcgcggcggcgaggagtgaagaggagagagcttttatatggcagcggcgagaggaaaccctagctttagggctaggttaaatgggccgagatttcccggcccattaacgcacgggtgggaattaggcccacacatcgagatcataaatgggccttcggtgcaggggtcatatttacaccgctcgttaaatggcctttttctcgttcttttttccttatttttataaacaacaaaatccgggcattcatcaacaggaggaaacgattccagataatcaaccagagaggattacgatgcaatgctgattgatatggtctcaattctaccaactagacaaggtttacagcttcagggggaaaaaagcatcatcatttcatcaccaactaaacatggcagatttctacattactcatctactggtgtatattgcagaaatatgttacatgatgacatgtcagaacaattgacataggataaacttaggacaaggaggcgagttccattatccttgctttcttgatgaaatggctcctggagactgctacctaatcaaagaggctctctacaccgtgctgattttttttggcccgtaaaataaatgcaatgatcaagttagttgacatgatcaagactgcaacgaaaaatatatttgttgagttcagggcttacatgtctagagacctctagctgcagtaactattcatcctcaaagatcatgaggcagcaaagaggccccatgagttgtgtttcggatatgtgctctgataagcagaggttggatggcagtcacacttcaattccttctccggctcaaatgccacactcttgttgctcttttgtttaagttcatctgaatcctttagtgaaccctgctcttctgagtctttcttgcgcttttcagtatcttcgagtctttcttgcgcttttcagtatcttcgagtctttcagtaccttcttttgttcttttgaatccttcggtgccttcatatcttctttcgagttcgatgacttttgactctatcaaaacttttggtggtttcagttgtttcgaatctttttgatagttttgatagtttcatctgacaaaggaaaggtgcatgtttttatactgtatctaaggaatgcatgaaaagaagtaaataatgcttgcagttgcggggtgaccaaaaagtgaactcataatttccctgcattacaataggcaacatgtattcccccaaaaaatggcaaaatgattcaaagcctatttgttaaatttttgcaattgttttttttcatgtaggcaaacattgtatggtcatagctactacttctgtaattctgtttctatgctaatgatatgcatctagcgtacctggatttcacttggccgtgtagccctttagtaccgagagtgccaatgtggtgcctgtattcagatctaaaaaaggtctattcacagctcacaaagaaaatccctctctctccagtcagatccggttgcgttctagttattcgtcatatcaataagccaaaagaaatgttcacaaagagtgccaactgaggatttgaaattgcaactggatcaaaactagtatctccgcagtacatagaaatgctagcttcattgtctgaatttcagcttgtatacaagcaagctagatagaacactgaagccaagtatcacaccccagaggttgaactctacactttcctttttgctaatcagttcttccctattggcttcatctctgcttgcttcagaccgctgttcacggcactgttgcggtatccatctagtgattgttctctcgtgaacaacaagctgttctaagcaatctggggagctcagttcgcaactgccgctgctgatggtcagaacaagcaatgtcttggctacactgccagaagcccggagagcacatagtagatcagaccacacctccatacgaccacacctattgccaaacgctgcgccttctggaaccacaaccaccgcaaattctgagtgaacgagtgctggatggtgacggtaagacacaaaatctgcaccatactgcaaccctgatctcaccacccagttcttaaatctcagatgcgagtaagccttgtacatctctggaaaggactccgacatggacctgaagtgattccacagttgcttatcactcatctgcttcttgtcgtgtgactcaaccctgatgcagttcagaacatggcagaggtagaagacctcctcagggctaagttggaaccagtgcttctgtgccgcagcaatttcgacggcgtggccaaaggcagcacggtttaggatcacggcttgctctggctcaactccaagaatggcaccgccacctggacctgacaaaactgccacaggctttgagcttatgaatgaggccttgagctcagcaacaatgactgacatgggattagctgctgctagtgctgagaagtccttgccatcgttgcccttcttccatcttggacctggcaaatccatatgctgaacccactcgcagaggatggactaaaattgatgcgtggtcaaatgctgtagtgaatagcaacgacaataaagcaacaagtaaacaaagttgtccaaacaaatacctcaagaaaggaagattcactacatgcatcactaatttatcgaacatgttaatttgtaaagcatagatacataaataatctgccaaacaactatgcattaagttatggcctcacgggttgaaagagaaagggaaatggaccgaaggcccgacaacaacttgcagacttgtccactgcgctaagggttaggaattgaggattgctcttctggcgaaaagaaaaggaaaggacagtaaaggctgaatgacttctaaaatgaaacaaaacaatagactcgtcacgagcttttgaaattcacaaacggaaaaagtttctaaaatctggtcatttccaaataattgagaacaatcacgagatagataccacagcagtgccatgaacaatggtccaaaccttacatgggaagaactgaccagcaaaaagaaaaggcgtactagttattattcaaccactggggtgtgtgtaatactaggcttcagtgttctatgcagctgcttgtattcaagctgaaattcaggcaatgaagctgaacatttcggtgtaacctacctatacaaccaaacgctatagaagaagatggcatgaaccctaaccatgaacagaggaggggacatgatcacccctacctctactagtgcaaacatttcaagctccataggatcaaatgccaaaagagcaacctgccttcattcctcgatacaaaaagaacatatattagcaatctatattatcacccaaaccgtcctaaataagcctctacacatctccgaacttgaaacgcactacaccacacaaagtttcaactagagaatgatgagaaatcagggttcgtatgacctcagactcggttgtgcagaacccgtacgtatttcgacagtaagatgcgtatgccgtatgcatcgacaaacacaccgaagcaactacggggagattgggaaaaggaaaaaaaaaatctaaatctatcgctgcgccaaatcgaagcaccaatcaagacggcgacgacgaagaagctaactaaaccgccgttctccgacgagagggagatgggggagaaggtacctaaaattgcagtagaagctgacgtggaccaccgccgccgccgccgccgccgccgccaccgcggattgatttgctcaaccgaggggaggagcgcggcggcgagaggaaaccctatcgatgggccgaacatagatgggccggaatttaggcccacaaaatgatatcttcatgggccttctggcctagaaactagcgggccggcttacgttgctgcatcgcatctacacaataatttctcatttttattacattttttattataacaaaattagaaatttatcagtgtaagagaaaacgagacccacataatcaagagaggattaggatgcactgagaactgatataatctgaattctaccagcatcaccattttcatcaccaacccacattgcagatttctacattactcatcatctactggtgtaaattagagaaatatgttacatggtgacccaagtcagaacaatcgatagaggacagctagaacaagagagtttaaatggcctcctagctacttctaactaactgaagactcttcaccgggctgctttttttttttggcctgcacaagaaatgcaactgatcaacacatcaagtctagttgacatgatcaatattgaaaaatggatgaggtgagttcagggcttacaggtctagagatctctagttccagtaactgttctcatcctcaaagatcatgaagctgctgctccatgagttgtgctccgggtacacgctgtgatactcggaggtcggatgccagtcgctgttggaggccttgagttccttctcgggctccacctcggcgaacgtcacgcgcttgttgctctttggtttaagttcatctgaatccttctgcgacccctgttctttcgagtccttcaacgccttttttagttctttcgagtccttcagtgccttcttctgttctttcgaatctttcgcagccgccttcttatcttctttcactgccttcttgtcttctttcgagtccttcaatggctttgactctttcgaaacttttggtggcttcagttgctttgaatctttcgatggttttggttctttggattcctttgatgacttcgaatcttttgactcctttgatgactttgaatctttccatgatttgccagactgtttagatgatttgccagcctgaaagacaacaccacagataataatgaatttgtcacttattctcaaaatgacatgggttgtgaaacttttaaaagcaatagcaacatgttcacggtaacaactcaaaattgaggtggaaaaaaagcattgcttaatcagtaactgatgaa

SEQ ID NO: 65262 - DNA, 16201 bp, Oryza sativa
cttaactaattttagaccaatataccttgttagtcagtttcttcagagcttcaggtccattttcttcaataaatttatcaagtgctgtgaggaagtcatcggatttaccgaaaaggccctttttctgagggacataccaaatgttaaccatttggtgcttcacaaacataggtctcacataattttggtacacaaaggctgcaccattgaagtatggcaagacaagccagcaaataaagatcaatttcatagatggccaaaaaggaagcctgtagaaacagaagatggaaagacaatggaacagcaagtcagtgtaccatgatgactaactgtaaatttgtccaagccaatggaaaagactcagagaaggactagagcaagtacgaattaataggtctctcttccttaacattatgttgtaatcaccatccaaataaagtatgcaattaaaaaaataacatgggtgtattattccaaaccctacaaacctttcatcacactgcaatggcagggataaaacaacagaactgtggaacatttgtaattatcctctttttaaaaaaacttttatgaagagggactcttacaagtgaaagtagatcagtagtcagttctatgtagaatggtattggatatagtttctactgctataatttgtttccaagaatgattaatcatttatgtttgaaaccctgatttaaggaacactgtgtctttacctgcccagaaatgaaatgctctgtacttgtgtcctgttaactaaacaaagcacacaagtaatcaggaccgtggaactatattgcgttccttcgaggatgttgttcccatcctgggaacacatggacaatcttgcccctgcgctgttaaaaccttttgaaagaaacgtcccacgctccttgatcccattcctcaacccatggacccaggaactttggtgacatatgcacacgtgtcttgctctaacgattgtcagaatgttgatactacatagtgtgaaaatggcaatgcaggtatgcacatcccactagttcaaagatcagggatttgtcaccaatagttcagactaaaacaataaataactctaaaactactagtacaaagtttttttacattaaaaagaccacaaatatcacaagagtacttaccactgaataattgatgcaaatgtgagctcaaacagtgttattaatgagtacatcacccagtatgtgagccattgttgatcatccacaggggatttggtttctattgccttaactgaagcgtacctgtaatagcatcgagttacatttgtgtttaccattacaaattaactttaaaaaaacatgaatatgttgaaacaggataaaagcaacaaacaacttacaacggataagctagtgcaaccaaaggcctgcatgagagattaaaaaaaaagtgttaagctgaaggtaaagtcaaagcattaacaacatattcatagtagcatccaagctagccaggaaattaaaggtggaacggttctaaattcaggataaaacaggtagtattagatggtctctaacatagtagaaaagcaccccttgacaagtcagcaagtcagtataaaattaaccacatcatttcttatattacttttacaaattacgcagcagctaaagggatgtccatattttctaatccaacatagcatactaaaacatgacatcgattagaggaaggtagtgtgcatttctacagcatgcatcggtccacacttggaattaaagaaatcacagtgcccaaaactggcacttgtttctttatgcaccatgatcgctacgagacatgaatgacaatctaccaaataataaagaaacagcagcagattattcaatcacacccattctcctgcatgtgacctcttacatactgcatagaaaggaatgagaaacagctaatggaaaagataattggacaaagaaaacaaacaaactagtattgaaagtggaaatgccgaaaggtcgaactaccctacaattgctccactaccactagcaaaactacaaatcggaaagcaatactagctttttctaaaagactgtgaagaggtcaggatgcagtagaaagatacaccgcactagcagattgaagtgacaaaaactccacatctgatctacatgttcagattgcagacttggtgatctacagcagagcagcccacagcacgtgcatcacaggcaaattttagatttttgatgtcgcataagcattcgggaaaggtgcgggttgcaatgtcagcatcaacggatatgttcttgtgtcaagattgggataagaaattgacgtttcgaagtccaaaacagtaaacgcacccaacaacaacataaaaatctacaaaagcgaggatttggtgacagataaacgaaaaatcaaacgcctttcctccagcagaataaacaagaagaaatcctcgatgttagactgcaatagaagatcgattctttcaggaagaacaagccttcgcaggttaataaaaaggaaaaaaatgtactcctactaatctactaggaaggaagtgtttatttctatttctttcaaatgaaatcgccagttacatcaagaaaagcaagaacatttccgatcctgaaatatccactgaaaaatttaagcattgtactactcttcgaaaccaacattactcgattccaagccgcaaccagcgggggggaaaaaagaacaccctcagcacctcacggaccacaagaatcaagaacagctaccgcaatgctacattgaaccggacgagcaaacacatcactaagaatccacccattgctgctaaaatcatcgccattccgaaaggaaagaacaaaacggtaaagagatgaaccaaaaaacaaagaaccgaaaattaatttgggggggggggggggagagcgaaggcagggcggtgcgactgactgacccagcaagaacatcgaagttcttggcaagaaccttgagcaaagatccggaccccatctctcccccgctcttcccaatcctcccagcagaagatccactctgattgagcaaagaacctcctcgagcgcttcgaatcgggtgggagttcttggaaggggattcctgggagactgaaacctcgcctgctttgctttgctttgcttcctctttcggtggtgctgctgcttttggtggtggtctcgaggggagcaaaatctggagtggagggggaggaggaaagcgtagcgtggtggtggtggatggtggagcagacgaggcgaggcgaaggcgagacgacgggttggaaatggcgaaacggaacggagcgcacgcgtacagaggaggggatttatgcgggtaagcccctcaggatgtgaggatttggttgctggtccactggtggagtggtggtgggctgtcagcttttcagttgttcactcgctcgctatagcaggtctcgctggatgtgaaagtgtgaagctgccgtttttttgttgcggtgtattgaatgttcaccgctaggaagtttgaagtgctgcatgtcggtgtgtttagttcacgttaaaattgaaaatttgattgaaattaaaatctatgatatttagatacggtaaaaaaccacgtatccatatcggatacgtaataggatacggatacgtatcggatccgtacgtatcagccaatttcgcgattttccgaaaaagaaaaaaagcaggatacgtccctgatacggtctgataactcccagatgcgatcaaagaactacacaatcgattcattgtttcatcctggtaatcatctgcgctgcgtattgcctccgtggttctcggctggggctcgattcgcggctcccagcgtcagcgctgcgaacatcgaacgtagcgctgccgtcgtcgccctgtagcgccgccgtcgccatacgcctggacgccggctgtagcgccacctctgcaaggcgttccaccatctctactggacacaacgcggacaccatcacagggcacaacgccaccgtcgctagacaccagcttccttcgttcctcggtgaggaaagttcgttggcccatttctacctctccatgattggttctgggattaactttttccattttcttttcctttttttctgaacgaagctactacctccatcctaaaatgtttgacgccgttagcttttttaaaaatgtttgtccgttcgtcttattcaaaaaatttaagtaatttaataaattttttattaaattaccacaagtaattttatatattttttatgtattatttttaccacaagtactctatttagatctaataaattttgttattggaagtactaatgcagctagcacctccgatttgtctaatcattactcttttagttgtaaaaacatgcatgttttggtttgctctcagttattggcaagttagcagtctgcctgttcattatttgggcttcatagcttcaccaacttgagatcatttgggctttatttccttgctagaatctatacatttttgtattttctgttttatatatacatatatagatgtattcatgtatccgtgttttatgaaaaatgacgtatccatgtatccccgtatcgtgtatccgtatccccgtatcagggtaacatagattggaacaatgtgacggaaaagttggaagtttgcgtgtgtaggaaaattgtgatgtgatgaaaaagttggaaatttgaagaaaaaattgggaactaaaccaggcctattatagcccgaataatgagaaaattcgataccgagatccctgatgtactccctccgtcttaaaatatagcactcttgtacttgatgggacacatactagttcaacaaatctggacaggggtatatctagattcgttttactacaatattactatattttggaacggagggagtatattttattttgatttttgttaacacgtttttcaaattactaaacaatatgtttattacaaatttcttttatacggaaattgattttttttacgtagtattaactaaatctattcttcaagtttacaatagttaaaactgaattaatcatgtactaatggctttctcgttttacatgtgttaactttaactttaactttatcccatagaccgcctcatagagtcccatttgggagagatcaaattgatggatcgatggacaatctgattttgtgatagttattcgagagtataaacaggtgaaaactattacaaagttgaaaaggttattttagaaaagtagtctacaaaattttcttaggaaaattgtgctgtgaaatgtagcgtttatgagtttgggaaacgtgcaaataaacaaccagtatcaataaatgaacaaagtcttaaattggataaattaaatattatatatatatattattaataaaataaaatgtctgtcaaaaactgatatgtgcaatattttttttgaggaattgtactttaaaattggcatgaataatcatacctaatttatcggcgttagtaaaaaagaatggggccatcttatagtttaaaaaactagaagaattatgttgtttgaatggagatgaaatcttgattatgtacgatgtcacatactttcatgtgtgatttttctacggaattcattcattttaaatatgtagcacctaagaataaaaagtttgtgaaatttcttcttatcatgttttaaaaatataatgtgtttttctttagtagtgaaatggcgcgtgaccatttgtcagatggaataatttcagtttctatgttggctccagtgacgctcgcgtattaataccagagtataacaaaaagctgtctacaacatagtatatcatttaataatattaggatgagctgtcatgggacacattaaaaagctcataactttgtggattttttttcagaaaatgttgatggtaggaactgggccttgttcccagaaaattttaccaaaaaacgtcacatcgaatctttggacacatgcatacaacattaaatataaataaaaatactaattgcacggtatgcatgaaaatcgcgagacaaattttttaagcctaattagtccataattaatcataagtgctacagtaatctacatgtgctaatgattaattaggcttaataaattcgtctcgcggttttcatgcgagttattagattagttttttttttgtccaaaaaccccttccgatatccggtcaaatgtccgatgtgacgttcaaaaattttcttttcgtgaaaccctaagaacacaatatctacagaaagggaaatgaccacaagagaatgtagagtctaaactttttagctgcattcgtgtttgtgaaatgtaagtagttagatgcatatgaaatttcatgatatcctagggatagcatcataaaagtaagacacgtacaacatcaaaggcaagcgatgactgcacggatcgatgcagaacagcagattacacacaactcatcaaagaggatgatgatccgcctgtttattctgatcctgatagatagccttgttaattgtgcaaagttgtacagtactactatagggataaggtttaggcagtacttgccaatccaagccatccatcaagaaatgagcgttcaggattgcctggctcgatctcctcgttccttttagctactattccgtcaaaaaatcgaagtcctagctacgaacatcgattggtctctctttttacgtaggggtactccttagtccttgctccttacctgttgattgtgcaaatgtgcacgggagacacttagtgcgagaatactgaagcattcaattaactttaaaatctatgataaattttatatggaaacaactaagggatccaagctcactcttaaaaaccttgtttctgtaggattagacacaagcaactaaacctaccagagaggctaaatggtagattacgtcagtgaaagtgaaataatcgaatcctgatagatcaaaacacaccgcaatctcaaaaaccaatgaaacacacgttcggcggtctatccaacctaatagggtcggtctgtccgaggcatggccggtctgacaataggtgactcggcggtctgaccgtcaatctaaaaaacaacacaataacgcttctataaaaactcaatttctcttaaaccaaccatttggaacaagttgtaaacttgacagaataaactagacaagctaagaaacaactccaccggagggatttgtaaaataataaacaatttaagagaaaacatcctcaaaagtcagctgtctcagaatttcagcaaatctgaataaaacctaaaacttaagtaaattcgaaactagcaagatccaatcaacaaagctttccagatctgatcattgaagtattagagaggttttggatggattaaattgaacagaatcgcagcaaaacaagcaatcacaagttaatgtcaatacccgctcgactccgcgatgccggcgaacgccttcttcgccttggccacccggaactttggtcccccgaccatcatcggcttcaccgccttgttcaggaagtccgcagcggcttcgacggcgtactccaagttcgccttgttgctcaatctgatggaacaaagataacataattaagaaactaattaatggataaaaaaagattttaacacaaagacgcatgcgttttaggtcagtattaccttggcgagatgaacaagggcactggctcgcggctaaacgtcgggtgagagaggcccgccaggttgcagcccacgctaatatacacgggcttgctctcacttagtgccgtcgcgatggcagtgtcgatctgctcgtgcgcgttgtcgaggttgttaatgagcctacatacgtgcgggaggagatggagttcgatcgcggcggcggtggtactgaggacggggatgtggccggcacaggaccccgcggtggcgccgaccaccacaccaccggtctcctccaacaagacgcctgcgcccgccgccgcgccaaccacccccgccaccccggcccccaccacaccgcgcccgccaccgcacgtaccaccaccgcaaccaccgccgcgacaaccacccccgccaacccggctccaaccatcgcggcgcctcctctcccccagtcaagggtctcgtcgccggcgcaattgtacaccatcttagggatccccgtcgcggcgcatgccgagccgccaccgccggaggtcggacagcccgcctcgcttgcctgctccgccgcccacccgcccatccgctccgatgctccccgggagaagagtgagaggggagagggaagaagataagagtgaggatgaggaagaagagagagaagggagagggttgaagggaggagtgaggctaacacgcggggctcacatgggcctcgccatttttaaattattttttgtgtgactgataggtaggtccacagtttttattatttttccgtgatataattgctacgtaagcgccacgtcaatgccatgtgggacgaagaccgagtcaaattagtcacgtagacgccacgtcagccaaaatcgccatcaatactgtcaagggacctcatctggaccggttttgatagttgagagaactgttgtatctaattttctgatggaagaacgaaaatcgaattcgttaacaagttaagggatctcggatctcagatgaacttattcctattattactgggaaatgggctggccatcgatcagacttggtccaagtcgtagcccaattccaacacccacctggtgaatttttttcttttttaatttttttaatatttacataaatattatatcggtggaaagatttacaaaaatagacaatgccgccctctatttggacggcaagctgacgtggcatacggcgtcgtgacggtgccatgtgctcattttgcgcttagacctttgccgaggctaaatgcaatttttgccctgccaaacaagcaattggctagttctttttgcatctgggccccttgccgcccttgcaaattttgcacggaggccccttgccgcccagacagaagacggcaaggggaccacgtgcaaaattcatagcccccaaaaacgtccgtcctgcgcccatgtgccacgtcagcttgccgcccaaataaagggcggcagggtctacttttgtaaatctttccaccgatataatattttttgtaaaaattaaaaaaaaatttaaaatgaaaaaaaaattccccacctggttgcctctccccaagttcaaacttgacaactgacaaagttctgagacacttcgggctacccaaaaacttttcccaaaaacatcacatcgaatctttgacatatatatagagcattaaatatagataaaaagaaaaattaattgcacagtttgcatgtaaatcatgagacgaatcttttaagcctaactaggccatgattagctataagtgctacagtaacccacatgcgctaatgacggattaattaggctcaaaagattcgtctcgcagtttccaggcgagttataaaattagttttttcattcctatccgaaaaaccctttcgatatcctgtcaaacatccgatgtgacacctaaaaattttcttttcgcgaactaagcaagcccgaaatttcatgatatcctagggatagcatcataaaagtaagacacgtacaacatcaaaggcaagcgatgattgcacggatcgatgcaattgaactaatcatccgatctacgatctgattacaccgttgtgttcgtaagaattgaatctttataacaagatctcacatgattatatttgataaaaaattagaaattacttttataatatatctaaattacttaagatttcactaaattacttcttagacccataaaagtaaatttaataaagcctaaaagtaatttacatatattatagaattaacttagaaaaaaaagtaactttatcacgacattaaaagtaaatccgttatggaggtaaaaacatgagtctatatagaaattaaatttaataagtataaattacatcattgactaaaaatgtgtataaaataaacaactcacaacatgaatgtatagatttcttttaataccgtaacaagttacttcacttttgttttaagttacttctacaatatagggtaaattactttcaggcttaattaaattacttttatgactaagaagtaatttaatgaaatctaaaagttatttagatatattataaaagtaatttctatttttaataaaagtatagtcatgtaagatcttgttataaagatttaattattatgatcacaatgatgtaatcagatcgtaaatcggatgggtaatctaagagaaaattccataagaagaaaaaatacatgcacgcacttttgagtatactagtagcaactaaatatgaaattgaggtagctggttatgaccatatcgtagacacttgtagacacgtccatatgttatggcttctacagcacatatttagggagtgtttagttcatgccaaaattagaagtttgattgaaattggaacgatgtgacggaaaaattagaagtttgtgtatagaaaagtttcgatgtgatggaaaaattggaagtttgaagaaaaagttgaaaactaaaccaggcctaagtttctggcaagacggtcaatctgggaagaggaaaagaactgcagcttacctacaaaacatgcatttctctgaagaatcatatcggcctgaactttctctgaaagcaattgctcttatcatttcatcgctctttgcaaattgctcagtgcaggaggaattaccatgaccagggcatctaaagaaatcaaatcaatcctgcaatggttcagctgctgcatacaactgattcacctgatgaagagatagatatcaggtatgctttgctgcaaaacaaacaatatactactagtatacgctatcatgtgacctgctggtttactgaggcagatatcagctaacagcataatcaccatatgcaacaggtctctgtatcatttcaacctcagcagatgactggagctactaccatgattattacaggatgcattatgtagccattaatattacagaaaaacatacggcgagtgcacgactggcatgcgaagcccaggaaaatcttgcgatgcaaccatatgcatggcattctacagttggtaaagttctcttaaacaggagaaacaactacactacaagaacatagtaacacggttccaaccttctcggaattcagatgctacgctaaatactagttattccaataaagtttggtacaatgccaatgctttctgcaataaataccctcttttgcattctcatccagacgaaggccaaccttattacatggcatcttgaaacactgaatgcaccctgctgcttcatagttctacaacaatcgcctacttctgtaggtaaggacagttcaatttgtcagaatggagatggaatacattgccaatatctgttaatcgacatggatctacaggcaaaatgtgccaaaaaggagatatttagcttttattgtgttgacagtgatgtaaactttaaaaaaattaaagaaaatatgctcagtaataagaatatgacgtaaggagggccaggcttttagaaaggtactgaagatacttcatggtataaatacatttacataacattatgttgcttctggtcatattatttgtgttcaacgctagaaagttcaaaatggatagggtactcatgaacaaatattttgtgattcaactatatgtatgcacaaaactaatgtgtatatgtttttcaaataatttccatttaccaagttttccatgttggccgcttataacagtatataaatctatagtagtacaggaaacacaggctaaatcacagttcgcgagtaaaatttcgtagcgaatgtgaaggagcagccttcaactcacagaagttgtgagttctgacttcacttaaatgaataagaaccagctataacaacttcattttgctggaaggcactaaattacttaactccatttttatttggaaattccaatccatcaaccagttcaaaaggtggaacactatgcaccctccaaagtaccaagtatctagccatgaactccataacatagtaaagaaagtataattgtcacaaataagaacatgcaattttcaagaaaaaatagtactgtcggtgacgaaatgagaaaacatccaatgactcaccttgcaatggcagattatgctttaatgtttttgttgcagggttcgcattttagccaaaggaacctctgcacttgcgagaccaacataagcagtttttggacttccgacatccagaattgattcccagttgaacattaccctggctctgaccataatcatatgtaagctctgtcatcggaggaatatgcttgattgcaaagaatgcgatatgtggatatccctcgtcaccatgatcatacaaaactggttgccaaaaaacatttggtgagcagctgtggttcataaagcgagctatgtttccagttcgttttgcactgataattattggcagttgcttaggtgtctcacttgagtcagaaagactgggttcacccagtaattctggtgcatagttccatcttaaattctgctcagaagacggtgtctcaaagatgtaatcatcttctccaatgatactgtttctgtcaataacttctcctgcatattcacaaataaatgtgcctgcccgaattggatcccaactacgaagtccccaacctcgatctcctgtcttaaacacctcaaagtggatctgagaacctttctgtacaactcggttccggcaattatgtgagcatgtacaggaatcgttacactcatacagcataggcatccggctaacaagtatgcctgaagcactgtatggaagatcaccggcatttcgatgagtgcaagagcagttgttatcaccaggaaggcacacacttgcgcaattgcagccttgcatctttctcattgagctgagagaattcctgtagttcagtttagttgtgtagttgaagtggctaggacctttctcatcatccacttcattcacaaggcaaacaggcttgctttctgcaccatatgatatgtcacgcaatataacatggtctcgagaggaaggattctccctccatttttcagtcttcttccacactgctatgccatcaggttgaccaggttctctgagcagcttgtgtttaaacacattaaagccagtttttcctttctccacccatgcttctcttattttataaaggccatcataaatgtatatcttaccagtaggacaagtcaaatctcttacactacgaacaactctgatttgattacctctatgcaaactcctttcaagtgcaagattacctctttcaagcttttggtcatcctttccagacatgccctgtccagtgtaaaccagcacatctgggtcatcttcggtattctcatacacaccagctgacacgatactgatagccacaggatcctcctcattaccaaacttagcagacatgtaatcaatcccagacatgctctgactattcagtccaaccagacacatctctattctgaagtagaacatatcaccaacctcgacacctggaacctctccaatcctcttgttcttatttgcacgaagttcagcactcatcatgatactcccggcctttaagttatgttgctgctttgctccttgcttcacctcatccaactgcatgagcctccgccgcagtgcatcaaacatcatgagtacattatcaacagattccctaggatcatctgaaaacaaagatggcagattcagaagattgacatcaattttcctaggccgtccacgtttccctgttattatttcaccactgtcatcatctatcgaaacacctgagtgacttaaaggaatcagtgcaccatcaggcacacgctttggccgccctctcttcctcttaccatcttctggtaaggtgacagcagaaggtgtctgcaaaacaggctcattatattttgattgaattggaggagctgaagtatctgcaccatcctgtacacgcctgggtcgtccccttttcctcgtaacagattcatttacagcagaagcggtgtctgaaaaactgtactatctacctgaggagctgaaggagttgacaggacagtacatcttgtacccgcttgggccgtcccctcttcttcttaccagattcatctgtggttgctgaaggaggcgtctggacagcagtgatgttacctcctggagctgaaggaaccaaatgagctgaaggaacagaagaatcttgcacgcgcttgggtctgcccctcttcctcttagcagattccactgtacctgccacagctatttgcaaatcagggatgacccctgtgttgtttgctgtaccgttagcaggagcagctccattcaagtgaacagcatatggctgcctctggttggggtctgcaggggcagccggtgatgcaaacattggtggaatactagcaggcattgcctgttcagtgcccccagcatatggtccaaacggggtaatacagacaatcgaagatgagttttctttagcagtgaaagtgtgcagaccaagtgccgcagggaacatgggagtcaatgtgcgcaagggttttgcatcaacaactgctgcattatccatcggaactgaagttgtctgccgagttccagccatggtaagccactgttaatcttttgcaaaacaaaagtttatgccgttatttcctttgtatcttctctaggtttgtttaccagtcatagtttaggttaagctggataggggtaaaaaggagacctatcagtatacaattgagcaagaaattaaagctatgtttatttaatgcagcattttttaagtcatctgttttactgaccaaggagaataaacagaagatctaaaaggaagcttggtcgttcatcacagatcttgagctaaccaactgcaacacaagagatatgtgtaaacatcgatatgagaagactaagaattactaaagcatgataaaaatcaacatgcaaagactaaatcaatagaacatcccattagaagattatcaactagcggaagagattgaatagatattttacatgaagctaagattagaaacagattcctattttgtcgcaacaagttaaaaatagaaataataataacgacacttgttgataattagatgggtggagaccattttgcacgtaaaacaaagaataatgatgcttgttaataattagatcatttaagataaccaaaagtttcctgagaataacaccttgtgactgctatagattagagtcatttgataaaaaaatcactttctagaagggaaaaggaacaagatagccatgcatttacaggatggcaaagatagcgaatcagcacaaggagggtcactaggcatgcacttcggtagtgtataagcacaatagcgggaagggggttgcaccttcccgtgacaactaatgtaggtgtcttttacccacactctattttgtcgactatgagatgagcgcaacagaacacatttaaatatttgtctcatagcagcatactagatagaatcacagccaatggcccctattggacacatgatgcaataaaagccatgaagagtgaaaccgtccccacgcatcactggagtcgaaccgccataccagtgtgtgctaccgcgctgacatatcatcacagctataactgatggtagtgtttcgctattgggcaccatacccactttattagctaattccgtttgtctctatccattcttgtcatccgatccaaggattccaattatgttattccaactcttaaagggggctaagcaagaaacattgcctgcctccccccataaataaatacatatggcgcgagaacagcccacggaggggcatgtcgtcgccttatcccctaagcacattaatggccaaaaccaatctcctacattaacacacataaatataaaaacctacaaacaaagcaccgaaagagtcgcaacgattgcccttacattagctcaatcgcaaaacccctccccgttccatgcatacgaaaccctcggcaagctacctacccatccatgatccccatccagcgacgggcgtgcggccatggaaggatgtggtgaggctcagttcaatcaatccaaaccaccttcatctattggcccataggtaatcccttctctccttggaacccttttccttttcttttttctagactcgataaccacagccatcattg

SEQ ID NO: 65263 - DNA, 1662 bp, Oryza sativa
acaatctcggcgaagggatccgaattaggagagagacgctctctccccatctcgtgcttctcattagactcgttctttcttttctttccgcttcctttttttctcgagccctattgcgtattgcgttgagcgtgtgatgacttgtgataaatttataacaaaatgttgggatcttggataaatgggtttcacagatgggaacagctttacatgaactgaaaagtcacattcgaaccagttcgcatgtttctcaaatttgtatgcccttgccttccagactcgagcgagtcgcttttagcgcagccgatgaaaaatcattacaatgcgattcatatcataggaaaatatgcatttttagcattgccgtgcttatcaggacacgagccgtatgcagcgatgtgaaaagtgactagcaatcaatccatgattccatagtgcgcactgttccttccagagcaaatgtgaactttggctagcaaactgatgaaactcacaccaagccttctaaaatagcaaacgaattcgcaaacctaaaaccctgaaatagctattgcttagaggtgtaccaaacgaatttgcaaaccttgaaacaaagtgaaccttaaaacgaaatgagagacacaaaaggtcttcagaacgtcagcaaccctggcggattggaatatatacattacaaccttgatatatacatgtaaaataactgtatcgtcaaccttgatatatatgttaaaatgaacactagcaattctgtcattcatttccaatgttttacatagcaacatgccaacattcattagaatcgttctagtcatgaaaacttaatgattaaagcaaagtcaaaatgataacagacaatgacgcccacggttccctcattttccttcatgcgagaaaaatgggtgaaaatgacaatgtcggaactcattgggcactgaaatgtctgaataatgagctgcctttctcctttaagacaaacgagcaggatttgcatatgccagccaaatcagattgccatgcagttaaatgtcagttaaatgcatgcagccaatgcacgttgccatcatcaactcaaagatggaagaaaggcatataaaaccaaaaagaaaagtttcagtgttcagctccagtaaatgtggccacaacgtcatcttaataataacagtcatgttccgtgcacaaccgcatttgtgattggaaaacatgctcaagagaaacagaagatgatacctaagttccctctcaatctcaacgctcccaggatccaatttttgcgtatccaagtgagcatcgcatgcatgcttctactcctagatttagagtaaatcaggacacagaccataatacatggatcacgaaaaggtaataagctgcagaaaatcctaccttgagtagcatgtgagcttttgcccagttaggctgcatcattcggcatctccatcagacagagcaccttcaccatcacccatgagcaatctacaaatgctcttgtttgcgtacagaactgcagttggtccacgagtctatgctcaaacatcacataaataacattatcattcccaagcttacgaataacgcacgaaaactgtatttcaacagttaacaagcaaccttctaagacatcacaggtttcaagataatggtgttaagggtatagatgtgaag

SEQ ID NO: 65264 - DNA, 1761 bp, Oryza sativa
ataacacccttgcaacgcggcaaacattaagggagttatacctgtacccttgttattaacatcagcaccagcctgagatcatgaaaagcattgtggatcatgttttgattagcaaaataaaagcacagcagtagttgaacaaatacagactcgataacacactggcctttatgagtagcttcatgcacttcaacgaacagcagtcaagagcacttatcagggtactacaggctccattgttggcaattacgttaggctaaaagcagaatatgtgaaagaaaaaggaaagaaatacaatactttaacttttttttttctgatcatcgtttgccaattcttaaaaacgagttcagagttcatgaagccaagatggagttgccgcattggaagagattttaatgcacatttagtgatgtcaatataaaatgagaaggtcggcaatgaagttactgaaggtacaaacaatgacatgataatccaaaagcatttcaatcatttagagttgaatagctcatagagcaggataggttttattagtgtcatgaattgaacgcccaagttttcactctttccgccgaaatcatcacccaagccttacttagagcatgccaaatggtaatcttaagacttaggagtattactaaaggtcaagatgtataataatcgccgtctatgtcaataggtattccttttgaaagcaagaactctgttaccttacagcatcctgagcgtgaatgagatgagctataaatcctgggagagagatactatagaaattgggttatgtgaataaacaatgaccattacaataaacaacttggaacagattacatgtgatcaagtataaatagagcaaacttatataactttgagtggtgatatatagaaactaaaggtatctagattgccacataagaaatgattaccttttttttcgaagggcaggaggactcctcttttcattaataaaggaggagagaaatggtttatttgcaggcgtttgctataaatacaaggacataagaaatgattacggtgaagctgtgattgaaacatactccattaatagtattgcagtattatagagccttgtacaacaatacaattggtaatatatataagaatgaactggatattgagggggatctgtgccagcagcatggtggagaactgtgtgcatcctttatcatctgattttgttacatcaccaccatgatcaagaaaatacttcacagtaggaacatcaccagactcagcacaggccataaacggtgttaaacatatgtgataaacagcacattggtatacttcacatcatactaccaaacgtagacatggcaaccctgattttgcaaaagggtgatagagtaagataaataatgaccagaacgcttcagcaatattgacgtcacccactcaccccccaattcctccatcaagaacttgcaaacagtcagatggccctggcatgctgcggcatgcagcaacccaatcccatcctttttacgagctaagactgcatctcgggcctttcctttccccatatcaaggctctttataatatcttctcctaaagaaaaacacagaaacgtcatctcattgaggaatagaatggacggattaactacctataacacgaaaagaaaagtaacaaatatgtgtaatgtgcaatatcctcactgagtcatgtgcacctatacactcactgggtcgtctatgtaaacctgtactttgcaacttgaaaacatttgttcagattac

SEQ ID NO: 65265 - DNA, 2795 bp, Oryza sativa
gcctcaaatcttgcaatctctagataagataagttggtaattcatggacctgggaatgaaacggttaaaagctttcacaaacgatcaaatccatctagagaacctagaaatacggaaaatagaatgtggcaaagttctgaaggcaacgagagtgctagatgctgaagcgcagctaggctaaaacttttccttccatgttcaaatcaacaatacaaccatcgatgcaaacgcaacacaagtacacaagcatcactcaaacctaagggcggaaaagcacacaggagcatgcaaaaggggcatcccctcatttgctatctaaatggttatgaaacaattaagaagatagattaaaatgtgatatatcactccataaacatgtattcaacttttacaagtccaacgagaaaaaaaacaaattaaattacagctagttaaagtaggtctatcacatttatcttattaaattcttttagaaaaattataatcattatagtggcacgtaaataaatatgtttagaatagtttcccatcatgcctacacagatcgatcgggtgggatggacacggcgaagatgaggagaggaagcacccttcgagtcgtccgaggtacccatctaaggccgccccaggagagcgctcgcacctgcgaacaaagcgagaaatcaccattagacacaggccgaggagcaagccccccgactaacgcgcgaccgggacgatcgaactacgagaaaaggtgcggcaggggaaggctgaacgaaactggtgccgctggtgccgtcatcggtcggccggcggacgaacggcgccgccatggctcgccgcgaggaggacgggtggggtggggtggggtggggagcaagaggagacgacgaggagcgttgcgttgggggtgggtgggcccgtggcccgtgggcggtgtttggccttcctttacttcgggactgtttatttcgcgagaagaaaattgctaggtgttacgtaagatgtttttactggatttcgaaagagtttccggatataaataaaataactaattttataacttatctgaaaaccgcgagaagaatctttcgaacctaatcaacccgtcattagcacatgtaagttactgtagcacttatggctaatcatggattaattaggctcaaaagattcgtctcacgatttttcacctggttgtgcaattaggggctgtttggttcacatactaacattgcctaggtttaccatgctttcttagccaaacttgtcaaaggtgaggccatcaaaatccaagccacactctagccaacaaaatgaaaccatgccacactttttagagacatttacatgtgggacctagattacaaaagagaaatcttgccacacttgtggaagccaaccaaacactcacctaacatggtcaaacttgtctaacctcaagtatggcaaagtgtggcaacttatagccatcaaccaaacagccccttagttttttaatctatatttaatgctttatatatgtgtctaaatatttgatgtgatatttttgagaaaaaaatttgggaactacaacaggccttcattagtcgcttcgtacggaaacgcaaccaagggtgtgggtttttccggtgcactagactgggtgcactcgtggggcgggtgtaggtagacccggttcatggagccatttgcccggtcttgagttgagacaaggctcgatatacatacacacacgcaaaatgcacgtatgtggtaacgatggtggctgaagtttggacgattaatctgctttatatttttgcgggcgagcgccgccttcaacctcgccagttgctgccgccgctccgcccgtcgtcacggcgctcgcccgctgccgcactcctcctgcacttgctcgccatcgccaccgccactcctcccaggctcgcccgctgccgcatctgtgatcgcgacgacgcgccaccgccagagcgagacgaggaggacatgctcacagtggggcccatattgggcacactggtctttaataattgtttctctctcctattcctttaaaaataataaaataatcatgctggtgtccagcagctaattgctagtttttttacgatgccttacagcaaatacaggtttatgatgtctcctagttaataacacgttttttggatgtcctgtagcattttttttgctaaaaaacaatgtactaatttgaatggcaaattttgctacacgacactgtttatgggttttagccctaggacactgcctaaactcacttttgggagaaaacactccataaacgtagtaatttgccagtggatccgcttcgattaaaataatacttttcggttgaagaggtgagagaaatcgtgtgaaatgtaaaaaatgcccttggcccacatgtcagatctatctcctatctctcttatcatctctctctctatatatattctctctcagaagcccacggggcggcgtcggtcgcggcggagatggcgaggacggcggccggcgaagtggagcggggcggtggcggcggcggtggacgagcgtgcggctggcagagcggcatcgttggtcgagcagagtggtagcggcggcgagcgagcgcggggcaggcgacagctagcggcgtgcgagagccgcggcggcggcggctggccagagcggcgcacaccccatggcgacggcgatggcgacgcaagctcctaccatgcccgccggatggtgttcaccgagaagcgtcgcggccatggtgacgacgatgcaagctcctacctcgcccgccgccgcgtccgggcgtggctccg

SEQ ID NO: 65266 - DNA, 5021 bp, Oryza sativa
tatagttagatgaaattttactaattaaatacctaaaatactaactcttaagtataggattaatgaaaatataaatggatgaatttctatagattatagattatttttagtactctccataagaaatcaattcacagtattaatttagatgtaattaataattgaacaaatgtatgaattcccgtaaattattgtggattatttttgggtaatctctataaataatcgattcacggtagaaattcggacttaatcgctaggaatttttagacgtacattatatttaattgtttagtcataaactaaattaaaacgtgtaatattataagataattttaggattccgtccgacatttagctcgcgatagaaatttctaacctattaaatgatatgttgctcgggtaggttaaattaaaaactcatgacaacaaaataattcttctcgcaacatagtttaaattgaagtggagtttgccctagttcgcgaatagtaaagttaatataaaagaatcgactttcgcgttcgactttcatttggatttatttggattcttatttgaattctaaccgaaattcaaatcaattttcgcacgtaactatagagaccgagggagccgtggatccaagcgaaggccaagacccgcaagactttgagcaaggcaagtcatcactattccttgaacatgttgatcctaattgtgaaattgttttgtttataaataaaattgcatgcaatgatgaatatcctacttgtgattatgccatgccttgattattgtttacccttaaatctttgtaaccatgtttacgtatgagtccttagtcaactatgacaattgcttagaaatgctattctagaatcaggcatactactcatatttatcaaatgctatatgcttgggcaattacctgtgggaaggtaattgaaatgcggcttgtggtgacatgagcgccacattgccatgatattgatgacatgatttgtgaaaggagaaataaaattaaacaactgttttcgactgaggcggacggaggatctgggtggtatctggaaaaggctagtaccgtccccagtcagttaaggaccgagccatgaagttaagcatgaaacgacccccgtacaaccgtacttctcgaatgggtatagacctagcggattagatagctgagcggaggcagtatccatgcatagtggtttcttgatgtgtgaggcaggggctctacggtggggcagccattggtaggaccgcgaggcgggtgtctacagtggtgtcgccatcggtaggactgccatgtgagaatctaaaacataattataacttaatgcatgtgtgagtattcccttcccgggtgcgccaaaactcctctcactgctagaaaccgtgtacgcctagagtgcatgaggatgaaaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattctttaacttgtgtgggatgggatattgcatgatgatttttatgctgatggagccacttcctgagaggcgggaatgtggacgtcctcagaaaaccataacgaatcaatggcgggaagctatccttgggatcacaatggatggtggacagaaccgtcattgtttaatatgaacactggtattaaaacttggtcagtttatgctaggtcttaggcttgtgaaaagaattacaaaacttgctttgggcaaaagaaccatagccatcctttgaattcccctgtcatgtgcatcattgatgtggtggcttgctgagtacggttggtactcacccttgcaattataaaattaatcagaagcgggagatgaagccttggaagatccttatgcctactatcaggagggggacgaagacgatggcgtccagtaggtcttagtacggtcgttgcctgtggcaatggcatgccgctgcctaaaattccgctgccttatctaaactctgcttttggttgtattccagaccgctcggtctgatgatttaaacaatgcccgcgggcttatgttgtaataattcgtactagactctcgtgtatgagcatttggtattccagctatgaattcgtgtgtaccagactacttgatccagggaaatggtacggtttacacgattgattcctgttataaaaacgggggtccacaccgcccctccacccgcgtccgcctcgccgtcggccgccgaccaccgaccgccctccgcgcgcagcagctggcggcggcggaggtggtggagcagtcggtgaacaccatccggttcctcgccgtggatgccgtggaaatggccaagtccggccacccgggacttcccatagggtgcgcgccgctcacgccagccgcagccgatgccctgcttcgctccgtcggccgccgtcctcgtcatctccgccgcgaccgacaccgccccgtgcgcctctgagagagaatatatatagagagagagagagatgagaagagagataagagatagagctgatatgtgggcacaattgcatttttgacattttacgcgatttttctctcctcttcaaagggcccaagggtatttttgacatttcacgcgatttctctctccacttcaaccagaaagcattattttaatcgcgcggtgtccactggcaaattaccacgttttatgaagtgttttcccccaaaagtgagtttgggtagtatcttaggattaaaacaacacataagcatggtcctgtagcaattttttttggttttttttcgactatacgaaaaacaaaaacaacgaaaaataggaagcctcttactaatataatcttgagtgaatttgaggagaggtgagagagagcaagagcaagcaagagtggcattcagacttgggcaagaagggagcccccgagggacggggcgagggggggtgcactagagaggttggcgtgctccccctgccatgtcaatatcggccgccacggtggtaggggggcggcgacagcgactcagtagccaaaaagaccatatatagaataagtttgttcaaaattctatttatgagataagtttttcaaaaaaatcgtgaaaaatccatgtccgtgggccactacatgtcattgactatctaattgcgagagtgagcgtgagcgtagccggccttgtctctccaactggcaaacggctccctccatgcaccgggtcttggtacacccaggtccccacgacacgagcacgagctctgcgcaccgggtccagtagaccgcaaaacccacaccccatcgtattcgtcgtggacgggggggggggggggcaaaagcaagagggaggccaaaacccccctccacccatttcgctctccttctcctgcaagcttcctcctccccacccacccttcgttcctcgccgcgaggggcgagccatggcgccgccgttcgtctacctcagccccaccgaagacggcaccggtacgtccagatcccgcacctccgctaacctcttggttggctctcttcaattcttctaacggcgatctctctcgctctcgctctcgctttgtacgcgcgcaggtgcgagcactctcatgaaggcggccttctgcgggaacctgggaagcctcaaaggttgcttcctcttctcctctcttctccgccgcgtcgatcccactcgatcgatgtctgtatacatgccccccttttgcatgctcctgtgtgtttcttttcctccgataggtttaatttgtgtgtcgacgcttgtgtactcgttgttgcgcttgcgatggtcgtatgatggattttgcatgagctgcgttgttgttcttgggaatttgccgcattttattttccgtgatgctatggctgcttggattttatcgtgcgtgaaggccgtaaccctctgggcatgtggattagcggatattgcacacttatattatctagaaattgcaagatatgaggcttttattgtagcaagcacttgtgtcggataaatgtggcagcgcgttcgcgttgttatcatcttctattatattacctctccaagtgtggatatatgatgtatagtcaggtactctaaacaaatgttaatttgcaagtcgcaaagtacaggttataggtgcacattgtaggaataagtcttggctggttggtcttggtcttgtggtgcctttttcctgcttttcagctttctaggacagcatctctactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggacatggcttttgtatttagtgaatgaagaaaaccagaaaattgccccatctcgagtgccatcctcttctcaatgagagtaaccattgaaattctaacatctggtatcagagccacaccttcctgtaggctaaacatctcttgttccaccccttcccaagctcggttgagctctcagccagcagcagcagcagcagcaccggttgcccctccttcccctttcccttccccctctccacacagcagccccccggaggtgcgccatgtccgacgctcggtctcggcgttcggtcgcctcgagcactcggcgtcagcaggacgccgagctcgccgcagcagaagagcgcaggcgagcaacggctcagaccgctgcagcagcagcgagggcggccagactggcggcagcggagttggcagcagccagggcggaggcggaggcggaggcggcggaagatgcggcacgtgcggcggaggtagaggttgagaccttgcgcagcagcatcaac

SEQ ID NO: 65267 - DNA, 2494 bp, Oryza sativa
cggcgacatcaccgctgacagggagcttgaggagctggcaagaggaaagggcacgggagcgagcagagcggtgggcagcagcccacctccacggcggcggcggcggcccaagggaccgtgcgcccgccgacgggaacccagacgggcgcgggcgtgccggcggcagcccggagcccgcacgcggccctcgcaggcggcacggctccctctcccctgaccggcgccatggtcaccacggcgtccagacggtggtcagggattttggtcccggcggtgggtggcctaccctcaccaaaaccaactacatcgagtgggccgcggtgatgagggtgaggctccaggtgcggcacatgtgggaggcagtccggtacggtgacgtcgactacgacgaggatcggcgggcactggatgccctcatcgctgcagttccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcagaaaatggtgcagtacggcgacgacacctacgacgaggagagagctgtcgagaagctcttccgctgcgtccctgagaagtacaggcagatcgctcgctcgattgaatctctgctggacctctccacgatgtcgatcgaggaggcgttaggtcgcctcaaggtcgtcgatggtgatgagccacggcctctctcggggcccatcaccatcggcgggaagctccatctcactcgggagcagtgggaggcctctcagggtgacgggaggaagggggagtcatcttccccgacaggcggccataagccgcgcaaggcgcggggaggtgtccagctacggtgggcgcgaagacgtgccgagggtggcgcccgcagaggcgcccagggcgttgccaccggcaaccacaagccggcacgagacgacacctgccgcaactgtggcaagcttggccattgggccaaagactgtcgacagccacgacgcggccaggcccacgtcgcacgggtggaggaggaagagccggctctgctcctagctcacgcaagcatcgagctacctccagcggcaccggccgcagcggctttcctccaccttgatgagccgaaggtactcgtctccctctgtgacggctccagcaacgacaaggctgatgggtggtacctcgacaccggcgccacccatcacatgaccggccgacgggagttcttcaccgagttcgactccagcgtccgaggcaccgtcaagttcggggacgcctccggcgtggagatcaagggtgttggctccgtcaccttcaccgccaagtccggtgagcacaggctgctcaccggagtctactacatccccgcgttgaggaattctatcatcagcgtgggacagctggatgagaacggctcacgcgtgttggtcgaggacggactcatgaggatttgggatcgccgtcgtcgccttcttgccaaggtaaccagaggcactaatcgactctacatcctcagcgcgcaggtcgcacatccagtttgcctcgccgctcgtcgggacgacgaggcgtggcagtggcacgagcgcttcgggcacctccacttcgaggccctgaagcagctcagtgccaaggagatggtgcgaggcatgccgtgccttgaccacgtggagcagctctgcgacgtctgcgtggtgacaaagcagcggcggctcccctttccccagcagacgagcttccgagccaaggagcggctcgggctcgtgcacggggacttgtgtggcccagtgacaccggccacaccaggaggacgacgttatttcctgctgctcgtcgacgacctctcccgctacatgtgggtgatggtcctcggcagcaagggagaggctgcggacgccatcaggcatgcgcaggctgctgcagaggcggagtgcggccgcaagctgcgcgtgctgcgcaccgacaacggcggcgaattcacggcagctgaattcgcgtcgtactgcgctgatgagggcattcagcgccactacaccgcgccgtacagcccacagcagaacggcgtcgtcgagcggcgcaaccagacggttgtggggatggctcgggccctcctcaagcagagggggatgccggccatcttctggggggaggcggtggtgacggccgcctacatcctcaaccgctcgcctaccaaggccctcgatggcaggacaccgtacgaggcttggcatgggcgcaagccggcggtctcccacctgcgggtcttcggctgcctcgcgttcgccaaggagcttggccacatcggcaagctcgacgacaggagcaccccaggggtgttcatcggctacgcggagggctcgaaggcctaccgcatcctcgacccggagagggctgcagg

SEQ ID NO: 65268 - DNA, 4717 bp, Oryza sativa
cattacgcgcaatgttgtgttcgacgaagggcgagggtgggtatgggacaaggcggtggatgatggttcgactccgacgtacgacgacttcaccatcgagtacgtccacttcgagggagctgggggagtaggcagctcttcttcaccgagcgtgtctaccccagtccccgagcctccaccgactccaacaccaacacaccctcgggccacgacttcgactacgacgagctcttcgtcgacaccaccccagccggtgtccccacacgctccagcaccaacagccactcctccgggcacgtctactccgacgccagctcgtgttgagcgcagcccggtggagttcgttactccgctctcccacgacggggagcgcatcgacgcgtaccatgacggcgagcagctacggtaccgtacgatggaggatcttctcggcgaccagccggtgccgggactggtgcctcgcaacctggaggcgcagttgcaccttgcgtgcgacgacggtgagcctcggtcttttgcagaggccgagaaacacgcggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtccgtgcgactccttcttgcgctggctgctcaggaaggctggggcgtccatcacatggacgtcaagtcggcgtttctaaacggcgacttgaaggaggaggtctacgtgcaccagccgccgggatttgtgatccccggcaaggagggcaaggtgctacgcctgcacaaggccctctacggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttagtgatcaccggcaccaaggatgcagaggtcgcggcgttcaaggaggagatgaaggccaccttccagatgagtgatctggggcctctctccttctacctggggatcgaagtgcaccaggacaactccgggatcacgcttcgacagaccgcctacgccaagcgcgtcgttgagctggctgggctcaccgattgcaacccagctctcactccgatggaggagagactgaagctgagccgcgacagcacagcggaggaggtggatgctacacagtaccgacgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccgaggtgtcctggcaaggcacacttcgttgggtacagcgacagcgaccacgccggcgacatcgacaccagcaagagcacgagcgggattctctttttcctcggcgagtgcctcgttagctggcagtcaatcaagcagcaggtggtggccctgtccagctgcgaggccgagtacatggcagcatccgccgcttcgacccaggcgctctggcttgctcgactgcttagtgatctcctcggcagagatactggagcggtggagctcagggtggatagcaagtccgctctggccctggcaaaaaaccccgtttttcacgaacggagcaagcacatccgagtgaggtaccatttcatccgaagctacttggaggaagggagcatcaaggcgagctacatcaacaccaaggaccagcttgcggatttgctcaccaaaccccttgggaggatcaagttccttgagctttgctcccggatcgggatggctcaactctcccacaagacggcgcacaagacttagggggagaatgtaggaataagtcttggctggttggtcttggtcttgtggtgcctttttcctgcttttcagctttctaggacagcatctctactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggacatggcttttgtatttagtgaatgaagaaaaccagaaaattgccccatctcgagtgccatcctcttctcaatgagagtaaccattgaaattctaacacacatgactcaacgaggttgtttccaattgcacacattagccattccccttttcatgttctaagcttctataggctataactacttaatctgtccattctcttccttagtgtaatgacgttttcggtggtttttctttgggagaaggtgctatgcctataaagagacttgagattgagaaagtaaaggcccaggatgcagtcttagcttttaaaaatgatggaatcgggttgctgcacgctgcggcttgccagggccaactgaatgtttgcaagttcttggtggaggaattggggggtgacgtgaatattgctggagcacaaggtcattatctaacttttatcatcctttcgtgagtttgctggcttccatgtctacgtttggtagtatgatgtgtgagtatactaatgtgctattcatcacaggtttaacaccgtttatggcagctgctgagtctgatgatgttcctactgtaaaatattttcttgatcatggtggtgatgtaacaaaagcagatgttagaggatgcacagttctccaccatgctgctggcacaggtctcccttgatatgaacactatccatttccttgttatattatcaattatattggtggacaagattctacgatactgcattactgttaatagattacatttaattcaaccatgtcgtcacagttatcttttattgtgtcgctaatctagatactattatagccccatcatttggcctaaacagccaaagaataagccaaaatttgaatttttgaacttgattttgaagttgattttgaaatgcttttaacgtaatttttgttaatgttggcttttaagtcgctacgaacaaatatacaaaagttttacttataaattaattttaattttctaataagccaaataagccattttggccaaatgggcaaccgatgggagccttagtttatatatcaccactcaaagttgtattggtttgctctgtatatacttggtcacatctcacatgtaatctattgtgatttgtccattgcactggtaaatgtttattcaaataactcaatttatatagtatttgtttccccatgatttatggcccatctcattcattgcaggatgctgtaaggtaacagagttcttgctttcaaaaggaatacctgttgacatagactgtggccttggaacaccactcttgcatgctgctaacgatgacaaggataagacactgaagattttgttggatcacaaggcagatgtatgtagttgctactatttcttatttcctcttcctttttttcactgctagtttggatagctagatatttgttttgctttccacttagattattagctgatgtacacttatgcgtgtttgcatgggactgttttgtttgcctggactgaaccattccaagatattgcagtgcataatccatacttttggttttttccacttttaacattttatggaggatcttagatcatatgatggtgtgatttaaaagttatattccagatcttaaaatgatttttctttattatgttatgaaatgcattattgtgattattatatatcttaccctcgaggattatcctaactcctaaaattgtcatttggcctgctctaagtaaggttgactcatgatttttggagaaagagtatggaattttaagtgttcaattcatcacaccaataataaaaactattgtcctgctctatgagcttctcaactcttaataaatgaaatgcttttggatcattatgtcaaatttgtaacttcatctgcatcatttccgcccttctagtttgatattgacatcaccaaatgtccaccataatctcttccaatgcagcaacatcagtttggcttcatgaaatttgagtagctgtggttgtacctgtatctgaactctgaatataattattggtttcatgtgtaatatgaattttcctattgtaataagaaatccgtaaaatatgcacataatgcaatttgaattctttcaacagcgcaaattgctaacttgaatttgtaaaaagtggcaaatgctaatcaggaaaaaaagtgcagttcaagcattatatttatttcctttttcatccacatattctgctttcagcttttactaaggctaaactctcattttctgctttcagcctaacgtaattgtcaacaatggagcatgtagtctcctgatgagttcccttgtgtgccgttcattgaagtgcatgaagctactcataaaggtcaatgcttaattgagtctatatttgttcaactaccgctactgtttta

SEQ ID NO: 65269 - DNA, 702 bp, Oryza sativa
atagcagtatctctactgcattggagacgagcgaacggagaaggctgcgccgtcgttgagaggcagcaagctataataggcgccatctttgtcgatgcagcacgcatgccacttcatcttgtatgaaccctgaggaaattcagacacatccagcaggcagctagagaatcccaccccactgtcactcgcttcgaaacgcgcaaatgctgtcaccatatccttctgctcaacatggaccttcttcctccttttcttctccctcttctttcccaaatcatcctgtacgaactgcataagcttggtattaagaccaaccattccagcagttttcttgcgtatctcaaactgtttgcttcttgttcctgttacatctaagcaggaggatgctgagcttgcagctaaaacgcagtatagcttcgagatatcaatgtcactcctctctaacacacatttccactgcaagcaaagggtcagggaaagctggaaactacttggtactgatatcccgtctctgttttctggatttgaatcatataaatgaagttcagcaccaaagcaaggcctgcatgatatatagtaaacaagttaaccattattacagatctccgtgaccgatgcattactgaaacacaaatttcagagaggaatggtgagatatacataaaataaaactctgtgatcatctacctggctgcaggaatt

SEQ ID NO: 65270 - DNA, 1126 bp, Oryza sativa
tgatcaccctctgatataacaagtccagagaagtcctcatttgcccaatcagtggccattacatcaccttcctcatcggatgatgcgtcgtcgtccgcttcctcattatccgaatcttccctctccatttcatcaacaattatactgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgttgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgtttttttggatttttagtgaatataatgaaatttcacagaggagggactgggctttataggggggaggcaaaaatcgccctcccccagggcggcaagggggccgcctgcaaaattccatgcc

SEQ ID NO: 65271 - DNA, 5200 bp, Oryza sativa
aattcctgcagccctccgtcaattttcaaaatggaaaattatttttgtaaaacttttaataaaaaaaattataaataaaaagaattgcatataggactactactcagcacaatgaggcccaggcaggctgacgaattctcgcgggcctcacacgacgtactactactctgcagcattctcatgaaaaaccttgtaaaattatcgtcgaaaccggttcggattcggtctcatttggaatgaaatgctcttatgaaaacttcacaaaaatttcattggaattggttcgattcccgcatatttggtcccatcatctagctatattgctgatgaaaactccttgttttcgaatcaccatctctctaaactagtgtaataatctgtactcatatagtgtagtactagtagtatatagaaggctaagctagaagtggtgatgcttttctaatattttcaagccgaatcttcccaacggtagtgacgactagatcacttgacaaaatcccaagtaggaactaaccagtgccctaatttataaagtaatactatgatcaatgcccaactaacccattgttacacaattaactaagcagtgttaatggactataagaaatacaatcttcctaccatagtttaatctcaactacactatgtgccagaagtcatgtgttcatcttcatcaggtcaggagtagaatctgcttaatttagctacaaaagtagcatcaagatcaggggatcacatagccacttaaaaaattcaaatgatggggactctctccagttgataattaattgaagctacttcttcagacttaaactagtggggggcatgcacttgacccaaactaaagcatccaaactttttgaaaaaacactagaaatatactgcactgtagagtattttactttatatagttctgtagtgtttaggacacagataagatgcatgactgctaatgacaaacggctatgcaatacttactcataaagccgcctcgattcacgtgctaatcactaaattagtggagcaggaggagtagcagaaggattcattagagtgagagctgggttagtttaattaatcaacactacacttagtttgacatcattggctggaatcaaatcgatcgaatggccgcaacgacacatgaaaccaaactgtcagcagcagcagcagcagctagcattgctgggctcgagatgcagaagactgaagacccagtgataatccatagctgaagacacacattttgtccatgttttgccgtttgaacaagcaacttaaactgtaattagtgctggccgtattcatgaacagcaatcaggtgtcaggttaggcagtagggtttacgtctccgatcacccaaaaacatggccaagaaaacaagggacaacctacacgacaagatcaaccaacaaacgaacaggccaaaaatccataattattcagcgatggtaattaagaacagtagaacgtgaccaagtccggacatgattagtgacaagcaggggcgtaatcaggttgatcacgttaatttaattgtggaactacgcgagttttacgccaatttatcgcagttttttgaactatctgcgtgatgatggatcgatcaagtggtcgtaagggaaggttcctacgcgcgtgattctcgttgtggcacctgtgacatgttgacatcaccatactgatctcaagaaaagcatctctctggatcaacggtcctgatcttcttgtgcaattaggcaaaattcgttataccgtactatatccgttctaatttttagctataaacatggatatgtatttatttaaattcgtagataaacattgttatattttagaagggatggagtactatttaaaatcaaaacttaaaagttgttcatctttaagtagaaaaaacgtattcatatgcttcatccgtccttaaatataagtgattttggtggtatgtgacacatcctagtatgtccagattcgttataatagaatgtgtcacatcccacactaaaatcttttatatttagggacagatagagtatcaaacatgaatccacaattttcaaatgatgtttagccacaaacaatattcaactcaatatgttaattttccatcttttgaaatggatactgtagagtataccgaagctgcacatgtaaggattgctcatgtgactacggtgtgtttggggtgttgaccatgacgacttttatattacagtaactaccaatttattacaagtaaaacaaatatatagatgtacggcgctgcagcaattagtaaaaacaaatacacgtatattctcagtactcgagtggtagtatactatactgatttttgtttttcaaatttgaaggacttgctctctttgcaggacactgttggttgggatgagaatacttcaggggatacaggaccgttggatctgagtgcagagggagacaacggaaatgagccgttgtttaatgataccgatgggaatagaggacgtgatggaatatgcccgtctcatgacaaatggtaccttcaattcatcctcactcacactgtcccagtacacttcctgtccatcactctatgagcaacttgtgaatctcatcagtaccattgtttttttttcttttcaatttgagtagtacaatcaccacaacaatctcatttgatagtttaatacttctacctctgtctcaaaacaagtttattttttatcccccgtttttatcaaattcccaatataactattcctcattttatcttctcctaattctcatacttgtacaaactccaaatacaatgactactttataaaagaacttattttgggacaaagggaaggagctaaaaatgaattcaatacgaggcggaggaagtagtatgggtcactataaatgcttgatgaccgtggaagttttttttttattcggccagaattaggctcctttggaacaaaacggtttttaaaagaaattcaattccatggaaaaaatttcctaagtgatcctttggatcaaatgaatagacatcaaaaaatcatatgcgatttctttgggtctgctcaaaacataggaattttgattttttttttaacttaaggtccaacctattgggaaaaaaagaatcatatgtgcctatctctttcctgcttacattcagacggtcatttttagagttttttttaattcataggatttgaagtgctagggcattctaagtctctaattatgtaaccttttttaactaatttctatgagtgtcgttaatcatgtgttccaaaagagtccttactttagagtttagctctttctctcagactcggaggagaattattgtgtattgttggcctccatatatagtagaacagtcaggagtcttgagagttgagaagcagtggtttaccatatagcagatgtcagtgatttgagtccacttatcttcaatatatgaacttattagatcttgtgcacaatgcaatagtgttatacacaaacaaaattagggtcaaaagcaccctttctagctttactacaactcgtagatttcagtatagactcactgattatagacaactactgtagtttagaatatgatatgaaaattattccttcatatgtgatccattttcacccccctaattcacacccgaaagtgcaaaggtaaagagaaaaaaaaagagtcaagccagacttgcatcagggccagttgacttgggatgtgttcggcaggatacgttggaaactaatcctttcgaaaaaaaagaaacagatcattagcgaatgatttattaagtattaacttaaaaacttaaagaatagactatatgatttttgtaaacaactttttaatagatttttttttgcaaaaaaatacattatttagtagttcgggaaatatacgtgtgaaaaatgagaggtagaagttggaaaagagaagagaagaatatacttaacctagaaagtttccacacgagcatactctaaaattgccagtttcagactattttgagtcatcagtcgggttgggcatgcctgtgaaggtcttatggcagctgtagtatcgattcggcgagtttgttccaccgaagttaaggccccgtttagttccctaatttttttttcaaaaacatcacatcgaatatttgaacacatgcataaacattaaatatagataaatgaaaaaactaattgcacagttagggagaaattcatgagacgaatcttttgagtctaattagtccatgattagccataagtgctacagtaacccacaagtgctaataacggattaattaggctcaaaaaattcgtttcgcggttttcaggcgagttatgaaattagttttttattcgtgtccaaaagccccttttgatatccggtcaaacatccgatgtcacatccaaaaattttcttttcgtgaactaaacaggccctaaataaatttggaaattgttgtacgtacaactttttcttacgatcttagtacgataacggcgcgagcacatgacgagcacacggcacatgcgcacgcggcagtcaagagcactcatgggctaggacagaaacgtttcatcgtataaacatcgtacaaaaaaatcgtacgtatagcagcggtgaatcaattttttgttagatccccgaaacgtcagaatcgattttacgagacccacccaaaaaatatcccaatcacatctttcccctcatcctgcatatctaaaagaatttattcgatgtgttcaacttctctttgattgaaactattcggttctcacagtgtataaggtttgtttttttttcattgtacgtaatggattctaggttcacctataacaagggtttcacttatcgcacgataatcacggtgattgcgcttatcacggggaaatcggcgatatagtttaggtgaattttgaccaaattcaaaattccggaaaaaaatcaaaaaaattgaaaaaaaaatcattgatgtagttcttgatttgtaattgacaatagtgaagaatatttttgaaatagtgtaaggtaaattcaaatttgagggcaaaagcgaaaatagtttacaaattggaaaagggaagagaatattaggccttaagtatccaacatattcttccaattattctcaatttatagttttctacacatattcaaccgtattttttattttgttttccctatttattttacattaaatgatttcagcta

SEQ ID NO: 65272 - DNA, 4028 bp, Oryza sativa
tcaacaaaactttcaactttggaagaaactaaacacagcctttgtttttttaccagggtgtaatagaagagtagagtacgtgcaccgtaggagtactctatttagagtacgtgggcacgtcgggcatccgtacgcagggagtagattgagcggaacagagacaaggagtgcaggagggaggagacgagacacgcgacacagggcggcaacaaagatccagggcgtggggagccgtgcatgcgtgcgaagtgcatgcgcaggtgtcagtcgggagtccagggcagggcaggccggccggtggtcaaatcgcacgtcatcatgtagcagtacactcctctgagctctgctaccactagccctgtccggactccggagtagggtagctcgtcgccttcgcgtctcgtctcgtggactctgctattcctggccgtcgcatgcatgaacccaccggctggcctcgcgtcgtcggagacgatatgaatcatatcgcaacctctgctactcctactcctactccacccgaagcgacgaccaccaatacggcgctctgaatccactcgtcggcgcgtcgcaccacgactcctgcatgctcgcctgcctgcctgcctgcctgcagcgctagcctgtgtgtgtttatatccttcgttttgtaccggtccggctacccatgcacgctaggccaagtgtgcgtgcatgtgatcctctttgccaaaatgcatccagtgagatgatggtcgcacatgtcgacccgggcgaggcggtgtcacctcgatggatgtccagccctcccagtgtcaccggaaccgagggttgagggatgccacttccatcactactgtaatcaattacgattaagagcagatacagtgacagactattagctaactataaacatattttaataagataaaagatgagagagaagagaaacggtatacagatttatagccagctgcagcagcacggattccaagacacattatgtgtatgatatgtgtgaccatatattaatagtatagtaagcaactatattgtatgaattaactattacaatggctatagataaattagaggtagtagtggactatactattaaacttgctctaataagcttgagctaattcctaccaatcctgacaccataagcttgcatttgctagtaatattcatatccatatttcatactccactgttactactatgcagtactttctccgtcctaaaatgtaagtacttttaaggttggcacggctattaaaaaagtaggtgataatgattgaaaaagatgtgtgattggttgaaaagagaaagtaggtgaaaaagaatggttgtgattggttgagaggagaaggtgggtagaaaaatagctttattttggaataaagtactgtgctagaaatagctacattttaggacggaggtagtattccaattcatcactgcgtgtgtgtttgtgtgttcatcatccacacggacactgcgacacgcagcaaagctgcaaagcagagccaatgagccatggcaatgccactgtgacgcagccattggagaaccggatcgaactagtattgacctaccagcagtatactccctccatactcataaaaaaatcgtttttgacagcgacacggtctccaaaacacaattttgacatcttgtttctataaaaaaatttattgaaaagtgatatgtatacttttattaaagtatttttcaagataaatctattcatataatttttacattttcaaacctaacaatttaaatcaataacttaaaagttattcatgatttatatttctaaggtttaaattaaacattattctagacgactcctctactaacactgagggagtactgtactactatgacgagtgtactgtgtaccccagtcaagtccttccaggagagatcgagtgcctttttcagctatcaaatcagaacctaatcattgccgaaaagaaagataggcgttgaaaagctagagccagagaaaaaaaagaaagacaaaagtatgacctttcatatcaccactcagctccgattcattcaccacctgctacatgctactcctactactcctaccagtatactccagtagtgtgtgctcacatgcaatgggcttgtgtgcagcacatctggctagttttacagtttttcaaatcctttaaaatccctaagaaataagcttaagagtactaagaaataagcttagtagtatatgtagattttaaaagaaagttaacagaagctttagaatctttaaattttgttttttttaatctctctctcattcgattcgtatgatctactcctatataaacaaccgtatttgtagtatttgatatttggattggtgccaattacaagccaaatcccatattgtagtgaggaaatttctagaaactgtgccaaatttaacatggatataaccaactaattggcttcaagccaaactatcgcatttactatttaaactaccaaaagattggtatgggcacgttttgacatcaatccaaacaatttttatatttctacctttttatcaatcctgagtttcagaaaaactcttactgataattagattgaaccctttctgataattagcgatctaattagttacttcatccatttccaaacgcaagcgattgatttgcaggttgttttgtactagtactatcgtaatgtatatttgtgtacagatttgaatcctaagaaagagtaattgaaaacagagggagcagtattattaaccattacctagttcttcatggctcatgctggattctgctgtgtccataaaccggatggtccatgactgaagtaacttaactacgagtatccaatctggtttacatggagatcttccatgcattggacctactgcagtaaaagggacaatccctgcgtatactgctggagacatcgttacaattcattcaattctatacccaggatatggggggtgtggtgattgccgactttttttcactgcgaggtggactagaaaataggaagaacagccaattgaatggttcgatccaatagccagttgaatgtttcgatcggccggcgagtgtgctgtaacagtgaaaaatcggaatctcgtcgagtgatccatccgttgggtttgtacggtgagcacagttccgttaagcagttaccgagtccccattcgccatgtgctgtaaagtggttgaagtttgaggctcccaacttcccatcagttgccttcactccttcagcatagtataagccataaccgtttattattgataaaaaataatttaggaataaaactttgcatatgtggtgttaacggcttaagaatcaaaagttcttaaaaaaaacaatggcacgtctaataaggattaacatgataaactgtgtaccaaccaaacaacccctcgtctctataaccgaaagaaaaaaaaagaaaaattaattagagtagcaggtttgacagagtcatgcccaaccaaacggtttcagccacatctacaaaaagagagtggagtgaattagactgttttgataaaatgaatcaaagaggtgtagttgctattaggttactcacaactgtactctagaaccaactcttcgaactaaaatttacttcatccgtttcataatgtaagtcattctagcatttcccacattcatattaatgctaatgaatctagacatatatgggtctgttcggttcagctggactgtggctgcacagctacagcgctgcagctctcctagcataatcttgcttgttgagtaatgtagctgcagcgccgctgctgtcacagccagctcttctgaacgcaccctatatctatctagattcattaacatcaatatgaatatggaaaatattagaatgacttacatcgtaaaaaggtggaagtaagagctacagctctagctacatgtacatcaccagtacccctgagctggaactgggaggaacaaactacggcaagtggcagcagcggcaagtacccaacccagttcaaaacacacggggctgcaggaat

SEQ ID NO: 65273 - DNA, 8022 bp, Oryza sativa
caacctcgagtcggtccaaggccatggtggattggtggtggtcggctatggtggtctcgtcccatgagtgactagctcgcttgctgtgacgagacgtatagggcttgtttgaagaagtttctagctgctgtaacttttctaagaatcagaagcactcttaaatggtacggcttttggtttgaattctaaaaaattatagcattagaatccagaaaataaattagaagctagaaaatgaacttctcttacaattataagctcccctaaacagttttttggttcagattttaaaaaattgtagatgtaaaatttaaaaaataaactaaaagtcagaaactggaaacccaacttttctagattcttaaaagcttactagcaaccatctgcctctcagtaaactccccaaatagggtatagcatactgctggcctctaccattcaaatcctggctggtcaatgccgtttaatccgttacctttccggacttgttttttaaaaaaaaacaacgggatttgatttgctggccttgaattgataggggaatgtacatccaagtgcactgttaaatcagaggggaaagaagtgggattttttttttttgtaatctcccctccagctagctcaacgtacactttgcctgtcacttgtcagtaacaagctcggagacgacggcaatggcggagcacacgatcgccattgccatcgatcaaacatgatcgatcgctactatgtcgcatagaaacagagactaagaagaagaagaagaactagttcttgtagtcctcttccttcttgcaatggcgaacgctgttcagatcaccacctcctctgcaagaagaggtcgcggtccctctcggcggccggctccgacgagcggtcgaagcggctgagcacggcggtcttgaagttgaacgcctcctggacacggttgcacgagcgctgcatgcccacgccgctcaggctcgccctcgcctccagggtcacctcgctcagcggcaccctcttccgcgcgccgccgccggtgccgccggcgacgcccggctccggccgctgcttcggcgcgctctgggaccgcaccttcgcctccgacgattgcgtgctcgacatgtagccgcggcagttgggcgacgcgccgtagccgccgccgccgcagacgctcttcgtcggcgtcaccggcatgtgcgcaagccgcggcgtgctctgcgccgtcgccggcctgggcttctcgagcgggcaccagtcgtactccgggaagtggcgtgcgctcggcgccgatatccgcggcggcgcgccggggagctggtggaacgggaggagcggcgacgacaccgagttggcgtaccactcctcggcggcgccggcgtcgaccacgggagggctcgtcctgaccgacgacgacctcgacttgggccgcccggtgtccatctccacgatcttggggctccggtcgtacccgtacgacgacgactcgatgctcgccgacaggcggcggctgtacgccgccacgccatgctcgctcctcgtgtcgtccatataccgctcttgctgcaaacacaagaaacccccgaggtaagaattgtgtcacagcaaccaacatgcctcggacgaacacctttaaaaaaaaagctcgcccgcttcgcacgcaagcgatcgtggtcgtactcgtaccagggaatagcgcggccggacgggagggtggtggtggaggtgcagcggcggcagcgcggcgccgcgcgacgagcgcgcggcgcggacggcggcctgcgcgcggacgagcgcctgcatgctctgcagcgtcgccgccgcctgccgcctcaccaggtagccgcgcaccagcgcctgcagcttcaccagcgccttgagcgctcgcagcgccttcttcgcctgaaccaagaacaaaaataaaaatctaatcatgtcttaatctatgagctttttttggaaaaggaaatctactggaacagtggatgaaatcgaaatgagcacgtcgccaaagaagacgaacagatcaagaacagaagcagacactgttgttcttggaagaagtgaggaagttgttggggctcactcaccaagaatcctcggaaggctgtctggatcttgaccgcggcggcgcggccacggggatccaagacgccgccgcagacgaacaccgacgaggtgggtggcccctggctggtgaggcggacgacctcgacggccgcctgtgccgccgccacggccgcgtccgccgcagccgcggtcgccgcggcgaccgcgatggcgtgcttgctctgctccctctcggtgtcgctgtacatcgacttgagccacgccgcctcggccgccttcgcgatcgccgcattccctcccaccgccgccgccgcctccccctccgtcgagtccctcgacgacttggcgaagctccaccgcttcctgtccggcgggggcggcgccgcggccgtcctcccatgttctctcccctgctccttcttcccgccgccgccgccccacaggctgcggaaccacctcgccgccttgcccatggccggaattcgcgactccggccggcgagagagacacgccgcgctccaagaccaggtcgaacacttgagcaagaaggcgaaacgggtcaagtttgaataagagagggaaacgcccgggagggaggagcggggttcaaataaaaagaaggggagggggggtccaatacaagacaaaaaattttaaaaaataaaggggaaaaaaaactatccctaggaaagaatcaaatcaaaccaaatgcgaccaaaccaaatcgaaatacgaaatcataaatgatggcaataaacaaatggcggtgcagctagcatccaagtgtgtgagagcatgagagaacaaccaaagttgtagtagctcaccattcaaaaaaagaggctgtttcaaaaagataggagtacggtagggggggagtatatccactcccacgtcccgtggctgcactgtgaaagctgcaaacccataatctcaacgtctcttcgtgatttgtgttggcttgcgagatgtgaggtcacttgccatcattaacgatgtaaaaaaaacagttatctatacactcatttgtataaatctacgtgtccagattcattatactataatgtatcccgttctagtatgaggatagttttttttttaaggacggatgaagtactcctcctgttgaaaaaaataatttctatagataaaatctaaatatatgataaattgttttttttacataaagagtattccctcggttctatatggtgggttttctacacagcggtatatactacaatgaattcgaatagagagtgtgtttcaaattcgtcgctctacacaatacgttttatcatagaagactctttgttgcaccgaaaataccatcagaggggttatcgcagctgtgggtaagcactaagcagcatggagagcactagtctactactacctggcacgtgatgggagcgctgcaaaaaagacggtgaaaaatacaaacacctttggcctctttccacgacggcgcgcacccaaacttgccatccctacacctccaaaacctccaacgatcatgtcgattaacgtatatgcatgcacgcgtacgtacgtacgtacgcacagtgcagccttcgtacacatacacacatcgtgtacgtacgtaagtacgtacgtacgcagtagtttctttttactagcactagcagctgtacttttctttttttctttttgggccattggagcgtgtgggcttttgtaccctggcgccactctcgtgagctgcactttgacttgtagcagcagttgtagtatgccggtgcaaagcagagaaaaggatcttttgggcgatgacgtcatcgggatcgagccacagaagggctcacaggacgagtgggtccttgggaatatcgaattattgatccatcgagccatcgatcgatcgatctggcgcatcaccgctactatgataaaagattccaaatcgtcgtccactgtagggtagtactcctatatcagatttgagtttggttttgggctaaatttaatttcatcctcacgaagtagtgagcttaattcaatcgattagatttcttacgataaaaccagcttatccgggtttaaattctggatttgacacatatgcttgtatttaggactaattatttttatcaggatacgtgatgtattcgtcgataacgaggtgtccgtgatgcgttcgtcaatcttaatatatatcgtcctaatttttcggatacgtttataagggtagtgtgtccatatgttagtacgtagcgtctgcattcgtaccgtatttctaaaagaaaaattttggttttgttgtagttttatttttgtttaaaaggatacgcgaatgcaaattactgtacctgtagtagtagtacgtgcgtgtcctcgcgggtcgcacgtgcaggatcaggtagggcgtgatgtgtgcgcaatgtgtcaaaaacatgttactactactgctgctggtgcctggtggcgaaactgttgctgtgcgtgggtgatttgaacgaacatgacgatgcagtgcagctgggtgagaggcgcgtaccacgtacaggagtttttttttttttatgtaccaccacgatctttgtgacctcgcgtcgtggtactatctcacgcagtaaatgaccctgttcgtttcaatttttttgcagggtcaactcgccccagtgtgatctttgctgacctggcccctgctgactctgaggtgtactagtaaaaggaaagaggccgtgtttagttgttttggcaaaaaaatttaatgcatacgggcacacatttgaagtattaaacataataacaaaataaattatagattccacctgtaaactgcgagacgaatctattaaatctaattaatctgtcattagtaaatgtttactgtagcatcacattattaaatcatggcgtaattaggctaaaaagatttgtgtcgcaatttacatataaactgtgtaattggttttttcgttcacatttaatgtttcatacatgtgtccaaacatttaatgtgatgaaaaagttaaaaatttgaagggaactcaacacagcctcctacagaagtgaaagcctcatccgttttcacagggtttgactcgggccgcgatcgcatcgaaaccataaatatgaattttaacagcagaccgtgatgaaacgaaacggattggcacgaaatttaacagctgccattgaccggccaggtttttttggaaatatccaagtgaaaacttgtgatatttctgagacgcagaagctgtaaataaatgtgtacggcggcaaccggcaggtgcacatttgctggctggatctttggggggcacggcacgcatggtgtggactgtcacacgaatatttttttaaaaaaattctttgggattagttggcgtttttcgggtgtcacgttgcgatgcaagtatgatgtgggggaatcaatgggtttttttgaaacgagaaacaaagaagggcggatggaatcagaggcatcatggaaatttgaacctacgacacaacgcccctcgatttttaaccaaaacagcaaaatttcaattcaattcctatacgagatggagaggtgaattgatcgcggtaataaaaagtttgcacggttttctcgctcgccgccacacggtctacgagaaagggaaactgcaggtaaaatccgcggtggccggcggcgcggcgacctaggtgccagcgccgccgctggatcggcccagccatcaacgtgggccgtgagcccccctcgtcgacggcccatctaaggcccgcaccgcgaaaagcccaacgcacggcgaaggcgacggcggtggcgaccggcgaccccgactccggccaacttctccattcacctccatgccaatgtgacgcgagtaaatccatccaatccaatccaatccacgatccaatttggttgctggattctcttctgttcttggatagatatccatccgatccgaccatggacaatgtttcctccccctgttgctacgcagtgtgcagttaccgaaaagctaaggaacagaacaagaagagcacgacgcttatccctttccgctgccgccgtatcgatcggtagatggatcaaaaccgccactgaaagggatcaactaaactactgatgaaaaaaagttgagtgctttagacaaaaacacaaaactttcacgtgcctccctccaatcccagattatttttctatagatcgatcgatcgagccccgtgaatgcgattctgcgcgcatttccggagcgtcttttgatcgtggttgggtttgtctgaaccgaactccaaaggtctcgcctttcttgctctgaagcttttctttagcttttcgattcgcctgtcggggaccgggatcatggcggcggtggaggcggagaaggtggtggcggagctgcgggagaggtgcgcgacgccggcgtcgctgctgcgggatgtggcggcggcgatggccggcgagatgggcgccggcctggagaaggagggtgggagcagggtcaagatgctgctctcctacgtcgacaagctccccactgggtcagtcagtatacctgcatatgcatcgcctcctctgaattctgaatttctgatttgtgttcatagcgtcagaaacaagagtgacagtagatacatctctgaaaatgatgggtttacactgatcagttttgtgccacgaattcaggagagaggatggattgttctatggattggacctaggaggaacaaacttccgggtgctcaaggttcatcttggtggcagcaagaagcatgtcgtcaactctgaatccagggaagtcagcatcccaccacacctgatgtcagggacctcctcggtgggtttttgtacgctgaatcatcatcatttgaccgagttttgctccattttgatgttgttccactgttgtgcatttttttatttgacgatattcgttgttttactatatgtctgcaggaattgtttggtttcattgctggggaattaggcaagtttgttgctgaagaggaggagggtactgacatgccaaacggcaagaagaaagagctaggattcaccttctcttttcctgtgaggcaacgatctgtggcatcgggtacccttgtcaagtggacaaaggcgttttccattgatgatgcagtaaggcgtccttcataaactcaacatgcatcgcatacattttttgtggtgatgtaaaaaatagtcctaattagtaactacagctctgcaaaacccattatttatatgaacatcttgcgatatgaacgttgttctagtcacaagccttgtcattaatacttgctagctcttactagtagatcagtttcacgcaaacaaaatatccatttttaagctgatatgagtgaatcttctatcagataaaacatttctctgaaatcaggtaggtgaagatgtggtggctgaactacaaacggctatggtgaaacaaggtctggacatgcatgtagctgcattggtgagtattgactggcttttacctttcataaacataatatatctacaatgtcaggtaaacatttttagtctgagagaacttttttgatgaaatagattaatgatgctgttggaacattggctggagcaagatactacgatgaagatgttgtcgcaggtgtgatatttggtactggcacaaatgctgcatatgttgagaaggcaaatgctataccaaaatgggaaggggagttgcccaattcaggggatatggtaagggacaaaggccatactcccaccttccattgaaatttaagcaataaattaactcacataagtttattttactcaacttttttgttgtatctttattcaatttctaagttttttttaagtgcgtttatcgtatttcaggtcatcaatatggaatggggtaatttctattcatcgcatcttccagttactgaatacgatgaagcattagacaaggaaagcttaaaccctggagagcaggcaagtttcttcagcaaaagaccacctaccctgcatgc

SEQ ID NO: 65274 - DNA, 3029 bp, Oryza sativa
taaaatatccgttaatgtgcgaacaggactccgcacatttctgcaatgcaccatgatgaaacacctgacctaaagatagtggctgaaaaattgcatcaaatcctagaggtatccatgcttctgaaaaagctcatattctgcatgtgtattctctgtagtgacatggtatgtatgcctgcagattacacatacatccttagagataaggaaaatggttgtcgaaatatgcgatatcgtggcaaggagggcagctcggctggctgctgctggtgttgcagggatcctcatgaagcttggaagaaatggcggcatcaacaatcagcgctcggtcatcgccattgatggaggtttgttcgaacactacaccaaattcagggaatgtttggagagcacgttgggtgagttgctgggagaggaggcttccaagtcggtagccgtcaagcacgcgaacgacgggtcagggataggggctgcccttattgcagcctctcaatctcgatgaaaatttgctagataaatagtagtatatgccgtccatttttgctctggagtgaaaaaaattattgaaaaaacctagctttgttgtatgtgctgcttgggcatggtggaactggaagcagtctgtaaccaaaatgaggcttgatatactgtcgccctgcatagttgtaacctgaaataaaattggaactgcaaaaccttcattgttacctataattatcccttttggggatttttttttaatattccgaattggctgtaaagatgtgtgtgtgcaatgaattatattatgcgctacttccatgaattaaattctgcagtagtaaggataaccaatcaaatctagccatttataactgtttgagaatgtataaaatttacaatctgtgtaatacggagtataatattctgctctaaaactcagcaagtaacaacaaaggaaggaaaatgtgatcccatcattatttgttcaggtgaatgttcccctaaaaacattttgctagcatccctgtctctgaaaccatcgtgtaaaaccagcagcggtgactcttccgttaaatccccaacgttaatctcggtccttaggtttcaattagatgtgcactttcaataacaacatgctacaacaaggaaagtttttaccctgaaagttgaaacgtcaagaatgattctcgatcatactccagtactccccctgtcccaaaaaaatctatctagtattggataaaacttttatctagcatgtccagattccttgtactaggttatatcctatctattctatattggttttttttttggacggaggagtatgtacaagtactgtttatagtatttttgttagtaagccctataagctaggtatacatgttaagactggattaacaatgatgataacgcaacaagaattatgccatgatatgaaaatatatctcgaatgaacaagaagaaattcccatgttaacacctccactaaactgtctttacatcttaagttgtacttactgttagtagatgtggagatgatttcattcaatcaggcgaaattgtgcctacgtgtgccgtgttacgaccgttggatggcgcgcggagagtgcggcaggatgcggcgtgtctcggagccccaagtttgagaatcattcgaacttttggtttgaaagctccaatgtttacctttaagttgtgttttttttttggcaaaattttcacgcgagggattgtgtgtggaagctacgccgaaatccacttcgattttgagttgaaactagccgaatctaaaagtgagcccacttttgagttgccgaggtggatagcaatactagagcccatgatgacaacttgatcgagatgaaacgccgacacgatcgatggagctcacatttttgcagacatgcatggcaccataattaacttagacgcattaactagatcgcttaattaacaaaacacataactaatttgacacatgcctgcctacatccaaaattacaccaccaaaggcgccatagattagcttaatcacccagctactagtaattaacaacactgttccatgctactcgatcgtactactaatcatgaccactaataccgtcatgatctctcgtaagtatacatataattatgcagcccaaagacatcaaaatggccataaagccaagcaccacagatcaaaatcctctgcagttaaagtcatgtgacgttatcattaacatataggcccgataatccctaggtccacctgtcaatgacaaaggaccgtgtatttgactgcagagggatctcaatccaagcaccacaccatgatcaattcatcatcatcggcagcagcagctgaaattgacagtgattagttcagctgtcagctgctgccctcttcctgctccctgccgccctcatcagctgcaaattcagaacgaatcaggagtaaattcattttgattgatcatggtggttggtgggtggtaggctcaccgacggcggcggcaggtcggagctcttgagcacgcgcagcctcttcgcggtggcgatgaacatcctgcagcggatcgatcgatgagacgagaaattcatttgggatggaagctagctacggatgtgtaattttgtccaacttactgccagggaacgtcgccgacgagcatccggtcgccctcgtcgtcctcgtagacgagcgtgtactcgccgccgccgaccatctctccggcggcggccgcgtcggcctcgccgtcagcggcagcgctctgagctgcacgagcaatagcatagcatcgtgttcgcatgaggtcacagcaaagagcaaaccgcaccacgcggcgggcggcgcaaggtaaagctgagctcaccggctaggaggccgcggaagagcttgtcgacggcggcggagagctgggcgtagccgccgtacgccgcgaggtcgaccttcctcccgatcgggacgccgtccatgttgatcttcacgaacatgcccttctccgcgccgccgtctttgctcgccttgtcgccgttctgcggcgacgacgacggcggcg

SEQ ID NO: 65275 - DNA, 1718 bp, Oryza sativa
gaaaagggtttaggaagatctcgccgatggattattgctgggagtggtacaccggttattcaggtatattatttctcggtataatcgacgagaaccaatgaaacacggacaacctttgcaaaagaaaaaaaaaactgctcggagtactttattcgttttttggttttaactggtttactgagcggtttcttggctcaaagatggttgattagcaccatataaccaaagcgcagtggcttatctacaattttatataggtgatccaacttatatattttttaaatatataaaattatcgtggattattttctcgattacatggacaaattaattgttttttttaaagactgtctatgtaaaattgcagtggtaagcattgcagcgaaagaaagtacggagaaaatgatttttagcaataatccggggtactatataaaattaatttattttctaagtatgtaataattgaaatttaattaatcatgcactgacaattttattatttttcgtgtcctaacttaatcttgattttcgatagaaacgatcagtaaatttatcacacctatacggagtgcaagggcagaactagatatgagagggggtgcctaggaaccgttcaagaaatttgtttagctatagtttatctatttttaacatatttgcaccttcactcaattcaaattcagacatatgtatcagtctaaacttgatttaaagtaaatgatacccctctctatttgacagcgtgtatatgtcagctttatggataccacatatctaatagtagttgactaaatcttggcaggacctaccacatactatgtcctatatggaaacaacctacggatataggaggagttccggataaggaaagacaaccagagttctacatggaaacaacaaagactactcggattgtatccatattgttttccctagttctacttggacgaggggacacctataggtataaatacaagccccccaggaggagaggggacacgagacgatcaacacccaacacaatcgacatagaagccacaacatagaagcctaaatacgccaaaacacgccgccggatatcgacttcagggataagcacggctagtaccctgcggtgtctccggatactgtcaggagagacgaaagcgctatctctgatctcgccgggcacggattcgaggaggaaggctaccctgttgtcgactacgagtcagatcttcagaccgccaggttgacaacagttagagaggctaccccaaatattgtactggtgtgattatcatgaataagagcaatatcggcttcgactaacaggatgtagggttattacctgacaattcaggggcccaaacctgtataaaaatcctcgtctttgtctcttttacttcagtctcgcgtataccctagtaccaacgatccccataccatacaaataccagaattgcgacatcaaacgtcgacagtatatactcctcatcgtagagcaggtacaatagcatgctataaccagccgcaaacatatttcaaggagacaaatgagaaggaaaaagagcagcgggctatagatttatagccagctgtagcacggactccaagacacagtgtgtgtatgacaggtaggaccagatattaatagtgtagtatgtaactatcgtataaatgagctattagattgactataaattaattgaagctagtagttgactatactattt

SEQ ID NO: 65276 - DNA, 3830 bp, Oryza sativa
gggagaaagaaattttagagatcgtttttctccttttgacgtcatctatggtacgagcaaagccctaatataacagcaggtataagccaattataaatatattttaaggagataaaaataagagagaagagcagcggactataaatttatagctaactgcagtatagactccaagaagcaacatgtgtgatatgtgggaccagatattaatagtgtagtatatgtttgtaggtaactattgtataaattggctattaaattgattatagatgatttagagctagtaattggctatactattaaacttcctttaaccaactcttctctttgaggccattcacagcgctcctatgtagcgtgtggactcgctcagccacgtaggacactcgctgtggtggacaaaaaagtagatggggcccatgaccttagtttgcttcccctatctcgttttggcttcgagagcctcgcctgcaactgcatgcatctaacgcagggcccacaaagcggcgggaaggggagaaggggaagcggcggcgctgcacgtcatggttgtcgtcgccgagagccatcgtggtcgtcgtcaggccaccaacagatcagccgccaactctaccgcccaagaagattcagcggtgatgccgctgttgcgagtagatcggctagcgagaggaagacgaggcggccatcttcatggagcgtgggacaccgcgagtagccatcgttgccggctccaagaagatgagcgcgagctcaatccactgcgcggcagcaccatcggagctcgattcgcagagagaaagagggccttgtcaccgtcgcctccggccgccctttccgcttcatttattgggccaccggcgaggaggaggagtggcggtggtggataggagagacggcaacagaggggagaagcggctggcgccggcggagcgagaacgagatgcggcgattccggcagagaagaggatcatgtgagagagagagggggagggaggagaaaaggtataggaaggggctgacatgcgggtctgaaataaaaaaaacaactaggctgacctttactgcggggtgtgtggcctaaatgtgttgtgcttatgtgacatctagggctcctcaaatgagcaaaccgcattatgaatggcctgagtataacctttcaaatcttgcacaaatagtatttcctcagtctaaacttcaaaagaaaaactaatatgagtacgatacattctaactacgaatctgaccaatgctaaaattatgaggttgttcggctggctgggctacgactgcgttacagtagtagctagcacggacagttcctcaattgtcaaggcagttgtcgcgggtgttgtggcccggctttgccgaatagactgactaccccatactccatatgtggatgagttttcagtcaagtttatgttatacccgattcacctctacatcctttaatatccatcttttaattaaaaagggtgttgtttttacaggaatggaacaattccattcaacggcatgcttcccgagctttcaaatggtgcactttataaagaattctcaatacattagtttcttataatactatcttgaatttattttcagcatcataacaattaattcatttgtttataccatatgataatatcacaaatcattaaactaatattcaatattccattccatttagtaaaagtacatatgcttcaattcccttttttaaagttgtctaaacacaagtactcccttcgtcccatcttaattgatgaaaagtgaaactcaaaatgaaacgaggatgagtcacatcattctataaatattaaccgttggattcattacaagacgaaagaggataaatgaatcttggctgttgaatttgatggatgtgaaaataataattcaagaggtttccggagatgaaactactagaagacaaaagaaagcaaggaagggggaaagctaaagaataaatataaggttatgcatataatttacgatttgcatctattgagtaaactactttacaaataaaccctcatcataaccaaagattcaccggtcaagattgagcaatttagggcaaatacaaaatgcaggttcatttgattaattttatttctaacagttaattttaatatatttgagaaaaaaatgcaataaggacatgcagagtcatggtcgcccgaatataggtttaataattttcacatgaatttgaaatgaaatcaaactcattccttaaaaacctaaaaacaatatttgtgcataggctataaagagcacgcaccaataaaaaatatgaggtcatgcaaccatgaagacctataagacaaaacttataaaatttgtgataaatattaagctatttattgttattatcataatattaattagcatgaccaatgttttttttacaagcaacgagaaacccataaaaaaggattgtcactctcacatatcacataccatataatagaaggtatagagtcacgcgaatacgcgacatcagatgcgggttttaagtgtagttgtgggtttttgcgtccaacgtttcaccgtccgtcttatttgaaacttttttataattagtatttttattgttattagatgataaaacatgaatattaatttatgcatgatttttattttttcataaatttttcaaataagacgaactgtcaaacgttagatacagaaactcacaactgcatttaaaataggacagagaaagtattattactaatacatactccatccgtaaaaaaaaaacagctttctgactacatgtatctggacatatggagtacgttatatccaaatatatatagccagaagtgtttttagagacggagggagtataaagtgtatagctgtcttccttggaaaaggaagagaatcaacaaacaagtataccctgactctgatggtgccatggatggaggctgctgtgcagaaatagtgcaatactacatggaatctttggagcaaggcggcttcctcatccagggtctacaaacaacacttgggctatttcatgggcccatcactatcaaacgggatttatttgtttctttggtcctgaacgccgggcccactttctttcggctctggcctttgttcacattcacataccactgctccactacagcaaaccacagttgcgaaccaggctatgctacagtgaatccaactgaaaggagaaaaaaaaagggaaaagtacaccgaaggtccctcaacttgtcatcgagttacaaaatcgtcccctaaccgcaaaaccagatatcggagatccctcaactaacaaaacagttcgcttgaggtcctctggtggttttggacccggttttgtctgacgtggcgggtgagtcagcgtgggccccacgtgtcaggctgccacatcatctccctcccctctctctcactcttctctctctgccacatctctctctctcactcttttctcctctcactcgctctagggcgggcgcggccgctggggggcgctggcgaggtgggcggtggcggcgacgggggtggggatgagaacggcgggggaaggggaggggagcgagtcaagggtggtgggggagacctcgtcggcggcgaggcggcggaggagcaacggcgaggagaggagggcgtcggcggcccccacacccgcaaccacccagcacgtgctgccgatgcccggcggtccctcgcgcgcctcgacccgccgcggcggaggggcgacggcgaggagaggagggccggcgccgtgggcgcgtccggcagccagcaggggaggagggccggcgtggcgggcgcggtcggcggtcgacaggagggagtgc

SEQ ID NO: 65277 - DNA, 5376 bp, Oryza sativa
ccgcctcgccccgccggccagtttgccgagacagctcgagaacggcgagggcggcgcggagatggggcgggggtcgttggctgcgaccccggcgaggcggcctgctcacgcgttgcagctgccgtcgctgcctcgtcggccgccaccctcagccctgtcacgccgctcgtggccgaccccttcaaccggtcaccggcgtcggcatcaacggaggaggaggccgtggccatcgcactcgcgcaaagaagagaagagtgagagagagagaggaggaagggagagatgatgtggcagcctgacacgtgggacccacgtggggcccacgttgactcacccgccacgtcagacaaaaccgggtccaaaaccaccggaggacctcaagcgaacggttttgttagttgagggacctccgatatctggttttgcggttgggggacgattttgtaactcgatgacaagttgagggaccttcggtgtacttttcccaaaaaaaaaaaagccatatctagatgaagtcgcgcagattaacacttgtttttcttcctcatgacaatggagaaagttctcggcctttggataatgaaaatgcacacagcagctaaccttgatctttgggtgtttcctttttaagggggatttcctgtctgtctgttgatagaaatttgatgtgtgcatattttttttttttgcggggagatgtgtgcatattgcacgttttgactgatagatgtttgagattagtgctggccgttcaatactccatatgtcccaaaaaaaaaagtcaaattctagggatgaatctgacatgtgtgtctagaattggactttttctttatggagggagtacgtgcgatattagttgcacttcttttaccgtgagatatctgtcgagattcgtgctggttgttcgataagtactcgatcccgtgatcttagaattgcaagcactaagctacgatggtttatttagttacacccaaattaaattgcaactattctgtacatgctaactagcatcatacttaaactataattataatatagctacattttacgtgtttttagagaattttccgtcgaattttaaatagcttttttatatcatgttcttttttccgatgagggtggaacagacatctcatccgctacatcacaaaatgcacacagataacgaaacctccctcttttatgctccttttctacaaacacatgtactaagaaagtataaataaaagctaaggaatgatcaaagaaacagctgctaaatgatgatcaactcattcatccgttcatccatcgtactctctccgtccccaaaaaaaaaaaaagacaaaccctgggtttccatgtccaacgtttaattatccgtcttatatgaaatttttttataattagtatttttattattgttagatgataaaacatgattaatactttatgcgtgacttatctttttagtttttttcataattttttcaaataagacgagcggtcaaacgttgaatacggaaacctatgatttgtcttttttttttggatggagggccccggaggaaaaactgacacatctggcccgatcgaatccccatatccatctaacaattcatcatagcctcttttacgaacccatggagatcagccggccagagccatgtgcccaaaacaccatatattcgtatcctcccgtggaataacctaaagcggaagctgccgcgcgcgcgacgcatgcatgcgcgcggctggcgcggtggtgaccactggagaacgcgtgcgtgcggttgtcgtggttgcgtggccggtggattggggctcgctgtctcgacgacgtcgcgcgcgccccgtggttttctctccgatcccccgcgcgcgcgacgcgactggggagatgacctgatatgtcgcacgtttttggaccacgcgcgagagccaccaccaccacaaccacacgcgccgcgccgcaatccagggctgcgcgctcgaacttttttttttttttccaatcgatcaaaagctagtggtggtggtggcggcacagccatatgtccacatcttatcacgacatcgatcgatcatgttcttttttaccggcacggccggacacctccggcgcctcgccgccgccgccggcggctgtcaggttcataccacttactagaacatctgtccgtgccgggaaaacacgggcaggttcgtacacacgtactgtgtaaaacacactgtttaccactacgaggttaatttcattggttgccgccgctacactaccggagaaaccatctttgatcggtcgaccaaattccacaatagtctcggttccaataaaaactgtgactaaaaattctggtcagtcgaccaaattccacaataatcccggttccaataaaatcaggactaaaaagtatctcgttttataagcgcaacgggactataggggttgcaaaccggaccagtccgtgctagaacgcatcatttgtgtgatggcgttgcgtgcgcgtgctatcaccacagtgagcgggcatcgtgattgatcaatcgcaagactttcacttttacgaatcagtacgtgacagcgtgtgatgtggtaccccatgatatttttctccatcaaatataaaaagtgaagctaccaagataggagtatatacgagctgatgatggattaactaccaataaagcgtgtttagttggggaaaaaaaaatttttaggtgtcacatcggatgtttgaccggatgtcggaagggattttcagacacgaatgaaaaaactaatttcagaactcgccgggaaaccgcgagacgaatcttttgagcctaattaagccgtcattagcacatgtggttactgtagcacttatggctaatcacggactaattaggctcaaaagattcgtctcgttatttcctccataactgtgtaattagtttttctttttatttttatttaatacttcatccatgtgtctaaagattcgatatgatatttttgcgaaaaactttttgggaaataaacgggccagcttcgacgatcgacccactgaaagcctgtcacgcatctgcaccaactaggcatggcattggatactggaatagcttagctagtaactctctctgttagcattttctacattcatatcgatgttaatggtctagattagttaacatcaatataaatgtagaaaatgctaaaatgatttacattgtgaaacggaggaagtagtaccggtttgaagaacaaaacctggaaaattaccacgtcaaaattggtctatacggagtactccgtacgcataagtgcataacgtcaattgctttctaggtagaagtgacagtggtactattcacattcacattctttgcacatttaggagtatgtccatttgatttaaacctgaacatatatactcctaggaagtgataacatgatgatgtgatactagtctctgatgccatctttagcatccagctttattatagataagcacaatctcttgttacctttcctgttttggactatgcagaactcttcagaaaaatgcgtcataggctgtgtttagttgagggggaagtttagattttggttgaaattgaagatgatgtgactgaaaagttgtgtgtgtatgacaggttgatgtgatggaaaagtactaaagtttggatccaaattttggatctaaacacagccataacactactactctctagagtctagattattttattcttggtctgaatctttgtctatagacgggattacgtcaactttcctagacggctagacttggatgacaggaaccaattaacgtttactaccacttaatctctacaagctcaacgattaaacaaaggctaatgacggtgtgtttgcactactagctggtagtactatactactacttacatgattagcaataatgagtacaagtgaaaacttaacatagtgcatgcatcagacgagtccaaatctgaagtctcgtcagtctcaacaaccctgaaactaatcggctcttgaagcaaaggacaaagaataccttactagtagtaattactccctccatcctattataagtgcaaccataagttttcgcgtctaactttgatcgttcgtcttatttgaaatttttttataattagtattttcgttgttatgagatgataaaacatgaataatactttactcgtgacttatgtttttaatttttttcaaaaatttttcaaataagacggacggtcaaagttggacgcggaaaacaatagctgcacttataatgggacggaggtggtactattccctccgtcctatgcagtactgcaagattactatattttaggacggtggaagtactagtactattaccattgttgctgttgctttctgtctcttagcgtccttgcatcgatcgatcgatcgaaactgttattggggttgcttttgcacggacagatcagtttctttcggtttggcgcatctatatatatccatccatccatccatccatccgcgatatgaaatgcaaaagttgtaggagatcagatgccctcgcgcacttggtgttgttcagttagtgcgactgaatcatcaatcagtcgcgtgccgacaacgagctatagctaaaaaccttaccattatggagtgctactgtcctaccactgcatctcgaagagactgctcgaagaaaagattaccgtggaggaggccatgttgttgcattgttgttgttgttgttacctgatgacactgacgtcttctctagctaagcctgaaccaaccggctcggcatggaacacgagatcttctcgatcatcaagtggaattactattcagagtgcaaacgcgaacaggggagaaattatagccggagaccttggccttccttttgctgtttccgatcgagccgcccagttttcaagcaatcagccggagatgtgggagcagagttcaatctttcgttttttggcttttgtagtggagggtgccgatatactgaaatttcgaaaattttgatccaaaattttgaacagaatttggtcaaatctgaacaaaatattgtcaaattcataaaaaaatggaaattttgacaaaaaaatatcatatctggagggggggggggcgataggaccgaaatttcgttcctaaattttgaaccttgtatgggagatcacgtatggcgagtaagcgccgaggtgtgctcgccaactgtgacctcatcgacactgaggactgtggtcggagttcgccgcttacgtacactcgggaccgaaccctgatagaaatgcatggccctatcgtttcgcttatccttatatttatttgtattgcttattaggaaaaaatgagtaaagattatatatatatatatatatatgggctgcaggaat

SEQ ID NO: 65278 - DNA, 3475 bp, Oryza sativa
cctgatgatcatgcatccacaattcccaatttctacccaaactgttttgcttacttacagagcgaagcaagaatgcggcgaggaggctcgaacgatcgccgggagtgaagcaccgcccagttgtcgatgagcaggatgtcgccctgccgccacgggacggcgacgcactcctcctccaggatctcgccgcagccggcgatgacgtcggccggcagcggcgagccgtcgccgaaggtgacggccctgacggggtcgttccgggcgtccttccacccggtgtacgcggccaccatgctgttgaaccatatcttcctccccctgctctcgtcccatttgaccgctggtatcgggcccatgatcgtcttcaccccgtcttcagtccattccagcttcatcccgagcttcgcagccctaagtgcaattaattgacagagtgacagttcagtaacttcagttagtagctgcagcatgtatgatacattgctacctgtgctgaaggtaacgtcagaattctagttcaagtgagaaaccctgtagtgtgatttgtgtgatggtcgatgggctgatggaatcggtgatgagcagctaaaatggcttgaattattgaaggtttttcatgtggctaattactgaatgtggtcatgcagaactgaactctgtagttccattggttctaaattgaatcatgcatgcaggtcaatgaaacgtactccctccagtttcaaaatttcgtccatcagttttatcactttatatcttttgtaaaatataagattatgactgtacttttcgaggcaaatctatgtatacaatttctattgctcgcaatctaagcattcgagaaattgttgatggtttgaattttaaaagtttgacagaatcctaaacgttaaatatttatgaccggagggagtattatggtggaatgcgacgatgttgcagtgggtttctgaatgcaagtgcaaacattcagaactcatgacaagattacgatatagcggtatatatcagtgtaactgaagatttcagaaaaagaaagccagacctttcctctgcaatgctcttatctttggtgagaaatgtagagtgccatccacggccaataggagaagacggatcatcaccctctcctaacaccctcgtgtatatcagcccatccttctccaatttctcaacaaattctggatacttttccttcatcctcttgtaaacgtagtggctcaacactatcggtgtctcaccaccaatcttcggttccacctcgcagaagaagaacagcttcgccggaaatgtcggaacctgaaccaaaaacatatatgaaatctcagcttaattttaaacattagtataagcttgtagcgaaagcattttcttgaactcgaattggattcgatttgctgtgattgtatggtggacctgcgccatctcgtggtggaaggggatcttctggtcgggcggcgactcgttggcggtgaagacacgccccaccacgttgctccgcggggcggcgccgccgacgtaggggagctccgcgtacccgaaggcgtccacggcgcggtcgaagtccgccgcggcgcgcgccgggaacccgcggagcagcaccgcgccggcgccccgcagcagcggctccaccgtggacgccctctccgaccgcacggcgtccaggaacgcgtcgaggccgccaccggccgcggcggcggcggcgctcgggacgagcaccgccgggaaggcgacgccctcgacgagccgctgctccgggagggcggcctcctggaagaagctccccgccggcgccaccatgttaatccgttgggtggtgtgtgcgcgagcgagcgagcgagcgacacgaggtggatgacaaagggcgttggattcgttgggattttttggtggggacgatgcatatgcttgggatgaacgtggacgggttctcgaacagtgtcgggatggtggcttgtactagctcagtcaagctggacgtcacacttgtcacgactcacgactcatgatgatggcaacgtgcattaccctggtgttgatggctactacctccgttcaatctcaaaagttagttattatattctggacggagaaagtattaaggatgtaagcggattaacctgtaaacattgacggacccagcctaaaattttagctatagcgtaacaacgtagagagtacactttgaactaaagctatagaatctactttctccgtttcacaatgtaagtcattctagcatttcccatattcatactgatgttaatgaatttaaatagatatatatgactagattcattaacatcagtatgaatgtgggaaatgctagaatggcttatattgtgaaacggagtagtacaaaacattgtacagaaagttatgttgcagattagaattaattcaaagcatttttgaaatttagattagattttctagacccgattgtgaaacgagtgctaagcatagtgaaacgagtgctaagcatagtgaaaaaaaatgctaaaattgttataaaaatcaaaatcaaattctaaggtttaaaaaccaacttccaattataaatacgtagtctcatgttacttatagtcataataaattacatagaacaaaagcttgatgaagtgccctcttctctctatcctctgtctccctcttctttctctccagccgacggcgcggggtcagagagggcgactgtggggcggagtggccgacggccagagcggcgtagcttgactcggcggggcagcagcaaggtggcgcagaggccatgcaggggaggtttgaaccgaggcattccagaggatgctcttcggtccggcggtcgtcgaggtgctgctgcttgcggccgaaagtcatggcgtcagggaggcgttgcgggtaggcgggagcaggtggatgcggttggtgtcaccggcattgcatgggcgtagagcaatgcgtgcgtggccgacgtactcaattcgtgggtacagtgaggccggcgtcagcagagtgggcgtgaggcatgggtgaggtccgtgtgccgggacgccgcggctgcaggctctggccaccctgcgcagcgctgccgacatccagcgcgccgtggcgcggggtctggaggactttgagcagcgggagtcgtcgtcgcctgctccgaccactgcccaccccgctccaccggctagagagagaacaggggatagagagaaggggtagtgaggataacgtgtgggtccgcgcgggcccaccattttttattatttgtgtgtgcaactgacacatgggtcctattgattttattattttttaatctaattgccacataagcactacgtcaataacacgttaggtaaagacctagttaaaaggagccatgtaagcgttaaaaccgaacacaatatggccgagggatcttatttaaacggttttgtatgctgggagacctgttatgccggttttgcgatgaagtgatgaaaatcggattaagcga

SEQ ID NO: 65279 - DNA, 1721 bp, Oryza sativa
cctccctcctcaccctcgactggccgcaggggccccgcccgtcggcgggaaccacatcctacccatacgtcatcgccgcgcacgacaacgtcgtcctgttccagatcatctcccccgacaagtacgctcgcccttccgccatcgactacttcgtctacaatgccaacagcagcagcagcagcaaccaccacccctccttgacgcggctgcccgtctcctactggaggaggagagacacccttcgcccgcgcatcatgagcagggaaggcacatgtattctgtcctgcagcaacaattctccttcgttcgttgtggctgagctcgagagaagatcatgccaatcttccgaaaccaacatctacctctttgcttctggctccgatgactggagagtcttcaggaatgtgccgatccgccatggcgacggcctcgctcacctgtgctggtggacaactgatgcagtgttgtcgtaccacaatcgctacatgatctgggtggactacttggtagcagggatgatcgtcgccaaagtggcacatccaggaagggttgacccaccggagcctgttctatggtacgtgccgcttcctgtcgatccagttgatgggaacccttatgacattgaccgtgggcgaggatgccctcaagcctcccgtagtgtgtgtgccacccaccatggcatcaagttcgtcaatgttaaccaacatggcggcggcagcagcagcagcagcagcagcagcagaagcttcagcatcaccctgtggtcgtggcgcgaggaggatcaaacatggggagaagatgcaacattggatgctgaccaacttcgggacctcgattctgagaaccgccttccaaatatccaacctgaattccccgttgttgacatggaaaacccttacgccgtttgcttcttgttgaacgagcgctaccacactgctgaccccaatgccacaacgtggatgatcaaggtgcacatgaagaagaaggttctactagattgtaccggatattccaacaaaggaagcccttctactgccagaaggatgtctgaggggctctccttcatctccagcgaaatgccatcttacctgtctagaaaaaccatcaaaaggtaatttcatgtctggtttgcgaaatgcctgttcacctaccatctctttattatgcacaactgctactgttcttggggttgcatgtcctgcagaatcttactagtctgaactcgaagtgaatttttctgcccaaatatgtttagacaatatggacatcgtggttgcttgatcagggcttgcatgattgttagatgaatatagaattgttcctaggatttaggtatttagcaccaccaacgtttcttgaaccttttaattacttggtcctggatcccgctataaaccatgctagtacagtttatggaaagcatgataaaaatccatgtttgtttatatgtttctatttcatcttctcaaagagactccgcaatcgtgaactcttattattatttttgttttgttaatctaaccatttctctgaatcttaacttcaggcaggaggttgataagctaggaatatgacaggagattcaggaatcgtcttaccagtttgaagattggatgcatcaaaacgaccaggatgtgagctcctgcatgttaggctaaattatagatgttcggaaagaaatttggcagactatgacacctcgtagttggcagactatgaca

SEQ ID NO: 65280 - DNA, 1464 bp, Oryza sativa
attcctgcagcctctgggctgagcagtaccgtgcgaaacaggtgccgtaggtcgaggtcctgctccgacggtaggcgcgcgaggccgtggttgtaccggaccagctggaggtacgacgtccacggcgctgtgacaggagaagacgcgcatgaccgcacgcatcttctcctgcatccggtcgaaggtcaccctctgctcaacgtcagtcaagtgcaaacctctgttcaacctcatttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcatgagtgcgaggaaggtaccagcgaaggtagacacggtagttctcctccgtgtgtgggaagagcttgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaatccgcctaaaaatttagaaatgaacaatccgaactcacgagtggtcggcagggaggacggtcggctgcacgttgcccggaaacacctgcctaagtccgaactgtctcatcacacgctgtgggcagtgaggctcaacgaaaatatcgaacaccatcggcaggatggtgagccagtaagcctggtcgcgtgtgcacaaggacgaaagtcctagcggtgctctcgcagcgacggaaggtgccgagctgtgcaccctcgactgctgacaggaacgagcggtggttcctgtcaaaaccacggttcaacagcgccggtgtgtcgtacaccatacctgcatcaaataggttgatcagaaacatataaataattagttcaacataagtaataaatgttcataagcgaattactaacacatattaaacaagagtacaaataaacaaaagtgtttagtccgaacactcatcacgataatattatgatacaacaccgaatagttcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcg

SEQ ID NO: 65281 - DNA, 1308 bp, Oryza sativa
tcctcgcaggacctcgtttgccttcgagcgcccctagcttcggagcagtgcgacctacagcaccggtttcgcacggtacagttcagcccagatattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattactactgttaaatacttgtacgaaactgatggtccttgtccagcaggatttgcagccgggatcttcggtactggggcctcttcgtctcacgccggtaggactggtcctactagccagttctacgacgacgacttgcacagtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattgtatttt

SEQ ID NO: 65282 - DNA, 1995 bp, Oryza sativa
catgaaatcagttgagcaacgcccaaggaaattctcagctgtcagagtttcagaggggacacctgaatcgatcgatcgagctcccaaagcaaagctaggtcgctctcaattctccagccactcacattaactctgaattgaaatctcaagaactgtcaggcattcaggcaatggctaaactttggggttaggaccacctgacctcaggatcatttagttattcagagagtgacctcacagctgtaaccattttcgctgggaatgtttcaaagcattgttcaggccaagcaaagcacacatgtataatttgaattgccagtgatcgattaagtagagcagtacttacttcgctgcatcagtagtgagattctcatgcactggtgtgctctaaattggctgcccaaatcttcattagaattgaaagcttcagtggacctcatttgctactacaggttttgcagggcagaggcacgaggcagacaatccttcagaaaatcagaatgaatcactgcttcttgttcagagatcagaaatgccaaggatacagtgctctgattcagtgcaaagtatggcaagtgaggaatttcctcgctgttagtgaaggagtaaatcaaatccatcacattcacaagccacaagtggcactgaagaatgtcagagtgcatggtttgcctcaattctactgtaccactagtactaatagtagtatatttttcccctctcaggacaggaattgatcccaaatcaaggacaggttgggtctttctctccaggcacataattttgcaccattttcgaatcgaaaacgtaagaggtgggttacaatgcttagtacaaccaattttagtctgtttatttcatctaatccaatggatcaaatctatatatactaccacatcaactactggtagtaaaaaaagaattctattgataatataattcatgaatcagtggttactaatttatgaattcataaatcacttctactaataataatactggtaacagaatattaccaacaaagagcaccgtaaagttacttaagacgtaaacgctggtaacagaatattaccaacaaagagcaccgtaaagttacttaagacgtaaacgctggctacccaaataaaggaatggtcagtagttcatcagaaggtcactcaagattgtgaggtgattcatgtgagtctgcctagagaggacgaaattcgtttaggttgctgaatttaagagggacggcgcagccagactgcaggagaaactgacagcaacatatcgtcatttcctcattggattggagtgtgcaataaataggagcctgcgcttctcattcttgtgaaaaatgaaaaaaaaaaaagctcatgaaaaaaaaagaacgaggttttattgcatgaatatggctgaaaaagaattatggtggcatttcctcccctctccaatttggcaacaaaatagtgcagtgtatatattatgtaccctttcatagagatgctttttaggatttgtttattttagttgcaaaaagatctcttctttcaagatttaataaccttgtgggaccgcctatacatttgtcaacaaattttcttctaaaaatttgaaaatttgacagatgtaattatagtacaatcgtagtgtaattacactgtaacttgcatgtaactacagtgtaacttgtatataagtttcacgtaattttgaatcgttagatctattataaaatttgttccggtgaggaagaaaaaaaatcacatcacacacatatgtgaaagaattttttctcacaacctccattttaccgaaataaatgttagagtaaatttcacaaaactacatgttttatggttcaagttgcagaaaaccacacatattttgacacttggtacttaaatacatatattttggtagtttagtttcacaaaatcatactatcaatgaatgaattcacccatgatatgacgtggttgtttcatctaggatatggacgtggcatcctat

SEQ ID NO: 65283 - DNA, 4850 bp, Oryza sativa
cgaaggcatatacaattggagtgtgctatcatctcttaattatagcctgaacacttcggtgggttcactgaagcttaatttagaaagtataaataaaaatgagctgctaagcagagaatgatgctacggaaatatataggggggaagcaatcctagttaggttacctttcaagcaatgtgacttccaattggagttgagtagttctttcctttccttcttccaggggcatcgaaatgcgcagtttatattcactgtctaccatcttctctcttatttccttgtcctataaaataggatataaaagcaacatattaaataataaaagggaaaaccacttgcagtttcaaatagttcaacataaccttaccctttttgcagcacattgtcggtaaaacacaatttcatcttggcaaaaaggctcgatgtcattgatttgcaggcctgtgccgtataatatttttgcaataatacttccacacacagagaaagagaaacacgattttaaatgtcacagaaacagttaactcacataagaaaagattcctgagtataccatcacagggctcaacaccttgaaggacatgcgaggcaatttcttttggtatggcaggggatggtggctcacgcatgagatcatcaccagtgagaatggtctcttccattgtttcctgtttatcgactattgggaaacagatatgaaacaatagcatcacgggcacaagcagaagccatacatgatcacaaagttagaatctaaggctggattctcttatctattacgtatgaatacacagcatattgggagattagttatgattgtaatgtcatgtaggtaagtagtatcttgcagatgctttattggttatgcagctagaagaggatttttaccagcattccaccaaacttgatatcatttacatgaatggaggggaaatagagcaaagacaccaactgagctaatcaacaaatctcgggtatcattgtgtgcagcaaatcagcacaacttccagaagttgaaagcccaatggaagattatactagagagaaaaaacttaagaggcacctgagaaaaagatactatacgatgagactgcaatactgaacatgtccggactgactctataagggctttgttcaccgtattttgattacatcctttcttacaatacaaagataacaacacaaattttattaaagttaccatcatattctgtaggatgatatggagttcatttttcaagacaagaaatggactggagagcttagtccttattgtcctccaaacccatataattggcaatctactcaggatgacaatgctgacaataatgaatttcaaagtgattttcacactgcacatcactataattcagatcgcctatcagtgcaaaaaaagagttctttccttgtagttgcagttgttaaatccaaaattaactcggcttaccactaaattgcctgtcatgcaactacaatcaacccaggtccgcactaatcaccaactgcacattctatcagctaagacacaaattatacccctaactaataaaaactgttctttctactccccccagactaacacataataaccagagagcagtaggagaaaggggattacaagagggcaagcgcgtgcataccgtccatgatgccctagtaagctttcacgccggcgagcaatccgacgcggcaaaatcgaatcaactccctccagcaacaagaggaacaaatacaatacaggttagcctccgacttcgggagcagaggcgtgaagcccgaaaagaacgaatcaaatgcagagatggataccaaaaatggatcggagaggagccggacggcggcggccggcgaccaacggcggcgcgccgtttgccggcgaggggatcggaggaggaggacgacgacgacctgagccctgaaccacctgtgggccttctgggcttttgttcgctactataggcccacacgtctgtgcccatgggcctggttttccggcccacgatccatcggccccgatcaacggctgtgattcgacgagggtgagctagggcaggagtccccgccttccgatggaaaacggacggcgcagatcgcgtcccgcggcggccgcgcgctgtataaatccgcggccccgcagcgcgagaaacccttcaccgcagaaaccctagagctcaccctagcgcgccgccgccgcagccatctccgccgccgctcgtcgggctctctccatctcccatccaggtaaacggcacaccccccttggatctctccctctcttaggttgccatttggtagagtttttcttgttgatggaatgatgacgggtgctggaaatgtgcttcgctaatgctagtgctgcgatctgtgatccttttgctgtgagataattggtcttgctgtcgttagtgttagcttctacgcgttggcagtaggttcttggatcgaatgcagcagcgggcgttgggtttacttgaaatgttctgtttttttaatgttacagtttcatgtgtgaatcatagaatatttgtttccgtattgatgaaatggacaaaagtatggttaggatctgaatatgtagttccacgtttacgggatgtgtacaaacttgtatatgttgcattctatctctcctgattggttgttacgctcatttacttgctttgtccttacatgctagtgttatatgttagattcattcttttgctgtgatagtttattttgtggctagttaatgccatttatctgtttagactttgcatcgcagtcttggtcattgtcacctatgttcgtcctttattcttaggagataacatgcttaccgatagttgttagtcaccttggttgtttagatacatgaggagtttctacaaatcatgatccatctgttaagttgaagttacatagtctgaccatatttcgtcctgatttgttcaggatgaagttcatttctgcctatctgatggcctatctggctggcaactccagccccactgcggaggatttgacaacgattctggagtcaggtaatttcatctccctgatttatgtccatatttgaaactgttcagaaaatgtaatctagccaataaatctgcttaactggtgtctacattttcttctgcttaatctggctaattccatggcttcagaaagcagtttttttggtctaaatttcttagcatttaatcgttaaattagaaggtaccattctaaggtttgcattcctttctaaatgttagactatatttagattgattggtttcgttcttatcttcttgggtgctttcattaaatataatattgaagtaatagtcatccacttatagctgtatgtactgtgaaatttgacctcaatctttgtctttgtggcagttggttgtgaaatcgacaatgcaaagatggaactcctgttgtctcaagtgagtggcaaggacatcactgagctcatcgcttgtggcagggagaagtttgcttcagttccatctggtggtggtggtgtagctgttgctgctgctgctcctgctgccggtggtgctggtggtgctcctgcagctgaggcgaagaaagaagataaggtcgaagagaaggaagaaagtgatgatgtaagaccaatgttcttatttgtctcaattagcatattttgctcattcattatgtctatggtagtttgacatgacttctattcaatgtataatatcgtatgatttgcaaaccgttgcttctgctatgcttcttattgccatttaacattcatgtttagtttattagaacaaatacacctaatggtaactaatttaactgtttgcaaatttatttacaggacatgggcttcagtttgtttgactgagtgatgcggtcacctcttctatcatcaataccagactttgcgcaggaaactagagtgatgatgtttgggattttagcttttcttctttagttaagttgaaaacacttgaggaaagactatgcttcctactatgttttgatatgtagtaacgcagccatagggtgctggttacttcactggtgaaccatgcttttgctatcaaaattcaatgcttaatggaggatgaattgtgctcggcagtagtttttagctgtgttcaattatgtgtccctatttgttcggtgttatcagctcccaatttgattcatttgagctacgttatctgtctatcgttcatcttccgaagttgttttcctttgattttctgttttagagattacgataagccagaagttacatcagtaataataaaaaactttggcaattttaaacgagaaaaaaggctattttttgcatgcagatgcagtaaaaaatcatgtaaacaatttctggagtctggacatagcaaatgaaagattaaggacatgcgtagtggttaatttcaaagtagtgatagaatcatagaattgccatacaatctaatgatctctctcaaagagcaaaatatgtagatggaaattataggactggcatataatacgaaatgaaccaatcacgaaagagctactaataaatttgccagaattccatatctcaaagagcaaaatatggagatggaaattataggactatggcatataaatacgaaatgaaccaatcacgaaagagctactactaaatttgccagaatttatttttatgattactgcttcagaatgataagaaacagatctcttatatacccctgaaatacccctgaattttgcttactttcttgtataccccaaaaatttgattttgatcccttgcatactcctcccgttagttgaccgtatattttctataaaaatgaccattttacccttggatgaataaagaaattcataaatgggctgcaggaat

SEQ ID NO: 65284 - DNA, 8982 bp, Oryza sativa
taggggcatggaagggatcaaattgaaatttcaggggtatagaagggatcgggtaaattttaagggtaggggcatgggagggatcaaattgaaatttcaggggtatagaagggatcgggtaaattttaggggtatgaaagggattgagtgagttttcaggggtacacagggaatttactcttttagatgagaatgatactcccttcgttttttaatagatgacgccgttaattttttttctcacatgtttgaccattcgtcttattcaaaaattttatgcaaatgtataagatataaatcacactttgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggggtcgggttacgcttgccccggccccgagggccgaggcaccccgaccccttaaagaagtctgcgccacatatatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcacgccttgccccatcccgtcaagacgaaagcctctaggcaactcgtctcaagccggagctagcgtgttatctcttagagatggcacgttagccctggtcagatttataccaggcttcatcctaaccattacaggcaagatgttgtgtgaagaagggcaaacatgcacgttgctaagctgacacgcggtggacaagaatgaccgatttgtgaccggtctgacactgctcaggtcgtcagctcacagccacgttcccgcgacgcgcctgcccccggcagaagtggaggtaggtatgtgccgtcccatcagaaggacgtttggagggcaaccgtgcaaatctccgtccatttacgtaaagaagaaaaagtccagtttggaaagggaagggtgcatgtggtatccccttgaagtataaaaggaggaccttgcccatagagaggtgggtggattcttgccagatttagagcctagagcggaggagaagtggacacactttgtagctcattcatacacaaatccacaaaaacacaggagtagggtattacgcttcggagcggcccgaacctgtatacatcgctgtgtctcgtgtgtcttgcgggcgagtaatctttccacacacagcgagagcttgagatctcaccctaagcccccggccgaaccggcaaaggggggcctgcgcggtctcccggtgaggagccacgagctccgtcatctggcgcgccaggtagggggctcagcgtgtgttttctgagctctcagactcttccgtgggcgccaagtttcccttgttcagcctaatggccgagcaagcaaaggcgcacgacctctctccgagtgtgagcggcgacgacggggagccgaatccacgccgtcgagctcgtactcccccacctcctccgcgccaaagccctaagcagggggaggcgcttgagaaggtcgacaagtccatggcatcaccagtcgcgggtggtgcaggaggacggcaagatggggagcgccgcctcctcgtatacggcgacggcagcacgcctcagggtgcgcttcaggctgctggcgcgctcttacgacacccgcctgtcgtccatgacccggagtctccagcccaacgatggctggaagatgtggccaacttggtcatgacggctcagcagcgcctgggtgctggtggacggtccaccaccaccaagacctccggcgccgccaccaccggttccgtgtcatcaaggcggagggcgcggcgagcggcggcggctgcacgtcattcggctgccactccctcgtcgacaccgtcgactcgggaggatcagcatgagaagccggatgcccgcctcaacagcgagcgccggcgtaacagccggcgtactccccgtgcaacggagggcgcctcctcgtccagagtgtcacctcgacatggacgtgaggatcagccctccgtgcccccggctggtggtgtcggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatctgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaagaggaagcgtggacatggaactcctccggttccggagtggcagcttcggccgcccccggatctgccgctcagacagggcggcgtgacaggaggaggaagaagaggtcggaccgttccggcgacgagggtcatgtcctcgccgtcgagggcgctccgcgggccacccgaaaggggaggcctgcgagcgacaaaaagaaagaggctggtactcccagcagggagcgccccgccggcaggtggtgctccgtgcacaacacctccctccacgatctcgcggactgtcgtgcagtcaaaaacctggctgagcgaacgaggaagtgggaggaggacaggagacaggaacgccgtgagggcaagtccccggcggttccttccggcaaacggcgaagtgaggccaagcagatggcccccgctgttgacatcgatgatggtgacgatgacctaggtttccaagaacctggggccaccattgccaccgtcgatggaggagcgtgtgctcacgtctctcgccggagcttcaaggctatgaagcgagagcttctggccatggcccctactcatgaggcgatgcgtcgggcgcggtggtcagaggttgctctcactttcgaccagaccgaccacccaccgtgcattgcccggggagggcaggttgcgatggtagtttcccccaccatctgcaacgtgaagttgggacgtgtcctcatagatggaggagcggctctcaacatcctttcccccgcggcctttgatgctatcaaggccccggggatggtgctccgaccgtcccagccgatcatcggtgtgacgccggggcacacgtggccattgggtcacatcgacctaccggtcaccttcggtggacccgccaacttccgcacggagcgggtgagcttcgatgtggcggacctcagtctgccctacaacgcggtcctaggaaggcccgcgttggtgaagttcatggcggctgtccactacgcctacctccagatgaagatgccgggccccggtggccccatctctgtccatggcgaccttaaagtcgcgctcgcttgcatggagcagcgcgccgaccgcctcgctgctgcgtccaagcccgagggtggtgacgagaggcttggcccctctgcccccaccgccccgaggcagcggatggccacatgcgacgaggtcccggtcaaggaggttgccttgggcgacggcccatccatgaccacacggatcggtggtcttctggatggcaaataggaagacgcgctcgtctccttcctgcgggcaaacgctgatgtcttcgcatggagaccagcggacatgcccggggtccccagggaggtgattgagcaccgtctcgctgtgcggccgggcgcaaggccggtccggcagaaagtgcggcggcaggccccggaacgtaaagccttcatccgcgaggaggtggcgagacttctggaggccggattcgtccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatattctggttaccatcagattcgcatggctagggaggatgaggaaaaaaactgcgttcattacccccgtaggaacctattgttatacatcaatgcccttcgggttaaagaatgcaggtcccacttttcagcgtactactcgaatttctttgggtagccaaataggacgtaatgttgaggcgtatgtcgatgacttggttgtaaaaacgcgcaaccaagaaactttactttcagatctagcggaaacttttgaaaacctccgctccgcccgcataaaactgaaccccgataagtgcgtgtttggtgtacccgcgggcaagcttctcgggtttttggtctctgcccgaggcattgaggccaaccccgagaagatacgagctatagaacggatgcgcccccccagcaaacttagggatgtgcagtgcgtcactggttgcatggctgccctaagtcgttttatatcgaggctgggagagaaggcgctacccttatttaagctcctcaagcgctcggggccgtttacttggacggaggaagctgaacatgcccttactcagttaaaggtgtatctcagctctcccccggttctagtcgccccagagccaaatgagcccctgctactttacttagcggcgaccccccaagtagttagtgcagcgttggttgtggagcgcgatgaggacaatcctcattctgcgcacccccactctgtgccgacttggcccgggagcaggcagggaggagaggcccccgagtcgaacggtggcctaaggcccccgacgaccggagtcggccctctgcccgctcgtcagacggtgccgggtgcccccgaccctcaggaaggccccgaggccactgcgggaaggccgcatctaccaccctttgaccccgaggctaaccctgtgcagattcgacccgggagagagcagggagaagaggcccccgagccgaacggaggcctgaggcccctgacgaccggagctggccctttgcccgcttgtctgacaacgccaggagcccccgacccccgggacggccccgaggccactgtgggaaggccgcacctgtcatcttcggaccccgaggtcatcagcgcaggagacgagtgtgccccaagaggccacttggacgaagagcaccccggggatacggcccctagcgaagaggatcggccccgccgaaaggtgcagaggcctgtctactttgttagtgaggccctccgggacgccaagacccgatacccacaggcccagaagatgctttacgctattctgatggcctcgaggaaactgcgccattatttccaggcgcatcgggtcaccgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagactgtctcaatgcccgaggccagcacgaacccctcacagctgcctcaaaccgcccactgggtgatgcagttcgacggttctctgtctctccagggcgccggtgcaggggtcacgttgacctctccgaacggagacatcctcagatacttggtccgtctcgactttcgagcgactaataatatggcagagtacgagggactccttgccggactcagagtggcagctggactggggatccgccgcctcttggtattaggcgactcccagctagtcgttaaccaggtctgtaaggagtaccggtgctctgacccacagatggacgcctacatacgccaagtgcggcgtatggagcgccatttcgatggaatagagcttcggcatgtgcccagacgggataacatgatagccgacgaactctcacggctcgcgtcctcgcgagcccagaccccaccgggcgcctttgaagaaaggcttacccagccatcggcgcgacccgatcccttaggggagacggatgcgcctaaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgttgacatccatgagggcgagtgcggagcccattccgcctcgcgtaccttggttggcaaggcctttcgtcaaggattttattggccgacagctcttaatgacgcagtcgatctggtccggcgatgcagagcgtgtcagttccacgccaagcaaatccatcagccggcccaggccctgcagatcataccattgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaatcgtattattacggataatggcacccaattcactagtgaactcttcggcgactactgtgaagacatgggcatcaagctctgcttcgcctcacctgcccaccccagaagcaatggccaagtggagcgcgccaatgcagaaatccttaaaggcctcaaaaccaagaccttcaacattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggaccgtatcgagtgatcggtgtcccccggccgggctcggtacggctggccacgggcgacggcacggagctgccaaacccgtggaacatcgaacaccttcgccgcttctacccctgaaagggggggtcgggtgtcaggtttctatctcgggccaaccccgcacccccctcgggtgtgcagggttggccgggggctaccacacatgcacatatattccttttcttatttcagcttttcaataaaagcagtttcaatttcctaaaggttgtgtctgtgccgtttttccttctaaagaatcttaacttgaaataaggtcactcgtgctcaaccttgccctcgggggttcggttcggtcagcaaaaatcgccaaacggggcccagaaccgagccgtgccccggggtgtggtgaactccgggggggaatcggcaaaagcccacgatcgggttacccatacccctcggtcaccacgttcccggcctggccagtctcgacatgtggatctccccaggcactagccccgacccgagccattcgaggaccgggacttgggcgcgagcccttatttcaagctaaggcgcaaaaggaccatggcacagatcatcctcaacttatatatatagcaaaataaagttaacatagaaattgtttcatcatttttgattgcagagtaatttgatctatacaaaagaggcatgaaggccttagaagaaagaaaaagaaaaaagtaaagattgacgggggctcgggggctcattctgacgcgcccgggtcgccggcctcgtcgccatcgtcgtcctcaccgctggcatcgccctcctcgtcggagctgggggcgaacgcgagccgaggggctgagccctcgaagccgttgacgatgtggtcggcggcatcccggacgcgcgcgcgcgcgtcgtcctcggtcccgggagggaactcctccagcgccatccatggagagaagttggggtcccgggcctggtaactcgccagcacgagttcgaccgctccccgcgcgaggtcccttgaggatgacttgatggtcttctcaagctcctcggggagttgctcgagaacccaagccatcctgttgaggtgcggagcgaggccttccagattggtggggggcaccgacgactggcctccccagaggcccgcttgccgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagccgcgaggcgggcggccaggtcgctttcgcctgcggccgccccgccgataggcgccctcgcggccagctctttctcccgtgcctcgaggttggcagcccgctgccccagcgcggctctctcggcacggacacattcaaggttgcggcgcgcctgctcctcttgcgccgc

SEQ ID NO: 65285 - DNA, 2051 bp, Oryza sativa
ttgcggcggccaaggcctgcataatgggctcggcgctcaccggggcaacggaagacgaggagaaaagtcgccttggagaaaaggcgacgcggcttggccccccggaggatgcgctgggctcggggatgtcccccgggcccgtttgatcctgggcgtcgcccggtgaggtaggcccaggcgatgcgcccgcggcctcgtcgcgagccgcctcggaggatgtcacctgaggaccgcccgagggagtgggcccaagtgacgcgccagcagcagctgtcgcctcagcctggcgagcccgggcggcctcctcccgggcagcttcttcggcttggcgagcccgggcggcctcctcccgagcagcttcctccgcttggcgaacccgggcggcctcccgggcggcatcttcagcttcccgaaggcgggctgcggcttcacgccggtcagactctcgcctccgctcctctgcggccgccggatcttcggcctcggactggccggatttggggtggcgggaggaatgcgacgggacatcgctgaagcagaagaaaaaaccgaaagacgaacaaaatgagtaagaaaaaacttcttttttgggaggaaaatggttgcaatgagagtgagacgaacctgcgagggggtcggttgaatgaccactttggaggggaaatcaggtttccccggcatggttccgtctcccccgtcttacggagccgcttcttcttgcgcaccccctcgggctgcgacgtcggcgcggccccctccgggcgccgactgctggcacgcgccgccccgccccctcggggaggagatgggggaggtgtacctcccagcttcctcttcccctgggcgtcggcagggcggctgctccccgagcccccgacgcggggcccagaagcacgaccccctcctggggcaggttgttccccccggcggcgcacgcccgcgccgtcgtggcccttaggggctctctcctctgaggccccgacccccatcataatggttagaatggagacgcggtcgggatcgctgcagagggggaggatctcctgaggaaggcgagacgcctccgcggagctaagattcagcaccctttggactacgatcttgaagtcctcaggagcccaatcccatctggctccctggtgggtccgcatatagtcttcaggcccagtatactcccaggcgctccgggcgcgccgttggagcggcgcaatccggcgatggaggtaatcgccgtacaccatggccccggtgagcccttgggatcgcaggcccgccaggcggtcgaggacggcgtcgtactcctcccccagatctaccggcgcccgccagctggagacctgcgccgggggctggcttggaagacggaggcgcgcttcgttggcgaggggggtgtagaaccagtcgctcttccagtcgtcccacttcttgcggaggacgcaggggatgtagcggttcagcaccggcccccgcggctggaagtagcagccgccaactaccgacggcggcgacaccgactgcacggtgaagaaccaccggaacaactgaagagaggggcgcaccccaatgaacatctcgcacaggtgtgcgaagatggccaatgtcatcaccgcattgggggtgagatgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggcagtacactgccgtcgagcagagcagagccccgtgccatggcggtggaggaagagatgattgggaacgagcgcgtgtggcgaaagtagggcgtagcagagaaagagttagagctcaggcggcgaaggcaagaggaacaatggcgaaaggaagggagcaaatcctttcctcgatgcttttatacccttgccatcgctggtcctgg

SEQ ID NO: 65286 - DNA, 3071 bp, Oryza sativa
  unsure (1)..(3071): unsure at all n locations
cgacgcgcctgcccccggcagaagtggaggtaggtatgtgccgtcccatcagaaggacgtttggagggcaaccgtgcaaatctccgtccatttacgtaaagaagaaaaagtccagtttggaaagggaagggtgcatgtggtatccccttgaagtataaaaggaggaccttgcccatagagaggtgggtggattcttgccagatttagagcctagagcggaggagaagtggacacactttgtagctcattcatacacaaatccacaaaaacacaggagtagggtattacgcttcggagcggcccgaacctgtatacatcgctgtgtctcgtgtgtcttgcgggcgagtaatctttccacacacagcgagagcttgagatctcaccctaagcccccggccgaaccggcaaaggggggcctgcgcggtctcccggtgaggagccacgagctccgtcacacttaaagtactatgagtgataaaacaactcgtaacaaaataaattattattacgtaaatattttgaataagacaaatggtcaaacatgtgagaaaaagtcaacgacgtcatctattaaaaaacggaggcagtagcagataacaaacaatacggtgcagcgcaaagtagcaatggagagaatttccttgcttttaagcagaaattggataatcacattgaagagaaactggataatcttcaaaaacatcacagccaccatggttaaacaattacatgcatgatttatgacacatgtcatgtactcaacaattccaacataatgacgaactgacttttaaacagatacccaaattttgtgctgattatttatgggattaatgacagattcttgtatacatatacccagttgccctcttactgcagattctgagttcagaaaccctgttcaacaaggtaatcgccaagcctctccacaaccatgttgcactggccaggagtcatcggttcctcatagattccaatgatgatggatagataaggtcttcttgacagtaacccctccagttccctgagaaaatgtaacaaaaatgcgatacatgaaattagcatgtctctacagagaccagcaatagcttgtagcaaatcaattttcgggtaaaatttgtaagtttgttaaacataaaatacttctgcggttgagatagtgtctgaacaattaaaggtctggtcaatctgctttccgagataaaacggtttgatgagagaacggagatagtagcagggatgaaaacggtcggaaaaaccttagtgtgattcaattctaggaaactttatcaatgtgctagtgatatttatggtccatattgtggcgttcctagtgatttctgaaagaaaggggaatcttgcagcactattctagacccttagcttcgaaaaatgatgtaattgctttcagctgatttgctggaagggaagtatattttgtaggtcaaaagttgaaatttgaatcggcgaactcggtaaagttgctctcatagctttcacatatttgtgcgccctatgggtagatataagaaggaagccaacatagtctacctttctgtgagatagaagctaaagaagtttattcccatgtaactggaaaattcgaataaaatgctcataagatactgggctacatggtcattcgaatttcagaagatgaagtctatacagaggtgtgtttggagggccattcacatgaaacagtccttgcaaggttgcaagaatcaggaaccaaaatttctctcatttttctagaaatttttgcgataataacaacttgccaaatataccaagtataaaacgcaatcgctggacacacaggaagccttttgtgttcagcaatataatttcccttcatcacattgttctaaacttctaatcagttgtgtttagtttaccactgattcaccattcaccaacaacgatgtcagtcctccttttggcacagaatgactgactgataacatcgaatgctgactaaaaattagcaacggaaaacacatgacagggaaaaaaaatagagcctggttttgctgctagatcaaaattctcttctcttccaggactggaacaagcaaagcaatcgcaaacgtctctactggtaatggcagggttagagttacgcatctgaatatctctcatctcatgagagtgaagcagagagcgagagagaaaattgctctgctccgctcgtcctgtgctcccagagatttgattcgattcgattcgattcttgcccctgacttgccttgcccaaatcttggcaagcgtcgtctctgctcaccgtatgtttgattgatcgcacgtaaatcagtagtattatgggccttgaaggcccgtaatggaaaatcagcctgttgcccgggtgttgatccttgcatcatcatgctgtcttttaatagatttttttttggtggggtggggggttatagtaggcccaataccttttttttttacattggctgaataaatgattactcctacattcttggtttaacgagtctaggatttgggcggggagcatacagtctccagtcagcactagacctagcactcattgccattcgagcaagatcatgagccaccctatttctcctccttttattttgtgcacttgcacctgttggagacattgcatcacacttatttccaagctttaatggatgaatggctgaactgcaacggattatctgatgatttgggatgtgataatatttgaggtacaaccaaatggattagctgttataaatttaaaagaagtattgtagggaacttacatacgtagaaagctattattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaat

SEQ ID NO: 65287 - DNA, 6329 bp, Oryza sativa
ctagtggatcccctcggccatgtgctctaatggcgatttctcggtttgttcgcaggtgagagcgctctcctgaggcctgagggcggccttcgacgggaacctcggacgcctcaaaggttgctactacctctcctcctcctcctccccttcttcttctccgccgcgtcgatccccttccccgatcgatgcgtctacgcattggcccccttttgcatgcgcctgttgcgtgattttcctcccttaggtttgggtgattcctcctgtgtggaacgcttggcgatggctgtagtactgctaattaatttggccatggaatttttgaaggaagggcgcttgctgcgttgctgttgcctttgggaatttcccacattttattttattttcggtgatgttatggctgcgtggatttttcaccctgcgtgaaggaattaacagccaggtctatggattactggagatgcatgccatcttatctagaaattgcaagacctgactgaggcttttattgtagcaagtccttgcattggataaatgcgacaatgttgtgatcatctttctattacaattacctctcccaagtgctaatgtgtgatgtgtagcagacagtactctacacaaatgttttcaagtcacaaggtataggttcacatgactcagtgaggttcttgcacgttgcacgttttcgtcgcttttcttttcacgttctacctagttaatctgttcattttcagattatcttcctcactgtgatgacttttctttttgttcttatttgggagaaggttttataaagagccttgggattcagaaaggaaagacttagggttgcaagcgggtcaacccgtgaacccgcttataggcaaaattagtaggtaacccgtataaatgagtttatggatcgacccacttgcatctctaagtgcggcaaatcggaccacgacgtgaaaacacacgggttatcacttattttacatataagtaggtttgcgagttggcccgcttgcatccctagatgccgtcttagctcttaacaagcatgggattggggtgctgcacgccgcggcatgccagggccatctgaatgtttgcaagttcttggtggaggaattggggggtgacgtgaatattgctggaaaagaaggtcattatctaactgtaccatcctttcgtgaaattgacggttgccatgtctatgctttggcagtataatgtgccaagtgtactgatgtgctgtttattacagatataacaccgtttatggccgctgctgagtctggtgatgttcctacggtggagtattttcttgatcatagtggtgatgtaacaaaagcagatgttagaggatgcacagttctccaccatgctgctggcacaggtctcccttgatatgaacactatccatttccttgttatattaccaattatattgttgtacaagattctacgatactgcattactattaatagattacatttaatccaaccatgtcgtcacagttatcttttattgtgttgctaatctagatacttttagtttatatatcaccactcaaagttgtattggtttgctctgtttatactcgctcacatctcacatgcaatctattgtgatttgtccattgtattggtaaatgtttattcaaataactcaatttatatagtatttgtttcccccaagatttatggcccatctcattcattgcaggatgctgtaaggtaacagagttcttgctttcaaaaggaatacctgttgacatagactgtggccttggaacaccactctttcatgctgctaacaatggcaaggataagacactgaagattttgttggatcacaaggcagatgcatgtagttgctactatttcttatttcctcttctttttttttttcactgctagtttgatagctagatgtttgttttgttttccacttacatagttagctcattagctgatgtacactgatgcgtgtttgcatgggactgttctgtttgcttggattgacccattctcagatactgcagtgcataatctatcattttggtttttatttagacattttatagaggaacttagatcatatgggatttccaggtcttaaaagggattgttttttttttgtaatgaaatgaattattgtgatgagagttaggatagcgtgctacttaccctgggtagtgcgcctcccagagccccttgatcgacacagccaccccgcgcgcgtagcatcttccacctgcgttgtgattattattataccgctgacctttgagtaatacttccaagtcctaaaattgccatttggcatgctctaaataaggttggctgatgttcttttgggaaagagcatgagaatttaggtgttcaattcatggcacttatataagctattatcctgctcttttatctactcatctcttaatgattgaaatgctttaggatcatcatggcatatttgtacctccatctatctcattgctgaccttctggtttgatattgacttcactaaatgtccactaaaatctcttccattccaatgcagtaacttcagtttggcttcatgaaatttgtgtaaatgtggcattacatatatctgaactctgattataataattatggtttcatgtgtaatatattttttctattttagttaaaagtctgtaaaatatgcacataatgcaactttaattctttcaacatcgaaagttgctaacttcaacagttagacttataaaaagtggcaaacattaatcagaaaaaaaaaggttagagcattatattgcttccctttttctttcacatatttttctggttgtactgaggctaaattcttatattctgctttcagtctaacgtaattgtcaataatggagccggtagtcccctgatgagttcccttatctaccgatcattgaagtgtatgaagctactcataaaggtcagtgttttattgagtctatatttgatcaactaatgcggtgttttaattttgctaactcaagacatttgttccatgaacttatggagctaaatattctattgcacaatgcttttctcaggctggtgctgatgttaatggcaagggtacagttgtaacccctttgatgcttgctgcgtcgcaaggaggctatactaacttcattcagtttcttctgaaggctggagcaaaccctaatattcctgatgatgtatgttttctattcttctgagtcagttattggttctccactctggtctataagtctgtgattcttgtgtgttttattacaactctgattattttagggagttattttagcaataagttgaggctgttttgactaaggtcatgttactttatgattaagatacagattttacttcggttttcgttagcacatttttcaaattgttaaactatgtatttcgtgtgaaaactttatatatagaagttgctttgaaatataaaataaatccattttcaagtttaaaataattaaaactcaattaatcatacactaatggttttctcgttttacgtaccccatatttaatcttcatccttatcacatccgaacagggcttaagttaacaaaaacattgcacttatcatttgcatattttatagtttcctatggattatctgaacctgtgttcgtttatattattgtatgtgtaagtatatcttacgagttgtgcaaagcatggatgacctttcagtaaccgatgagttctcaaatccagcctatatccaaaagaccattttgatagaaggtcatatcaatgtccaaaaatcccatggccagctttgaacctaacaccatggttttttgggtcgtaatgagtcgtttggttgaaacttgaaagccccagattgtgataataggccatacactgatttcaccaatattgtttgttttaggttccttgctgaattacactgtatgaagcgacttttcttcattttgttgtgcttgtgcagttgggttggttgccaatagagcgctgcattacatgattgcagggaagaagttgaaatgctatttccattgacttcttcaattccaaatgtcccaaactggagtgtcaatggaatatcgctcatgcaaaagtcaaatacaaagccaatggtacattttatacagttacacacttttgatctttttgtactaaagatactgctatgctctctgttcatatttcgtgttgcttaccatgcactttgcattgcagagctctatttcaccacttcacgtagttctctgatgcttgttaagttgttaggctgtaaaactgggttagcttacatatcaatggcatttaatagtactagatagaaggatcatgtcttaatagtactggtttagctttgttatcatacatattcctttgaagtagaacaaacccgttttgtccttcagcctttggagtagttgtgaagtcttcaatttcgctggagtacttaataacctgactttaaaagtctggtccacatacaaattttaataataaatataagtggcatcttgagctcttcatatataataatacatctagcccatctgtctgttgacttgattgtcagcaacttagaaagtcaaatttggaccttaagttgttaattcaaatgtgaaacataaatcagagggggggggacttttcccttgtaagtatcacatattgtgacttatgtaaatgatgaaaattagagctatacttgagtggtagtgacttctgcaactgatcaaaattagagttctgtttgagttatcgatatcatcgagtacgcttaaattacagcataagaatgccacaggactaaccacaaatcatgaagaatgttggagataaagatgcttagtttctttattaatggaaatcatcctaaataaatgttctattattcaaaatttcaaaagtttacttcagattgcatcaggatactattgtttacgttgtgtttaggatcaacatcagaaggagagtagaaaagtcgttttgaaggcacaggcagatttgctattcaagcagaagaattacggcgctgcagcaaaaatatatgatctggtaatttcttgcaccttatttctgattgttaacgctaatcaattattgttgttataaagtttttgtacgttattcttaagcttgggaatgatttgtttatctgatgcttgagcataggcttgctcacggaccgactgcagttttgtacgcaaacaggagcatctgtagattgctcatgggtgatgctgaaggtgctctatctgatgcttacaaatgctgaatgatgcggcctaactgggcaaaagctcgctatcgtcagggtgcagctcacatgctacccaaggtaagactcactgcagctaacgtattgtgatccatgtattatggtccgtgtcctgatttactctaaaaccaggagtacaaacatgcgtgtgatgctctcatggatgcgcaaaaaatagatacggggaatgttgagattgagagggaactaaggcaatcttccgtttctctcgagtatgccttccaaataaaaatgtggttgcgcagggaacatgaccattagtactagcatattccgttgtgcttgtgcccacatttactgcaactgaagcaactcaacactcgactgttcttttcggttttatatgccattcttccttctttgggtcaattttacgctttgggttgttataactgacattttattcgtccaaatgttttgtaggaaagctagggaattgatggcgatacctccagatgagcagtgaggcagaataactgcataatcgtccatcagtaaactataactagctggaacttcttttcttagcgatgcactattttgttggatatgtgatgaaatgtaaagaatgcacttcacggaactctcaccaatcggcagccagcgactgtcctctcgtagtctcgtactcacctctacgatggaaaaccaaccataaatccctgttatctatctgatactactcacaacccctgaacattgtatcagttccaggcaattatcagaacatcaggcttatgaagaaggtacagtcatttttgttatgcgtgtacgaagtatattgcattgtcgtcgcacgtgaggtgctgctctatgatcgtcgcaaatgtctcgcgttttgaggtagaaaagtaggttttgggaaaaactacaatcatcatcaaagcgatggtacctgcatctcgcataatttgagaacaagcggcggcggtttccgcagaatctctagagccatcgaggcggaggctgctcaggctaacgcctgccgtcgccgagcatctgcctcgctgtctgatgatgacttgttaggccaaaatg

SEQ ID NO: 65288 - DNA, 904 bp, Oryza sativa
attcctgcagccccaaaaatgtgctgccaccacccgaggtccggcgtcctgggtctcaccagggcacatattctccgagagcgtgcctgtcgttggagaggaactgcctagtctccatcagcagcgcgccgtgccagttgcggatccggacgttggcgacatggacagcacggatgacggcgttttgttgctgcgacagcggcggtgccatggcagcggagatgagcacgcacggggagagctcgagtaagaaagaggttgaggaggtcttggtccccgacgccgtgccccaggatgccaacgccaccgacgagtccagcgtcgggaaggctagtggccgcgacagcgatggcggccgcatcgcgattagtcagcacctgcgcacctctctgtggtggtcgcagcggcgacgttctggctccgtccgcgacggaccagcggcccacgcgccgcacccgtaggctctttagtcccctccgccgtgccagtccccttcagtctccgtggctgcctgcgagggaggagaggagaaataaataatgtaactgagatgtgggccccacctaaattttactgccacgtggacgccacataagctaaaaccggactaaatactgtcttggaagtcgatttacaccggtttttgaaggtaagggagatattaaacccggttttacgattgaaagatcggattcgaccatggggaagaaatgagagaggaagatagacttactcctaagcttaactggggcgccatgtggtggcagcccaacggtcgcggtcgtgccgaccagccaagcggccacctgctacagctatcttcgccgcttagcagctcaaatgcttgatggacgtgttcgtgcacacacccagcttcatgaaatggaataagtccactttgact

SEQ ID NO: 65289 - DNA, 1528 bp, Oryza sativa
cgtctgcttttggatggttggtcggttggtccggtccccgtttgtggttgtggccgggatgcgtcgtgaacgcgtggcggcgtctcatgccaggaaccgggcgaaatgcgtagcgtcacggtgccctgaggcgtcgagatctgagtaggaatctggttttcttttggatcaataatttcctgttgcactactgagcttgtggtgtgcgagagagtaaacgccaaggatggcatgttgcaactggctagtatatactccatgtaatgtaaatacttgcattggacagcgatttcagggtcaattcaagtagaattgacacttattttgggggattagatcagtagctgtcatagttatttcaatgatgtcctgcagatcgtagtgatcttgcgaaggtctcgttgcttcgaaggatgaggatgttcaacttcgattagttggatatctctttctgttttcctgtcttgatgaatgctgttctaaaccatggtacgttggcattggggccctggtatgttctgtttctggaagtttgaagaggtcgaacagggcagggctttgctgttggagagaagactgtagagatatgctgcccattacaatgggagctaaaactatgttcttattgcactctttataatcgatcaaagaatgaaacactggtggtacacatggagattgcttccataacgttacaacaggtgatttatatagacagatacaatgccttgcagcagcaacggccaacggcgacaatggcaacacaacatagcagtatcccctactgcattggtaggttttattactgcaaaatttgacctccgcggcgttaccggtagctgcggtatacgggggtgtacatgcagctctctgcgtatttctccagatccctgggttgaggcagccgggtcgccagtcctgcacagaacgattggccgtgtcagaggccacggttttttggcacaggacctggatggtcgtggaaagtgtgactagagtaaacgacataccaagttcataggcttttgcagccacgcttgcggcaatgcgagcagaaatctttctgatgtttgtgaagggcgggaagatcgatcccttctcaaagttctcctgagtggcctgatcagctagtgtttccgctgtttacgagaatggaattagttctggtgtagtactgcggtacgcgtcataactgtttcggatttgagcaaacattcgactgagtacttacaggcagctagaagcatatcctcgtgaacacggacagctccagagattacgacaccgaggccgaatccagggaaaatgtaggcattgttcgactgttgtgaatagcgaatcaattagtaacagtcaatttctattttggctttgctgtctcttggaataagtatttaagcaaggaagcagtacctggcctggcacatgtatctttccattgtactccacagggtcaaacggactgccgctggcaaatactgcacgaccctgcaaggatacggatggatcatcatgagttatgcattat

SEQ ID NO: 65290 - DNA, 12462 bp, Oryza sativa
ttggatgcagaggtgaaatgttgcattaacagcattctattccttttggttctatacctttgaatccagcagccaaaccttcttgcggcactcctcaattggagcctttgtctgaaaaccaattgagaccagcaaagttataagccgtaagtaccataatgaattattataacagtacagcagttagattgtgaaacactatattacctgttttgaaatctcaagagcaatgagttctgcaatacagttccagcctgcatgcaaatgcatcatgttatgtgtttcagggattacgtcatgtttcaacagttgagcaaagattacaataagccgataagagaaatcttgaccaacctcaccagcaccaaggaacaaataagtgtgttcagccagggttccaccaaccacctttagtgatgataaaagacctgcaaggaccacagatgctgttccctgcaatccatacattttggtttaatttagagggcaacaaacagaacagtggaaatttattctataagaatatattgtggtgaaactaaaaatatcatggctcaaacaacacaagtggttcatttacctggatatcatcattgaaaacaagatgactcttgctgtattttgcaagcaaatcaaatgcgttgtgattggcgaagtcctcaaactggcacaaggaagattcagtttcattagcccttatattatgtctattatgaaaacaatgaaaagatcaaataataaaaatatattttactatgaggctggggcagacctgtatcagaactttctcaccatagatttgcttaacggcactcataaattcttccatgagctcatggtactcctgccatcaaggacaagacaaggttcagatcttaagttgtcaatttatacaacaccttcattactccaagcaaaccctttttggtggtaccttgccagtagcacgcctttgccggagcccaatgtagaattcatcattcaacaattgctcattgtttgtaccaacatcaatcgtgataggtaaacactacaaagtaaaagtgcaatttgcaaattcagatgatttggctgtttttacagttttctggtagaaacagccgaaaccataatgtaatggatatgaatgcttacagctgacgggcgaactcctccaagggcagtgtacagagaaagtttaccaacaggaatacccattccctgtaggaaagatcattgcaacaacaataagtaaagtttctgaagtaagcaactaatcagacaatcatacctgacaacccaaatctccaagccccaaaatgcgctcaccatcagtaacaacaataacttgaatgtttctctctggccagttccttagcacatcaagaacctttcccctagaatgcacttccagtcagtccaaatcgaataggtagagagaataaaatcaacacactattcttggatattcaagcaaagctaggcaaacatacttgtccttcaagctgacatagagaccctgtggttgtctaaatatgctcccatacttctggcaggcctcacctactgttggtgtatacaccacagggagaagctcctccacattatcaatcaaaagcttgtagaagagcctctcgttcctctcctgataaacacaaaggtattattatcatatcttcaacatgctgttcctccacattgcccaatgcccagtcatttttgttaaattgtaaatcattcaagaagtcatcaggtaaaaaagattaatttggattacctggagatccatcatggccatgtaacgctgcaaaggtacactgtactggcgaagattatgcatgatcttcttcacctgcacaaaacattaaggagggcttaaaataaacgccacagagtgataaacaggttatagttgcttattgatgtagctcgtacttgaagatcctgagacacaactgccggaggaagaaggccacgtaagtaatgagcatcccgctccttctcactaaaggcaaggcccttgttgtgatgtggatccctcaaaagggtgtaaccactgttgcacaagatcaattacatcagcaactccatttcagcatggtgaacgaaataaatcagttctcagtgcacaaaattatggccacttattcgtatgaaaaaaaaactgccaggccaacattctatagtagcacgattctccttatgagtgcctaaattggtgttttgcagtacttgctgtaagttactgttctcagctgtattttacgatctagggggataatattggtatataactcagcacatgtgtgttaaatttataattaatttccagctaaatttcattgtcaagggatggcggagaaaacaaagacagacaatattggcatggcatgggccagattagaatataccccacccacaggagtgcaggaaatataaaaagctactagtagaagaaaacaatcaaatctttttttctcagctacccgggacctactcaaaatccatccaacattaacccagttcagattactccagcagtataaattatcaaaaaaaaaaaacaccaacagtaatattctgcgaatttttttttttgaaaccgatattctgcgaataaaatgaatatactgtaaaaaaaataagaaccgtataatccgctgacttgaggcaagaaagaagaaaacaaatttgagctgaactgattgtaatatgtttcttcgtgaggagaaggctgcggtaaattacgcaaacaaacaaatgaaagggacagattcagctttggcaactgccacacgacaaagaaatcgactggatcaacacaaattcgagatttagcacgattcgagcaaacaagcaacaaaacaaaccgagctgcgagaaggcgacgcatcctcacttctaggcacgtcaaaattccaaaacggattagaatatttatcacgcgggcgaaaccgtatacctaacccagatcaacgcgcaagctgagctaaatcggcaaaaaaaaatccccaaaaaagtgcttcagatcgacgcatcgtaacgtccgccgcgaccccaccaagatccagcccccccacggcgatccgatccgattcgagcaccgctcacctcgcgacggagaaggcccatggcgtgacgggcacctcctcggtagccatgtcctcaaccccgccgccggccgccgcaacctcctccttcttctcggtctccgccgcggactccatcgcgaccgcctccaccctcctcggcgccgccgcacggaccctcaccgccgcggccctcctccgcacctccctgcagctcgtgcatccgctcccgctcccgctgctgccaccctcgccgcgcttccactgcagaggcacaaaaacacaaacacgtcacgctcgttcgttcgtatccccccccccccccaccccaaaaccccccaaaaccacacaagcaaactcctcgctcgaggggagtacgtaccagcggggaggcggcggcggcggcggcggtggcggcggcgcgcgcggacagcatggcggcgaggtcggcggaggcggtggtggttggtggggcgcgtcgcgtcctcgcgtcgccgatggctggggggaagaggaagcgagcgcgtgaggggggtaatgggagggaggaggccggtataaaaaaggaagggggttgcgttgcggaggggggcgcggcacacgtgacgtggacgaggccgtcgggtcggagtgttttacggtttattttattttacacgcgggggggaggggtatatgtggtgggttgtgcgcggtgtggtgcggtgatgtttccgcacgcctcgccggaccgggccacccggtcgcatgtcgcagtcggcgacgctcgctggatccagtacgttgtatttgcgtccattataaggttttgcataagtcggctgtgggtttaacttaacctaaacttgcggctctcacgcacgaataatctatgtattttttaataaccgaataatctatgaaaaggtaaagttatcgcactattttacttttttaaaaaattacacagcacatgctcgcacactaacccctatgaacacacacgtaaaccctgcatctatgagcatctttgaagactgagccggtaaatcctgaagattgacaaagtcaccacgggcgtctcgtcctacccttgaaagcacaataccgttaaatcctggaaaattcgctcccatgaaaagtcgagcccagcaccattttacttggtgatgcacaaatagagtagtgagattcatatataagtaaaaatgattttggtttagtatatgtatgtactctacgattgtatagttgatacaatgatattctgcgatatattatctgattatggataaatggcatctttatatcttctacgttttatatctctttgtatggctgacttgtaatattatcttggtttttagttgggggtatgtgttactaggtttattttttagggacgaagagagtgcatataaatgtataatagggtttattagtcatcttgataagccaatcaccaatataaaaatccatattccacgtctatttattactatctcgcgtataccttgatagaattaatctccatactcgacaataccattgccggctatatcccgtcgacatcattttcctaattcaattttttgttttgttcaactagtagttttcttcttctctcttaaattatcttatatgtaactttttttcttcctttcagaaactttaaaggcccgaggagaaagggaacactgagcgtaataagtgaaacttacggtaagtcggtaagtcgtatttcttgtaatggaactttgaggcataagatatttaaaattttcactcgcaattaagagggaacaaataatctttgggtctgccagattaacactagttgaattcaggaaaattgcaaatggatcatcatttttttacgcaaaaaaatatatgaaataagtttttttgaacgagaatgttcagaacaacttgaaactgtcccatagtcatagcctcacaggtctgcactgccggcatagagtacatcgaacacatcagatttatttgcttgtcacttgtccttgtcatatggctcgctaatcacctgtaggcacagcacatgcctatcaataattatgagctggttggttagaatggagcaaacccaagattgtggctccaaatcaccgtgtaattaagctttggaatgttagttgaaccgtggaccatatggccatcagcgtgtgtggttgtgtggactttgggcgtcaagccagtacacgtcgaagatcgaatcgtcgtgtgtcaattcaagccacctttggttgagcactggtaatatgtggtcctgatcactactgattccatcacacagctatatatgattccatcccacagatttgggggagggggggggggcataaaaaaagaaggcacttgccttttcctatgtgaaggtcggagtaggcatgacgatgggttgtttggttagtagctaactttgccaaaccacaagacatgtaggatcatatgactaaaaagtgtggcgagccacagttgtgataatgaaccaaacgattgtctaaaaagttatggcataactatccttagacatggcaaattgaagatagcaaccaaacagtcccgtagtatgtcttatagcggacgagaggttttcaaacttccatccggcttctactagtagtagaaaataatttgaaccattgatctcatttgatcgaaggattcggatctatttataatatcaccctactagttatccgtagaaacaaggagtggcgttattatataaaaaaaggtacataggggtataatcgttatttggcagggactattttttttattcgatgaaatataagtaatgccaacgcaatggataaccacatatcgatctagaaaaaaacataaatgaacaagttatacatattcactatattagtaaattattgattactcttaataataataaatagttcagattatttctatggtaggataatacttttcttttgcggggtactggtagagtaatactaataataagagcagcagagaatcgctgaaagaaaaaaaaacagcttcgccatacatatttgacagtaagtatatgcaaatttacaaatgcgttttgcatgactacttttactgacacggcaaaaaaacataaataaatcttcacataccgctacacttttttgcatgatactactacagctacatcccagcatgttccagcatggcgttcggggcccaattaagagcgaccggacggatcggcctagaaccaaaacgagcagatctagttccagttcattcattcgagagggcgcacacgcatgtggtggcgtatcaaaagcgtggatcggatcgatgcatcgacgcgcgcatgagcgtctcgtcgatcggctcgtcgtcgctggcgtgccacggtgccagtgctgttggctatgggctcatgcatggccaggtgggaagtgcggccaagtgggagcagctagcaagcaagtggtggtggtgtgcgagagtacgagcgtaccactccagttaggccacgggaaaggaaattcgagcgggttactgtacgattaccacgtgccgtaattttctctgttttaaagcacgatatagttcgggctacctgttactcgttccgtcctaaaatataataatgtccagatttatagctaaaatttattatatttgggacagagttccgtaaaaaaaatgttccgttaaaaaaatattttaggatggagatagtaaatcgtagggtaatggtaaccccatcccaaataatttgttaaaactcgatttggagtgcatttgctaattacggttccctttggtgtgctacacgattttttattattgtgcatatgaaaaacgaggcactccattcaaaatttgcgcaagagttccgtcaaaaaaaaagaaattgcgcaagagaaaggtgggtcttctacaattttgctgctgccacgctatttgactcatgcacagtgacctcgcgttttatggacacaatatcccaccccaattaaattgcccgtggctcgtgggggtcacacgacacgaggagagagagagagaggtgtgtgtcagtgcgatgtcgcagtctcgcagaaatctcgcacaagcgtgctactcgcttgttctaaaatatataaaaagttttgagattaaacacaattattagaaaaatatataaaattaaaataaaataatattataattagttgaaaaatgaggataaatgaaaaaaagaatgatatggaactgtgattggttggaaagaaaataaagttgttatatattgaaataaattaggagtaaaagttaagctctgtttagattccaacctattttttagactcgatcatatgaaacgtttgaacatatgtagagcctttgggagtccctgtttatgagtacaagccaaggaaaggtagacgataaaggcaaaaaacctgtgatgcagtctcggctcagttctccggacaaccatgaaaggaatcacactacgaccatgggatggacccccccgccgatgggctgggttaaagcaaatgtggatggctccttcattcaatgttcggaagctgctagtgctggaattgtcattcgtgaccacactggctcagtactgctcacttcctggagaattatcagccattgtggatcagcggaagaggcggaagcgactgcatgctgggaaggggtgaatctcgcagctgagtgggtgaaaaaaccgttaattcttgagacagactgtgccaacttggtatctatgcttacgagctctggatttgatcgagcgcagctctgccatgtcctccggagtattaaatttttactccaagcttgcctgattttcgtgtgcagaagattagaagggaatgcaatagagtagcccatgatttagctaaatttgccatgcgtacgaaccattcagctgtttggcgtatgcaggctccttcttgtgtttttggggctctggcaaatgattgtaatcacattgatgagtaatcaataaagcgttcccttcccccgcaaaaaaaatgcatgaaatattaaatatatgctaaaaaataactaataatacagattgtgactaatttgcgagataaattttttaaatctaattgctccatgatctgataatatggtgttacagtaaacatttaataataatatattaattaggcttaataaatttatctcgcaatataaaagcgaaatttataatttattttattattactataaatttaatattttaaatatatgttcatatatgtgatttgatacgaaaaaacttttaaacccttatctaaagacagccttttggagtagtactctccccgcaggcggtgcgcaagcacaagcagaagcaaagcggacgcgtggcgcgaaaggggggcgcgcattcactggcgcgccgcggcgagtagccccgcaaaggggtgggcccctgcgccgaccgcttctcggtccccctcccaatcctcccccctcactcaccgcgagcccccaaaccgaaggacactgaccaatggtccccacagggaaaagtggcccacacggcagcgaccggatgaacgcgacgagaaggtacgaggcgggggcggggccgggagagaaaagtggacaggagttggggagttgaggcctcccctgggtgccgccctcgcgcctcggcctcgcccgacgcgaccggtccacacgtgatactggacttccctttctctctctccgccgttgcttcctccgctgcttcttgtttgttttgttttgtttgtagcggtggatggagatggatggtagtgctagtgcgttgcgtaggcccgtacgtgcaggaaatgggcaatactcctcctacgacgatgctagtactgcagtttcgtccgtgacgattactcgttattattcctaccgtcctacgcactcctactcccgtattagtactagtattaagactcacaatgcatggatttcacatttttcgagtttgcctcggccggcagggggcggctactgataccacatcacagccactcgatccatgcatgcaccgatcgaatcccagggaaaaccacacacacatagagatctcgatcgggcggtggcacagtacgcaacgtgctccggttttgttgggtccccgttcgtacgatctttcgcgcacgcggacgcagcgtgcgtgcaccgcaccagtccctcccactctggtttcgcattgatccgttttgatcggtcgcgcttccccgatcgctacatatgcacgctgcccagcagctctctgtaaaggctgctgctagcgttaaatacaccaaaactgcctaacaacaaattccaactactcctacatccccaaatgatttatttcttctttttttttcttctactttttatttgaggaaatatcgcatggttaacttgttactccctccgtcccataatataagtgattttgatttttttcttgcaacatttgaccactcgtcttatttaattttttttgcaaatataaaaaataaaaagttgtgcttaaagtattatagataatactgttagtcgctaattatatttatcatcgtttctcactattttatataagccgagttggtctaacgttgtaaaccaacactcctcctccttatattatgagacggagggagtagttccctactgcaccgtgctcggagaattctgggctccatcttttgacctaaataagccaaagtctcattccaaatttattttgactttgatttgaagacattttccacacagttttttttatgttggcttttacaacgttaagaacatacatatagaagttttactgttttattattaggaaatgtgggtaactgatgaggctgtctgatgcaaagtggtcgctgtttcactttgtgattttacatctgctgtcgtctcttctgcactgctgacctggagtgttggtcgctgcatttgcatccgacgaacgctgcgtgtatgctactccatgtttctgcagtttcagctggatgcctggatcgctatcagagtcgagtgggtttgcatgattaattgcgagaggcacccatcgttttccccggtgcagccaaggattcccctactgagctcgctactgattcgactagatcctcttaattctcatcgcttaatgtcgccgaatccaattattgccaaaaaaagataaatcatcattgcatctgtgaaccttattggacacccataggcaaattcgatggaggagttagcaaggccaggagcaaaaatatgtaagacaagcagggatatccttttcctcgccgtcgaaagaactattgtatgagtattacaaaaaaacttaaaagaaaaaaatgcgacgaatatgtgctttggtttctggttagaggctcaacaacaatcaactgaatctttcccggtccacccaacaaaagacctgaaaggtgcctgcattaatttgtttatcttctcttttctgcagccgtgaatggacaaatggagatggaaatgaggcgtaggagtactacatgcagatgcagcttcacacgagatggaaaaattagctgctgagtgcgtgctgactggacagccatcgatttcgatatgtacacatgacgacgagaccgattctgctaaaccagtcagcgcatgtgttccaggaagcgacttttttatttttatgtgaaacgacagtgtccagcttcagtgacgcacgggtcacgcaaactatgaatctgacatcttaaaacttggcgactctgctattaattgattattacgtgaagatacacgcgattcgccgttcagttttgtacagatactgcccaatatacaaagttggtcatcactcaccagcttaatcagtcgaccaccgatagccagccagaggagaattaagtaatttaatggtgaaagatactagcagctgatctcctggtaacagttcattcaatctcatacaggccattacatcatacaataccagctactaacatgtgcagttagcacaagagaaagatcatgatcagtggatgcaaataaagtaattaaagcacacgactacacgagcttggtgttaatttatggggggcaggagaatttcgatcttgagactgctgctaagtcttaaactgcactagctgccaatggcttgagacggcagagtcaaaatctatggacggcgaggagagtttttgttggggggtttgagcacagtacagcccggacagcccatcaggcccacggtttggagaccattttgtagtgggcttcgtcacagagcatgaccgttagtaggtcctgagcatttaaaatggggacgttgattgagaactgccgttgcaaattctacctgcaggtagcacactgaaaagccgaaatcatgcactgaattcgtaggattcttttctagtcaagatacagattttatctcgattatcaatagcatgctttttaaactattaaacggtacgttctatacgaaaactttctatatatagaagttgcttttaaatatgaaatatatccatttgtcaagtttgtaacaattaaaacttaattaattatatgctaatagctttctcattttacgtgcatcaacttaacattcttaatcagtttcaaacaccacagttacgtacacgtactactccattagtggtactccagttaggctcacgtcgcttgtatgtactactcccttcatctcataatataaggtgcccacacattttaagattttacattcaaaatattttgaccaatatttagtacaatatgaattgaattttacttgctaaaaattatatcattgaaattgaattcacatttgaatttactttcatatgattataattttgttactataaaccttatagtatatgagtaagacaaacattttatggagaccgtgttaagttcgaccatgtcttatattatgggatagagggagtatgatctaatataccttatacgcttatgcagactacacgacacaatctgcgttgatcttaatatattgaagtggtggatttatgtattttagactctgctgaataaactttgccggacagtgaactgtagtcacgaatacatcagcatcggtcgccaattaacgagttggtgtcaactttttttttttctgggtgggttgggatcagcttttcgatctgatcaatctcgcttgatgagttgcttcctggtcatggcgttctccaatctcagtcaggactttaggcaaccatataaattgccacgatccatctcaaattccatcacgaaaacctcaacatgccttccaaattgaaggcactcgttaattaagcagtagtgctaggaatgatggaatcgagtgaccaatcaatagtcaattaggacctgtttggtacacctcaaacttctaagtttaactctaagagttgggtttggagtggagttg

SEQ ID NO: 65291 - DNA, 4720 bp, Oryza sativa
cgatcgatcgagatggtgttcgtcagttttgtgcacgcatgaacaagtccatctgcgatgctgcggcccactatagcatagcatacacaagttgggccgggcccatctctgttttctttgggaatacacgaggggagtcccgtacatctcgtgatcgatgttgatgaggaactgcatcaaagcatgcaaattctacatgctaacatactgacaaagtctgaaattaaagccaaaaatcataagttgcaggttcggcaattgaggcattgacgttcgattcgaacaaccatgcatataaactgcctcacatctactaatctcatctcccatcgcctcaaagctcaatgctctgatagcgttcccgtggaggcggacgccgatcgatcaaggtcaccgaggagagagaggaggagggtcggaatttaattcaccgaagcccaccagctgatgaattgctggtcatggcgttctccagatgccgctcgtcctccgcgtcggtgtactgttcagcatgttagcaagcgagaatcatgaaatgtatccgacagaattgtcagaattggaattggctctttgtttgagtagggatcggagttttgttctccgaccaacaccccagtttgcgtgggctttgtaataatggcgcccttcgatcatctctgatcgagcgggccttgcacacacccggggcacaactgtcaacactgttgctctggaagaaatagaaaacgatacgagtgaaaatagaacagacaaatccacacatttcaaatcgacaagaaacctagatgcacatgtatttctaatttcatgatgaaactaggcggtgacgtgtcacggacctggatcatctccaatacttattttggtgtgaaggaattgtggccaaactgacctctcgttcttttttcgcaggaggttcggagtttctttttccgaacccctgccttacatattatatggacaatgtgagggtttggagttttgttttccgaccccagtctcccgtgcttcttgtgatcgattttgatggacaactgcaccatctatcatgaaaattctacatgcttgcatactgaaagtctgaaagccaagatcatataggctcaaattgcaggttcgggccattgacattcgaacaatcccaaattatatctactatatatccacgcaaaacggtgtgggggaatgatatagcgaaattggtatacaagagacagcaatctggaatttggtaaagttggagttttaagctttggtggtggttcgtgctcttcaaaattgaaggtctgtatatgtatattttatcctccactgattaaatttttgcatgacatctaggagtggcaacggggcgggttagagatggtttgggccagaacgccaccaccgagtgtgcgcgtgttatgaacaactatgttcatactgtattttttttttaaaaaaaagtgcatgatagtgaactgtagcgacgaatacatcagcatcgatcgccaatttaccagtatactttttttgtttttttggaaatcccatcttcccattctcttcgatctcgatcgcatcatgagttgctggccatagcggtccttccaaaaaccttttgatggtttttccagacaggtaagatggcatttcgctggagatgaaggagagcccctcagacatccttctggcagtagaagagcttcctttgttggaataaccggtacaatctagtagaaccttcttcttcatgtgcaccttgatcatccacgttgtggcattggggtcagcagtgtggtagcgctcgttcaacaagaagcaaacggcgtaagggttttccatatcaacaacggggaattcaggtcggacatttggaaggcggttttcagaatcgagttcccaaagttgggcagcatccaatgttgcatcttctcgccatgtctgatcctcgtgccacgaccacagggtgatgctgaagcttctgctgctgctgccgccatgttggttaacattgacgaacttgatgccatggtgggtggcacacagactacgggaggcttgagggcatcctcgcccacgatcaatgtcagcaactggatcgaccggaagtggcacgtaccatagaacaggctccggtgggtcaacccttcctggatgttctacattggcgacgatcatccctgctaccaagtagtccacccagatcatgtagcgatcgtggcacgacaacaccgcatcagtcgtccagcagcacaggtgagcgagggcgtcgccatggcggatcggcacattcctgaagactctccagtcgtcagagccagaagcgaagaggtagacgttggtttcggaagattggcatgatcttctctcgagctcagccacaacgaacgacgaagaattcttgctgccgcaggacaaaatacatgtgccttccctgctcatgatgcgcgggcggatggtgtctcccctcctccagtaggaaacgggcagccgcgtcaaggaggggtggtggttgctgctgctgctgcggctggcattgtagacgaagtagtcgatggcggaagggcgagcgtgcttgtcgggggagacgatctggaacaggacgacgttgccgtgcgcggcgatgacgtatgggtaggatgtggttcccagcgacgggcggggcccctgcggccagtcgagggtgaggagggaggtctccggcggcttcacgagctcgaaggagacggagatctggtcgccgccggaggtgtaggagaccgccgacgtggtgcggtcgcggtcgtcgcggcggaaggaatccctccgggcgccgtaccgattcaggatcgcccaggtcgaggtcggattggaggcgccggcggcgtcgtccaacgatagggttgaggaggatcgcttcagcggccgcccgggaatctccgtctccttggtcggcgttggtccgcgacgggatgcgtcggccctggcccgcgaaccgtcggacgatcccttgcgccgcctgtggctgggaatccgtgtccccgtccccgtctccgtctccgtggtggggatccgcatggcggcggcggcggcgagggttctgtgtttggttcgcgaaagagaaattaaacaaaggcgagacgaacataaacttggctcgttggaggagtatttgggttggggaaagtcgggttaaataactcttcagtgcaacccgattcggatacccgagtcggggagggagaagcgcgataggcaggactcatccaagtcgttagatcgaaacatccaacggtcaaaaaaaatccaagagctcattgctcggactcggatatgctgtgttcgggaggtaactctccagctcccgcgcacgcagaacggaacgactcgtattttgttataattcattaagtactattaattttattaaaaaatagattaatataattttttaaagcagcttttgtttaaaaatcttttgtgaaaaacacatcatttagcaatttaaaaagtgtgcgcgcgtaaaacgaggaatgtgacttattctatgctgtgcggagtcatggcctcatgggtctaggcggttcgtgtttggatcctaccctctctatccaaatatataccaacccaagaccaaatttgacgtatcataggcctacaaatctaaacatatatattcaggttcgcatttctcaaatccagtcgtatgttattatatatcacgatagagtaagattgcacgattgaaatttctcggggtgcgactctaatctaggtaaaatttttagcgcacataaaacgagaaacctcattagctgacgattgaaatttttattatttgtgtgtgcaactgacatgtgggtcccacatgtttttttttcagatctaattgccatgtaagcgctatgttaatgacacgttaggcaaagacttagtcaaaagaagccacgtaggcgttaaaaccggacacaatacggccgatggatcttatttaaacggttttgtaagttggggacctgttttgcaatgaagtgatgaaaatcggaatgggcgaaaaatagagggacccaaagtgaacttattcctctcctgaccgactcggactctcccaacctcccagccaggcccagcaattgcgttggcacttggccacttggggtcacccgtatccgtatcgggttgcactgaagagtagctgggactgtctatccatttgagagatggatagcaaaatcgagagtggtttatcttcgcctcgcctttgttttccctttcgcgcaccaaatacgtcatggccgcgcacgacgtgtgggtaggatgtggttcccaccgaggggcgggtctgccattgcttgatggagttagaagacagtagcattttcgtcaaaaaaaaaaactaaaaactgcatggatctaattaaccttcttttttttttcggtcattgcaaactttcatcgtccgattgtgaggccatacacgagagccacacgtcgttgccctagaagaaataggaaaaatatacggatgaaaatggaacagaatcgcatatttcaaagagacaagaaaccaaatgtgcatctaatttcaagaggaataagttcactttgacttccttaaaagtggtccgagtctaatttataacacttaaccgcaaaaccagatattttgacttctaaactgttaaaatcggtacaatttaactccttcaatggttttggaggacggttttactgacgtagcgtctacgtggcgata

SEQ ID NO: 65292 - DNA, 1097 bp, Oryza sativa
gtggcacttacgtgacaatagaattaaaaaatatgcgttggacccattagtcattcacgtaaaaagaaatgtgggcacaccctgtctccttccttcttcctcttccctctctccctttctctctctttctctcctcttcttcttcccctagcacggtggcggcggcgacgaagttgcacgacgcgtcggtgcggcggaggtggggcgcgaggaaggaggagaggcggcggacctggcggtgcgcgggggtgccgaaggagggagggcaatgcggtgagaattggagggggcggcgccgaacggcgggtgggggagggggttgaagggcgacaaggtcacagtcggagtggaggagggggtgtaggtgctggttgttgcgtcggcggcggcgacatggaggtgctcttcgagctcgtcgcggttggaggagcggagctcaatgctggctcgacgacgacggctccaccgacagcgtctgcggtcgtgcggaggtcgacgacggctccaccgccagcggcaggttctggagggtgaagaaggtactcaacctggggttagagcagcggctacgcgattccatcgccatcgtccacgacttcgtgaacgcatcatctggtagcggcaggagcagatccgccgctggtgccaacctacctccctcgtttcccccaaccccaagtatctccgccgccagcgccattctccactgacgccgtagctctatggccctctccgatggcggtgactgcctcgccccagcttgacggcctgcctcctcctatggctccggcgctgccattggtgccgacccacccaacttctaccatgctcgagttgaggccgtgacggaggaggagcaagagtggacgcctcggcctcgacctccctaggtcccgctggccgacgcccctctaccgccacccagctgacgcgacgccgccgctcccctcgttgtcccatcgtcgctgctgtgtagaagaggatacgtgccagcctgccaggggaggagaggagggggtgaagggaaagaggaagaagagagtgataaggggaagagggagatgacatgtgggccccacatgttaagtcagaccggg

SEQ ID NO: 65293 - DNA, 793 bp, Oryza sativa
caaccattgaaagccactctgcacaatgaattgttgcttccacatcctaaattgtcacagcaacaaaaaattatgaggaaataggccaaaatcagcaatgatacaagcatcacaaacacaaataagagaggaaggttgggatggcaacagcggaaaagattttctgcataggatgctctacaaaagaaaaatagcttgccttccacccatctttttgccgcattgaatgctccaacatgataatcaggaaattgtgtatgaggtcttcaatatcaccaatgcttatgccatcagcatatttcttagcacccatctataattagaaatttgtgaattagatcaatgggtagtggacagcacaaaatgtagcatgattcttcttgcaatatattctgacataaaaaaaaggcctacgatacttacctcatgattataaatcaaaacctccaaaatccattctggccattctgaaattgaggtcatcgtggttctattctctggatgactgcaagccaaaaacagaagatcctgaaataatatagagggaaattttgacaccataagaaatttaaacaggtaaggtcgcaaacaaggtttcaggaaaaaacaaagaatagataacagcaaacagtactgatgagcaaaaataataaaaaaaaaacaccaaacagtactaacatagaggttatatgtgggcatataatgcaatggaagtgaatatgattgtgcagccatgcaggtgtttggttaaaagcataagaatatagttaaacacggcatggaatattcgggc

SEQ ID NO: 65294 - DNA, 1304 bp, Oryza sativa
agcaggtttgtccccccccccttttgttgccggagtagtttaccccttttcccacattaacatcaacttatatgttttaggtccaatttacacatccttgttggttccagttttagtgaaataggtatagatacagaaatgttatgttactcaaactcctgaacacattatttaaattcttgctctggacaaaacaaattgttatgctcaaagtcatataactaatgtgcctttgaccaataaaaaaagggctctgatttctcttaggacctttaacttttcaatggcccgctttggttcagaaactttcatttaatggtctgtaaatagtatctttaaaaagttttggttgtccagcaattttctcaatttgtttccataatagcatccttgaaaaaaaattcagtctgaacacaaactgtatcctaaagtcgaatgaccaaaatagggcttttcccatagcaaaacataagagttctcaaaaatgaggtgggagctcttgagagcaagctgctaactgtagtttctaccaagaaattgtatttactcacaggtgaatcatatcttcaatgccagtagtttctgtcaattgttgataaatctttgtgatgacactctcttgagtcatctatacccttttcagtgtgcaaagtaattgatatatcatgttccttgttgctgaaatgatgtcagattattgatttttgatatgtactgggctaaccgaatgtcaaaaaattcccaagcttcctcatagtggcactttgacacgttcggtcatgtacatgattttattgatagtatcttcttttgaactgtaggcactcaccgaaggcctgcagaagttcttgggttggttcatgtttcatctcgtgtgcggcctgcggagtctttatgggccttagcctatgggggtccaatggctttacttccgttgactataagcaatgtgcagatggatagtcttgaacctatgcttggtgaattgtcgattgccactgcttctctttctgccccaattttcaggattatttccctggctattcagcatcctggaaataatgaagaattatgtcggacatgttcaccggagattttgtcacgtgttttacattaccaattacaagcatttccaaagatggaaggtggagagggggaggcagtgactgatgaggagctagttgatgcaattgtatccttgtgccaatctcaaagaaacaaccatgagcttaaagtgcagcttttcagtactttgctgttggacctgaagatgtggagttcatgtacttatggtttacagaaga

SEQ ID NO: 65295 - DNA, 725 bp, Oryza sativa
attcctgcgccccggttcacgtcctctgtaacaatgatattacacatgtgtgtaaaataataagaaaaagtgatttcatcccttgaagggataacccctcatttagtgcatgtcacctaaatggtcataaaaaatataaaaaaatagcagcatagattaatataaaatatatcacttcacaaacatgcaagtttaaattcaactgttataagttgtaacaaagataaaaaaaatatagttgcgaatgtgcaataactatttttagtctaacttgttatttttgttgcaacatgtataggttaaatttgattttatatgtttgtggagtgatatatttcgtattaatatatttactattttttttaaaaaaatttgataactatttagatgacatgcagacaacgaggtaatattcctcgagagatgaaaatccacatcctgataataacatttatgatagaggactctcatcccgtcgtgtcacctaacgcatgcaggttgtacttcaagtgcacgttcagccgcgagcggagttgcgcggcgaagaagcaagtgcagcagcgggacgccggcgagccgcccatgttccttgtcacctacctcaacgagcacacgtgccagcagccgcaagctgttcccggcacgcccaacactgcaggtagctcgccgacgacgacgagccggcaacgacagtcgtcctcctcccgccggcggaaatgttggac

SEQ ID NO: 65296 - DNA, 717 bp, Oryza sativa
ccactagctcagtcgatgggataattgcagtattagacattctagtatcttgttgagccgcgtgctcgagacatctggccatgttttatggtcgtaattatccaactaaaatgcgactgaatggtgggctgtgggtgcgtggttttgtgagtcgcacccatggcaattaaggaccggttcacgggaaaccctggaagacttacagcgcttgccacaagcgggagtgggtaactgcttgatctgaagtatagctcgcccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacacggtgacgtgtgcatcatgggcacatgatgacgcggtgacatgtcggtgggttgtgtcttgtgggtacagttgtgcacctctggccagagtaaaactattcgaatagccgtgccgcggttatgggcgatcgaccagattcaccgtgattagtctcacacttaataaatcgacccaatacactgtagtttaggtgggttggttgggcctgttcaacgtggtgtagcgttgatcagtggagatttaatgttactttaattactca

SEQ ID NO: 65297 - DNA, 726 bp, Oryza sativa
aaagctacgcgtgtcaactgcaccaagcaaactttctgcaaaaattaccaagaagtacgcaattttgcttctctttgttacctgtcatcttgttttagaatataaaacaaacacttcaagaacatgaaatacattcagtgtgattgcatgatagaagttgcagtaacccataggcactgttagtgttacgcctgctaccataatgcctctaattctctttacgtaatctgccaaaataccaatattttgaatattatccccttgattctgtattgctgtctgatatcagattcaaggagaagagctatggtagcagtggtgcaacatcggggctgacttctagtttggcgtttacaccagttcaggtaaattaaagattttttagctgtctcgtttgcttcaaagataaataaacggtatgcttaatctttagttgttttgacttgggtcatggaaaaggtagtacatgtaatttttgtttatcaatagcttcaccagtagaactcttctaaattaggtgtattctgctatgctgctggttattgcacagcttcgtggattttatgttgctattcttgtacggtaagttgggtactgcacaccattgcatggttggttttgtcttgaaatctgacgctgtatgttttgtaggctaatatcagagttgatatgcgcctgcattgtaacatatttgcaattacatcgattagtatttttaatgtaact

SEQ ID NO: 65298 - DNA, 705 bp, Oryza sativa
ctgcagccctgaccatgtacatatcgggatctttcaaaggttggtctgacagttgtttctatatttttgcctatctaggatgctaaccgttgtgagtattatttgatgcagccgattggtgcactaaaccctgagcgactagaaaaattccaagagcgctactctacgtttgaggatccaatcatcccaaagttccattatggttcacattactccagtgctggcacggtacatcttaaagctgaatcaaatgtttatttattactccctccatcctaaaatataacaacttcaatatgttgtttgattttttttattcaatgtatatcttggttgataacaatacatatccgttgcaggtcttgtattaccttttcagggtggaaccttatactacgctctcaatacagctgcaaggcggcaaatttgatcatgctgatcgtatgttttctgatctatctggtacatgggacagtgttcttgaagacatgagtgatgtaaaagagctagtaagtcttaccagcaatttgttttcctgagtaggcagcgccgaaatccagtcaagatcttttgctgcaatataactatctgatgatatttatcaggtccctgagatgttttacctccctgaagtatttaccaatataaattctatcgacttcgggacaactcagcttggaggaaagctaggtacttgtatttcag

SEQ ID NO: 65299 - DNA, 3285 bp, Oryza sativa
tagaatggtcctgttggatcatcatatcaatgaattattgaaatttagcatttatgaatgatgtagggtgatataggacttctgtttagtatttttaagaagccaattctattttttttctcctcgcatatcaccatttacctaggaatatttcttttgcagatttaaacagaggggtaaagaagcagtaatggccaacaatgtgttcttctacattacatatgaaggaactgtggacattgacaaaatcacagatccagtaagtactagtatgcgctcaagctagtgcttggtttcccgtgttgtcatctatctgctcatatttttttaaaactgaaaatgctgaaggtgcaacggcaagccatgcaagatcaaattgcttactttggacaaacaccatctcaattgctaactattccccacatgaggagaaagccattggcagaagttttacatctacaggtaatctatattaaaccctggctattgagaacaacccccaaagcaaacgattcaaagcatttctttgaacagaaccaaattattccaccttggatgaggagtattgtcaaatagaagtcaagtaaacagattcaagttacctggtgtggaacactggaaagtagttcaaattgaacccaaaagcattagctggcaatttaattaagtttgggttgtgtagctaactagttttcacatggtggagctggtattccatgttcaagagtagacattacttgcggcctgcctcactgttttttacatggactgacccttttatttgctgtgcagactatattccggaatccaagtgaacttaaatcatatttacttccaaatccagatcgctgcaatgttccggccagtaccatgtttgtatccaatgactctattgtagttgtagatgtaaatgtgcctgctgctcatgtggcacttcaccattggcaaccaaatactccagatggccaaggggacaccctttctatttcatcatggtagaaatgctgcaaattcaaccggtggtgcactgatgcgcatttttaaaggatctgctagttctggagaagattatgacttcccaagagctatagcatttgctgcttctggcatccgtagttcagcagttgttgctgtcacatgtgacaaagagattatcactggtaattgtttcttttgactgtttatgctttagcttctatatgtattttttttgttcatttagatgatctttcctcttcatccatcattttctttccattttctggggaattctctgcttactagtggaggatgagacatcctacctgctagatttggggggagtttatagattcataatcattttcttaccagacagattcgttatcatgagccaatgaagttcatatgtgctagacattcactaacgtacaagaaaggcattaaatggaacacagcatggagttgtggattcatattgtaatgtaaaaagtcacgcgcatgtaagcaatgtagtttaagattgccttgtgagttgtgacaacacttcgaatccaaagatgcaaatttgccctttatatcttgcatatattggatttaaattaaaatactgaacacctgttgcgctagataaagtcaagcaaacagcttgatctgaaacttctggatttttttctcgaataaaaacttctggattttttttctcaaatagaaacttctggattttaatgaagtgttatggtaggcagcttccattatttaatgattttttttatgaagtttcgtctgctttctaataccattttactcaataataggtgggcatgctgatggttctgtgaagttgatctccccagatggagcgaagactattgaaactgctactggacatcttgctcctgttacctgccttgcactttctcatgatagcaactaccttgtaacagggtctcgagataccacagttatactctggaggattcatcaggcaggctccttacataagaaaaatgcccctgagcctccaccaacaactccgacaacaccacgcagtcctagtgtgagcaaccttacagaaatcaggaggcgtcgaattgaaggtcctatgcatgtattgagaggacatcttgaggaagtgactagctgttcagtcagtcctgacttgggacttgttgtatcctcatcaaacatgtcaggtgttcttctacattctttgaggactggtcgtctgataaggaagcttaatgtagcggaggcacatgctgtatgcttatcttctcaaggggtcattctggtttggaatgaatcaaagaaaagactatctacattcactgtcaatggactccctattgctaccacagttctatcacctttttgtggacgggttagttgcattgagatttctactgatggccatttcgccttaatgggaacatgttcttcaagcaattataagtgtgaggacagtactgagactggggatcatgaacctaatgaaccaaatggcaaggatggcatatctaaacaagctgaaactaggcaatctgttcatgtgccttctgtatgctttgttgatctgcataaacttaaggttagtgtcacaagcaaaaaaaaaaggggggggcttatttttcatttgtggtaaccttaccagaaatattttactggcaggtatttcatacaatggagctggggaaaggccaggacgtcacagcaatcgctctaaacaaagagaacacaaatcttctactgtctactgctgataagcagctaatagtgttcactgatcctgctgtgagtaccataaattcctgatgtatcaaaatccatttagcacttgcttttccataaagtacttacgttgccacttaaccttcgttctaatagagctggtaatgttgcagttgagcttgaaggtagtggatcagatgttacgtcttggttgggaaggtgacgggcttcttcagtcatgagcaaaaagcatttattttggtaaatcattactagcttaaagatcattttctgttcgtgttagcataatgaatcgatggctcgagatgtactatctgtacaaagtggataagtaataggacctgcgagttaggctgagcaaaggctaggtcgtacaccatatccagcagatcatattattcagcgaactgctgagtaaacgaactttatcgagtagccctgtaaaaatcccgatggtttttctttttgtagaatgggtgaatagtcattttacattgtttgcagcgttgtatccatttttggttgctcggttcagacagttttctgtcttacaat

SEQ ID NO: 65300 - DNA, 5440 bp, Oryza sativa
  unsure (1)..(5440): unsure at all n locations
attagtagaacacacaattaaataagagaatgtttattgtttgtttttcgcttgagaaaaaaaaagaggaggttaaagatggcctgcctttctttcatttttcgaagccgccgaccccctctcttctttttaggctcaaagtctggaacaggaagtggttttggaagctttgcaggaggcggttcttgccacttctcaatcttcttacggatttcttctaacaagttacgcccagcttttcctgttggatcacctctgatcgaatcaatccttgctgctagagttgactttgcagctataagtctgcaagcacgagtcctcagagctggtggggtactctggaatacatcggtttgttcaagatagccaacacgaaactgagatgtggcagtagaaaacccagcaagatttttcctcttagcaccaagtaactgaacgttacaagcaggcatttttgcaagtgctcccaaaccaccagcagttcccatcaacttcgaggcaacagcgctgccaacaatggcagacaggtttggtgcaatgtaacccattctgctctctacaaattcaagtaccttcttctttgcagcatcaagagtaagggctctctcacatgcttcaatagtttttaccaagttctcctcggaaagcggcttcccacttgtcgttgatgctgtcgtgaaattaccattataattgcagaaggtaaaagcctttccagatctacaagcgttaaatccatctcatttccaatcttctggacaacccgagcataatcgatcggatgatgaacaagggattctagttcaggaaacttcagcctatacttgtcacgtatgaaattatggattataatgatctcattctcaatatctactgatagagcattgcaatcaacaatcagctggtattctggatcttcctccaggatcgacctttgattggaaaaatctgtacctttctgaagtgcattttcaactttctgcaaacaaagagtgattctgtaagttgccatgtatggaaacaaaaggctttgttacctaaaaatacaaatgacagtcccctttagaatcaaatttagaaggattgtactttttgcgcaaagcatttgtaacattgagtatatagttaaacatgtcttggactctaaaacacacccattaatgtttgactgcaaatagccttcttgtgacaataggacagtacagggcttcaaaatcagaaaactagaagaaagaagtcaaacaacaatccaattaaaacaagaggacaaaaccatcttcaagaaaaaggagattttgagcttgatcacatacttgcataatgtcattgtaacgttgtgttttctgaagctttgaaacactatcaaggtcatcataattaagagactcgaggtcaggcatatcatcatcaccaatctcttccgtgcccactgcctcagcattttcttcctcctgaaatttgatgattagttaacaaattctcaataaataaatcattgtaaaatctgtattatcatagtaactgaaaccaactcacaggataggcttcattgtctgaaagttcatcaagatccgctaagaaagaatcagcaaggcttgcctgtaaaatggcactgtttataaaaatggaacacatcacacatgaccacagaacagaagaaacatacctgaacagaaccgaatgtcaaagtaaacaaacttgcacatggttacttaacaggacctgaagtgaatttatgaactcaccatgatcttaggttcttgtccgaagtcttccaagcagcagcaagagctccaactgtagacctagcaagagaagttacaaaattacttctgattttctacgcttcacatgccatgtttggcttttctgcactaagcaggatatcagattgcaactgaagtgccgtcctatcaggctagcgcaaatagggagcatccctattccccaagcagacgctgcatctacacattctgagactaccaattggcagcggagcgcaaggggacggctaacgcttccactgtcggaatctacctacagcctacaggatacagtatccgggatgctntagaagcttcgaatcgccggaaatttagagacccctcggaagaacagtaacagccatacctttgcagcgcaggcgcagcagcttctctctcgcgctgccctagtacgggtcgcggttccgcacgctctccgcgaggctggatacgcgcccgtgaggccgcggcggcgaggcggactctccggcgagccggtgggatacagggggcggcggcggaggaggcggaggagggaggacccaaatctgctcgagtttgggccggaacctttttgagagggggacgcaccggcattggcagggaaggtcggtggagtcagcttctgagttctgatcctgtcctttcgtttcgcatctgacgtcccggaaaatttcggccagttcagcctggagctgtatcaggctcggcccaactgaaaggtacctgtaaaaaaggcccagctgagaagtgaacggggctatataggaagggttatatataattggaattggatttttcatacaacttttgacttctataattatgcaaatatatttgtaatttatatacaacagatttttaaaaggttcctcgtcgtggaccaaagtaacactggactacgactaaggttcccctaaaatagcacctaagataagaacacaggtatgttcatatgttgtcatgatccgatcaacaaagactaaaccataggttttcactgtagagagcaattcttaaaagtctagacaacacccccacaaggaagaggaaactgctatttgcccggtataactagctaaggctaaatccagatattcatttttttgaaaggagggtaaaagctttgcctcgtatattaatagaggagcagaaatacaagagaaatatgtacagggtcagccaaaaagccaacctgcaaagggaaaaacactaggtgatatctggatattcataacctacgagttgaggaaacggtactcgacgagcaccacctaagcgaagtctcatagtattgttattctcttgttccgagctagtgccataatgcctcccagtattagcacaatccaatcgaccataaacaccataccctataaccttgtttagacgtgataccctacaataatcgcgctgcgagcaaaccaatatataggcacacactcacaaatccatagtgtccatctagagaacgagtaagatgtggacataagcgatattgtcaatcaaaaccaagatagcaccaatctataggttgtgtggaagaccttgaatatcgatgaaaacattatttagaagtacacgttaggtggcagcagtcaaggtcggatgtaggcgtgatgccccaagccaggccccgttgccgatgtcgtcaactagcacgctgccagtggcacaacagcggttggtgatgtcatgctgcttgtatctagctagatttggacgctcctatatcaacttcttggcacacaagacgcccgatgatatctctgtaccctatcgctgttgcacctcggatgacgacacaacataagacggggagaagatcatctaccatgtgtgtgccaaagtgccagatcaatgctggagacgtccgatccatggttggctccctaggcagtcgagggggaggggaagtaggatgaaacatataatagagtcctactgccatcggccatcgccattgtgtttgtcagaaaccaatgaggatgaagagcatggtgtagcggtttggatatctttcgtggggtgacggcgctagagtttcatcctaggagatgaattaaatgtcgagcttggtgaaaatttttagtctccagagtgaatatggtgccttattttcaaattatttttatagtataataatataatagacaattatttaacacctcactctttttaataatagaaatgatttatatccatggcttctccataaagcacacaacggttggttgttcaacaaataaaaaatagatataggtgatagggtaaacctctaattctttttcattgttgactaacattaaaccacatagattctagttacctatttttattaatagaactgcactacccaaggtgaattaagagccacctcatactgtttagtctttactccacttgttcagaagatttccaattataaactctattctaatttctactacgtgaagaatacatagagagaaggccaattcttaaatgttggagtacatgcccgaacatgggtgaggatgatggtgagatgctgatataaaacaagtcaagacacttatccggttgctccttgtcaagtgctggagttttcttttccgacctacgggacgacgggaagcatgctgagctgctgctgatcagcgatcaattcagcatcgtcactatggtcgatcgaattatttgtttccgcgactccgaggacaggtcggaaccgaacctcccgatgagacgagaagaaaacggctccacgactgcaccacacatgccagtagccacgcgtccacgccagtgcacagtcccggagtacttgcctgctccgctccgtttcgtcggacgaacgtcggtctgtcacgctcgaaccggcgcgcgagtgcatcccctcgcgggcgcggtgaaaactgagcgcgaccggccctagagattcgtcactccgccaagcgatccagatacgcgcgctgccacgccgtaagcgtaacgtcgctgtacggcgttctcatccaagagttgcccgtccgcgcgcgcgcgtggtatctctatcccctcggaaactcgtggccaggcgctgcgcgtacgtgcgagactcgccgtctcgccgtgtcgcactcacacccggccgcctcccgccccgcggaggcagagaggtgtcctcctgctccaagggcacgcgtgcacgcgagacccgcccggatcagcgctgggtttccgcgggagcgcgtagcgcgtcaacgtgccggggctgcgcgggtttggtgcgtgatttcccctgctgatcgatctgctcggttacgtgtgccttcccgtgtcgcggtggccggaacatcgcgcgaggtccggtcaatgttcggtaacaacagatcgacaaatcgtggaccggtcgatcattgcagtgcgaagctggcgtataagagcaagtttaatagtgtagccaattactaactccaagctataagctaactataaacatattttaaaaagataaataaagaaagagaagagcagcggactacatatctgtagccggctgcagcatggactccaaaacgtaatgtgtttatgacaggtgagaccagttattaatagtatagtaagcaactattgtataaattactattatattagctatttagagactatactattaaacttgctctaaggggccggaccgccgatcgaatgtt

SEQ ID NO: 65301 - DNA, 13502 bp, Oryza sativa
cattcgatcggccaaaattttggcatagttaacaaaattttggtaatttatatagttactaaaatttgacagcaaactaaatatagaaatttttggcaactttactaaaatttggtaagattgaaaatgacatcaaagtgaacaagtccataaaatatgaagccctgacgtggcagttcctcgtatttctcgattttcggggatagaaatagagttagttttggataatagtaacacacaacgtaaatatttagacatcctaattcaactaagcggaattgctagggctatggctatggcgaacctgcacgtcctggactccctcgacggatcgaggtgcatcatatacaccgacacccttttggaagcttgcaatcataatgctctgtgtctttcaccaagatagattatgttcgtctcatgtgccgtacgtgcagccacgcctcgccggatcacctgactttcacgcatcacttattcaaccaccatcgcagaccggggagaatcgatcggaggttgaaggtccgttctctctcttctttgctcattgatccagtgattcctaggtgtgtctgcttgactgcttctaggtccttgcttgttagtgatcgcctgacgttaattggcttacctacaccataaaaaacagtatacaacttaggctaattgggtcatatgtttagctttatcacttgtcgcactcaacagcgaatttgcatattaagaaaataatgggcagaacatgagccacaagattgtagtctttgccatggccctacagttgtggggctcaaaagaagatccggtagagagcataatattagagcacagggaatatccttgttcagaagaatatcctatatctatatctccccattctctgtccctggcatttgaactggccattagcaaaatccacctaaccggcaaaggtaggtgtatgccttcacctcccggtatgaacaagcagcattctaatttgatcatcaaccagcgaaattcttctgttacttttaactgagtacgtttgaatgagcatttatcatacttatacactacacgtgtataggtttccaaacacttgataatattggagaaataaacggtctagaagtgcagaaacatgcacatttaccgtatgtatatgcgtgtgtacttctaattaatagatcggtattacatgatttgaagttttgaactctttagtccaagtatgccatcatatcatatagaaatctgtttataggctaacttgtaaatttcaggttcaaaacgagaggaaagttcagagatgagaaaaggaatagaagcagcgaatatcgaagttgttaaacagcagctactatgaccctgtaatattctgtaaggctgtaatcgttgcgacttgaacgccacaggaaaaccacggggtagtgtaacctcaccggagaaagacctgacccaacagcgcccgtggcccgtggaacggtcaccacgacaaaagccaaaaagactcgcgtaaacatctataagaccagtaattcctcggaagccacggtcgaggcgactccagaaagcttcccctccgcggtccgctcgcctcctcacggcgccaaagcagccaggaagaagaagaaccacgctgtttctaggacgattcctggaacagccaacttctgaacctctatctgcaagactgcaggtaatttgcatgctccatctgatcaaatctcttcgcctcctctcctggcttaaatttcccattttctaggataaatctcctctctttttattgatcttccatccgtctagaaaaaaactagattctggtcggccaaacgggatcgcctcgtctgccttatttatttgccttgcaaatttgaggggcctgatttaactctctttctatggacccctgttcttctgcttgcttccagagagtgcgatcctctggttgcgtctggtttattcgcttgcttgcaagagcaggacccgtcttgctttctccttgcattcttgctgttgagttaacaagggatccatagggcacaggtattagtgtggagtatttgttttctctccagttgccttctgttcttcccgtttctgaatcgattcttctttcggtttctgaatcggaagtaagatgatgctatggttgaaggagatttttgtttcttgtccctccaattgttgagttgattgaattatagttctcttcttccgttttcctcttggtccttgaacttgattatttgtaattttagacaatgggtagtaaaaaagatttagacaatggaatgatgccttcagaacttcttgccaagataggaacctgaccaaacggcggttcttgattttgtagcattaaaacatagggccttcacagttaaacttcaggtcgctgtgtattgtcaattcatagggccttttgctcgttcaacgcatatcaactaatcggaactggtcgtcaactcctgtattttccttttgctcgtgatgaaacgggaaatcccacttgggcaagaaaagaaagtgtcggttctgaatatcgtaacatcctacctaatcgcacgaatagcgaagtgcaaggtagtttatgcaattcgtctttatacaatttttaaattatgaccaacttaacttatcgtccacattaaactacgtgcagtcgtcgccccaataatttggcaaaatattgttcatttcgtcagatgcttgcgtgttccttgcagaataagctctatagctttcaccgtgtccatttgctgccgaacaattgtgaaccagaagttccctattccatttgtgtcaagctgttaaattttgtggtcctgtggacaactcctgatgatttctcttttggccttttgcagacagtataatacttcttcctggttgcagccgcctcagcggaaaaaccaaattcagcttcattcatgggttccccaagcaaaacacgtcggatgaagccattggggattcagctatatgagtgtgcccgggggagtcctatctccttcagatcatgccaggctcttgtattgatactgacgttcttatcctatgctagctatcatgccactaggaagactacaagcattgtcaagagtgttcttgatcctaagacagaaaacctaggtatgttgcattggccgagccatctgtatcttcaggatttaagagatgcacagggcaacatgacggctctctatagcggctgggctccgtttaatgccgacgatggtactgcattgctcggggagatcgacttggcatttctcggagtatatgcaatcggcatgttcttcgctggccatttgggtgatcgggtggatctcaggatacttctgaccatcggaatgataggcactggatttttcactgctgcctttggtgccggcaactggctcaacatacacaacttctactactttctgggtgttcagatgatggctggcctgtttcagtcatccggctggccatctgtggttgcagttgttggtaattggtttggaaagagcaaaagagggctgataatgggaatctggaatgctcatacatctgtgggaaacatatctggttccttaattgcagctgcaatgttgaagtttggatggtcatggtcgtttgcagtccctggagtgatgatcgcagtcgttgggcttgcagtgtttctgttcttgcctgtcggtccggagatgattggaatcgaggaggatatccatgagaaggatgctgagaaggatgacatgagtgcacctctgttggaagaacgatcggcatcaaaagaaaaggcagtcgggttcattcaggctggaaattcctggtgtagcgccatttgctctctgccttttcttctgcaagcttgcggcttacacattcctgtattggcttccgttttatatcagccacacaggttcgtccctcctttttccgagaaaaggttcccctagtcttgtgtgcaatttcaatatcatactgattttttttcctcataccaaattaatcttttacctcatgattttgaaccaaaccattctgtcatgtactagtatgaactgcactttgtttttggtgtaatctgatgtgtattagcactaagaatgataatgtacctgacaatgccaatatgtttccatttttcagcaatcggtggagtgtacttgtcagacaccgcagccggtgtactgtcaactctgttcgacgtgggtggcgttgtcggcggcatccttgccggccacatctccgaccgcctcgacgcacgggcgctgacggcggcgagcttcacgttctcggcgatcccggcgctcttcttctaccgcatatacggcagcttctcgctgtactcgaacatcgccctcatgttcgtcaccgggatgctcgtcaacgggccgtacgccctcatcaccaccgccgtctccgccgacctcggcacgcacagctccctgaacggcaactccagggcgctcgccaccgtcacggcgatcatcgacgggacggggtcgatcggcgccgcggtcggcccgctgctgacggggtacatctctgccaagagctggagcggcgtgttcacgatgctcatggcgtccgctttcgtcgcggggctgctcctgtcgaggctggtcatggcggagatctccgcgaagatggagtcccggaggcctgacgctgctgctagtgatctgccagtgtcctccatggaacaatcttaggctccattagacactttggaaattgtgtccctggtgaaatgctgagaaattttacaagcgaaaaagcctgaaaatggagacttgagaggtgtggcaggaagagcaaacccctcacaaattcccttttttttttacacctgaggagcaaggtgctctctccagccccaggattgcatcttggctatgagcgatttctgttgcttgtgatgtgtatatggaactcctaccgtatgaagtgatgattgtcaactctagctgttgacaaaggcgcgcgtgtggaatgcgggaggttttccggatttctgtatagcgagttataatcgggctcttaaagcttgtgcgagaatgcagcagaagtgttggttcctatcagatgctaatgtaatcttgctgattcaccggtgaaacagctggagaggagactggaggtgtaattcgaagaggggacaatctccttttgacctgcaatttgaagcacacgtggtactagacggtccactagaatcaggtttcgatgggaaaacatcaaatttccgtaggatagatctaaaatcacctgataaaccaacgtggaaatgggaaccttctgagagatgcaccgtgatcacgtcggctgaggcccataggtgctctgggctttggagttttaagtgggccgttctgccgcattcaagcatatagtgggcctaatactttggtcacaagtaagcccatattgtttatctagcccaaacaaggaatcgaccttggcgtcttgttggactcggagatttttttttttttggaagccaagacaaaccagcagccttgttaatgaaggatgcaagaatccgatcccttcccctcctgatttgccatcggcaaagcacgttataatctagctggatacgcattagcgtatcatcttttctgcgtgttggcgtgctatttgatctcctcttcccttgaccaccggttgcggttcgcgtgaatcttatcttaatgccagcgaaagctaccgatcgagattagctgtcgcgcgtgttggtaatactacgttaattgttcagtgttcagaaataggctgcgttttccggtgccagtgctcgaaacggcctcccgttttctgtacatgatgaccagtgtgtagtttctctgtcgcctgtcggtttgcctaatctctgacgacgtttctgaagctaccctgaaactattttgtctatggctaatcattctgaatgcaattcactattgcaatgcacgaggtcctgaattttgtttttccaaacaaaaacttcagtatttttctccctttaaacagatcagggctcgccggccggcagagggaaagactgagatgggccgaaaacggtgccggccatgcagatgcaggtcggccgtcggcctcgccctgccattgccaggctgccacacagggacacacatcagctagtcgtcgctgcaggggcgtgcctaccgacctgccgctgctacttgtccaaacaactcggattatagctttcgcagttgcagccttgcagagcaaaagcattgggagcgcgtgccctgctaggattcggttccagtgcagtggccactgtgactgtaagttaagcagtcacaagagctatcattggatttaaaacggatggcccagatgcctcagtactgtagcaaagtacggtagcgttttttacttggaaaaagtacagctctagttttattgtagctcacaatttgaaccattggatcaataaatagagggctgagattgttagaaattgcactggatctcaattcgccctgctagtcctagaaatgaattgggatcctatgcagtttgaatagggactgcaaatttagcagtcttatgtcttcactgccaccacggatgcaaacaaaactgccaacatgcatctgcattgttgataagaagcaggttcaacttctatccagcaaaccttcgttttgttgccacgcagattattgctgattgctactcccgtataagaacatgaacgcccgtactaaggtagtatagtaggattgtagtaacagataactaccgtctacagcctcagtggcccctgcatgcacatatgtatatttgtaacttagtactctacatcgtcttcgtttgcactggatgatcgatgagacgatgactaaacatgggaagaaatcaagccactcttaaagattaatctagtactacatcgtatagtgctatacatccaaattaattaaggggccctgagctccctgtctctcgccatcacgctccttcatcatcagctcctcgatcctcatctcatctccaagtcgtggctaactgaagacttacgtggctccacagatctcaagacgcggcaggtatagctagcaagccgcgccacttgcagacgcccttatcccatacgtaatccaaaccgcccatggcaaaagctgagatcgatcgatccatcgatggcgagagcaaaatcgatcgatggatgcaaggcaccgaaaaggatgagcggctaagcacggatcacaagggcaatgagccctagcaacagattattaactgaagacgacgcagcaagtccacgcacgtgggagtcgctgtagatgtccatggtttctcgacgatttatgactgattttgagctggccgaattgagggctgagcggtgtgcattgcatgcattgtttcattgttttgacctgaagaaaggtaagacatgtacatgcatgactcggaccggttgattgtggcacaagcagaacaacagtagtagccatcgcaagcaaaagcgccatgcatgaaagctgcttctgtgaagtagagatagtgcttaattgaataatttgccattacattataaacgttaggccaaggttgactcgtttattatttatgcagtatatactaaacgcttattttcagtacgttagtttcttggagcctcgctctactataacagtatattttacttgtgtctgtgtgtgtatgtgtgtgtatatatatagcagatatcttctttatgcgtgtacgcggtgaaatcgacactaagatgtgttatccattctttctataaagttaaggccaaaagctcaaacctcgtgcttccacatcatcatcaaattgttaaccgttggatgaatgcattagatcgcttttcagacgttggatggaatacagcatagagcccaacccattagtcaccgagtcagtctcttcgccttctcagtgtcaaatgtagcccacatgaatatattgacccatctgcaccatagtataaaaactcggaccggacgtcgaattggtgaggcctcggttcaccggttcaaccgcggtgttaaaatttattgtttattgcacaccacaatggtcagtgtggtgtagtggtggggaacttaacgctccatctagcaaacctgggttcgattcccatgcttcacccgatttttgaacaataaaataaaactgggccttaggacttgggcttcccattaaggaagatgctgtacggtggcccagctcgtatgagccggtcggttttaggagtccccgctttagtggtttttcctgaaaactgggccagccggttttaggagtccccgcttcagtggtttttcctgaaaaccgtccggttcagtcggttcacactgggtcactgcatgaacagtccttgaaacacaccgaaccggcgaggtccctagtttaggttttttccggttgaaccgccggtccggtctggttttttctactgtgatctccacacacatctacatgtatccaacgctttatggctgaacgcccctttagttgagttgaaccgccggtccggtccctgtgatctccacacacatctacatgtatccagcgctttatggctgaacgccccttcagttgagttgaaccgccggtccggtccgattttttctactgtgatctccacacacatctacatgtatccagcgctttatggctgaacgcccattcagttgatatgtgctatataaattatctacaaattttggataggaccttcagttgatatgtgctacctaaattatctacaaattctggatagggctgctaaaaagaatttgctacctaaattatctacaaattttagatagggctgctaaaaagaatttctccaagaaacatatttgtttcttcttgaggttgtacctcctatctaacaaattaatgattgtacctactatctaacaaattaatgttaatcaagtcccgcagcaacgtacggggcatcctttagtttatacatctcactgatacaaaattctcctactagcttttctacctgcgctaatttctagtcaatactgctgcacttggctacaaataaacaactgattgcaagaggaccacatgaggcgagtgtgacaggagttgatcgagagaggcgcccggcgcgctatgtttcatacaagtgcagagtgacagatagggaggttgcactgccccccccccccccccctcctcgctctcctgcacgttattatatatatctttccgatgagcatcagtgcattctttttggattgtgctacgtgaaagattttctgaaaaaaaaagaagaggaagcgtcggttgtacgcgcacaatcacgcgaagaaattattttagctgagctagatagattgtgcttgcatccgatcgattgcatcgtggctgtctaatcataaaataattccttagattcaattcatggatttgtacttagtacattatgtgcggccgttgatcacgtacaatgatgtactgattgtgtgatctgttttgtttctacttcctccgtctcatcaaacttgtcgttccaggttatttagcatgtatattaagcatgtatattaaggtcaggagaaaaatactataataccccttaaaaataatgtatggttggatataagatggtggttaggggtagaatgggaagaaatttgaattgaaagtggttgatgtgataaatagtactctaaagtgacaactattttaagataacttttgaatcctagaaagacaaatattatgggacggaggaagtaccttgtatggtttctgaagtttgaaaagctggggaaaaaacaacgcagaacagggtgtagttcgttttcagagaagcatctcaaaagtactatgtgtgattacaacccatgcaaagttttcccctttctttaatttccttttggcaccaggtaggcttttcccctgcttatctaatccaaggtcgaccattccaagttcattctacttttatttttcgatccttttcttcccattcttttgtcaacatcacttagcctcttttgcttgtgaacttccacatacaacgaaacacatgtatgacattggggttttagcacttgcctctgaaagcaagtccaaaacgcttttagaacggagatgcaagctggttagcaaatctttgttgcccacagagacatgcactagtctttagccctcatattctaaggcccatttatttgtggcctatgtgatgcatatagattacgttcagcgtaacatgctaattttctctgctgttttatttgtggcactcgtcattgatgcagcaatcctcaagctgcaagcatgcatatatgagtgatgaaattcacacacattattgtaagaaatttcacggtcattgttggggaatagaccccacacctggaatgctactcctgtgttaaaaggaaagatagtattgtaatttcccattccatataaattaaaaggattcttaaagggcaaagatggcgatctcgttcaattccattcatttatctccatcttcactgctatctcactctcatccactcctcaacttatctcatttggttctccatatgttcaagctagttccctcccatagagggagagttattgccatgcttgttggattttattccaacagccattaagagataccaagaggagtaaatgagaggagaggatccttcgccatgcttctcatacgccatggtacttaagatattgaaagttaacaaattttacattaaaaaatattgcatcttaccttatctcttcaaatactgtaaaattgcttttactaaaatatacttatacagtggcctaataatattagctaatgggctagttcgacaagcctgatgcgacggaggcggctgcgctgcgtgcgcgtggtactgctggtgccagttgtgccaccgtcgcggaccagaaaacaggcccaggcccaatatcttcaggaccgggagtgtgtgtagttgtgtatatatactagggctgtcaaaaaagctcggagctcgcaagctgctccagcttgattcgttacaggtttgattcaagctcggctcgaatactagacaagccaagctcaagcctaggctgaggctcgcaagtcgcaagctcgagctcgaatagctcggcatggcttgattagcataagatgtattacatgtagaaagatatttttgatgggtcaatgtatacttgtcaccgtgcttgacttgttcaagtctcaagacctcatcaatgcttctcaataaagcaattattcggctgctagtaatagtactactatttctattagatatagtggctagcttttgttaattgcaacgtttcaaagccatgaattcatgagaaaagctgcagaggtttcattcaagacaagtagcacccattaattttgactactgataatttacattaatatctcttatacaagagtgtaagttctttagagtttcaacaaatcaagctgtcaagctcgagtaggttcgaagctcgatcgagctcgaactcgagctcactcccaagctcgatcagtatccaggctcggctcgagcttagctcaagttcatatcaagctcaaacctacgtaaccaaactcgctcgagctcggcttgttgactgccgcacgctagcgcttgccacctccaaaagcatattcatgtgtgcatcactacacactaaacacagtactacaacactgctatatgcaaatatctgagacctgcagtacaatattgtagcccatgatcacgtttcctttattctttttcttcctccttttcctccttttctcaccgattgatcaggaaaaaggatgtactggccggtgaatgtctgctcatcatgatgatcgtgtccagtggatcgatcgatcagcattgttcagtgtaactttagtcttattcggaatcctgttctcctagctaggagatacgtagcttaggctcgaagagagatacatatacatgtgtagtagcttcatgcctgatctctataatcccgtatgcatgcatatatggaccatattacgggaaattttattgttatagggatgcaccagtactgagaattataaaattacaccagaaaatttctgatacctcgtattacctcctaaaaacagtaaatcactcataatatataccacttcaactatatagtacatacatgcatcttgcccttttttttttagctctatccctttaactgtactttttgtttttccattgagagagcttgtgttattattgtatcacttaagaaatgaaagtccaagataatattttttagataatgaaaaataatcacatctttatcttctgctataagatacacaaccataagtttgtttaacaaataaaaaataaatataaagtgatgtgacaaaccctaactctgtcttattattaattagtgttaaaccgcatagattcagtcagcatttatacgctacccatagtaaaatagaagagatatttggttatggatttcaaaagtatagcaccgttcacaagatatataaaattttgtgaaaaaaaagatactccctccgtccctaaatattttacgtcattgacttttttaaacatgtttgactgttcgtcttattcaaaaacttttgtgaaatatgtaaaactatatgtatacataaaaatatatttaataatgaatcaaatgataggaaaagaattaataattacctaaattttttaataagacgaacagtcaaacatgtttaaaaaaagtcaatggcgtcaaatatttagggactgtcggagatatgggcctgggggtatgcaaagtgaggggaatttaccttcccatccagccacgtggccctacatcctggccctacccccgcaccttgcaaatcgcagaaacggcggggggggggggggggggctcggggtgccatgtcatgcccctagggccctcgtgctgccttgccctgaggcctagcccaagtgcatgtggcagggggagcgagcggagaggggactcaggctaacctgctatcaatgggaggcgccccaactgcccctcaccgcatttaatgcggtaggggcagacgtgcggtgccgcccgactgacgcacgttagtcaggactgaccaagtctgtgaccggcccatcgccggtcaagaccgattggacaagcggccgtgcccccacgtcgcctctgtatccggcggagtggagataggtatgacccgtcccatcggagcgtcattcggagctccctccacgagaggaggaccaccacaagtcttcacccatttataaggggatgacagggttgtcccccgtgtcaggcggggggcggcgctgggtcgcgctcaaggacgggctgctgcttagcttccgggcgaaggcacggatcgtggcccggacaaggtgaagtgggtccccctcccatgaaaagttaggtagaggcggtgcatgtggtatccccttgagctataaaaggaggaccttgcccaccgagaaaagggacgactctcagcaagcctggactctaggaaaagaagagcg

SEQ ID NO: 65302 - DNA, 3279 bp, Oryza sativa
cccgaattttcgtgcctctcgcggaaattgaatagtttgttgtgaaagaaaagacattacgatgtttagggaggttaataggcactacattgacctgatatgtttagggaggttaataggcactacattgacctgatagcttactcctacgttttgttcagagaggtaaacaagcgatttcaaaagcacttgtcgaactgttaccatcaacctcttgtgctgctgctgttgtttgctgctcctgctgctgactcgcgttcagaggaggacggacagcttgtccggttacttacctccggtgcaccccctcatatcagcatcaggccagttgtgcagagcgagagctttaaaagaataagcacaagtgttggtcagtacataaccccctggcttaagaaaagtcagcagcaataggaaggcaactttaacccctacggaccccagctttggtgtcctgcaggctgcagcagccagcagggcagcgaggagaggttgatccgttgatgcaaatgcagtactagtagtacacatgcaaacaaggtgcaaaagcattggcagggaaaggtacatggcagcataaacaaatacagtacgggctacacgagagacttgccatcgcttgcgtcgatcgcttaagaaaagggagctgtcagtctcatgatcggatagcacgttctcatgcagtttgtttagtgtcgtagcttaaagaaattcgtaagcagacatggaactaactcatccatcaggccatcacacctgtaacactttttcaaatccaagatttgtttgcaagcttcaagagaaacaaccggcttctgagttgtttaagctggcgctcaaagcgttcccttttttttttctaagcagaaaggggccaatcaagggacaggagatcatgaaggcaaagaatgcccaaatagggctttgcagcacgctggagggggacacaggccaagtgagaggtcaagggattaaataagccctggaaataaaggaccgttgtactgtgtctgtccaccattgatcaattttactaatcaacaactggcctctgtacttacgttgcaaatgaaaagcatggatatggatgaacactgagggaccacacgcaatgggtggtgggggtggtcgacgggcgaccggtggccgtgcatcagccactcgatctccgatgttcggttgcggtgccactgtcccaaatggtccacaagtcaggtctgtagatttgcaaatagtatagcagacactacagctgaacgagcacgattaataaggaaacagcacgagtggggcatgcatagcacatgagatgggtcagaagtacatttggtgcatatgaaacggatgagagcaaacaacatcaagtctctattgcgcgggtgacgagcaattttaaaggtgattaccagctgtgcctacacgcagcgatgatgaaatttgggtaatcgatgacaaggcaaaaacactttactactatgtactattccctccgtcccataatataaggaattttgagtttttacttgcaacgtttgaccactcgtcttatttaaaaaaaattagaattattatttattttatttgtgacttactttattatctaccgtattttaagtacaacttttcgctttttatatttgcaaaaaaaatttaaataagacgagtagtcaaacgtggcaaacaaaaacaaattacttatatcgtgggacggagagattagtactctagtaggacaggaagagtactaaatactgtagtagtactaatagatttgtgttctgagcaaaagcagaatacagtaaccatatgcaaccaaggaaattcgcacgttgctttcgacattagtctgagctgtgtagtaatggtagctgaatgaaaagtctgagctgctgtgcaattctgctgctctctagtgtgactgtgaggacatgtttagagctatattttttcaaaagcaaactatagagataatccagatggccgtttttatctccaaggtttcggatgaacaaaaagaaacagccaggaatttcaaactacactggcaaaagcacagatgaatcacaaaaatcgccaattttgagctattcaagaccaaaatacaaatccctatatacaattagcagaacacaaatatgtgcatcgtctgcatttgcaaactctgaggaatatgaagtctatgaagtattagtgagtataggccttaaaaacataaaagtataacataatcttttttttttgcgaggaaaagtataacataatctccgccgtagaatcagtgtatacatcgattccttgtcctccaattgcaggcaactattcttgaatcttcaacaaaagctagcaagtataaaaggaccaaaataaaatctgattctatccgattcacctcttcttgtcacaactacttatcatccatgccctccttttattttcagtagtataaaccattcaaacatacacttcactgattagaacttaaaacaaattaattcatcatgctatatattactaatgttgcatacctcagatgtacacaggaattttccaatttggtctattgtacacaggaattgctaatgctgcaaacctcagatgtttagcagaacaaactaaccattgcacccatccctggacaccctaaccattctttgtttccactaaacagaaaacctttacaccggcgtgcattttgtttcaaaatcatggcatatacctttgtttcagcaaaatcgtctagtgtgacaataatcaataatatcccaagctatattatttgtgtaaaacaataaaatttgctattgtaatattcagttatggttattccagcatgtaagtgtaatgcaatttgagtttaacagatccatacatcaaattagcaatcattggatcaagcaatttgataatgcactccgtttggatattatgacagcctagcccctcctactattaaaatgacaggctaagctatgcaatgcctcgtgcgtgtagatatcagaggctgagtgaatcaacaactaatctaccaaacatcaccaaaagaactaaaaacagcaccgtatacacactaatgcttgtcataaggacattcaacatgccaaattatcttatctattcacaacgaaatgtttccaagaacatgaagtggccaattgagcggagagcaacaacatagtggtaagaccctagaggccatagccactggtcacacactacagagacactcataccaagattgccaaatccattaggcctacctaataaacaacagagtgtgca

SEQ ID NO: 65303 - DNA, 12992 bp, Oryza sativa
agctctacgccgcccaagaactgcatcctccactctgggctgaatcagaaacctctcgatcttactgacagcatccgcatcagtgccagcagcatcaagtgattcaagaagacatagacaagactgtaagcaattcaagaagtgttggaaaatgggaggtcgctccgatcactgccatagtcaatagcaaccacaatcttaggagcaagctgtttcaccaactgaagcatagctgggagtggagtgcgtgctgagcaaccaactgggaggcttactgcaacaacctcatcagctgtaggagcaatgagttccataggatcaaatgcgtcgagattaatagcattgaactcaaatggaataccaagatcagcagcaaactgtgagaggttatcctgagtaagatgcagctcaagcgggtggtgggaggcggctgagacgaaggctgtgagcttcaacatcggcaaggacacaccgccagagccacagcggtgagcaagctcctgcaagaacgaagcccactggccgccgacaccgaggtcgaaatcaatgacgcggatacaagacgcggttgtgctggcgatctcatccagaagcgcctgagttaccgtgaagttggcaaactggagcacgggggagaggtcggagaaggatttgtaagcggtgagcttcagggcgacgtcgagcggagacgtgagacgggtggcggcgtggtggccgtcggcgagcgcgaggaggagggcgtcctttaggtaggaggcggagcggaggaaaggcttcccaattgggggaagctgctgattgagccgcgccaatatctctcgcgcgcctatggagttgccgacttcggttgccttcgccgccgctgcaagctcgtccaggaggtgttgctgctgcgccgccgccgccgccgcggttgacttcatcgcgttgcgcggatgctgcatcgaaggctggagctggaagggtaccgcgctatgtagcgttggaaacgggaggcattgcgcgggcgccggcggcggtggctggggctggttgtggaggaggaagagattgtcgggcacggagtggtggcgcttcggcggtggctggagcagtggctgttgttgatggtcggagaaggaggggaacggcatgaacaaggtggaggccggcgtcggctgatgctggttgaggagtagtgtgggtgatggcaagccaaggagagggggcttcatgtcagcgccgttgtggaaaggcgcagtagtcgccggcggcggctggagcgccgcttcgggcgacaggaggccgaaagcggaggtggccttgctattgctgccgctgctgcttgtgagcgacctcccgccggaggacgacaggtcggaggcgagggcggctggcgaggagacgccaccggggtgatgctgcagcgggaacccgaacccggcggcattggcgagagctgctgctgcgagagccccggcgcctggggttccatgtcgccgggggcagccatgatccagttcaaaaatgtctgctcctggcctgccgccgccgcggcgtcgccgagcatggcgtcccagctctcctccgcgacgaagcccacatccagggcccccggtatgggcggcagctcaccgccaccgccgccgccgtgttcgccgggggccgcccatctggtggcttcggcggcggctgcgctgctctccgaaaccgccgccacgccggtagatatagaatccgccgcgccgctaccatgggacgaagacagcgtcgatgtggagttgggcgggctcgggctccccctgcagtccagcaccgacctcggctccaccagcaacgacccccccgcgcccccgccgccgccgcctttgtcctccggccaaagcagcgccgctatgctccccgcgagctccgccgccccgttcccgtcggcactgaagggtgccgccctcatctaccaacctactcgcgcatgctcccgccgcgcgccgccgcccgccgcccgcccccctctcgatcggcgcgagagagatatggagggaaggggatcaagaaaaacaataaaacagatgaggccgcttgcttgtgtgcgtgggtgtggactgtggaacagcgaagatggagagaagaaagccttgtgcgctctcggtctcgtcctcttgcccgtgcggccgtgctactaccagtatagttatgggttgccgtggtgggtgcctgccttggatttctctctctctctaacggtgccatggtccataggagtaggagtagatgcgtgcaacataaaaaaggttggaaagtgtactcccctctccctatctctctttccccatctctgcctatagcttttgtttttcttctctttggtttctcatcgttattattactccctgataccttatctgggttttatttttttgcccccgcgagcttgaattgtggacctcgaacgtgtcgattggcccagctagctttgacggttactagttcgtttcctctcagttgcaagtggagcagtacgagtacctctgtttagattttactcctacataaggtgtagatggatcataacaggagctgaaacgaactttcggtttcggattggaggcaaactttctcgttggtaatctcccctatacactgtagttgttctcgcgtccgacgccatgaatcgccgtcaatgcatactccgtaagtccgtatggtgtagagaggtatgtccactacacactaccgggctgtatttggacacggcccgcgtcttccagtcccaaccgccgagcctacgtaattgccggcccaactgacatgctgcgctcaacttccacattttcccggcccttctttgggccaactcgcaaaccgcccctgcgcggcatggaacgcagcgaatgctcacgcagtcacgccgtcatgcgtcggcgttggagtaacagcgacgccaagcgggcacgcaccgccggctagccgctaaaccaggttttgaaaataaattattgatgagtttattttaaaagttaaaaatgcttaaaaattattttaaaaatccacattctgctcctgcctttgctcgacgatggttttgagcaaacagttttttgttagatttctctctgtctcaaaaagaatcaaactctaaagataaatttagatttgtttttttttgaaatagagagaactaaagaacggtattactatatctttgaaatggtatagccatgatatctactccatataatatcattctctagattctctattaatagtatttctagacgatatgattagtctcttcctttatctttggtttttctctcttccctaagtctcttcctttatcctttgtttttctctcttttctgctataaatcggtctgactgatttgcattgtgtaaataaatactcttttcttctaatacactattcacgtattattattttacgtgttcgttaaaaaaatagtaggtgcaagtgtaacctgatgataatgtagctgtagccctgcgtctgcatgcgagcctgctaaggattgtggtgatagtgtggtgacacggccacaaggacgtttcttcattgcttgcacatgaatctggcctatcttctgtctcaatagccactttgctagggaaaatcagtcaaggtcgcaaaggacgctggtaaactttttttcctttcaatgccctgtcgtgttgacacttgacacaatgaaaaccctccaggacgagttgccacgggggtaggcgagagctgcagcacaaggaccgtgcgcaaatgtatgcatatgagatgtgatatgatatgacctgaccaaactcctggtcctgctttactgggacaacatctacagcaccgtaataagttctcattgctccaacgcagacagtactgggatatcagattggaccaaagaacagtaggcacaaggtcttccacaaattcaaccgctgtcacggtgtcacctaccacaacttgcaatattcagaccaaatcaccaaagtttttttttcctactttacacagggacgaggatgatttttttttttcaaattgtttgatgatctgacgttgcttggctgttttttcaggttttatctctccggggaatctccttatcatccttgtcatcaaataatgtgggaggttgaaattagttcgaatgttacatttcattccaatgccaatctgcctaacagccccaaagctgatgcatctgcccacttacttcggagcagtggagcacgcaattacacaaagctgcgttctggattccaaatgattacttcctctttatccatgatcatgtttttcaaactattacgtcccatgtaaaacctgtttgtatgaaagttttcgtaaaaaaatatatttttttcaaattcataataattaatcctatattatttttacttatagcttatcttgtttcacgcgcaacagaaaagacgaggaagagcagcataatctaaggtgactagttttcacttttcagaaaaccgtagaatctctcacacaacggttggtaccaattagggaaggacgtaatatcaaataaatataaggggtgagacttcgaacttagacaggctagctcaccaccttgtagagctaaccaaaatacctctgggcatttttcattgcagactagaagaaaccatggacattgaaatggtcagatcttaggaggattacgtagaaactaaatttctgaattaaaataggaaccataaaacattctgcatttatgcagtcgtgcataaataagcagagacgcgaaagggcacatagtcaagtaagtaattgtagtgacttgagtagcactacaaggttcttaattcaaatattcatagaagcaaatttcagattgaattatttaggggactaacttcctaatttaaaaacgttgcatatatccgatttgatgtaaagactgaataaaaaatatccttctctaaaaataaatgtaaagaataaataaatgagcagagacgagaaaatttcccgatcaccttcgcaacaggccgtgaagaagacaatcttaattggcaaaccgagacgagactacagcctggtctaggaataagttcattttgactcttttaactagtgaccgaatttgatgcgtatcctgaaccacagtaccggatatctcgacccccaactatttaaaccggtgcaatttaaatttcttggtggttttggagggcggtttcgctgacatgacgcatacgcgacggtgttgacctgatctttatcctacatggcattgacatgacgtttatgtggcactagaattaacaaatatacgtgggactcattgtcatttacacaaaaaaaaatatttgtggaccccacatgtcatcatctctccgctttcccttccccttcttcctcctccctctctctctcccttatctatttctctttctctcccctttttccaacttcggccggccgcggggagtggggctggagcaacggtgacatcagcgggcgaggtcggccgggtgtgcaaggttgggagtggcaggggcggtgggcgggggcgcaaggttgggaggagctccctacccagcgggaggctaccggcctccggttgaggcggaggataaatgggtgaatgacaaatggatcccacatatatgttttcacctaagcaccacatcaatgctgcagactgatcaacagtgctacgtagacgccacgttagtaaaatcgccatccaaaaccgctaaaggagtctaattacatcgttttaatagttggaatgtagatatccggtattgcggtttaaggatacgaattacattcagtcactacttaagggagtcaatgtgaacttattccgcctggtctaacccattttctgggcctctcctgaaacttagcctatccaacaatttctaccccctacggccctaccggcccatcgagttcctcacgtaacaaaccgatccaagtatatcgatctgcagatacgcgtgcatggtacgcataaggtgggtatactatacattcgcgtagccggtagcaatgggcacccgtacgtatgtacgcccgccgtggggacaacggagacggggggaaacggggcgcgcgctccgctgcggcagctttatccgacatctctcacgatcaccactccgccatacaaaaaaaaacctcccttgccaaacgcaaatccccacggcaactcgtcgtttttcacctccacggatcgcatggcattgcgccccaggcgaagtggtggtactaccagtctaccacacaatcactagtgtgtggtataaactggtagtacgtgctcctctgctccgattctttcacgcaccgattcccactcgtttactgtgtgtgggatgctcgtacaaaaaatgtagcataagcataacgccagtatggagtatgcagcatttcagttcaaacttgcatccgtgatagtggactaactgaagattagtttctgaaggaaggaaacatggatcagcgttgatgtgttcagcggctcatgtaattaaccgagggggtaattgaatttgaaacgatactcaatccgcgtgacgacgcttcctacttaagtattccagtacttccagaacagatggcggtaaaagtgatccaacttttcagctatcattagcgggctggatttacatttgcttaatgtcttggccttcagatcgtgcactaatccccacttaaccaaagagaaaatcacagctcttgtccagttctgggacacagtacatttaggtcttctcggccttctcaccgctcctatacaaaaaaacaaagacaatgtacatagcacatagctaactgtgtcatagaacttgggaaacaaatactactactgtactatgaacagcttttaagaaaccatcgggcttaacccatgcaactttctgcccttgtatatattcccaacggcaacccctccgtgtggcccttctctctgtttccctccttgcacgcttgctgctcgatccttggctcattacactgccatcaagatcacctcatgtctcccttcatatccatttcttcttgctgatcattatcactactcgtgtgcctagctagtgccttgccatgtcttgcttgacctctcctcagctggctcccaagatgcagcttaagctcactgccgctgtcgccgctctcctcgtcgtcgtcttctttgcgctcttcgtcggctcatgcgaggcgcgccgccttcgtgcccttggcagggtcagctcgctaaaaccatcgtcgtcacctcctacgccgtacaaggttggtgcagttgaaggaataacttggtatatatcggaatataaagtgttccttttttttggctgttctaatttttccatgcttctcccttgtgcaggatgcggcaagcatgaagcttcatggttctgatccaacgaaccagaagaaggatttatcaagtactagtatggatcatcacatggctagcggggacgatgcgaaggcgaaggacggagtggcaatggcatcaccaggtgcagttcagactacgattgtcgttagggtttcgaaccggctctctcatcaggagcgaagggtggacacagcgtttcatctggactacgctggccctagaacccatcccccctctcacaactgatgagtatgtcgttctgtggcattctctgactctgtctgatgatcttaattactaatatgcaacttaagtgatttatgtatatgagtgttcaatctctaattctggtgcatattcttgcttgtttgctcttatatatgctcaatttgctaataaattaatattatcggtataaatagatcgtagaatgtgtagttttgtagaaagctcgccggctagatattttgcttgcttgaaatatgaattgaagttcacacacatgtttatacatgtaagtttgatagccgtgtgagaactatatgttgacatctatatgttgactatatacaaaacttgatagaaacatgaatcgtaaatatgcattctacacgtcgataagataagataactttatgtgccaactactcaagtaagtaataacagatcgatcttcaacatttgtcagcctattattatatatatatatacccagctacaattctacatacactaattattatagccttattcaaacagcggatgatcacatatatatgcaattagacaatcattttatgaattgcaatattcttatctcttgtttaattccggccgccatgatcgttaggtccgttccagcattcattaggagctccatctcatgggcacttgtttctttgggaaaatatatcgatcacctattttgctaatttatggtcttttatcgtcatgtatcaatcagtctaaattttaatttttaattttggagtccttttatatattctttaatcgtactctatttgctagcattagatttcagaccataactaatataaatataaaagttataatggtaaactatctttaattaatccttttttattgcttatcagtcatggctcaaatggtcatagcaatattttaatttgtgtgcaaacatgcattcttgggcctagtaatatgtaaaaaattttagcctataaatcctaagggttggactgaattttgtatacgtgtttgagaaaaaaaaagaaaagaaacaactaagttggactgtaaaaagaaaaaagaaatcgtgggctgtagcccattaacgctcctaattatactagctagcacgatactaggtagggtaattggagtgggacatccggacaagtgaattcatgcccgacgtatgggcgcgatcaatgatgtgatgatggtgttgttattacgtacctgtgtgtagcatgcatgcaagattgcaagtaggggccaaggcggcaacataaatcgcgcccatccggaatttagaaatcacgtgttctactaccatctgtacactgctggtgctggccatcaatattgcagctatcagttacgcatcggttctactagttcttgctgaactctcacgttgaccaccagtccaccacatatggagatgcggtgtaatttgggaacaaacctccctgatcatcagttccatcccagccgagatttcaggccgcgcatggcaatatggcatgcatgctttgttgtttgttcctctgcgttttgtgtgcttacctgggattggagcgctgtgtgcacttttgttcattccactggctattctgcttgtcaaccaaagaaaactcggtgggtccatacaacaacaagcactagccacaaatccaacaccctgcaactctgcaaagacatggagtcttcacaagagtactgttggcctcgtgcgtaactcgccatcgatcctggtaatcttgggttggaaccttgcttcaagtaaacacaacagtacgtacgttcgctcgccgagcttgttcctcctgagcatgctctccgtaagtcacggtgccctgcttgacgcctctgtgtcctgactaaagaatatattcgcttcaaatccccaagcttattagagcaaggttaatagtatcgcttactgcgagctatacttttatccacatcatttataactaacagagtagttaatttgtataataaacaggctttaacattagctaatgcaaacaatattttattcctcatttatctggttctctctcttcttgtttcctctgatttgtccgtgagcctttcaccatcttgaaacgcgtgtgtagctgagcgactatttagtcgtccactcatattctctctcataccttttctccgccagctcatcgttgtagtttacgtggttgttttagcgccggtgtagcgcctcctattgcacctgctcttagtactgctgctgctgcctctcagtttaacatcattagaggaagattagagattgcagttttgcaccaaaagcaagcaagcacaagtactagtctcatccaagagaagctctatggaaaatcgtcgttgacttgacaaaaataaggtgtgcagaaacaagcttcggtttctggaacaaccaagcagtagtgcagtactagtacttatagttaaagttgccaacccgaggagtgatccatgtgcattggggggcatatgccacacacgagtccaatactgtgacaagtatctcaatcttcccaagaatgtcccccctccacctcaatcttgccaacaatcggctagtaaaataaggcaaatgtgatgggcaggagaaactggctgctccagaaaagacagacatcccaacccagatccaagctaacaacaacagccggtgcacctcgcagccggcccgtcgatcagggctccatcatcccgtcggagaggcgggaactcttcctctgttcgaaagcctccccagcgtccaggcctgaccacgccttttcacgtacaacagatgatacagcgaaacgcccgggtaagaccgtaggaaggagggaacaccgttgagtttgggaatcggcgtacgaaaaggtcttgatgtcactgcaccctgtccgcgccatgcgcgacgccagagggagacttgacgacgcacgctgcgcgtatagcggcacagaggcttgcggacgggggaggcgccgcgaccgcgagggcggttggagaagcggacgcagagagagtccagagacagtggaggattggggttgtaaccgatctgcgtacgggtcgttgcggctccacacttgacacctgcaagcccatggtgacaccttttaggtgacccaagaggtttgggcctgattggtgccatctgctgggccgatgagctccgaacacgacctccttgctgcttttttcctgatgggttggagcatctccgttctccaacaatcactccatcagtcttctcaagctaaattttgataatttcagttaaaaatcgtgcttcaacaacctctcccactgaatggtcaaaccatccggttgaccaaatccctccactgatcacttgccaaatttgatcaaccacactcacttattaattgtgggccccatatgctatccccctcttcttttttgctctcacgcatctctcttctctacatcgctattgtccgccgacgtccctgccactaccccttctccccttgtgccagtctcgagggaacagtatacatgccgaccacgagaaagtagctggtgtaggcttgggtgcgtttgcggtgatggccgcagtggttgtatggaggagatggaagcaaaggaaaggaaacgtgcgggacagcaggaggcactgcccagaggcaccaaccatcaccataggaggaggatggagttggcatgggctcgggcacagttactgccgtccttttctccagcatcaactgccactaccctgttcggcgtcgagctcatccttggagtgctggtcttgaagtagcgggggcggacggggatagagctgaggacagcggaagaggcgcctcaccttccgccgcgccgtcttccgccctcccgcaccgtctaatcctcattggtgttgcctcgtctagcgctacccccttcctcgtcggcatctctagtgggataagacgaagatggggaaaaagaggagggaggagaacatttatgaggctgatatatcggtcccactattatagatctagagtgaagaggctgttggagtgagcaactagttttacttgccaaatcaattagagagctggctatatagatgtttgaagagtctaatttgtatggtctgttggagatggtctaagagaggtctccaaaagttaatgagcatacgtgcgtctaaaaaataatgatgtcatctattaaaaaaaacatagggagtacttgtctttttctttcaacaactctttatttacatttctcctcactatatctccaccaacctcccgctactcatatactcctaatttaattggaggcgtcatagtttttttttccttcctccttaaaatcttcaaaacaaattagaattctttagattatggaatcaaggtagtagtaccttgttgatcaacatttgatactccacagtcactgatatgatatgatatgatatggcaacggccacggtcccagctctcctcctccttggcttaagattttttatctgtttctaataatctgatgtgacgaccctcagacctcaattatcatgtgaagttcaaaactttgatgattaaatggtgtataaataatgtgttcttcctattcttcagaagaataataattctgatggtggtcagaaaaatctaagattctcaagtgattaattgacatttgattaattttagattcccttgtgtatacacatcttcatacattttctgctttatatagtaccatttagactacaatacagaaaaggatactatatagggaccatataacacctgcctttcatgcaaagcacgagaaaaatgtctttttaaaaaaaatagaagaaaattaaatcgaatgaaaatcgaatgctacttttttaggacttactcgagtgctactgggtcattgatcaataaaaagcaaccttttcctcaaaatgaaacaaagttcatgaaaggaacagtagcatatataagaatattacctgagatagatggctttgttgaattttctccaaaagacaggacaataagaaaatatattaacgattcacaactttcaaattcgtgctattacaaatacacgatataatgactccaacttattgcaacctttgtaaacagaacaaacgatcaaacccgtagcaaatttatgaaacaaatacacaccaataagtgtacatcgatcgactggaacggctctagttctgcagaaccgcggtggaacgtttgcgacagaagatcaacggtggtatagctatatatgcatgcatgcacatataaatgcagcgtaaatgcaactatgcaagcgtgcacaggcggcggcggcggcggctacgagtgtagatagccacgcatatatatatgcatcaagtttgtttaagcgcaggtgtagccactggggacgcacttgtcacagtagttgacaaggagg

SEQ ID NO: 65304 - DNA, 3392 bp, Oryza sativa
atatggctggtagctaggcatatcaaagaaacccatgtggaaatgccagggccagggcgagcagcgagctcgtcctgagctggctggcgagagttggcttgggagctagccggcgcggcctgcgtggagcgcgcacacatcagcatcgtcgccagctcggccgcccgcacgcgctggtcaccacagggttgatcgcgcattggctccatggaccgatagaaagcgaagtatcagtcgcgcgcgacctcacggactgcacagtagcactagcgtgtggcagaggaactctctgtgatgtatcggccggtgatcaggtctgcacagtactcatggtcttggaagacgatgaactctgtctgtatttggccttttgttggcctgcttatgggtgaagcgctgcaccgacgttacgctcctgcttggctacagggaacttctggctgaggattgatccatgtaaaatccgtggagaaactaatgtgctcttcattcattcttcaattaatcatgaccgtgtaataaagcatctttgcatggttaattagatcgatctgtcgacgggctgtaaactggttacgggcacacatgcatgcccctctgtcaacggcagaagtacgtacgttcatcgccatcaagttttccaggatgtggcccaacggcagcccacggattggagcccattgcatggagggcggcacactgcacagttagcgcgtcccagcctgcggctctgtgccactgcaagcagcgggcaagaaagaacaaggaatcagtataagccacgcgtacgatatgaacagaaatatctggcgtaatcaagttctcgtgtctcatgcaacgtcgtcactttcaccggcacaaacagcgtcccggccggccgggaggtcacgggtggacggatgtacgccttgacgatttgatcgatgcgctacccatggtattgttgccgtcggcgacgagagattaaagtatgtttcgacagatcggttgcagtgggaatgttccactgtaccaagggcagggtttagatctggatctcttgaaacaattatttggggttagtgataatttcgcttatctctttgtacttttataatgcaatcaagttttttgcgttgggcggacgtgcatgtacaggcataccttacaaattaagggatgtacgtataagctgatgtgcgttttgtagccggatatccttgcgatattggacggcgaatttctttggatcctcctatactttgcgggtcggtcacggcataaataatcaatacggtaccgaacttgtttctctgatggatcgagaactatatacgtggtccaccacccggctagcgagccaaggatggtcgcgcgcggattcgtggtgcacctacgaaatccaccgcagccgacaagacctccccgcggtgtattagcccgggcgcgcgcgcccctgcggtgtaccgagagccgggtggacgagtaggtcagtaggccactccggcccacgtgcttagagcaagtttaatagtacagctaactatcaactcgaaatcatctataatcaatgtaatagctaatttatacaatagttgtttactatactactaatacatagtcacatatgtcatatacacattacgtcttgaaatccgtgctgcaactgactacaaatctgtagcccgctgctcttctctttctttctttatatctttaaaatatgtttatagctagcttttagcttgctattgtacctgctcttaatagtatagctaactatcgctccaaatcatctatagttaattttatagccaattcatacaatagttacccataaacatatactacacaattaatatctggtctctcctgtcatatatacatgcatcttgcagttcgtgttgtagctggctacagatctgtagcccgttgcttctctctctctctcttattttatctccttaaatatagctggcttatagtctgctattatacctactcttaaccagaagaggtaagtaggtaacgtgtgtgatggcttcgttgcccttgtagttgcagccgtccactattagctctaatttatctatagccgatctaataacgaatttatacaatagttgcttactatactattaatatatggtccgacctgtcatacacacactgtgtcttggagtccatacaaatttgtaacccgctgctcttctctctcatattttatctcattaaaatatgtttatagctggctaatagtctgctattgtacctgctctgaatggtgggttcaccgagcgaatgttcgcacgcggtctaggtccgtgaacacttttggttcaacccacgtatgttatctttttgccgaacatgagaatctgttgtgagtgaattgcatattgggccatataaatttaccagagcttcagcttagaccactgaagcatctaggcccctggtgttaattttggtaattaatgacaagcactaattatggactaaccgttgtctttgagctatacattttaagttaggtccacgtcatatgtgcgcatggatgattatcgatggattaaaattgacggcgcaaagcaaagggaaagaagacggtaaaactagcgctttaatttagaattgatcgaggtgtagggcgatcaaatttgctagtttaattttagtttcgccgtactattaagaggggtaatgacctagcaaagagatgattttaattgccacattaggtcattgcattttcatttgtgctctctttttcattacacacacattcatttgcaaattcactgggttcggcctgaccaggggcggtcagaccggccacatagtggcggtctgaccggcgtgccctggccggtctgaccggccccgcgggcggtctgaccggcggcactttcccggtcagaccggccccctggaggccgagatgatgctgctcgggatggccgatacagagccgacggagccgtagtcggtcagaccgagctgatggcggtctgaccgagccgaggccggtctgaccggccaccccatgtcggtctgaccggtcaggccgatggggccctctgacagcacttcaacggctagttttctagccgttgcagagtagcacggtctgaccggccacataccttcggtcagaccggcagagcacaaagttgggggatttcgccaccaacggctagttttggtgggtgggagtataaatactcccccaccagcagcaagggggctctcttggcacccaattcaattgcatacaccccttgcacctctctcacactcacttgagctttgtgttcatccatctagtgtgttagagggttgtttagccaagagtcaagtgcatttgcttccattgtagagctagtgtggcacttgatcatctccacaccggg

SEQ ID NO: 65305 - DNA, 8233 bp, Oryza sativa
  unsure (1)..(8233): unsure at all n locations
ttcctagagatataattgagccactatcaccctaggtttgcaaaacataacttagttacttagttagagttcaccctcaccaagtctagcaacttaggttagatttgattaggtgttatttaatttttaaatcgcctatttacccccctctagtcgacatctcaatcctacaaccacccctaatacaaagatttcactttagaccatataactttactatttttttcactttggaccacccttgtccaccatctccaacttcagcagcctgctgccactgttggtgtgtgcgccaccactgtgaggatgccaaggtgccgtgagggcttccacacgattgttgctggcctctgtccactcatcccctccctttcagtttgtacaatcgagctgccatcgagcatgggtggcttcctcaaaattgatcaacagaagcttagagctggtcggcacatgagctccaaccgttcttcgcctgctctggccgattaactcgagctcagctgaaggctgaagctatctctacgcgaactggcccgatgcacgtgctcgcagcctcgcactcgactgtacctccttcctagcgcgctctctctctctcggatgcattgccggagttggtgaatgcccgaagaagcaacggcttgccgcttgcgtagtgcagtagtggtggcagtcagctagcaaatggaaacggatagactgacagattgatagaatagtggcccaatgtgcaaagatggtaacaaacccttgcctaaagtgaaaatattgcatatggcctggtccaagatggaaattaggcaataatacttggcccatgatgcaattcactcaaaactttatgcatagctaagtgattgtccagtactctaggaggtattagaaatacatcataaatgtgtaaaatttgataccctactattaattaggagatatgaaaattacactaaaacttttttttaccacttgttatctttgagctgaggcactgtaaaatttctcttacacatataaatgatttattaaaattttattgtaaaagtatttcaatccgaattcgaattaaatttgaaaatatactgtttatttaattttttcttataaatattcgggatgtaaaattttttgcgtaaatataccgtcaatctcgcacaaccgttgcgcgagaataacgtgggaatgacgtcgtgagcggtatccgcggcgaaagcgcgagaccgctcggtctcacggaatggtacagcgagacagaacggtctcgcgcaaggactgagcgagaccggtgccatgctgattcaattagcgactaattatcttaattagcaattatttatttattaattaatcgctaattaagataattagttgctaattattattagttaattgctaattaagtaattaagcactaattaaatggaaccggtggacagtttcgctgtttgattccgcgaaaccgaacggtctcgctcttccattgcgcgaaaccgcgcgctctcgtgccttcaccgcgcgagaccgtgcgctctcgcactttgaacgcgcgataccgcccatgacatcacacccacctaggtttcgtgcaacggttgcgtgagatcgacggtatatttacacaaaaaattttgcatcccaagtattcatgagaaaaaattgaatgcatagtatatttttaaatttaattctccgaattcaaggtttaaatcggagtcgaacatgtaaactctttcagtgcataaacttaaccaaaaattaaaaaaaaacatgtgctgtaaaaggaaaaaccataggcatattcgcatgtctaggtcacgcgagaatgttcacgcctgcaaccctgcaccccttgtccgattggcctcttgttgacttgttgacgtgtagcttaaactccggctcgcacctactaatagattgcatcctcattaaacatgcattttttaagaaaaaatggttcatgtactagatttactaactatatatctacaatgcagatgagttattttcccaactatatatttatgatctcttcttgttaagaatatgtatgtgctattacaccaattaaacgaaatttgtgttaaatttattgtgggatatatatgtgtagaatttagtacaagttacatgtttttttacgtgtgcgcacgcttatctttgggggccggggtatataacattgtcatatatttcctccgttttatattgtgtgtctagatttattaacatatatatacttttttcatctcaaaatatagcaacctagaatcgaattgaacatatcctagtactacgaatctggacatgggatacgtcatatccggtcctagattgctatattctaggacggagggagtatatgaatgtgggcaatgctataaagtcttataatatgaaacggatggatggagtattttagtagaatacatttaaaaaaatcattacattttagacgatgacatgaaagtgatgagtaaacatgcaagcacttcagttacaaataacagagcagagagactttatttttacgtactgaatacaatacaagtgatatgaatcaaacaataatttccaaaaaataaaacaaacatgtaccccgatgcataatctcgcgtacgcgcggagaaggccacaaattaaacaaaatcatatcgaatcaaaccagatacgtacttcttgccaccaaatgcacgcatgcatgaacatgcccatgcatgacaagtgacaacacgctgctagcacgtaggaaccaaataaacccctgttgcgttgagacgtgcatggatcgatcgcgcggctactttataaagcctttagaagcacttgaagccggtgggcacgcgcttgccgcagtagttgaggatgaggctgaggtcgacggggaggttaaggttgatgccgagaatgttgcccttgatggccgtgcagaggcacaccgccgcctcgaggtcgacgagcccctccagcagcgggcagcacggctccgccggcggcacgcccaccttggccttgatgaggcccagcacgttggcgcacacgcccagcttcagcgcgtcgcgtgggcacttgccgaatgcggcgggagtcggggtgggcgtcgacggggtcggcggcgtcggcgtcgggcagtggccgccgcaggcgctgcccaacgagaagaccaccaggttgacggcgaggaatagcgcgatcgaggccttgcctgccattgctgctgctggatcacgcgcactaaaccgaaacgatattaattatctcttgataactcgatcgatttgcttagtgcttgtgatggtttggcattcaatttgacgtcgtatttataggagatgattaaagcaatataatgctgattggttatatgttatgacgagcaaccatgcatgtgagggtgattaggaagctgatctggattctccaaggaaagtacgctggaaatactttagctagtattgaacagaactagctagagaccaagattgctgctntgtgaatgcacgttgacgtttgtacctgcttgaaggttntggtcataattctgcttaagcatattcgcgtatggggtggctgctctgtctctctgtgcctagctaataacgtgcacaaaatgcgaaataaagttggttttaattagtaacgatgcaataattaatgatcagggaaaataaacagcgaaagaatcattcgacgaagacacccgtgttaagttgttttaggtttcatagtgtacgtacttgcagaagagggaaaataaattccaggctgcagttttgtttcatttggctcacgggatcgtcgtcggatgattctatcgaaaattcgaacatatgcacttgtagtcttgtttggtttgcctcgtatgtaaataatctaatcacgtcgctgtgctacctgatccaatatatataatcacgtcgttgtgccgtcgcaggttttttttggctttttcttcgtgtgggtttagcctaggtttttacttcaaaccatgcttatgtgagggtttttggcttggttttctcttaaaatctaggccaagtcttttcttcttaaataaaaacagacactctttgtcctcttctgtgtttttcttttaaaaaaaaactatgatcttagacgttaactctaataaatttcggctgactttcttcagccagcctagtggaaaaaggagtagatcttgaattttgtctgccagatgagttacttatttattacattgtgtttgattttattcgctacaacataaccgttcatctctgacggttcaataaggttatcactaattattgagtgatccgatgttgattattactcgggtgtgagaaatgactcattgtaacatgtgaacatccgtgagtgatcaagacatgtataacgggccaaaaaatatcaaatgtgacatatatgaaaatcgacaaaaaaaaaagcaaaaaacataatcacagtgggagcttgcagtgctcgaggctgagggtgtagaaaagagagggagaaagacagtccgccactatttcattgcttctgctcggatgggtgagggttagcacttaattagcagcatccgtgtcggtgctccggcttgggataggagctagacggtagccgcgttggtgctcgccgtcatatgggccactgtagtggcctctagtcattatcgtcgtcgtactacataagatcctatgttcttgagctcaaactagtcgaatatggcatcctcgagctcgaagtagtcaaattcagttactttattatttgtggagagggttaagcaagggagcattgctggttgtagggggcgaaggaagagacttggggagggaggggggaggggaggggtaagctggcaacatctgcattatgctcatgagtacgatgagcgctgctcgtttcaagagttcaacttgtgcgagagagataatagagatgcaggtcgccagttgaaaatcatatagattagaaagacctgctagagagcttttctctaatggctcgtatttatcattcgttatttatgatgctcatgatttgtgatggttcttatagactctagagatcaaagctcatctttaacgactacccatatattggttcataactatggcccaccataaagggtcctatacctcttatgggtcattctccacaggtatatttcaaacatactactttttagccattagaaatgagttcatctcaatgttttgtgttgggccgttacggcaccttttttttaaaaaaaaatagtgttttgcatgagtttctgaccccttttgagcttacccaccatatgcttacaaccttcttacccaccctaagcggtttggtaaacccagggtggcattcgttcacatcacccattccacgttggacatatgccataatcccaagcggtgtcaccaagccaatagatgacagcgggcatttattgcgcaccagacacaataggttgacaaggagtaaaaattcacaatttagtcaatctttcaaaacaatttaaccgtcaatattatattagaataagttttaaaaatctaacatctttatgatattatgatagtactagtatttttcaaggaaaatttatctatatataccatttatttgattttaaagtaagtattcgagaaagtactatcgatggtcaaaagttcacaaattttgataacttttgtcttaaacgtctaagtacgacgaaaacagctagtaactctttttgcggacagacattgggcattccaaacaaagtgtgaaatttattttattcataatgcaaaagaaataatcaacagatcatacaaggacccacacatgaaacgaataaaaacacggaaaatcgagtagctccatggtacgtgtgcatgcttaatttgcaggtgcacgcatgcatatttgtcgatcgatccatgcatgcgcgcaaatgttgcaagctaagctagcacgtagtagcaatcaaacagtccagataaaatagccagcggaacaaatgcgcagtagcgccgccgcctatcgatgcttagcatttgaagccggtgggcacgcgcttgccgcagtagttgaggatgaggctgaggtcgacggggaggttgaggttgatgccgaggatgttgcctctgatggccgtgcagaggcataccgccgcctcgaggtcgacgagcccctccagcagcgggcagcacggctccgccggcggcacgcccaccttggccttgatgaggcccagcacgttggcgcacacgcccagcttcagcgcgtcgcgtgggcacttaccgaacgccgccggcgtcggggtgggcgtcgatggggtcgacggcgtcggcgtcgggcagcggccgccgcaggcgctggccaacgagaacaccaccaggttgacggcgagaacagcgcgatcgaggccttgcctgccattgctgccgctggatcacgcgcactaagctgacgagcgattagctctctggagtttcaggagctcctgattactagctcgattgctgtgtggttgtgatggtttgatggcatttgtggcttgagtatttataggagaaattttggtgcaatgctggatgattagtgggtgcagctgtgagcttgcatgtgaggatgatttgctggttgatctggattggcctgaatatattttggtagaacattatagtgacccagatgctgcatttgaggaacatgctgacgtttgtttctgttcggtgattgatgatagtttagcacacaatcttggcgtatggcatggctgcactgtacctcgtaacatgcaccaatggcgaaaaaccgaattaattaggaatgttttttggcgtgatcggttgatagatcacggaagggacgtcgacatgtactggaatcaaagcaggaggaatcatatcatgctaacttgcttgagctttccagacaaccaccactccagcccatatttcggttttttcggaaaatgctagggcaggcgcccgatccggcgggaaaaaaaatcggacgccctctcccccacgcgcgcctctccgcgaaaaaaaggcgccctcctccacgcgcgtctccgcctgcctcccacacgtccccaccactcaatgccctccgttgcaacaaatctcccacatattacggaaactctctgttaagagaatacgtttcattttttttctcaactagtgtacttataatggttaattatgtatggatgaaatgtgaaatgttgcagtgaattgaaatattcttttgcaacaaattacccacatattatggaaacgctttatttagagaatccgtttcaatttttgttccaccaacaatgtttcagtaagtgtactcataatgtttcactatgtatagatcaaatgttgcagtgaattaaaacattatttcgctatttgctgaaatattatttttatataaggtgaaacaacgcctgattttttaaaaaaccgttttcatacgttgtagcaaaatgttttatgaggtgattttgttgtgtttcagctttttaaacgattgaaacattttcgatctatttagtgaaacaattccgatctacttggtggaacaacgtgcaacatttaaaaataattcaataataagctaaatattttttcatcggattatatccatgtgtggtcttgtttttttttaaaaaaaatcgagcacccgatccgtaggtgcgtcgattgttttctaaagtaaatttcgatggtactaatagtcatgaatggattttaaactgttgaggaaatattccctcgttgtttgcaaatcatccaaataattatgaaagaaaatggcaagatatgttaatatgtgatatatcactctgaaacatgttggttaaaattcaattcctataagttaaaaaaaatcaagttcgatttatataagttaaagaaggagttaaaatttggtttctatataagttaaagataaagaagacagtcgttgctcgttagcttggtgtaagagcatctccaacaacatctctatcttcctctccaagttaaaaattgacatttttggacaaaaacacactccaacagactctctatctccctctccaagccatccggctggccaaaccactcctcccgctggccaactttggccagccaaaattgacttgccaatcatgggccccacgccttttcccctctccctctcccctcccatattctctctccacgccctcaccctcctcccagattgctcgcgccggcgccgcccctctgtcgtcgtt

SEQ ID NO: 65306 - DNA, 10382 bp, Oryza sativa
  unsure (1)..(10382): unsure at all n locations
agagaagtggaggaagaagggttatttgaggctgacatacgggtcccaccgtcatagattcataatggagagtatggatggagagtctgttggagcaactaactagtctgactagctaagtcagatagagagttggctatataggtgtttggagagtctgatttagagaggctgttggagatgctcttactggtaaacgaaacatggaatatttcagcccagataggccccaacttctctcaaccgctatcatgggtcacagatttcagccctgatagcccccaacttctctcagcccagatacgcggagttgcccatgaaactgtgaggcctgaacgtttataagctttggcccattgtaaacactattcacattggatcttgatgatttcttgaggttagttaggcctcattgagaattgcagtggctcctcccaccactgagaaacgagcacagcctcatctcacgcggcacgatgcattccatcaaatcaaatccaatgcacagccgctttgcggttaccgaagcgcccgtttcggcgaagagtcgcacagcacaactcctcttcaaagcccatcactcacacgcgacgcggccgctcaaacaaaagcaaaaaccgcccactactttgctcgatcgatcgagaggaggatcgcgcagacgtagttcgtgcgccaccgatcgacgacgcgagcatggacgtggacatggagaggccgccggcggcgacggcgcagggcgtgcggcccaaccccgtcgtggagaggaagctcggagagctggacgcctgcctcgccgacgcgatgtcctcccgcccgcggcggagcgacgtcgacggcagcctcttcgcggagattcaggccaagaccgacttcctaaagacgcttatcgccgcggagggggagtgccacggcggcgcgctgccggagcacctggaggaggccaaggcgcgcttcgccgtcctcaagggcgcgttcgacaagtgggcgcggcgcgacgacgcggcggcgccagcggaggaggagcagcccgacggggcggccggctcggggtccgagtgctcgtgcaccgagtcatgcttcggggtcgaggtcaccggctgcctggaggcgacgtccgacgtcgagcgcgaggccgtggaaatggcgacgctcggcgccacgttcaacgccgagcgcagggccggacacaagccgtcgccgtcgccggcggctgcgacaaggaacgctgctcggcggcgcggatggaggcggagcgctgcttgctgcggtgcagccggcgccgtggcggtgctcgcgctcgccatcggggtggcgattgagtttgcgtcggtggctcgccaaaacgtttacgttgttccgacctgacagatttgtttcccttgcaatttcgctgtttttttcgttgtggcctcctacagtatttagcaacatgtagagtagctaaatttcgctcttcctgtttcttgtgtggtatccgactactcataaacatgtagtagtttactgtaagaagtaaatcaaggagatattggtattttatagtctgcatacattctaaactctcttaaatgtgtatgaaaaaatttgaaaaaaaatcaacatgtgagataaaatttaacaagataaattaatatgtgatagatcaatccacaaacatacaagataaaatttaacttctacatgttacaataaaaaattaactgtgaatgtacattaactagttgtagtttaatttgttttattttgtaacttgcgtattagtggagtcatatattacatgttaacaaatcttctgatttttttttcatttttatcataactatctgagtcatgcaaacaacaagaatgttctctccgagactttaaaatcccttatttgtttctgcatataagagattataatcctgcataaaacttgtcttaaataggttagtggggttgcttggccaaagctatgacgacttgacgagtccttgtccatggcaatcatctgtgtctgttcattttgtcatctaggctcatctcttcacttcttgagtcaatagaggaagtagtaaaactttgttttctctatctatcacggcattacagatcacaagtacttcaattatgctatacaatttacatgaataaaatgcaaatagctcgtcttctatctgaaaatgtacaacctattgaatattttctatgcgtacactactactctattgcctgtgacagtattatagatagcggagatggtgcgttagcttggtggaaataaacagagatcctttttgcgtaaacatatgactaaaccttgatctgcttcatgaagtgcccaatgcagacagatgacatgaaaactagcagcacaaacattgctgagaagccctgttgagatgatcttgctgccctaagtagttcctgaagcaatattaaatttaaatgttcagacgtttgacaaaaaaatacaactaatacttgtctaagcagtcgttttaaaaaaagtgtgttgcagttgtgataatcaggtgttagaatttacaagctgtacactgaggttgttcatcaatattgagggcataataactcataattagcaaaagcctgtaactgaaattgtagttctggtaacatttaactcgagagatagaaaatgccaagccaatttcagtcatgtttcttaaagaatttattctgtccttatatacctaccactaccggtgcatcattatttcagatgagaagatacaaacaggaatagcattattcctactccagtttgtcgactactgtagctcagtaacgcaaatgttcccttcatggaaactaaaggactagggctcattaaaagatcacctatctatcaccaaacgccaatgcatcccatatcctcattgattaaccaatgctgctattcaacagtttcctggagtcaaaagctcctttgtacatatttatccaataaagatatccagattcggtggttttatgtcactcaaaaataattcgctttgtaccaaactaccaatagatttgattgagtacgtgtcatttttgcagagttcaatccagctttttagtgcaaacatattcagtttaacaatattgttgcctcaggcataatcagggtgaaaaagttaagtattatcactatttccttcaagatataaacattgtttcaagaaaacgatttagaagcaggtactgcagtagaatccaacgctgaaatggcaggctattcaaagagcgtaacatacaggaaaaaggtactgaaatcttaccatctgttgctgaagcttctgattttcttctactggatattctctctctgcaaccagcattgattctacagagacaccctgaacagccacacgcaaatgcaatatgagcaaggcagagcaaactgatagattaaagcgtcagtttactgcaaaaaaattctgagtataacccgctaaatagtattgtctcaaccaaccaaacaagacaatacactgaattataacatacaggttctttgttttaggtatcatactgctgtactgacaatggcatggtaccaaacaaggtcacttatctacccagacaaaacaaactgaagaaagaagttgactactaaacttttgataatgacatcaagagtctcattctgcaggagaagcatcacaaggttgttaggtaaaacacgttagagataactttgacatgaaaatttttagtattacattagctaacatgtgattgtgatgaacctgaaatttttgttttcttttaaaatcggacatcggctcgtgtgcaatgtgcatttttactatagaaaaagcatcagagtacactcaatattttttaaaaaatgtaaaacccggatgccattatgacaatgcaaccaacaagactatgcatcactcatcttagtgactaaaaaaactttaaccgagcaaatggttacctcagcagatgaaactttgtctgctgacctatcggtgagtgtggatacctgagaaggaaacatgtatgatattgttttctctgtagcaccgaataaacatcaatgcatgatattacttacagttacagcatcaaacactgatgtcattttcactccatggctcatgacctctgactgaggggatgcatcctcttcctcttcctcttcctcctcaggcactggagagggagggatagcagcaacatacaccacccgcagcttgaactcctcgatcaccctgcctggcgctttagtaaactagaaaccacaacaccatcagctctaaattntgtaagccccggctagagatatcagatatccatgaagattgctacaagaacttaccaattcagggacaaagtctctcatggtcgccccatatccaaccgccacgctctgcacgaggaacttgtccttgcagtggtaatcggatagcatttaacgggagcctgcattgtaactacaccgatttcacaatttcagtaacgacatgaacacaacagaccgatcggcaagtcgagcaaattaactaattaagcactgtaatagtgtaatcatgtagagcaaatcaagcaaacctcacctgtgatatcgcacgagctccggggcggcagtataccgcaggcgtgccgcacagagtacttccttgggttcgtcgttttcacctacggattgtcagttttgcagaacgaaaatccgtcaccctttcctccaaacgcatcacatgctcacagcagcatcagctcagagcgagaagaagaacagagtattcattcaccttgaacgccacgtactggttggtcttgttcgtcagctgcatgcagcaagacctcttcctcttgtactcatcttatcaaaccaccgcataaacaagaaatcaagaagaaaatcagtcaagaaaagcttgaagccaacgctgcgaacaatcaagagtttggttctggaaagcacttacaggggatcttgagctcggaagggtgcacacgaagcagcgtattactcatggctccgatcggacagagcgagagcgagaaaggaggagcagcaacagcggaaaagattcggccttttgctccctttccgttccaaagaacctgtgtgacctggacgtcgcggcgcgggaagtggctaagcggttgctgcctcttgaagtaaagtatacgggcaaaatggcgatggtatgatgagcggatggtgatctggaattctggattccgtggagcagctcggggatcggaggaataggatattggcctgaactttatggtgggatcgttgcggcaaatatcatatttaagggataggattagaatgctcgtcatggtaattgcaaaaacctccaatccaatcgcattcgttggatgcgacatcaacgttgccgatgtgagtcctctggattttctttttggtgtcagctttgggtatgcccttttttatatactagtatattactactactactaatctaggatttttttccccctggaatgtgtagcctatttcagttaactaactgcctaatgcagaaatttatagaactcataatgggcacactagtttgttgcaaaattggctaaaatttccatctgcaaagtgcatttgcagttctctactctgaatcaacatcacctgtcaaacaacctccacaaaggataatgtatcatgtagctagaactgggtaatccaagatttggtagagtgtggtagggtaagcctaactaaaggcctcctcaactgcctgcctctgcagctgaaacctgaaacattcagctaattgatattcctgagttttgtttccttcttatcttaaaagtgcacattcggtagtggttgggcaatcaattattgttgagatatcagcttccaagactatacgagtgcgaaattgtttgggcttgtttagatatcgactggatttaccataaattgcagaagcacaacgttcaaatgccccatgtataattcagttgttctttctctaattcagtttatccatcataattcacggccggcttgacaggccaacaccacgttgaggcccattagttgtcagcccaatgctcacgtggactcaaaaggcccaaatagcctattggaaaaagtccactttgactcccttaattgttcaccgaatctaattcgtgacccttaactacaaaaccgggcaggatgactctcccaattactaaaaccaatacaaattgaatccctcaacggttttggagggtggttttgctgacgtggcacttggcccattatgctcgctgtcagcctagtcatgaggcccacatgcaattgattagggaaaaatataaaaaacgtagggccagcttgtcagggcactcttctccctctatcttttaaataaaaacagcagagcaaccgccgccggcagcgatggcgatggcggtggtgcgggcggcagcggtggatggcaatggcgatggctatttgtggcgccgcttcggctcgtcgccctccttctcctcctttgtggccgactgctgcgtcgcgcacgccacccttgtggagcgcggcgccgctctcgccgaccgcctggaggtggcgcgctcgctcctcggcgagaacggctacaccatcacgcgctgcagatgtgggcccgtgtggcaaatcctccggcgcaaccttgtcgccgagacgctgcacctatcgcgcgtccgcctggcggggaggtcgagggaggatacaacagatcaacagcaactcgtgttttctagtaacaactacagagctgagcaggacacaagccgccgcaagattcatcagtgatattcttcttttgaaaattaatcatcagtgataatcgagcggggcaggcgtatccttgagatccatccgctggaaatggacatcctgcatgcacatcacaagcaaaaataattcagtcatcacaaacctacacaaagcacacatcaagattgggaattcacacgcacgaacgtaccgatgcgaaatggttgacgtcgcggtggtgcgcctcgtcggcacgaacaacaacgacgacgtccttgagcgtggcgccggcggggagccgccagtagtcgatggcgatcggcggcgcggggacgttctcgatcttgccggcctcgatgtccttgaggtactcggtgtaggagtggatggcctcctcctcgaggtagccgacgacgcggtgcgcgagcttgggggagaggaggtagccgaggaagtaggcgttgaagaagacgcgctggacggcgagcacaagcgtgcgctcgtaccacctcggcttggccacctccatgaaggtcatgaggtgcatccgctcgttctcggcctcctccagcagcgcgcgtatccagtcgccgctgtgctcgaagctagtggcgctggctcagtcccgggccttcctctccgactgcctcatcaacgccaccaccggtcacccctttatcttcgagggcgccttcttcctctccctcgccacccgcatcaacttcggcacccccaccaccgaccccgtccgctaccccgacgactgcgtctgggagtccgacatggcgcgcagcccaacttcctcgttgaggtcgcgcccgctaccgctcagacctgaccgaggctcgagagcgaagctcggcatcgcccagatgcggagctcggcggccgtcgccccccgcctgccgtcgcccccctgctgaattgggagggagagagataagggggagattggggaggatgaggaagggatagactgacatgtgggcccacaaattcttcttctatgtgaatgacaaatgggtcccacgtgtatgttgttagttataatgccacctaagcgtcacatcaacagcagaccaagtcaacattgccatgtagatgccacgtcagcgaaaccactcttcaaaaccgccgagggattcaatttgttccggttttagtaattgggggagtcattctacccggttttctagttaagggtcacgaattagattcgatgaacaattaagggagtctaagtggactttttccttacaacaatatcgatcccatgggccaccgtggtgcaggcctagttgaaggctgcaaaatcccccttctacccctccgttctcgatatatacgccgccgcctagatgccattctcctcttctctctccttcctggtgcaacacatcgatctcaaattcttcacaggtttctctcatttcccttcccttttattatgaacttttcgatcttttctcccgcgcgctctcaatcggttcgagaatgagaggattcgttgtcggctcgccttgtgtttttgccccccttattttttttttcgtttccaattccatgatatttcacatccggggtgcaagtttgtagatttgaatacttttaggggaatgccatatatactagatcggaactgttcatggtgtagttacctttctggcatactccgcgacatggtgtattcatgccgcgcacgaatcgcatcgatgttttctgtttctgaacttgattgtctaacatgtcgttattactttagatcgtatttattccatgatagactcaatgcatgtgctgtctattttgtgatggatattccccccccccccctgaagaatcacttccttgtagttctctaccgtcagattgaatttttacagaaattatgcatgattggtttttaaaatcgaagtttacagcaatgcaaattgactttggtgccctcatgattcacttggcaaaagagaagttaggcgtacctaccatgtcattaagggttaatgatcgatactagttacttattgctaaatgttttctcgggtagcttatcactgtggatggttggcattgcattcgtaatactgaatccttctggtaaatggcatgccattttcagattatttgaagcaacaacaatttgattctgcaatgtgggcagatcggtgcatatttgtactttgctctttatttgaagggaatgtttatactttgctccaaggccttttcaaccaaaatattgagataaacttttctgcccacaggataaaaattcaatttagagcgttgagatcaaagtttttactatgccgaccattatgttgttttcattctttcctcaatgacaaggacgctgatgtagcataattactttctgcgggattaatctaggtgcaaaggggattcctgttggatagatgccattatatgagtttgctcatgtacgcatgatgtcatgtaactcatcttgtattttgagatttttcaagataaatgacgcctcttggctcttgcatgcaccaatgctatatgaccaggtatatgcgtagggcggattacatggccttttctatctggctgtcatttttctgatgcacataccttcttgaactggagagtacatgaaggtaaatcacatttttgtgattgtaaagtatatgtgcgtttagttgcgtcatattattatcttgtgttttttttttccagatctctgctaactttctgttgaacaactgtgcacgcacctacaccaagaagaaaacactcaagaagtggtttttcattgacaagaccctgggttaaatctagttgaagaaggcctattccacctcattttggtagtggatatgagcaacggtttgccactcatgaccaatcccatgatcaaaagccagccagtgttggcactgccttcaaatctaatgccatgtttggttacatccaagaagcatccatgttcttcattgtgtgtgacatacatcagtaagcgtgaacttgttgaagtcgttgatggacttgtcggggtaatgatgacatcatcgaaccgtgaaaagccagacattgaatctggttacgacggttcgtctgatgaagattccactgagaattctcgtgcagtaagttgcttctttcggttttctgttattctctttgttttctacaaaggattttaatatgtttatcttttatatcaggaaatttgtccttctgccttatgtttcttcgaccaaatcgtagctagtgcgcaagacaagaaggttgtgttgtttctagactatgatggcacactttctcctattgtgaatgatccagagaaagcattcatgtcctctgaggtaagccagctggtgtaagataaaatatgtattgaaacattgcttatgtatgtgccacttactaatattctcaatctgaataccttccttcagatgcgtgctactgtgaaaagtgttgcaaagcacttccctacagcaatagttagtgggagatcccgcgacaaggtctgaatatattttttacatgtattggtcttcacgttttagtgtgacaattatgtcagtatgaaaatcacatatctgatgtttgatgctggcctctccatgtccaggtgtttgattttgtcaagctgactgagatatactatgcagggagt

SEQ ID NO: 65307 - DNA, 1239 bp, Oryza sativa
ccaaatccctgatagaggtcactaaagcgattaagggtgcaacagttgagaacaacaagttttgcgtatctgttcattatcgtaatgtcgacaagaaggtttagttggaacattcttgcctcccttgtggccttgtcgctttgcaacaattgcaagttttctcctataagttttttttttctcgaatacagtttctcatataattttcacctgtttccctccagaactggaagttggtcgcacaggttgtcaacaatgttctaaaagattttcctagtcttaaagtatccactggacggaaggtagaaggattaaaaagatagcaatgtaatatactgttcctaataggcggttcatcatttgtatgctaaacaggtatgctattatgcaggttttagaggttcgtccaatgatcaactgggacaagggaaaagccgtcgagtttttgcttcgatcgcttgagctagatgattctgaaactgttcttcctatctatattggggatgataaaacggatgaagatgcattcaaggtcacctttcttcagaaattgcataccacattttagatccatcttacttcgagcgttagtgaactcaattattattcctttttttttttattatacgaccaggtgcttcgcgagcgaaagaatggatgtgggattcttgtttcgcaggtgcccaagaagtctgaagcctttttcatgctgagaggcccatcagaagtagtgatccttcctgtcatgcttaacttttttgctgcccttctgattatgcctagttaattcaaaattgctttggtcatttcacttaacaattgccatgtaggtgatggaatttctcagttccttggtgagatggaaggaacaatcaacatttgaagattgacagcttagccaatcagttttagttgggatagctagctgacgctagcgtttaagcattccctgggcgacaattttacagtgcccggacgtggagctggatagtagctagatagtttagctcccatagttgcaaagaaccagtcgatgctattccgtttcttctaatatttatcatcagaggcagagttctagtagttttttttttatgaagtgaacaatctttcagttctaccagtgaaaattcacaagcattacggcactgtgctaatcctgatattttctccattagtctccatcttggttaggtaccaggatttgcaataatgtcaactcgcatcccctttctcccc

SEQ ID NO: 65308 - DNA, 1176 bp, Oryza sativa
gttagtactacgtaccactactatttacgaaaaccaaacgttaaagctgacagccgttgcccgttattacgacttgttggagtgatatcactgatatggcaacaaccctcaaaaccgagtcaagttcccgtataaatatttccaccacctgtacataattcgcaagaattttgagtcaagccgtttaaaagatccggaagtttcgtacagaaaccaaacaaattttgtacgaaaaccgcggctttatattaattaataatataataatatcataatccgagtctaaacgaacggaaagcgcggcatcacgtaacaaccctttttcctttcacttccctagtctcgcgtctcttctactgctctccctccacttcgactccactcctcgtctccacggctgcacctttcccactcccgttgaggccgaattaaaaataccaaaagaaaaagggagaaattccaccgcccccctcgaggcccagctcaccggcggccgacgtctccggccattcccggcgaccctccccgcccccccgccggctcatgcttctcggctcggctccggcgaccccccgagcgtagccagatctgggcgtaggtggtgggggaggaggaggaccttgctccgtcggggatggggcggggctgcggccgctggtggtgggtcgccgtggctttggtggtggtggcggcggcggcggcggcggagggggcgcgtgaggaggcagcggtggcggtggcggtggctccgcggcggcacgcgtacgcggcgatgatgtacatgggcactccccgggattacgagttctacgtggccacgcgcgtcatgatgcgatccctcgggaggctcgggtcggacgccgaccgcgtcgtgatcgcctccctcgatgtcccgccgcgctgggtccaggcgctgtaagcccccccccccccctctctctctctctctctctctgagtctatgtcgctctcgcgccactagcctcacggttgtcttttagcttggatcgctgggtaatgatcaaaatctgtctccctcgtagatgttcgatttgtactttggagtatatttgaatcgaggtctgattcagctctctctcctcttttttttttcacgcgctggagggttgacttcgtgcctgttttgttgtttgatgcgaatttgtgggtttctta

SEQ ID NO: 65309 - DNA, 2130 bp, Oryza sativa
tgtcagctttctttgtatcctagtggtccatcctttcccctctgttctgagaatatcatacctgtgctggccagattgagcatttttaattgtggagtttagtaatagatattcaatttaatatggtatatgattagttgaagtaggtagccatgttgggccaggaagcttagccattattgagtcatgtaactagcaagagtatataatattatgttattggcactaatgaagttacaactaatcatggaggaacaaatatggacataacaaaactagaggaacattagtgatgttgtaacttataagtaccatgcaagaataacagtggcattattagtggaaccaatgaggtgattaatggggtaataatacatgcatctttcagaaaaaaaatgatatttgaattcagtttgtcatttgataacttaagttactggtagaattggcatgcaattattgttactagatatattttccgtcagctgaaatacatgctctttttgtcttgtgtggtcttgattcttctagtatttatgcatcttcaactgtttctttaggaaagatgatggtgtgaaggtggtctctgtggagaatttgaagaatccttatgaaaaacaagggaacttcaacatgcgattcaagttgactcttaacaagctgtatgcatggagcctagtttcctatgaccgagttgttatgctagactctgacaacattttcctccagaacactgatgaattatttcagtgtggccagttctgtgctgtcttcattaacccttgtatcttccatacagggctctttgtgcttcaggtaggattacttgctatatgggtttctcctttcttctgcaaaatttcttttactttctccatgtaaggaaagatattagctcttaatctcttcattactaggaatgactatgaatcgacctcctttagtccattgcatctacaaaggcattctgttttgtttagcacttcatattaggggtgatctaactgccattggataggtaatccttcattattgtttaattaaaagatctatgcagttttgttgccaactggtttactgcaaatcttttacctgaaattaataagcttgttttagaagctgcaagcttatattgaatctgttttcttcctggatattagtctttagctttctgttggcctttctcaaagcacagatgtatttttcaggggcgcgaaacacagaatctacaatacttcttaaatctaaacctatctaatgcacgggccaattgctgttttttttggcacaatattctgcagtaggcaaattcaaaatggttatgacaactcctactttgtgcactcattttttttgtcatactaaccagttgttacttattaatcaacctgattttctctagtccagaaccatctaaagttcatcaaatgaacctgaatattgaaatttatgtcgtcatgaatttttttttctttctattttgttttcagccctcaatggacgtttttaagaacatgctacatgagctagctgttgggcgtgataacccagatggtgcagatcagggcttccttgctagctatttcccagacttgcttgaccgaccaatgttccatccaccagttaatggtaccaaacttgaaggaacatatcgtcttccgttaggctatcaaatggacgcatcttactattgtgagtatcaatagacatatacgaattcgtatgctcatgcattttccccctagactaatgggatatttgttcagatttgaaactccgctggagcattccatgtgggccgaacagcgtgattacatttcctagcgctccatggtttaagccatggtattggtggtcttggccagttttacctctgggactttcttggcatgaacaacgccgtgaaaacttggggtgagtaattttctcagatattttgtcttgcattttatttgcatgattgaattctgatgttaatagaatcttccactaatgcattgcttcatgtacaaaatttgttagcatggatcatggatggtaatatcatccataacagtgtatcatgtgcactcgtgtgattggttaaatgccctttgtgaattgctttcctatcttctttagaataaagat

SEQ ID NO: 65310 - DNA, 2337 bp, Oryza sativa
acttgcagcttacaccatacccttcttcctgatcccacggacggtgcatccgctactaggttggccactatatttgcttggtgctttctcctttcttcaatcggatcaatgtattcctcctccacccccttgcggtcctcacaacatggttggggatcatcggtgctctcttcgtgatggcattcccatggtatttaaacggtgttgtaagggccttggcagtgttcgcctatgcattttgctgcgctcccttgatctggggatctttggttaagacaatgagctccttgcagatcctgattgaaagggatgcattcagacttggtgaacctaaccagacagccgagttcacgaagctttattgaggtgtgtattgcagatacatgtcattgcatttcatcagctaattccgattcgcattggctattctgatggccaattcagttgtacaagtaaaaccgcagatgaaactacagttgcacctttaacaccacctgaaacctttggagcccgtgatattcttcgtaattgcgtaggtgacatacagggcaaagggagagaacatagtttgatgtttgtgtgtggggggtgttggttgtggaagtggaactgcagaggaacattatagagtaatttttttgttacttcatttactgctcctctaaaagagccaacacattcttggctttcttgtaattgatatcatcagttccacacgtccactatcatgagattcaggtgttctttgcaaaatgctgattggaaaaagaaaactatgtactaccactggatatgcatttgcctttccctataggggggtgagtggtgacgttgcaaacaccaaagtaataagctttgcaaatatatggcggcacaaaatccaatcgtccacttcagaatgttgtcttgtctcgtcttgacaacgacgttggatacgacaaaggtgtttctcatgggcacggcccagtgatagaggtaactgaggttataggttcaacccggaagaaaccctcctctcaatgtcgatgtttcagtgtattacaagtgtttttaaatctttcccgctctcttcttttaaaaaaaaacacgtcacaaacgcaaacgctcacaacgtttgtgcactcatctctataaacgcaaacacgcacgccccacttttatgaacacctatgaaaaactaggtcggcatatcttgcgcgtgcacacttatccctatcaacgtacatacactatacccttatgagcacctccagaagattgggccgtatatcttgcgcgcatagattcacccctataaacgcacacaggtacatcctacctccataagcacctttgaaagactaagccgacatatcttgagattaacgaaatcaccacagatgcctcgctgtcaacgggtacatcgcttaccattgaaagaataattagccataaatatgaacatccgagtcagctttaaaacttgaacttaggtggctggctccaccacaagggactaggggtgtcaatttctccatcggggcgaccctaaggggccgggggcaaggtggaattctcacccgtgggtagggggcgcaaacagagttcactccctcgccgtccgccgcctcgttgtgccccctcgttggccacctcgtcgtcgcaccccctcctcgtccacctcatcactgagccccctcgccgttgccacgtcatcgcctgcaacctcgccgtccacctcatcgacgactttcttggttaggttgcggggcctcggggcgggtactgattttcgccctgttcatccctcgggggccggggacagggatacccgcaagagcgaggggacgggagcgttccagcctaacccggccccgtcccggcccattgccagtttgcaacccttacaagtaatctaacaagttgagctacgctctattcttttgctatgggttggttacaagggcaaaaccatcattttgctaagcctagcactcgactaatataattttgtaaaatcttcattttttatattttttcaaatgaattttggcctctttgatttgtagagaaaacaacaaatattggaggattttaatcctaaaaagaaaatactaagaagtcttttgaaacaaatgatttaattatattcttcctctaaaattcttatgtaagggataattctatagagatttcagaggaaaattagcaagagctttaaccccttgaaaatatccttgaagtctctcactctcatttgattcttgtgttggtctaatcaaatgactatttctacattcttttgtgttttacaatttgttttgcacttgtatttcttatatttttgttaactagaaa

SEQ ID NO: 65311 - DNA, 750 bp, Oryza sativa
gacagttatttttccttgtggctaaaccattgacaccttgtttgagatggataatactaaaaaaaccgtgttacctaatttagttagtaatgactatgcatcctatttctttgatccaatatattttctttaaagaatcatctatccttctatcgtgtttatattatgttatagcctggatctgttcaaaatctgtattatttcaattctatatgcactttactatatttttctgctatataaagctacacagttggaattacaaagatttagttgctactcatgatcctattctgcttcttcaactcccactttagctgttaattgatatcatttcgccctgtttttttttttttgtaggtaacatctaagaggattaactttataattgatgagagtgcaagcgagagtaacatggatgatcatgcgtccactagcggccaatgtgatcaacaggataaagataggagttggttgatctcctctctgcatcagatatatagcagacggtaaagattattttctgatcagatgccatgtttagaatttgttttctgatgtactcttatcaagtcgcaatgcggatattcttgtctgctgagattaaaaataggcattcaatacttgtgaagcaaatgcatgcagcatcaatgacattaaccacataatttttatttctattcacttactttggttattttcaatgacttcttgcagatatttgttgcggcgaagtgctttggaattgtt

SEQ ID NO: 65312 - DNA, 1712 bp, Oryza sativa
cctcctgagccattgtttgaatggaaatacccaaccttctacatattttatacgcagatgttcttgaactaaagatcataatggtactactactacctaatatctagtgagcatatacactgaaaactgtaaagttacaatttgatgtatttatttccatacatcatatcataaggataagtgggtattattttaaccgtgagtcacaacaaatttgatggtgcatcagctctttgctcttaaagcttgtctgtggttactccttccagttccataattcttgacgttttggatgaggttgaggtcaaacaattagaaccttgactatcactaacttttaaaatatttaatttgaagacactagaacatgatgcatatattagtttaaaaatattttttaaaagctaaatatttacttattttttgtatatattataatagaaaatcatagccaaagattttggagatcatgttgttgtccaaaacgacaagaattatggaactggagggagtacgtgctatttttctgttgggatatatttatacttgccttgatcatttgaaagacaatacaaatgtgtagcagtctagggccatcttatctatatagctcatctgacaatatagtctaagctgtttcttgtgatcttaacaatgtccttgttaacaggttgcaagggtgttgcacctcatctataggttgattgtgcagcctaacatttctagagccaacatgtttgctcagtcattcatatcttgtggtggtgtggatgcacttctcgttcttttacagagggaagctaaagctggtaacaacagtattttggacaattctgatgcacttttaagtgaaaatgattttttaaggaatgatgattcagacacaaaagctgctagtggtgaagcaaagagccaggatgatcaaattcaatcagttgaacttgaacagcacgaatccatccttcatgaagaacatactagtgggattacaagccaaatgatgtgccttgtgagattttgggatcaagtataggaaggaagttgtccagttctgaaaatcagctgctaaagaatttgggtggcatcaacttctcaattactgctgacaatgtccggaataatgtttacaatgttgacaaaggtgatggcattgttgttggaatcattcacattttgggtgctctagttgcatcaggtcacctaaagtttgcctcaagggctgcaaatccaaatttacctggtggccttctgacgacagttcatgaagaaggaaataccatgtcagaagatagagtgtcactgttactgtttgctctgcagaaagcatttcaagcagccccaaggaggcttatgactgtaaatgtctatatggctttaatttctgctgcggtatgttgtttatgtgctgtctagataattgtatatgtttttgacttccacgaaatcgatttcctatgattaattaacttaagagtaaattacttagttgcctgttggttaccttatcacctgacctttttctcaactcaggccacatgaaaaactgatatctaagtttctatcaacaaaatctcttggattgtgctttatggtatttcaagtaaaaataagcatgaacgctagattttctctgcccagtcgagtgtccgagtccatgtcagttttggcggactttgcagttatatcctttacttagtttttttttgtccatt

SEQ ID NO: 65313 - DNA, 7528 bp, Oryza sativa
aaggcgctagagctcgtgcggcggccggcgggagggtagtattgctggcaacgcaaactcgagccacgttgggcacttgggcgtttgctagctgctaccgctagtgtagccggcgaccacagagagagcgtgcgaaagataatcgattgcggaagccccaccccctctgttctccttggcctataaacggaatatttctcgtgagtcccacatgtcattgtctggacgagcaccctggtgctctgggccctcaacaccgaggacgaggagatgagatcgatcgcgtgtgggccggcgagccgcacctcctttaggaatttgtttctttctcagagtcctccgtttcttcgacccgtcgttctctcgccgcctgcctcgccgcccgcccgacactttccaacgtttaaaacccgtcttttttctccaggttttcgcaaggggacgacgacgccctgtgccactacggtacaaggccgcgccgagccatcggcccatcgctgcgtaaaggtgacagctagcgccgggcgatgcagccgcccaacctcgcgcgcgtaaagtgaccgttgcgtttacccacccggccgaccgatccgcgaacgccaccgtatgtactggactagctagtctctctgttccgctctactccaagaattcctcggttccatctgcatcgacggttctgtgagtctgacacgaagaacgtaacgttcttctctgtaactaacgcacttgttcggttgttccagaacgaccaggctgcagagctagtgcaactgcagacaacgatgccctgccgccgatgcgtttggcgttcagaaatggacgtagtactagcttggagcgtgaatggcaggatgggtgtacacgatacggatttgtcaaagccgagctgccgatccgatggtgcgtaccttctcgtctctgaatttgcactgcgaaaaaggtataaaggagggatgaatcccaacccaaaagccaaggtttattctcactttctcagagtacatactaccagtacacgctacacctccacctccgctgctttaggccccctttgaattagaggaaaaatggaggaaaaacaaagaaattgaaatcatacactatttatgcctttgattcataggaataaaaaaaggaaaaacgtaggaaactttcctattcctacaattctagagcaaaaacgtaggaaaattaacatccactctaacctcttagaaaactttccttgagtctatctctcttatctgattcctatatttttcctgcggtctaatcaaacagtcatttctatatttttcatgtgtttttgtaatcctctgttttacacttgcattcttaccaaaatcctgtgttttttctgttccttcgttttttctatacgatttaaaggggcccttaatttttagcaacaccatgtggtcctcaaactcatcagcagcagacaacaactaaagagccgtgtaaatatatcagacaatgcaattagtagggagaggcgcccataacacacagaagagaacaaggatcagagacgaaaaggtttagccttttaacgctgtgatctactcgccgctacaaagagaatggacggattgatccaaagtgcctcgactttactacttgcggcggggtacaccgtgccgcccggcgtgccgcgcgcctcccaacgcgagagggggtttcgacctacctgcacggcacgcacgcacatatgctctgcatgtgctgtgcaacgcatgggcgcagccgcgagagcaagcgcggcatgatgcgcctgtacgctaattcttggatcattcctccctgcgttagtttaacttaatcctaccggtacactgcagacacccagctaatcaattaggcttcttgcattagtatatatagtgatatatactatatactccgtaccttgtatatgtcgttggagtatcatgcatgctgtgactgtaaaagcctgcagctaaccgataggaaggtagcagagggatcgtactgttctatctcgtgcgtagtggtggcatctctcggtgtccccagtttgtaatctagccaagtttcacggcatattaatttgcagcgaagggagacttatggttggccatgcatgctctgatcacagttacgctcctatccatgtacacgccgtgtctctatccggtgttggcccacggtatatcaggaccatcgctctctcgcgtctagggattcggaaaagctggtgtatatgtccaacacatattttgatgcaatgttgatacgcgatgtgactcgggttttggtacgcagatatactcagatgctacggactgaaaattgtacttggggtatacacaaaagctagctgggcgacgacattttggagagatcggtaagtctattgtgtgtttagagctccgtcgatgacgttgcaattgttctatgacaagaaaaatgttaaaatatcagctaagtgcaggaactcaacctggtatctcagtgaataaacatatggacgaggtatccgtacattgtatgattttgatatatcagtcatcactcatcagtgtccgtaaatatctctctttttctgaaacattaacgcagaattattatacgttagctacggtagctaaactaccaggtgaaagctagcgatcgaaagcatgctagctagctgcatgcatgaccgttggcgtccgaccaaagcagaaattccaaaccggggccgcagcgccagcagctagctgagctcttggagtgttcccgtcgggcggctatagcttagctctctcctccattatttgcatggccgtttcctcccccctcacagccctataaattccgaacccctgcctcacagtctcggtctctctcaccacatattccgcgtgcatgtgaagagagagatatagagaggagagctagcgaaagtttgagtgacaaagacgcacgtacgcgcgaaaacgttgtcacgcttttgagtgatcgatacacgggggggatacacacgcaaaccgatcgatatggttcgtgagcgggtggtggtggtgatggcgttcgcggtggcgacgctcgcgacgagcctcctgccgccgctggcgtgccaggcggcgccggcgccgtgcgagcgcccgacgcgcgggcaccaccagtacaggcagccggtgggcgtgcggcggatcgtggtggacgcgagcggcggcggcgacttcctctccatccagcaggccgtcaactccgtgccggagaacaacaccgtgcgcgtcatcatgcagatcaacgcagggtcctacatgtaagctatacccagttagctcatgctcatgctcatgcatgcgtgtgcagagtttgcgtttctgacgtgatatatgtgtgcgtgcagagagaaggtggtggtgccggcgacgaagccgtacatcacgttccagggagcagggcgcgacgtgacggtggtggagtggcacgacagggcgagcgaccgcggccccgacgggcagcagctccgaacctacaacaccgcctccgtaaccgttctctctaactatttcactgctaagaacatcagcttcaaggtgagctagcaaacaccgttcgcgcgccatgccatgcattagccagtggtccgtctccatggacccggccgccaacgtacgcgactcacaagacgcacagggagatgcggtgcagtacagtgccgactgccgaggcagagaggcagacaaagtgacaaaacccttcagtgtcacgagccacatcttgcaaatttgcaaatgctgcatgccgggcgtctcttcttctctgtgtatcccttgttcttttgatattttgaatccgtttgtacagggatgtattttcgggttcttggagcagccaaagcagatggcttcttccggctacggcggagagaggctacagcctgatcgacgcggccggccaactttttttttccagtgaattgcatgcatgtaagtagcaaacaacagctgacgctgggttcctgaatcctatggcttggcagaacacggctccggcaccaatgcccggcatgcaagggtggcaggcggtggcgttccgcatctccggcgacaaggccttcttcttcggctgcgggttctacggcgcccaggacacgctctgcgacgacgccggccggcactacttccgcgactgctacatcgagggctccatcgacttcgtcttcggcaacggccgctccctctacaaggactgcgagctgcactcgacggcgcagcggttcggctcggtggcggcgcaggggcggcacgacccgtgcgagcgcaccggcttcgccttcgtcaactgccgggtcaccggcactggccgcctctacgtcggccgtgccatgggccagtactcgcggatcgtctacgcctacacctacttcgacagcgtcatcgcccccggcggctgggacgactgggaccacgccagcaacaagagcatgtacgtactgcttcagctagctagctagcctgatcaacttgataaaaaaatgaaactatattattcaattcccagccagctaacgcctgtgcaaatgttgtcgacggcgtgcatgcgtgcaggacggcgttcttcgggatgtacaggaactgggggcccggcgccgacgcggtgcacggcgtgccgtgggcgcgggagctcgactacttcgccgcgcgccccttcctcggcaagagcttcgtcaacggattccactggcttacacctgacgtctgaaagccgtttttcggcaccacaattaatttactggagacaagaacgtacatttgttagtacagcaaaagcgaagaatagaacattacgataaatataaagtattgaagtgactagtgcagtatatagcggtagattcattcgttcattcgttttgtctgatccggcttataatgatagctgctatagaattcaagcacagctctttacaagatctatagtagctatgtagtactgttttaaaagctttgtcatgtagacatgtacccatgcatgtgaggtgaatagtgaatatataattgattttgttgttactttaaggaaaaatccaaatttgatcccttaactatgaccttagtagattttgatccctcgactataagatcggtctccattatcaacttttgaaattgaccatatttcatctatgggcgccaatcacttctaagagttccgatttggatcagggatgaaatatagacagttataagagttgggggatgaatagtgaacattttaatgttcttctaattgaaggacaaagtcaaaccaaggccagataaaatacagacttttctctcttcataaagataaagattttatcttattttccgttagcacgcttttcaaattacaaaacggcgcgttttgtgcgaaaactttctatataaaagttgttttaaaataacaaatatatctatttttcaagtgttataaaacttgttagattttgtatatctcatatttatttattttttttacatattttccgctatctctctcaatactgttgctataaatcggttgtggagataacggaacgtacgagcctatatgtacaccgctctattggtattacaatcgattgcgctgagtcctatcacactcttatgatatcatattaggtttcttattttcgcatctcaaaccctaacctggcaggccgacatctctcgccgccctggtctcctcctcccaactccctatagactctgtcctcgacgacacaatcaagatcatcgccaacgcagtccgctcctccttatgactatgatataaaacgcattccgctcctccttccagacggccctaggtttgcaggttgatgacaccgtcattgctaccatcatcggcgatactgttgattgtgtcacaacaccggtaccctcttcactactcacagctccaccgacaataccccctctcatattattgttggcagtggctgtcttctccctattacttccgttggacgtgcttacttacactatcctacactactatagatccgggcttcagtgacgggtcatctgtgacgggccaacgcaactcgtcaaagataagtaatctctgacgggccaaaaaaatatcctcttcaatatatggctaccagggaggacccgtcacagatgtgaagtcatctgtgacggcttgcacttgtaacccgtcacagatcgtctgtgacgggtcacaaccatggctcgtcatagatgacatgtcatctgtgacgggtgtagtattatgaaccatcacaaaagagaccactcatctctgacgggtctttaactaacacacgtcacagataatgttatctctgacgggtggtagttatgacccgtcagtgatgagtgaaaattcaaatttttaaattttgcaaaaaacctcgaattgaaacatgtcctatataaaagttgtagctctcaatgatatccacaactttataactaacaacatttctattagagatcgtttacatccccgaacatgcattacaagtgatcagatctacttttaaaaacaaaattttgagttttttttcaaatgacatggatggatacatgccccgtatcaaagtcatagaactcaaccagatctacaacattataattgaaaatattttcatttcacaaaatttacatgttataaagtgagatatattttgaaaaatgaaattttgaattcttcaaacaacatcggatgaagatattttctatgtaaaagttataaaacacgataagatctataactacttagttgataatattttcatttgaagtcatttagggtgttaaatatatgttaaatgattcagacaagcatagacaaaataataacattggatgagtaatcaatatgtgttgagtaggtgagttggtaagggagctctatatggaggttgaggtcttgagttcgaatctcacgtgtagcatacaagttatattgcgtgaaaaattgtgaatttgtaggtagtgatgtgtaaccatgtataggatggctagtaaaattcaaaatattttttttaggttttttgatacgtttaaaattcaaaaattgtatttcttgctttgtcatcagtgacgggtcgtaagttacaacccgtcagagatgagtcatcagtgacggttaggtagttacgacacgtcactgatgactcatctgtgacgggtgacaagttttaacccgtcagagatgacttatataccggtcagagatgggttatctgtgacgggtgtttcatccgtcacaggtgattttgtcatcagtgaccactaatcactgaccaagaccaaacccgtcaaaggtgagggtttgggcccgttagagatgacctggtccggcgtagtgctaattgctgctttgttcttaacaatgttctaatctctcttgacattattaagagctttatttctgcacaccatttttcttatgataattggtgttccattgaacttgacccgtttggcctctttgtgaagttctcaaaattatatatatatatatatatataagcaatacacgtcctatggaa

SEQ ID NO: 65314 - DNA, 1461 bp, Oryza sativa
ctcagcactatgtacctcagtacatggcaaatactacctctgtccctaaagccctaaattacacacgctgtgttcgttagtgtagtttgaaaactaataggttgtttggtttggtgccacacattaaaatagagtaatggattagcacataagtataaatttattagtttaaaatttttaaaaataaattaatatatttttaaagcaacttttctatagatattttaaaaaatatattatttagcagtttaaaagcatgtgtgaaaaaggagaaaatagttgagaaggagcaaaaaggccacaccagagagtactctcgttatatatttactcccttcgtcccataaaaaccgaatctaaaaccggatatgatatatcttagtagtatgaatctgaatatatatatatattcagatatttagattcatatgtattatattcggttttagattcgttttttataggatggagggagtacactagtactactactacatccacgagttccccaatgccaaaaatactgcagaaattggatttcaccttagtgaattatcaccgtattgattctcctcatctttgctccaaagagaaaccgcggggctgcagaggatgcaacagctaggatcatgcggcgaagcaaagcgcaaagcggagggtagagtgcgtcattgcgaacctttggggattaacctcgccgacgatgaagccttcgaccgtgctgcccgagaccgagagcatatgccctcacggccgcctgaggtagagacaaggccatggaaggcggccggcggccgctgcgtcggacgcgttgaggggctcggggatttgaaaaattgcgtttggttttcgcggcggagagccggagataacacagagaaactaaccaatagtgttgccaaatcggcatcaatgcggatctgagtggtggtggtggtggactggtggttgcccccacccccaaccgcgtagaccacgttggcacgcggccgccgcaccagtccccccctccgccgcagcgcaatgcaccaccagatttggcgcctcctccccagcgccctctcgccgatccacgccggagctccccggccgagccgcccgccggcgcggctaggccgcccttcaccgcaacgacggcgggcgctcgcgctcacgcacctcccacccggcgcacatgtcgcctcctcgctgtctccgcccagtccgccagcccccacgccggcttgaggtccgcacttactcgtcgaatttccttcatcgctattcatggaatctgaggaagagttggattgtggtttgggtggaatgtaatacctggtacccttactggatgggaggaacaatgccgcacagctaaactggtgttaatttgggggaagtgccaattttatgccttctagtgctaaagcttgtgaattcagtttttggattatgtgatgtgcattgtaatgccgaattatg

SEQ ID NO: 65315 - DNA, 9029 bp, Oryza sativa
agagtggtgacaagttcgtcgttaaggtcaggcttgcgagcacaaaaggtataaggatgatattcgagcacttcattgaaaagctgcctaatcgtgaggtatgcagcacaaataattgcagattttagaataggaaaaggaattaaaagcacagtacgtttcaaattctcaatcatgttggtaacaaatcttggcagcaatggcacaatgccatcagtagcaacgtactagcatttttcgcaacatagtaccaacttatgaaatctatatgttatttcagtcacaaattggtcgtaggatttcctttgcaactgctctttgcatagatcacacttttccatattcttctcctagcagctcattttggaagcgaaggcaacagcggtttgtttgaacaaagactaccgccccacccgtatatctccagagttcctgtccaagctgcagttcttcacttctgaaggcagtagcagttaagtcactgtactcatcgtcataacctgcgataaatcactgtatcccattttccatcgtattgtctttgttcaaatgaaccaattgattgaagcatttgacttcagtgacatttctaatctgtgataaatctaactgcattctttatttgattttcttggagtgagcacgcgttccaacgtttgaatacatcgtccaaattcagcaaaaactttgaatggctatgttgagctcatggatatgatgtgagaaactttttttttttttttgggggggggggggggggttgagcactggttctttctgtgctaggttacatatctatgagacccggctttagtcaggcaagggctcaagttctattcataggagatctgaggtttctgaaccctttccacacaatggatgaacctttcagtcccaggcatccaattactagttgtgatagagtgaatgttcaccaattgactagtataagtagtgaacatctcccaatggaaaaaagctatcgaaattttaactttatgcaaaattttcagttttgagttaaaaatttgcacattcttagttcaaaacatctactaacattgaacatagtagttcagatttttttttatttcactggttagctcacaatggctgctgtgtttgacatgcgaggaaaagagaagatcgaggatacgcaaaacaagataagccattagcattagcgtatggttaattaattattaattattttaaatttgaaaatgagttattaatatataatttttaaagtaacttttctatatttttttctaaaagaatactccctccggtttcattttaattgacgctttggacaatgacacgctctacaagatatacatttgaccttatttttttattataatatatacaataaataaatacatgtttatttttattatagtgttttgaaagacaaatctatatatgtttttctagtttctttaaactaaatatctttaaagttattgatggttaaagttataaaaggttaacattaaccttgtccaagaaccagggggagtatatcgtttagtagttcgggcaatcaatcaaaagctaccgaacgcagccgaatacatatggcgatttcggatagcctcgccaatatgctactacgtggcaatatctagaacgaaattacgtggacaaatccactaggtaacctatgcgaaagcactaaatgaacccacataacaggatcagcgagaacgtaccgtgccggggagaaatgtttccaaatggccgcttgaccgcaaaaagcttagtgcctttttatcccttaacaagaattcctaaatatccactccccggaaaagaaattcaaggtctgccgcactcggaaggtcttgtttgtgttaaagtcggatttcgcaatggatgaaactagggtttcccaaaccaccggggccggggttatcgtgccccggcagtaagcacggtaaccgtaaaaaaccgtacgaaaccgtgcaaaatttatcaaaaattcaaattattttttaaatttatttgaatttaaggaggttaccgcggtttttctattaccgtacccccgcggccggtaaccgcggtaaccgcacggttaccgacggtaagttgaaccctggatgaaaccaccataagcttgaaattttggccaattaagattggattaaattccactagccgaaaaaaaaaaccgaatacatcattggtatacctttttagccgtgtaggagtttgatatagactatatttaggggagtttaaaattcgcaaaaaaaagttagttgatagttccgttcctgagaatatgaaaaagctaaaaatcccatcttcaagtttctaatttattttctaaaaattttttagttcttggagaagttgtatatgcaaaagcttccaaatagcgaagtgagcgttggtagaatatgtgtgctagtatttacccgttaacagcaaggtgttcataataatttcatcaatcacaatatacgtcgaccaatattttaaaagtgcccatccgaaatatatccatactaggtcgaacgaaaacaccccggataaaatcgggcagtctcttgatgcgcgcggtgtagctgcagggagctagcaggagaagctggaggcgcaccgcgcacgcccgaccggagccagccatggagcgggcatggcgcgcgctccgcgcatggagcgccgcaatacgctctctctctctctctcgcgcgcgcgcgcggatggcatgtgccttccctgcaggcgaccttgccggcttgccgctcgtctccccttccgcccgccgatggcgaccagtctgtccactcgttcgccttcgtgccgctgctgctcgtgcgtgcggcgccctatgttgaaccggatcggggggacgggacgacgttccaccgttcacggcgcgcggggttgtcgtaaagccatcacattcatcggaatggggaacctgcctagctgctgccctcgtgcgccgtacccccatcgaatcctagccgtcggttcagctccgcctgatggcccagacggtccagatcagccgatctcgccaggagagctggttggtccaacgtgacggcctctgacgcacgcacgcaaggcaggcaggacgacgagaacgcgtccatgtacacgtaggcaacacacagctggagcttttctttgaagagaaaaatagcaaacgaaggaaatgattctgctcgttttagagaaaaacatataggttacgtgcatatatcggcattttcttttgaaatccacattaacatgcataaatatattgcatggactttgacaactctcgctgtcataatgcatgctcctgtcagaacctagctaccgactaagtactctaacaatgggataattaatgtcagattactgcgtagggtgcgtcaggtgaaagagataactagccaaattaattgtgcgcgcacgaaactttttcctgtgtgcttgatttccacatcatcatatataggtcaacctagaaaatacaccactcttccttgaattttgctcgtggcatagttccccatttaaaaatgttattactaatctggttgtcaaattgcggtaagtggtgctgtgactaagtgtgaattatcagaatatatgtgacgtatgtggcacgtgcaccagtacatggtaaaaacctttactgtttgagcgggaatttgtttgctcgagagtatctagtttttgaaacatctctctggtgcagaggaattgtcgtgtttatgcttattttttcctccttctgatgaaagataggatcactattgtttgcagcatttttcataaaaaataatcatgtcgaataagcgtgtggctagttttcgacgatgaggaccagcacgttttttacagcagaagtcaaaactcgatcataatgtcctcacgcaccggagtggattttaaagtctcgcgttaattatatcacttaaataattacgatttttttaaaaaatatgaagatgtattaatatgtgatatatcactctacaaatatccaatttagaattcaacatgtcacaacggaaaaaataaatttgactcaacttctacattactaaatttgttttgtcttgcgacatgtagaagttgaattgtaaattttatgtttatggagtgatatataatatattaatacacattcttaaattttttttatacctgttcaagaggcatgcaaacaacgaggggatttaaaatagtatttgtcacggtgcaggccttgcctctaacgaggggatttaaaatgatttctgtcatagtttaccctttgcacgtgtatataggcttagatgtcggtgtcccatgcacacatgtgaatttccttctaatatagacgtataatttttttgcgcgatcgtgaaaaatgcacacatttagcatgtagtatatgcctctttgtgtgtgtgaaattttacagagtgcatatgaatttcacacgttgcaaatttgtgtgttcagattatagtaaggcatggcaattgctaagaatctgcgtgtgtgcagactgtttccgaaagatcaaatgacgcaacctagatacgatatctcacagacccactgtacataccccaacctgacaaatcaacactgtcaggatcggagtaacagtattttaatgcttcccaactccatcaccgcaatatcgtatcagccctaacggtcgacgaccggccggccagccggtgacccccatgggccgtcacttagctgggtgcgccaccagcgacggcgccccaatactctggtcaagaaacgtgccactacactgtggtttgtgcatatggaagcccagttcattctctgccgttgtctcatggtgaccggtccgacgaccaggaaaggtaaaatccagcgcgcgtactctgctctatacaaccgaacagtcttcaacgcaaaaaccgcatgcgagcaaactcagacttttgagggtagagagaagaacggtaatcacctagctagcttacacgccggattggactttccgttgcaaaaactacgtgtgcagcgttgaacagctaatcacctgtcctttcctgtcccacggatcatcacctatataagcgccatgcatgcaccgccatgagggaaatatcacagcaatcgcttcatcagctcgccgattgcaacgtgagttctactacacactagcagttgatacacacacacagttcaggcggcgataagctagcctgaggcctgaatatatatagcagctagagatactagtactgaattcacaatgcagcagcagcagctgtgcagcagccactgcctccctgcccgtgccggcagcatcgccagccccggctccggccgccgcgtggtgcccctcggccgccggcgggcgagcctcggaaaggtcacggcgtacgcctacccgacgactcgccgcgtcgtcgatgccgcaaaatccagcctgcttcaggatgtccacgttgctgcctcgaatcccagcctgcagctgctgcaggattatgctcccgccaagaagtcagcaaaacagcagaacggctcaaggtcctccttcgatcgagatcatttcaccaatctactccattaatcattaatttcctcacttcatttttgaatatatgcatgacattgtaaactttcagacattgatatttaccatcttactcaattttttaatataaaaaatactccatccgtttcagggtataagatgttttgacttcagtcaaagtcaaactgctttaaatttaatctagtttatagaaaaaataataataataatttcaactcaaaacaaatttattatgaaaatatatttaattattgatttaataaaactaatttgtaattataaatattagtatatttgtgtataaacttagttaaatttgaagtagtttgacttttactaaaatcaaaacatcttctaacctgaaacgaagggtatatcatacctaaagtacaattaatgttaaaacaagtccccacagaataaataatacttacttacataaaagtccttttaaataaaataaatgatcaaatatcatgtctaaaatcaccatcatcataaattcatttaaaaatggagattgtaatttctattgttgatcttttgatatttcagagaaaaaaaattaactctgatgttttgggtattatgaaatctctcaggacgaaggacgggttttacgaggtcgagatgacggtccaggacgacgagcttgacgagtacggcgtcgtcaacaacgccatctacgccagctacatccacagtggtaagctaatacatctccaaaagtaactgaagcatctgcatgctaaacctgttataaataatctgaaccgtgcgtttcatgtgtatcaggccgtgacgttttccttgaaaatgtcggcgttggcgtggactactggacgtcgacgggcaacgcgctggctctttcagaattgaacctcaagttctacacgcccttacgggtacatcttctttcttgttttacttattactattttggacatctatctcccaatcttgatcaacttcatgtttttatggtcacggcacacacaccgagaaaatctaacaaacatttgccttgcgttatttccagaaggatgatagattcgtcgtcaggatgaaggtcgtgaagatcaaaggtgtgagaataatcgtcgaacatttgatcgagacgctgccagatcgtaaggtaagcatgaatacacagggattctacagctaattcattctctgttaatttagaggtgattttattaagaggtattatactttttagtgtaaagcttgataccttgggataatttagtgtaaattttaattatctttaggtacttttcaagcatagtaaagtttctctaattttagctaatggtgatcgatcgatctcacacaatgattttactgctgcttctcccagctcgtagtggatgccaaagcaaccgccgtttgcctcgacaacaaataccgcccaacccgtgtgttcccggagttgtcgacaaagttacatcagttcttcctgtcataaacggctctttgttgctctcatgacaagaagtggatgaaccttatgtgctctaccggtgtacagagcaaggcacaatttgtttgatctacattttttttaccagaattatgaagcatactgtagtaaataaagagtgaataagttagtgctgaccggcttagccgtgagccgctttatgtgaggatgagatgtagatacgcaatacaaatgtgcacctgttcagcagctttcatttcaatgggcattccattaaaaaaaaattatgatcttccatcgtgccttggatttacagtttgcatgattgtttctcaacaagtgaaaagctgcgtatttttatcacgtataaccgtagactacactcgagtacagaacagataaaactcgatcagatgtataatccacggaacaagtattagcacttcagcaggtgaacccacaaacgcacgtgttgctagatgagaacacaagcaacagcaagagaaacaaatgtacggctgcttgaccgtttctaccacatggcaataccagtcgttttcattcaaaaagatcacatcaatataataccacaacaaacttccgccaggtaatgacaatagctaaaatataaaggtccacagctagtaagtagtaagacagttcctgtgtgcttgattttggcggcggctgtgcttttctgaaactgaacatggtctacacatgtcataggtgcttcgacccttgccagttcaaataccaaattcagaagtcagactcaattggagaacagaaacagtttttaatgccaaatgattattcaagtcactggttaataaatttgagaagtgcatgttccacaagcattagattgaaaatctacctacacaaacattagattgaaaatctacaaggtatgttgaagaacctggtctttatgatttcaaccagtcacttatatataggtatgtgacgctgagagccagttttgccaccaatgatcaatccaacagcaccaatattcaccatgatgcagataggcaccgtcattcttcgtgtcagtcactgctaccctggcctgggcacacatgatggagatacagtgtataaattcgaaacccaagtgtccatagcttcaaaatttagattctttcgaatttgaaacttaggtgtccattgcatgaggtgtaaagtactttaggtgtatgatataccactagttaggtgaatttgaatttgagactaagtttcaaagtactttaggtgaatttgaaacttagctgtctattctggtatatcatacatttaggtcagactttgaaagagccattgcataagtttcgaatttatacactggtatatcatgaatttaggttatggattatagaattggtgtccataccttcgaaatttaggttctctcatgttgaaaacgaaactatgttcctcaattatttcaatgcataagctaactaggtccagtgtataaattcagagatgtgttggggcatgcaacccacatttcaatcctagttcacataaagttaaggttaactgtcccccaaagcaaacaaaattgatccagtcaaatccatgtcagataacaatatatcagaaaagttcacaaaattgttcctatcaattcatcaagtgaagcctgaaaatcaaaggtgcaagaataaaagcagaccacatgattgaaatacagtcaataaggtatggatttacctcacatgctcagatggcttgccaatcctgcgtgctgacagggtccctgcatatgtcatcatataatagtgaaatatcattatctacggtgcccagattcatggtctatgaacagttaatgatcttgcttaccatcttcatgtatctagcacttttgtttcacttgccagctcatacagaaagtcagaggaaccgctgttcgcctcaacaaacacttttgttttacactcatagatttgttgacaaaaagtactgcagttcttctcatccaagaataactaaaaagctcagatagcaagattgcat

SEQ ID NO: 65316 - DNA, 1475 bp, Oryza sativa
caacgcccttggctccaccatgggtggtgacaccccaagcacagctcacaacagcaataatggcgccaaacacctgagattttagcaaggaactgatcaagtcccatggccgcagcgcccttcgcgctgactccagaatgatgctggtactgacaccgaagatcgaatcagctaagaatgccgaggacgccagaccgagcgcgaagctcatgagggttagcacgggcagcgcaagcacacaagcgacgacgcgagggaccacgaggtaatcgacgggctgcgcaccaaggacgcggagggtgtcggtctgctccgacacctgcatggtccccagctctgcagcaaacgcggagccgacccggcccgcggcgacgacggcggtgacgaccggggagagctcgcgggagagcgcgagggcgaggacgccgccgacggagcggtggaggccgaggcgagtgaactcgcgcacgaactggatggtgaaggccatgccgacgaatgccgcggtgaggagcgagacccccgcgctcccggggcccacgcggcggagctgcgcgaggaggttgcggcggtggacgcggccggtgaggacgcggtggaagacctgccccgcgagaagcagcgccgagagcccccgccagatcgcgcgcggcggggaccacctggagaagggagggggcgggggctccggggacgccggcggaggcgagggcggagaattattgctgccggtgggggccggggtgagggagaggcggggcacgggcaggcggcggcacgaatggtggaggcggaagaggaggtgagacttgtggttcgcgctgtcgccggcgccggtacaggataagctgatgagagggtgggtggtagcggagattggacggagtaggaaggcggcgccggcaccggcggacggcatgacggtggccggagatcgggacggtggcggtgggtgggtggtgggcgattgggtgggtcggacggacggaggtgatggggatggcttcgtgctgcgggaaggtagtggttgttcttgtgggcttcttgatgttgggctttctgagctctcatgtgatgggatcactgggccaaggcccaagataagtcaactttgacaaaagttaatctatgttttaaaacttaattttagcatgatggttttgattttgtttttcgtagtttattttttattgctgacttttagttgtttagaaaaaatattatttataaattatttttattggaaaaatattatttataaattatttttattggttcgtttaacttttcatgctttgtaccatagcggcgcaacaactaatcacaaacacaatacggaacgggcgcacacgcagccacccgatccggaacagaacaccattaacacacgggtataagcctccattaatccttacttgcatcttcatcctcccatgcaaaattcaacctgagaattaattcacgtacacgaaaga

SEQ ID NO: 65317 - DNA, 10427 bp, Oryza sativa
gacccgatgcccgacattgtccgcccaaaccctacccactagagttagcgggtaaaattccgtgcccgtacccatgcccagcgggcgcgggtatgtccggcaggtacccaatagatctcacatgaataataacttgaaagatatgtaatttaagaaagagaaataaaatcaataatttaccaaatcaccgtttatcaacaataatttgaattacatcacaacttagtatcagttagcatcacaaatgaaccgagagaaatggtataagaattaagaaatgagtcaaaagtagttaatacatatgtatcgggttgagcatgggttactcacgggtaaaaattgaaacccacctattgcccataacatcttcggatcttggacggacgtgcctatgggtaaaaagtcacacacacgcccatgcccgtcaggtcgggtatccatggatacccagactcatggtaaaattgccatccctacatgggcagctcagttgatcgtcgatcacctagtcaattcgtgggtgctggctgctgaaaaggacgatcctctcttctgttgttagtggctggaagtagggactgatggctaccggacaagcaaaaacaaactgattctctgtcttttcttctcccttttttttttttttgaactcttctcattgatgcttcgtgcctctgctgtgctttcctgttctgtgacattgtggcaatgatgtagaacaagctatctcctttcggcatggcatcagttgagcttttatgggcaaagtgagcaaaatatgcttgatatattcccaaatgttggtaatatcctcgtaaacaacaagcagcacacagaacaccgacattggctaacttatagtttcgctctgctggaatataaccagtgtttaattttgacttgcaggttgttgataaaactgtaagatagcaactagttcaacatttcctacaagtgtaaaaccaacggtacagttacaggagctttaccatatgcttaaaagcctgagatgtcacattaattaactgtaagttttaaatttggccgtccatgcttgaagaaaggctagccttcttggctacccatcaaaagagaaacccttaattggttttcagaaaacatgctgtctacttatttattctttctccaactagctccatgacatccaaatatcccctccatgacttcatctgtaatggctgcatctatgtactaggtcgaggctaagtccttggttactagcttaacctttaccagttaccaacttgaaggaagataagaaacatttatgccgtctacttttcttctgtcttttaccaacctgattcgttggatgcctacttgtctagtcacactatcgatgttatttccctgagtgcaataatatgttatcagctccggccactaaaaatctccataaagcatgctcgatggagtagagctacaagcagcttgctcttgctgttgagatttggcttcagagagcatctttcccatccttaagaaggtaccatgaggtaccaatgtaatctgaccgttgatttaggaagggtatgatggggctaaacaaattagggtagcgttaatcaccgcccatcccagccaatagtctgcggcggccgccaagcgccaatatctgttgccggcgtctcatcttgtccgccgcagccgccgtctcatcgcaggtattcccccgcggccgacgtaccctcgacgccaccgcggccgcgcgtcgaacacgcgtctgccgccgtcgaggacgccgcggcagacgtccaacccgcatcccgtcgtcaatagcggcgcatcccgtcgtcgcatacagcggcagcctccaccccggcgcatccatcccgccgtcgcaagaactcgttgtctcatccagccatccgcaggcgcatcgactcatccacgacgacgccaggcgcatcaaaatcgccgcctccaccctgccgcatccaccgtcgcatccagccggaatactcgggcgtcgcttcctgctgttgtggtctctgttgttcctgcatcgtccgacgctcttgtgtgtgcaccttacatttgtattccagccaactaaagtttcttaaactcatttgtattcatgccagctgcttctgttctgtgtgttttcagcccaattaagtatagtattccagcaacaatcaagatgaagcttccgtagcatgtttttagttttcagaacagaacgggcagccattttaattttgtagcagtgattccaacaacaatcaacaactccagtagcataaaaactgtacacttgccatatcagatttgaagtgatgcaaacaactaggtaattttagggaaatagatgataaatatattacatcagaataacattgtcttaacttagaacataagctgctgcatggcctccattaaagttgaacaaaagctgctgcatagtatccattacataaggtgcagatactacactaggagggggcatactactacattatgagggggcacatcaaagttcttcatccattacactagttgagaacctcaagagtaatacataggtcatcatcaacttcagtgaacagaaacacacaaacatcaccaagctcgaataaattggcttgaaccaacttgttccatctagttgtaaaggtagcccgcttatctttggatttcttcagtctcatctcaaaggattcagctgatccaaccagagtcacaagtaaatcatcaattggtgttgaaaggtggttgtttatgtactgcttgctaaatggcaaactgaaggcctaaaaaatataaacaagacatttagactcaggacatttatgtataaacaaatgcaaatacagggcagtcagatttgtgaaccataccattttcccttttgtcaaattagtcatctggatctcatacacatagagtggaatggtaggcaaattgcttacagcaatgtgagcaattttgtactgcatgttcagtcccataccagtactacctatcaaatccagggaaggtgcgaggtccatattgacctgaaattggaagtttgacaagcacatcatctgactagcagtacctaacattctgtacatttggacttattaattatttatatgaaaataatcacctctttcaatggagcacttgcgcacgctttgatatatcttagcaacttcatcatcatctacaataatatttcccgtgtttttggtttgtaagcaccattttagttcgaaacaaagaagaaaggacatgaataagtaggaaaaagaatttggtttaccatcttcactgtcagaaatcaaaatgactggttttcccctcggaacgttgtccatgctggtattgtcatgaataaatcataaaactcgaaaagcactgattgaataaaaggacctcgaagcagtacacttggaccttgaagaaggacgggagcaggcacacataccttgaagatccacggcggcgacccggattgccgtgcccccgctcgccaccgttcgggggctgcatggtcaacggcgagctagaccctgagacgccgcgcacggacgcgcgcagccgcagcactggacggcgacgcctgggctggagggaacgagtgaagactgaagactgcctatctccctcccgcttttggtcaccgagatcccgacgaaacgccgccacaaccatcgccgagctcccgacgaacggccaatgcaaccatcttcgagctcgccgatgtagcatagaaacctccgagctcaccgtcgctagggctgtcaacgagccgagctcgagcgagcttacctacctaagctcaagctcggtacaggctcgagctcgggcccagcattaccttcgagcttgaaggtaggctcggttcgagctcgatcaaggctcggctcgactcgagctcgattcgtagaagctcgttaagactgtttccttcagcaatctgaacttatctcccaataaaagcttcttaacaagccaaagtaggattacaaattcataatagaatataatagcttctcgacaggtatatactagaaagattacaaattcatagtagtgcataagtcataatagaattactactttataatagaccggtgtgtataacaccataagaaacattacaatatcatgtgtcaatgacttgacagaacatagagcatcaattaacatcaaaagtagcccaccggaagttcccaacatatgttccatctaaaagctctaatatctaaatattacttatactactaacacagcgtacttcaaatttcaactgtcacaaaatatttactccactattggcaatggcagtacgccaatgtgaaacctccaagcactttcttcaaactaattgttgatgctatactatatgcctgcattaatgtttcgtaaagttaaatctgaaaccatgtgcaaagattataggtaatgtttcatcagtgatgaggaattgatatggtagcaatagataatttatataacctcaaacatatacctgacaaacgagtctaattgctgcccacaaccgaatttgcagttgaagcttgagttgggacaaggataatagaattagtatcatcctcctagtatgcaacaaacaagtaaacacagattattagattgtgtatctctattaattggttagaaacatgaaaatataagaacttactaaatatgtgcttttgtggtggcctcctctaatccaactagatgtacacaccaaagcttgtgctgttgatgggagtaaagagctgtgataatcactaatcacttgaccccctgtgctgaaagctgattcagatgagactgaggtgatgggaatagtaagaatatcctcggccaactttgccacaattggatactctaattcattcatcctccaccactgaagtagattgaaactttttgcaggaatatcctcaacaggatcatctaagtaccgctttaaatctgacttaggaagactagcagcattctttgatttcatatactcatgaaattggctagcagcaaagaaatgactactagtagtgcccagagatgtactagtagattgagtggtggcatcattttcctttgatgtgctctggagttcactttcatatgatgcatgcaaagatttcaatgtggattccacatttgcaagtttcttaggaagtacagtttcttcatacaaagcagggaatgtgtagttaatcatacccatcttaaaccttgggtctagaaccaaagcaactgcaaacaaagtattgcattctgggccccagtacttctcaaatttttcaagcattgcatttgccatttctttaagaattgggtctttggacttcatgtcacgccccgagctagtcccgactggaattagcccgtgacgctccaaattaacctgttaatcgataccagtcccaggaaaacagtgctggtatcacagggagacagaatatcacagcaacagaggtctctttattatagagtagaggtacagtcatgttgggctgcggacagatcccgagctcacaactgcattacaaaagggaaacggaagccagggcttggaccaaacatcacaggcgcgacttgggaattaggccgaaaccctaaaactcatcgaagccggcttactcctggaagaactcttcatcagcaggatccgcttcatcttcttcagcaactggggggttatttatatagagcaagggtgagtacaggagtactcagcaagccaggggaaataagtgtttaatgcaggcttcaaggaaaggctgttgttttcgtaattgattttatttgaactcttttctgaaacaactaagtgagtgcttctcaaacgacacggatgagacagtgcgtcttgtccgaacggagtatgtgcaatgtatcagtctttagattttgaaacaaggttggcacccggccaacagcttttcaacagccacccgggccaacaacttttcaaacggccacccgggcctaaatcctttttccttcagaccaaaaatccaataatcttagaaattcaatatcttcccaaccgtaaatccgattgactccgttcaacttccaaaattccccaaatctcgagatctacctaatggcacgcttagaggtcattaatagggctttattttcgccgtttgttgagttgtcccgtttcgcgtgtagtttcggagcccgaagacccgcagtgcgaggatttcgaggatcaagctccggatctcgagcaaggcaagccacctttgaacatcttgagcctatatttgaaatttaattatattgcttgcaaaatattatgcattgataggatcgcacttaatcggttgtcccgtctgcaaggcagattggcggacctgcctaatttgtgcatttgatccttcctttgttaattgttataccatgtccccttgtaaccacccagttgcgcctcgatattcgtgcactctgtgcgagtatcgacggtcgccttcaaacttaaaatctgaaaaacaacttgggtaaacttggttttacaaaagacttggaaaacccgacacctgggtcggtgcttgcgaactaaatgaatttctaaaaccgcggaccggggaacgtaccgggtgtacggtttcccgctcttgcacttaaggaccgtttccttggaatttcatccaaacataagacaagtacgaccacatgggtggaatgggacacccctggctgagtaactagcttatcaggggagccatgatgccgagagacatgtggattcgccggggtggtgtcggagaggacccccctgggcttcctggcacagtatggtctgggacctagcctgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctgtagaggttaactaactgttcgaacaaccgtgcccacggtcatgggcggatgtgaggtgattcttagcgtagttttgtttgactactgcttgtgaaattgctgttgtgaaaaggggtttgatgtttgaaaaatctgtagctgacgggatcagctaggcccgggtggccgtttgaaagtggttggcccgggtggccgttgaaaagttgttggcccgggtggccgttgaaaagctgttggccgggtgccaaccttgtttcaaaatctaaagactgatacattgcacatactccgttcggacaagacgcactgtctcatccgtgtcgtttgagaagcactcacttagttgtttcagaaaagagttcaaataaaatcaattacgaaaacaacagcctttccttgaagcctgcattaaacacttatttcccctggcttgctgagtactcctgtactcacctttgctctatataaataacccccccagttgctgaagaagatgaagcggatcctgctgatgaagagttcttccaggagcaagccggcttcgatgagttttagggtttcgacctagttcccaagtcgcgcctatgatgttggccaagccctggcttccgtttcccttttgtaatgcagttgtgagctcgggatctgtccgcagcccaacatgactgtacttctactctataataaagagacctctgttgctgtgatattctgtctctctatgataccagcactgttttcctgggactggtatcgattaacaggttaatttggagcgtcacgggctaattccagtcaggactagctcggggcgtgacacttcaacaactgacctagtactctcttaatatcgacaatgtgagaataaaaaaggttagatgttgggtaggttgaacctgagaactcctcagtggctgcatgaatgacagaaagggcatcattgacttcacaatatagattccattcctctggtgttggcagccacctatagtttgcatctcctgcagcatatacatccaaggcagacctataaaaaaatgcagattgcagcattttgaaggttgagccccaccttgtgcaggaatcaatagccaaacccatgtcacttttaagggtgagagaatcaatatcagcactgaacttgtatgctcgattgtttgatttcttgatgtacttgatagtgtccctaactttgtcaattatatgcttaatcacagccagaccatcttggacaattaagttcagaatgtgagcacaacatcggatatgaaggaattttccataaaaccaaagtgaaccacgttttgtaaacttggcaagcaacaggttagcagcactatcattacttgaggcattgtcaaatgtgatgctagctatcttgtcctcaattctccatgaagcaagacaatcagaaatggcattagcaataactacaccagtatgtggaggctccaactcaagaaagttaataacacgacaatgcattgaccaatcagcatctatgtagtgggcaacaaggctcatgtagcaaattgtttggttagaggtccaaagatcacatgtgaggcttatctttctaacatctttgaaagtcctcttcagtttttctttttcagattcataaagcctcatacaatcacttctaatggtatttctagagacctttttgtaagaagggtttagcctctttagcaaaacattaaaccatgtatactccacaaggtaaaatggcaactcatggacaatgatcattttgcaaataagctcacgtatctttgtaggatcataataaccagggacagaaacacaaggagcatcaagatcaacatcaccttcatcaaggctagggaaattgatattctgttgttttatggatttttgttgaagcttgtgataatcacactgctctaaatgcctccgccaatgtgttgtagtgccactactattcttggtgagcagagtttcacatgccttacatttgaccttattttccatttctcctttcttcttctttgatggcacagtgcattcttcaaagaaatcccacaatggagatttctttttcctggtggctttagttgggtttccctcttggccctcttctccccttacttcacctggtactagctgctgattcggttgtgcttctgttgctgctatgccatccctattgctcggtgactcgatctctatagatagctgtctttgcaggtttacagacatctacaaaaaataaaaataccaactgctatcaatatatattctgcacaaggtaaggaatcaaacaagtacaacaagaaaagcattgccatcaatttaccttggcaaatggcaaacacacggtgttctgcaaccttcagtctttcttcagaagaggaggacagcaagataagtactactctatgtctccacctagtccataaaattcaatgtaaatcaataacatccatcaagcaactaaacactacacaattaatacatgtagggccctagatacatgtgggtgcaaaagaaataaaaatgtaaaacaaagaaagaagaggaaacttactcagatccgagtcgtcggttcgtcactcacggcggaggcggtgggctgctgctgtcctccatggggttcttcctggacaggagaggcgaaggatggatggacggtgcttggctagatccacagcagtggtcagtggagcactagagcagcctaggattgtagatctagaagagaaatgtttcgaggaagagagcaaatgagctagggtttggatacgggatggggatataagggaaataaatggttaggtgatggactgctgttggtggtaggattttggaattggagtgcgggagaaattgggataggtagcgggagtgaaaatttcaagcttctgccgaatagctcgagctcggctcggtagagctcgcgagcttcgagacaagctcgagctcggctcgaatccttgccgagtcgaactcgagctgagcttgcgacgagccgagctcgagctgctcgcgagctccgagcttttttgacagccctaaccgtcgtcgatgaatcgccgccacaaccatcttcgagctcccgacggttggccgatttgggcctgccgctgatgacctccacccatccctgatctagccgccatcgagtcgctgatccaggattcgctacatgcccctcctcccgccgccatctagggttctttctctcgcttcagcccagcgcttcctcctctctcgcgaaacagcgaagaaacagatgccgcgtgcgtgacgtgaatcggtatacaacgcgaaagtacaaaactaccctccataccacggtaccgcgtcaatgggaggtgcggtaccatgaggtaccgacgccttttggaccgttggatgatctcgaatcaacagtcacgatttggtactgcagttgctcaaggacagtaaaaactcggcttcagatgttcatttccagacttccagtg

SEQ ID NO: 65318 - DNA, 28483 bp, Oryza sativa
  unsure (1)..(28483): unsure at all n locations
tattcttttccctctaggatttttatgatattgaatgtgagggaatccaagttcgctctagttgatcacttgctcgtgagatactgagatctagagacgaagattggagagagggccggcttggctgcagaagcaagcaagaatcctacgtgccacttggagtacgctagatcttccagtcctactaacagtagctcctcaacagtctgcaggccctagctgcaccaaccaaaaacttcaagaattcaggatgcatatatccatccatccatctgtgcgttcgtgtgtatgacggttagcagcgaccactctgtgctagctagctccatggaggagagggacttagctctcattgatgcgcacacacctccgtgcgcatggagtagtatagtagtaccacactgctccataatacacatgcccgatcgatcgtcggcagcggcagcagggcctcgatcgcgagctagctgttggtatttattacacacctcggcctttttgggacagggatactggagaaagtaaacgattacattcaactcacggggatgtgtacaacccgatctattgatctagatattatgttcgatcttgtacgttctagcttgccgaaaaaccaaaccaaaacttgcatcaggtctctctctaccgggtataagcgtgtggtaaaggtaaaaagaacattgtcttcttccacgcctcagttgcaccatgcatgcattatgcgtaaatccagcctctaattaagccattggtgaacccatggagccatcgagcccgtacgactagcgttattctgagcctcttcttacggaaaacctcctcctccagagcgcacacgaacgacgccgcgcactgtgcacgcaagtgcgaaacggatggtcgttaaactgcccgcggcgcgcgctctgttcaggggcgtgggattcaccagacagccaccagtggcgccggtgcgtaagctagaccacccaatcaacagcgactccgtagtcaatcgtacaggctacttgcccccttcgcgcgcgcggtgcgcggaacagtcatagccacagcggttaccatcgcccgaatttaccgtcgagtcgctttgacccgtgcaacttaaccggtttaccattggtgagaacaactgagagaaggataagatcgtagagcaaaggttgctattgctactacaccattcagtagtgccgcgagttttgggtggattagccggtcgccttttgagtgccagtgggagaccggtccaaactccaaaggcgaggaaattctagccggggatgggacggctatggcgtgaaccatggtgcagaaggactgcatgccgtggcttagcttacctggaagggttctcttcgactcacgaaagtcttgcgtgctagtgaccccatcgcgcagcaaaagtgaaggggaaaaaaagaaaagagagcgctaaaaacacttgtggtacttttcagcgattctttcctgagctgccactctccccgtaaaaagaaaagaggtgaacgaatgcttcttgtacgaattccacttttttgctaagataatttaggtgcggcttaacagcggcaagaaaagtacaagcagagagcgcgagaaggagggagggagatcacctgcctcgtctaaaaaaagcgcaagggtaagcgccacctgatcgcagccgtccaaccatgatccatcacgtgtcgccacgtgagacagcaaatgagcaaaccccactgccttcgtccaggcgcgccccgcgctacggccacacggacacggggggacagcacaaggtcgggccaacgtatcaataccttgtcccgtcctgctgctcggtgtggaccaaccgattacgccgggagatccgcctcgggatgcgtgcccacacagcttccacaggggagagaagtacgatggccagactcattaaccgagaattaacccctgattaactgcgttaattgtcgtgctaatcccaccctgggtcagtaacgcccacaccgcgcaaagtcagtggccactgacacgccgatgcaatccaggtgggcccagcgaggagaaaagaacggtgccacgtggacgcgagacgtgggccatgcttataactacctgcccaccaaacgaggagagcagctcctgcaaaatcgagctccagttttgctgccgaaaccacacaaactgtccatcgagatccaactaattctcccaagcatttttaaacaactaaaagttctacatttttttttctcagtgctgcatgcttagtttaggaacagcaattctgttgcattagacagacgatttgttaggatccagcgcatatgtttgcgccggacaagtggggcccatcgcacagtgagaggaatgaacggagcagcagccaagcaagagacggacaaaatggactaggcaaagtacgaggctttcttttctgctttgctcctagcgtgagaagggaaggggggacgccgtcacggcggcatatgcagcagccaaaccgggcaggcaggtggtcgtggtggtgggcagtggaagcagggaggagagaaagcaggagcagaatgccgctgttgctgcaccctgcatgtggatgcaaccatgaacacactagggactactaggctgatcctgcattggtactgccattttgttgcttttcttttctactacactgcttactatctcgcctattgtttggccaaatcccgtaccatggacaattggaacaagaacagctggagactgcaacagaaagcaacagttcagctataatttttctcctgtggctctctctgtttttcggtggaatattttcatgctagattatgatcaagaagtaagcaagatgctaagctctgctagttgccccaatgtacactgttcgggtagcttgaaacaaacaaaaagacagaacagaatggaggacagcatcaagcaatttttgtagctgaatgaacaaaacaactgagaaaaaaaaaactaccaaagcaaagatgtctcctttttatgatattttctttaccttttcggctgcctggttaagcagctctttctctcgaatccatagctctaaccatcttctttggaatcaaccgaaaggagagagagcactgaacagccagtatgctcgctctctcatgctctgcttgctttcaagaacctggcttcgaggagaggaaaggatctgaaacgcggagagctccacgtcgtcgaacggcgccgggaggttcagatcaatgaagccgttgcttttaatcatggctggaatatcgtcgcccgatgcggccgccgccgcggctgagcacagctgggaccgcttgtggccgcccagagcttggccggacgcgaacacgcggaagcagtaggggcactcgtgcggatgcggcttcgcgccctctctcgccgccgtcgcactccggcaatggctggagaggcgtagcgggagaaggaggagggttaggcggaggcgcgcagcagccgcccctgccgccgcgcatgtggctagcgcgatggccgccgagggcctggtacgatcggaacaccttcttgcatgcggggcactggaaccgcgtccgcttctgcgcggccgctgcggccggagccggaggtgcgtcgccaccgtcgctcccgtcgtcgtagcctgcgccgcggagacggtagggcggcggcggcggcggcgtggctggccaggtgtcgcgggagagcatcatgagggacagcgctacgtcctcctccgacgtggcgtcggacaccgagctcacctgctcgacatcgcccgatccggtgttcgcgcgcttgccgtgaggcggcgaggagtagtactccgtctcgctctcgcgatccgagaagtcggactcggcgaggcggaccctccgcttgggcttctcccgcagcacgtatccctggatgggcctcttggcatcaccgccgccgtcgtcgtcgccgaccgcgacggatgtggacgcggaggacgtcgaggagatctgcgacctcgaggcggcgactgagtgggagcgcatgtggccggcgagggcgcgggggttgccgaagcggcggtagcagagcttgcatgtgttcttggccatggcgagagcttggatagagcttgatgaggcacagagcttaggagagctaaaaatacgagctttcagaggaaacggagagagatgaaagcgctgcttccgtggggagttagaatagagcggaactgccagcttcctctcgtttattgttttccttttatttcccccctttttttctgggtgactcattgtattcttgactggttgtatttgcagcatttcttttactgctcgtgtagaaccaagcccaaccgtatggaagatttcggactgatgcttgtagttaattgttagtacggatgaaaggaatgagcctattgttcttttcgatgaaatgagtctaatgttttgccatgtaccatcatgtggtccagtgcgtagtttttagcagtagcggttgtattgctgagatggtggctattttggtgatcagattagtcctaattaaaaatctttatttgctaccatacagaaatggcttttgcatacgtgccatatggctttctatgcgagggaatgtactgtgggatgctgctgtactcaatgcaatagctctgaaaattacccgccttggaagatgccactacacttcatggctgtcaaattgcccttttgatggatctccttaatatagctttgccttgttaaaccaccatttttatatcctgatcatccaaaggccacaccttggtgcagctcaggcgttcagtaagttgggtgagatatgtctgaatagagggctcagaatgagatgggaacaaagagtaggtgacaagaaggttgggaagatgggtagaccagtgagaacaaagcgaacacagggtggagtgtggcttggggaatcagtgatagtaataagtggcagattaatcagccggggtctaaatcacaagagtcacttacaatgcaccactgtttttatacctttctcattaaattaagatctgggtatggtgggaacaaaagatctcgatacggtttaggcaacgattaatcccttattagcagcacgttagttgcttacccacaaagcctgaccgagtgcccggccagcatgcatgcatctcatcagcggatctctcagaattatgcccatccaaatccagcctcatcttgttcttaatctccctggaattactcctggcctccccttcacattatcttcctgccaattttaaccaccaggcatgcatatgcaccagctgctgcatgctcgttgagagcttagcacttagcaggcaagcaagcaaagcatctgcgagagctagcctttccaactaaccgctttagggatctctctggttatgatgggtacgcattaggtgcgcccccgatttatgtacatgatggccattcaccccgaataaacacctaccagctagcgagctagccactcaggatcatatttagtactaccatcaagtagcgaccaagtatccagcatcattgttgatcaagcatttgttatgcttgctacggctgtcatgttagtagcatgctactgtgctgccgatgcatggtgttcattgtgtttgtgtgtttctgtgtgtttctgtgtgtgtgcgtgtttggacttcggtaggtaatttccaaatttccatttcactttgtagctggtactgtcagtactgtactagtacagcgtacagatacggtacaagtcaagggggatcggctggctggcttcaattccgttctgaacactaggcagcgtggcaggcgatgagatcataggcgtgtgttggtttcttgcttcgctcctcctctcgtatactctactggagtgtgaagtttttccccctatctgtcaccttcttttttcttttctgtcatcttggtgctgtccttgttctgctcttgatccctatctccaacctttgggagtattcattggaatcatcatcccgaattcatgatatgatatcgaagtgattagctctgaatacttacaaaacatgcagtgttctccttttcctttccttgggcctgcaggtgaagcagatttgtattctcctgtaaaatgcagtggcttggcaatcagtggaagcaaagggttagtgtcttcctatgttactattccacaatggtgtgtgccacgatgtctttttttctttcatggagaaaacgaaaatcgaaggaacgagtacaaatccgcgattcggtccagtactccggtcattgtcctaccctgtgaacttcacttgcagtcgcgtcgaagatccagaggaccaaagctttccgtgcaacggaactgtttagatggtactccagtccaggaacaagacgcgcgatgcgatggcgatgaaaaccacacgttgctctccggcgcgcatggccgtcttgtcctctcgcgctttcanaacgagcgtgcgttcgtgcgtgcagcggagcggagcggggtaaagaacggaagccgcgagggctacgagagggctagcgtgcagtaatgtccactcgcacaactccttggattcagcaaggctggatggacgggagcgcgtcaggcgaggacgaacgggattgggtcagaaaggattacggaagaagtcagcgtcgcgtcccggtggctgcctgcctcgcgctcgaattggagtggagcgatccgagtcaagcgccgaacgaagcgaagcccccgtcgtttccgccgtcgtcgtctcgctcggcagcctcgcatcgcatgcgccggcgctcgccagctgacgagagccgcgtgcgccatcaagcttaattgtgagcagctagctggctgttcgacacgtaaaccgatgaacgaagcgaagaagaagctaccgaatgctgatgcatttgctgtagacctgtagtgcatcgtgtagaaaacgaaaaaggatcaaacatataggccgtgtttagttgtaatttttttttcaaaattccaactttttcatcacatcaaaactttcctacacacacaaaattccaatttttccgtcacatcattccaatttcaaccaaacttttagttttggtgtgaaaacacagccatagctttgttgtcccctttaatgccgggttggttcggaaagtttcgttaaagagggtttatgatattcctacatgtttacttggtctttttgagacggatttgctacatttatgtcgccataaattttcgttgattacagtcggtatacatgcctattggtcacacagccgcacaggcttcccactgcatgtgcttccatgagagagaagattattttcacacatatatcgcgtgatgatagacgattacatactaattacactataattacatactattttatgacttacatatacaattttgaaacttacattgtaaatacactaaaattacatatgtaattttgggacttacatatgtaattttgagacttacattataaatacactaaaattacatatgtaatttaagaacttacgatgtaaatacatatcgactattttttggtgaaaaatatggcgtcataaatatagctactgatataagaacggtaaatatattcggtagtttgacgtgagggaaagtaaaactaggtgatgtgaaagacctttttacacatcgacggataaattcgttgtagtctagctggttaggatactcggctctcacccgagagacccgggttcgagtcccggcaacggaaatttttgattttctattttctggtcatgcaggcatacagcttcaaaaattcatatcttaaataacgatttcagggtgcagcatccaggctgccattggcccacgtggcactctacaaaattttccagggctactctgaaattatgccacgtgtcctcccgtatacataattaaactgcattcttctgtccacttaactctcaggaaaagtcaggagtcaataaatcaccttgcctaacccttgtgaagaagttggatatgtaacccttccgaagtctctagaaaaattaagatagaagttggatatgtaacccttccgaagtctctagaaaaattaaaatataacatggttcttcacgtgtatttatacgcacaaactatgtcagtactcacatagtcacatattgatttccaagacctttgatgctttaactttttaagactggttttaacttttaatacaaagagtaatcttttaatacaaagactggctttggatattaagctgacaattagagtcattagcctaaaaaattatgccttacataaatttcgtaattttcctataggttaacaaattctgtaaattatactaattcaaaagacacatcttccaaagtatttgtccaaaggtacttatagacgcttaaacaagttaatctttcattagcaaaacttttttcaagttgaattataatatacagcagagaagtacggctatctaaatgtggtagagaagaattaattagccatgcatacactaattaaccatattactctatttgttgataatattgctctaactatgttcgattgtacctatgattagcttgtattatttttaagatggagggagtatcgtatatgagactacagagaggagtaggtgacactggtatgttagcagaagaaatttctcttagagagacttgtcaaaaaatatatcctttagttttcggtccactaatgatctaatcttaccaattaataataggtgttaattactctgtctaatggaagagaaaaacaaaggtttgaaagcaaataggcaagtactatacataatttttatacataattttgctttatgtattaattcttttacaacgcttaaatctttacataaatatggttattactataagttaatcgttcctcagtcttttcaaaattcattaaataggttcttgtaaatctactgcatttgaaactctagacaacaacaacaataatttttctaaatgagtaaatatatccagctataagttggtgtgccgatggtgcgccaattttctaggatatggaagcagggaattgggaaaggatagggaggtgagatttgtatatttgtttctaatttttagggtatttagtgtaatgttggactattctataaatttgaaaaacataagaactaaagtaagaaatatgagggcccggcatgaaaaatcaagaatatctctagagttactttgcattataggataaacaaatttgagatatgctaactcatcctacgtgatactttgaggagggtcttgcactacgaacgccctaagagaggtggtatagctatagttttccgaattatacatatgaggctacgaattgtgacatctaaatggtgtactactcgcaatagaagatatggaggcgtgtccctctccattcacatgtggctcttcaaatagtgtgtgaactatgtggtcctctcgtagtcatgagtcatgactattttcgactactgagaagataagcaaatatttggaaaaaacagagagcgcggtagagatacaaatgataagatttttaaccatcgaggatttaataatgtaaaagtaaaataaataaagagaatttagaatgttatacttaggctgaaagaaaataaaaatatgggaagaagaaaaagaaaaaatcatttcccttttttttcataaccagttaaaaaaacaattccaactgttagtgctattataagaaacctctagttattatgagtaaattccctgtgtacccctgaaaactcactcaatccctttcatacccctgaaatttacccaatcccttctatacccctgaaaattcaatttgatcccttccatgcccctaccgttacattttccatcatttcactgttacgtttggttgcaaatatcctttttgccctagatgctttaggtttaaatataagcttaaaaaacaattgaaaaaattttgtttgggtgcacagtatgtgcattttataagactaatgaaactaaataattagtgcagaaaattttgacataaattttgaaaataaaataaatgtaataaattaaaatttttatttcaaattttaataggacaatggatttttttatcgggagcattcataaaaaaaatgttgtgaacattggtagtcctatctttatatgaatgctcctcatttttatgactttttttaaaaaaataaatacgtgttttttatttcatgatctaaaaatatttttgggataaataatgcatcgcacaacaaactcataactataatagtctcatgcgagaagcttttatatttttaataatgtaattcatgaatttctttgttcatccaagggtaaaatggtcatttttatggaaaatagacggtcaactaacggtcaactgatgggaggggtatgcaagggatcaaaatcaaattttgggggtatacaaggaagtaagcaaaattcaggggtatagaagagattaggtaaaatttcaggggtatataagggattttctcaattagtatagtcccaaacaattttcatataaggcttcaccttttagccttatcttattaataataattaaatcgaccatcaaccaacatatatttgacatcattttttcctctgtaatttaaatatttacaaatataatgtttactcagacttgtaggcataaaattaaaaactgctaaaatatctctttaaaattttacgcttttacaaataacaataaacagtatatgtagtattaatatggtttgctatatggatggtgtgctaacggcgcaccaattttctagtatttacctcttttgtgaaaaaaatactcaatacttgcttctcttgagaagaaacaagagaagcacctatttctttaaaattttctggtcatacaacttaacagattaaattcatatattacctcttttgtgaaaaatactcaatacttgcttctctcgagaagaaacaagagaaacaactataactttaaaattttctggtcatacaacttaacagattaatacattatcttgtgtgaaaaaacaagagaagcaactatttctttaaaaattttctggtcatacaacttaacagattaatacattacctaaattttctggtcatacaacttaacagattaatgcattacctcttgtgaaaaaacaagagaagcaactattttttaaaaaaatttctggtcacgcagcttgacagattaatacattacctcttgtgaaaaaatactcactacttgcttctcttcagaagaaaaaaaaatcctacaagtctactgcctcttcccaaattcatatgttacctctttgtaaaacatactcactatcttgagaagaaaaaaaaacctacaagtctaaaagaaaagaaaaagtcacaaaaaagaaggcaaatacttatatgctcatgcgaacaacatatatgcaattgcaaacgcatggaaataatgtaacagtatatatgtatgtactgatcaattcgcagatcaatcactccttgtcgttatcatcagcacccccgcgagacgaggagccaatgccgacttgcagccacggtgtcgtctcccctgccatgctcacgtccttgagatcgctaagcctcgctctcttgacggtggtgctgtccgcctcgtcctctgctgcggcggtgcttaacccgaccgcgtcgttggcgttctggctgccggttgtcgcggtagccttgttccgttggctgggtatcgccggcgacgatgggatgtataccggtggtggcgcgtcgagatgaaacgagctgccgccgaccttcggacggactgttgcggccgaggccagcagtggcgggttcgccgcgatgctgaggtcgagagcgggctccggtgcgtccaacattggccggaacgagagcgggacaaggtcgtcggctaggggtgggactgaggcggtgtgatccgccgaacttgacgtcagccagtggcaccgtttgtggcctccaagcgcctgcccggaggtgaacagtcgatggcagaccgagcattcgtgcatcttgcccttcttcttcaacggtgcagcggcgagcgcggcgaccggcggttctatgggcacgatggccatcgacagttctgccgcggcatcgctcgtgccggcgtttccatcaccgtcgatgcttgcgtgcacgttcctcctggcatcagaagtggccttggcgggattgtcctcgctccgatcagcgacctctgcatggtgtgatggctcagccacctctgcggcgttgctctccagcttggcagcgaagcagcccttcaccttcttgtggctggcacggtgcccgccgagagcttggtgagaagagaaaaccttcttgcacgccttgcactcgaacatgcctcgaggcacggtcgagacatactgtggcgccggcgccggcgggggaagcgccatcactgtatccagtacatacgtcgtcggctccatgaacgtgatcagtctcttatgttccttactcgcggaagaagatgaccgttgttctgcttcagtgacgcctgcctgatctaccttggacgacgagagcatgaccaggcaattggccaggtcctcctcctcgccggcagcgcacgctgagggtgtcggtgacaaatcgactcctgtgcccttgcagcgacgcgagcgcttccctttcaaccaaccggcggccggtgcagaatcctcttcgccgtcggcctcgggcgaaggcgaccacggttgcagcgagtgatccacgtcgtcctcgtcgtcgtcgtcctcgccggagctgcacttgccgtgctcgaggaaatgctcccacgacgtgaactccttcccgcagttcttgcacacctggcggctcctcgtgacccggttaggattggtgcggagctcgtagacgtgtgtcgctgcccctgacgacgacgggccgcccgcgttccaaggatcatctgccccgccgcgcgcacgccgcacggcctcatcgccgagcgaatcgtcgtcgtcgtcgtcgtcatcatcggcacccaacccatcgccgtcgccgacgccgtgggccctcatgtgcccgcctagggcgcttccgcacgtgaaccccttgttgcagactctgcagaagtgcttgtaccccgacgcctgcgccgccgtcggcggcggtgcccgaggtgatgacggcgacggctgcatctggccatgatgctcaagaagatgcaatcgttgtatggaaaatcacaatgtcaacatgtctcgacgaaaaatcaaatcaactttcggtgcgagacatatatatatgtgataatcgactaagtaccaaagacggtgaagattcacacatgcatgcgcttggttcgccgcggcggaatcgaattcgacctggagatgggagcgccgatcaagtgcgcgcctccgtccggtgtcacgaactcacgatcgcagcaatgccgcgagttctcctgaacctgaaggtccaaaacagccatccaaatttaaaaacttcgtcactactgcacgtccatagacatatatagttctcataggcgtgtttcgcggtgcatcggccgctttagctagtgacgtttgacaacgcctaggagtgacacgtgccggtgataataagctacatatctctgaatctgaaagtcaagggaccagcccacgaatcatgttcgtccaacggatgccatttgacatatatgtaggattggagttgttagttttttaacaacagcgcacgtgcactagtgtaccttggggctccttcggattgcagaatctaaaattaattttgttaaatttaacattgaatgtattttgataatattaatcaaatgacttataatatggaaaggagggagtagcaaattttggtcgtaattttaaaaatgataatcatgtaagtatcattcgcgtatgcacatctgaatagcaaatccgtctgaatatgcgacggctgctatactctagatcgcacatttttttagatgagattgtacactcttgtttcggaagtttccagagagcgccgtatgttggattgcaataagtggcagcgatccaaattcttacgattaccaccctccccttgtttggcgattctaaaataaggccttcccggggaattttcggctcctttcgccatcctgcgtcaacctgctgatcaatcgaccgggcaagtaacgcaccgccaggtccgtcaacacgagttgggctgtaactggatccccacacacgtgcccaactacatgggccggaacgggattcccatctgccgcaattagttgggccgggactgtattcacacgaacgcgcaacatgaattacagaggaataagttcactttgagtccctcagtcgccgagtccaaaattagtcccttgagcgcaaaactgagtagaacgcatccccaacatataaaaccaatacaaacgagatccctcggtggtattgtcctcagttttaactgacgtgacacatacgtggctcctttgacaaggtctttatcccacgtaacattgacgtggcgcttatgtggcaatttgattctgtaaaaattaaaagacgtgggacccacatgtcagctacacacaagataataaaaaaaaagttgaggcccatgtgaccccacgtgttatcgtcactcctccctcttctccctatcccctctctccttcccctacactgcaaggagaagggcatagcggtagtgggtggcgcagaggagctgaagatgaccaccgttggcaacgcccacaaagcctcatccatatttccgcggcgtgcactgtgctcgggaacagctctgactagtacacatgcgccaacttcatttccaccaactccgactcctcctgtggctcctaggccagccgcgtgagccgccacacctccttccctccaaaaccgcgtcgcacctcaacttccaccatgccatgagcacatgccccaccaccgccacaattaccacgatcaccaccacggagtccgcggacaacgacaactcaaccgcctcccctctcctctcacccttctcccctcctcctcctctcgtctcctccctgccacatagatctcaccgccccacccaacctcttgcacccaccagatccgcgcgccaatacatccactccccctcactatagccaacctgtcgaaatctaaggctcccaaattttcccctctctcctcttctctttcctacccatgttttgtttggtctttggaagtaacagagagacaacaaatgaagaagaaaaccggcggaatccacttctagtctacgcacttgggggtcataatgcggaagagcaccacgagcaccaggagcgtggtggccttggaggacggtcgaagagggaaggcaccggtgaggtcgccgcccaccatcggttagctccgtccgccacctgcctcgcttgcctgctccgccattctcctcgctgcccacccccacccccacccccgtccgccaccttggaagagagatgaagagaggggagatggaagaagggaggagtgaggatgagtaagaatagagagaggagagagaggggagagggcaaaagggtggaccggaggagcgcggatgacatttggggcccacatgggccccatcatttttaattgttttgtggtgtaactaacatgtgggctcatgcttttttttattacccatattaaattgtcacgtaagcatcatgccaacgtcacgtgagacgtagtagtcaaatgaaccatgtaggcgtcacgtcagtcgaagccggggatagtatcactgagggatctcgtttgtactggttttgtaagttggatgatgcattgtacctgattttatggtcaagggacgaattttgaaaattaagggaccaacttattccaatcacagattcacagccgacgtgcctccgaatgtgggccgagacagcgcagctgatcggccattccattcgtcccgctgcctcgattctattctttgccgtcgccgtcgcacgctcatcctattcccccacaccgactccccgtcagctgcccagagctactcgcctgaaatgttcctcatgtactccacgtagtttcctgcatctgggcaatttcatctcgtcagatatagtgtctggtcactggtgccctccaagaacgggcaaagctttgtcatcgctctagtctgtgggtaaattatttccgtcacaagatgctgccatggaatgctgacaaggacctcagtcctctcctcactcagccatggtccatggaccaggggcatccgcgttgccagaaatcagatcctgcacctgcacagaaccctttcccgtaccgtatgggccgccgcgtacgtacgctgccgtgggggcggccgagttgctgcagcttgcaagctgtgctgcgtcgagtaattcattaaaaataactcttattatccgaaaagtttttaatgtgcaccgacaacgcattcgcatatcgcaacagagaaaattttgcgtgctatgttcgcccattggcatggaccatgagttaaggtaaagtgttaattggtagtcatatttggtccctactggagttgatttgatgtaatctcgctaccttgtcgctatcgattccgttagcgttttaaagacttgatttgccggaaagcaaagttgatcggtcgtgacaacatgaaagaaaatcaattttacttgtccccgcatcagttcttttaccaatcgaggtagagaggaacaattgcattgcacaattcttactcctatcctaagtacacgagcaaaccataactatttacatccttgatctttctgggcactcgagtggcagctgccggcgatcaaatcgtgcggctgctgtgccggccgcctgtggcgggcaactggcagatcacgcgcgaatggcggctccggagctgacgtctactgggctgccgccgacgccgcttgcctctgctgcgcctgcgcctcgccggagcagacgagggccttcttgaggcacctctccacctggtacccgccgccgtagctcacctccctctccaggtgccggcagtagctctggaacacgctgacgctcacgttgagcctgaactgcatcaggaagaggaagtccagctccagcgagctcagttccgcggcggtcagcccgcccaccgcggcgaagtacgagttcttgtagttccggtcctcgacgaacttggaggcgacgaggatggctgtggtgagcagccgctgggcgttggccgacacgacgcgcacgccgtcgccgcggcgaagccggtccaggtacgcgtacgccacgacgtacacctgcggcgagacgttcgcgtaccgggagaaccgctccaggaacgcgtgaaggctcatgtccagcaccgtgccgctgtcgaaggcgcgcgccctcctcgcggcctcgccgtccgccgccgccgcctggtccctctcgttccgggcgatgtgccgctccagcagcgacgcgaggaccgacacgaccaccggcgtcgacagcgccgtcgtgccgtcgtcgccgcacgggagcgcgtacacatccgacgctaactcagtggacgccatctcctgaagaattcaatggcaaaagcttggttcttcacaaaacctatgctacacaagtacacagagaactcttgcaaatgcagacactttatacaccagagggaggcaagcgtgggggcaaaaagaagctattaacaatggcggaactgaacagctgaaggcgacacgaggaaggagcaaagaaacaaaagatatcggcataaaaaaactcagcacgtacacgcaaactggagctaaaacaaatcgagacacggagatgaagccttcaggcaccttccattgaggcccctgacccgatcacccgagcttatttatgatcaagcggacgacaaatgcatccaggggcagatctgattgatggctggtactgcactactgcggttgggggcggcatccgtgatcgacgaggctggatttatgagggaaaaacaagcgcgagtggcgaattatcgcgtcggtgcccggcgaacccgtacacatttaactatgcgagacttttcccgcgtacgtgctacctgctgttcaggtacggcgtcttgtgtcacggcgagacgcgtggcttgtgggcaagtgaagaacagatgcctctgatctttttagtcttgccttgccggttgataagctagtttatgatggtaatgggaacttctgttaagacgtcgaagcgaccgatggatgcaggagacgacaatggccgcggcgttgtaacaaccggttcttggagttgctggagaggagtggccctttctgccgacagatttgcactattttagtaggttggatgatcagtgggaatactgttcttgggtactcataggacagcggcatcgaggtgttgacatgaagatccagagaggatataaaaatggatctgctgatagtttttcttcatcatcagtactacttgcagaatgatgaggttaggttgcaataagctgcttcatcgaaaataattaaagttgccaaaggttaatttatttcatttgtgaggatcattttttggaaagagatgtctggttggtatatgcacgcacataaagcttgcaggaataaagcagaactttgctttgctttctgataataatgatcaaagttatcatgcccctgatcttagattttttttttgaactcctgatcttgattggatattggtatttctctcccactggacaagtagcttttgtttattattgtcaggcgtgataatgtacagcatgatctttgccaagagattccactctgggacatcgaatcaatcggccatggcttgcgacagtgctcatgcgagcggatggtaaacaaattgaggcatgtgtttactagagaatttttaaaaataaatttcatgaaactataggtgttttaactaaactatccaaaattataaatttaaggcaccatatcacaaaaccacatatttaaagtacataaaaagctatagatttaatattaaagttaacataaaattatatattttatagttgaactataaatgttatagttttgtgattaatatgatgctaaacttgtagttttaggataattttgttgctaaatctgtattttttgatacttttggtttggataactttagtgataaatctaaagttttgtaattcaacgtcttaaaattacatttttttcgatagtttggttaatgtataccaatatatagttttgcgagatttattatttttttcattgaagcatgttttacattctgctcttcacttgcttacggtgaccaggacaaagatcatctgaacgggacagagtaatgttagagagcagagtgacagcctgggggggggggggggggggttgtcataatacgtagcagaaaccacatatataattgaaacctcaaaactaccgttagattaaaaatggacgcctaagatttgttcacgcgcacgtggacgaatcttatgtccattttattttaatccaacgataattttcaggttttcagtatataagtgatttacactatttttgcaaatagaatacgtatttatcaagtacttccttcgtccaaaaatataacaacttttagtctttagaatttgtcctaaaatataataatttcttcattaacattctcctttcaaccaatcacaacctccactattcaattttctcacatatctccacttattctccagtcagagcactcccccatttaattctaccaactttcttaataaccgtgtccaactctaaaaatgcttatattttggaatgaagggataagctagtttcaagcaagtgcatgtttggtgaatgaaattgtctggtacacaataaaaaggtttattcaccaaaacaaacaacttgtctagacgtatcagacccaaaacaaacgtattataagttaatacactaacttaagtccgtataccggtaatgcatatttactcttttacattcctcaaaaagttcatgaacgatcacatcatataaaggactaagcataataacaaaagctatggttcaacgaagatatgtaacatccatggtgtcatggtgtcatggttatggataccacatatctaatagtagttgactaaactcggcaggacccaccacatatcatgtcttatacggaaacaaacctcgtatataaaaagagttccggataaggaagaataaatagagttctatatgaaaacgggaaggactactcggattgtatccatatttatctccttaatcttacttggacaagggggcacttatgggtataaatacaagcccccctaggagaaaaggggacacgccacaaagccacaagacataacatacacataagccaagacgatggcagctatataggttatcccaaatattgtatttgtgtgatccagataaataaagagcaacactggtttcggctaacaggatgtagggttattacctgtcagataagaggcccgaacctgtataaaaattcatgtctccatctcttttatcttaatctcgcacataccctgataccaacgatccccataccatccaaataccctagtcgtgactatcaaacgtcgacacatggggatgccatctcaagcgtggagctgcaatgatgtacgattgagctgggccggagcacggaaggcacagaggtggagccgtggagggattggacgactggggccacaacggcggcgcggctgccattggagacagaaggggcggagggacggggtgctgatgtgttgggctttttctcaacttgggtcttctgggctcaagtaatagcgctgtttcggaatggagaaggcttcgtattagaatagaggaacaagtccatttgtcatccctcaactttgcaccgagtttgtatgatatccctaaccctcaataccagatatcttgatcctagtcttcaaaaccgtgcaaagttggtcccatgacggtatagatcattttcccccttttttgttgacatggcatatggaggtcccacttgtcagggtgtcgttggtgtcactgggagatgagggaaagagagaggagcacctgctgcagtcgattgaggagcccccgcggaggggctcaccggtagtctccccttccctctcccacctccacctcccttgcaccaatgccgagcaagctcaagctcagtggggctcgtcggccacgtcgcccctttcccgcctccagtcccctcacatggaagctgagctgacaacctccccctctctgtctcaccgcatgtagctcatgacccgccaccttctcaacctgtcggacaacctcctccccagcgagctattccagccgccagccctcgacgggcacaaccatcgtctcaagtggtcttagtgtgcagacttgggagagggggagatgtggatgatgtgcactctccttcggcgagtggagacggcggcgggcggtcgaaggccctcgaagaaatcgtccctgatccgcctcgacctccaccccacttttctcgctgccgtggctacagcagcggctgccaccaccacatcacgcctcttccgccattcatcatcatctctgttgccgcgccgctcacctcaccatttgtccgtccctcatctccgagccgctcacctcgccatctccgtcgctgcgtcgctcagctagcctcacctggtttgggaggagaggccgagaacaaggggaagagaggaggaaggagggagagaggcagccgaacaaccccggcagctcgccggagggccagttgtccaccagtgccagctcctgcagcctcgtgctcgccggaaactggtctttgctgttgatttgtcaaacaacggcactgacgacacactgacaagtaggccccaccgtatgccacgtcaacaaaaacaatgggaaatatggtctatattttcatggaaccaatttttcacggttttgaaggtttgagggggtcagaaataatttctggtattggagattatgggtgtcatgtagactcggtgtaaacttgagggatggaaaatggacttattcttagaatgactagcgcgtgggccttccccgacttggatcgcaactactggtgtcgttgcccttatttgtggccaacgagaggtatatgtagtatccggttcggcggttgccatctcggcaaagtcagatcacggcgtatagattgacgtaagctgattcggcagagaacagaagacgtatcatgtatatatatggacgttggaaaataagaaatcgcttactgcatacgattatgccggtagctaaaacagagcaagaatagaggccgtcacacggccgggctcgtcaaaaccgagctacggttgccggttggggcaggcccgggatgtctccaaccatgtcaacgcaattatacaagtgcaaatcgcaacgcagaattcggttaagttataaccaagcaagagacgtcactagaagcagctctgcaaacggccacggagggagaacacacatcacgaacacttaacactaacagatcgaactcctcttttaccgcggctgcgcacgattcccggacgcgcacacaccgaactcacttcgacgaggcgagcttctgcctcgcgatggatctatcgcggcgacgttaacaaacacgcgcgtacgtagtcgcgcacgacgccgccgcattaggcggcgtagttcacggtggatcggtaggtcaacccggcctgccacccggaggggatgacgttgttggcgacgagcaccttgccggagcccgaggtgagccggatcgagaacggcgggctcagcggcttcccggtgttggagttgaggcgccaggtggcgccccacgactgctgcatcgccttccacccgccgccgccgcgggcctccatgatgtgcaccgcggcgaggtcgccgtcgccgttcgcgtactggaccaggatggcgaggtagtacgggttggagcccgcgtccaccttgaaggccacgttcatggcaaacctgcacggcaccctgcaggcaaaagtaaaaattcagtaaaaatctgcacttgtacattgcagagtggaccagaactccagaaataattttgcaaattcaatggcggggcacctcttatactggatcttgaggactccggcggagcggaggcggtcgcccatgccacggttggccatggcgccgaaggcggtgccgctcatgtcgaagtgcgccgcctcgttcaggcatacccctccagggcaggagtcggtgatcacgacggtcactgggcggccggagcacgcccggttgccggtgcacttaatctgtacatctaatttagttaggaatgctccacgtcccatgcatttgactggtaaaacatacaaatacactactgacttggtagcatgagccgcagcctttgccattcttgaagagggagggcccgccggcggcgatcatcgacgagaacgggcgctgcccgacggcgctctggtaaccgcacgcgccgcctgcatttggattaattaaccaacatggcaacgtgagtacttgaggtcaaatacgcacatgcatgcagttcatactaccacttgacaacgacttaattaccttcgctgccgtcgccttgcgggccgccgtaccacgtcgcgccgccggaggaccagccgtagcctctgcccagcgacatggtgctccgtctgccggcagtgtagttctgctcgtagccagagacggggagtgacagtatcggtagcgccactaggacggcaaaaacgaaagtgccccggctaaccattgctattttcttgttgggcaatcggttaggtagctgggattgttaagcggagattgctcggtgatttttaagatgatttgatttggttggtatttatagggaagattagcggtcacaaacgtggtagcaaattatgtgtacccaagcattattgaggtgaacgtggcaacttgaatttgtacatgtgttgatgtgtatgtcaactatgtgtgtgtgggatcgaagagtatacttgtggactttacggaggtccttgcatgaaggaggtgatcacgcagccgcaagggtttggataaactattctcacaaggtagttgtgttggttagaaacgctttgaaaattcgcaatttgatattcgtcttgtgtcatccgtacgtttgtcaaatggctactccataatgtgtacgacttgagcgtgagctgtacgtgcgcaacgtgcctagcaaagtagcgagtatcatgcccggccactcgaatgtttgtacatatggtacatatatagttcctttttcttttggagaaatatatatagttcttttagaggagaatgttgtatagtaacacttagtggcagcaattcaatcgaactagctgggtagcccgcgcaattagcacccatacaaaattatctattttaatatgatttattcaaaatttgttaaatagctatctcattatcttaagactttgaaagaccaaaccatatcattctcgtgtttttaattatatagtttttaaaagtcacaccaattactaccccttatgtcatcttcttctttatttgcttgctcgatctatcactatttctattcatacttcttggaacctttaaaaaatagattttatagtttttagagtttattgtcacgttgggttttatttttataatttctagatgtctcgtcaaacgttgccattatactcctctacggcccatcaactatctcatctctttattgtcattgagattttaaaaatcgaacataattatcgttttggttcatttttactttctagaagtcccaccaaaccgtcagcggctttgccattgtactcctctacggctcgcccgctgcctcccttctttattgtcattgagattttagaattgaacatgattatcattgttttttttactttttagaagttccgaacctttaaaaattagacttgtagtttcttttttataattttgagaagtcccatcaaacaatgccactatgcccctctacaacccgtccgccgcctactctttattgtcctcgtgattctaaaagtcgaacataactatcgttggaattcattttttattttctagaagtcccgtcgacggctctgcaactatactcttatacaccccacccgctgcttctcctttttattgtcattgagattttaaaaatcgaatatgattatcaatggggtttgtttttttactttctagaagtcccggcaaccgccttactcatttgcttcgcggcctacctgacgttcctcctttgcggcaattgtgttttattaacaatttttatatgtcgtatcaaccgccaccactctactcctttacaggcctgttacttaacttatctcgtcatgtgttttagatggtcttttctttcaataatctttatttttatcaaaaaattgagttacttatatgcaccccgcgcaccgcttctcatttttattgccattgagattttaaaaatcgaatattactatcaatggtttttttttactttctagaagtcccggcaaccgccttatttgtttgcttcacggtctgcttgacgtctctcaatttaatcgtcattaggattctatttgatattttattaacaatttttatatgtcgtatcaactatcaaccgccaccactctactcctttataggcttgttacttaatttatctcgtcatgtgttttagatggtcttttctttcaatagtctttatttttatcacaaattttagttatttataaattgtattcctaattgaaatcttatttttctttttctaatttcagaatttattttttttaaaaaaattagttaataccgtgttgtgttcttttaatgtttttatttttaattttcaatttcagttgtttcaacattgtattcctacttgaactctcttttaatttttctaattttggatattattttattttttatttaaaattttaattaatctcatattgggttcttatatggattcttctttcaatattgcttatttttaattccgaatttcagctaattttaaattgtattcctacttgaactcttcttttattttcttttgctaactttggatttatttttattctaaattttaattaatttcgtattgggttcttatatggactcttcttttaatattccttatttttgacttcgaatttcagctatttttaaattgtatttctacttggactctcctttccttttctaattttgtattttttttacttttatttcgaattttgattaatctcgtattgggttcttatatggaatcttctttcaatattgctttttttaattctgaatttcagctatttttaaattgtattcctacttggactctcatttccttttctaattttagattgtattttatttttatttcaaattttggttaatctcgtattgggttcttatatggaaacttctttcaatattgcttatttttatttccgaatttcagctatttttagattatacttctacttagactctccttttctttgttttctttttctccgattaatgtgggaatttttagcccctacagcgaacgtggtgccttcttttcgagctgtcttaataatataactagctgggtggcccgcacaattgcgcggctagcacccaaacaaaatcatatatttttttaagtatgattttacttaaaatttattaaatatctatctcattgtcttaagaatttgaaagaccaaaccttatcatcatcgtgtttctaataatatagtttttaaaagtcacactagttgctaccccttatgtctcagcttcttctttatttgattgctcgatctaccactatttctattcattcttattggaacctttaaaaattggattttatagtttttagagtttattgtcacgttgggtttcatttttataatttctagatgtcccgtcaaacgttgctattatactcctctacgacacgtctactgtcttatctctttattgtcattgagaatttaaaaatcgaacgtaattatcgttttaagttcatttttactttttaaaagtcccgccaaaccgttagcggctttgccattgtaatcctctacgggtcgcccgctgccctccttctttatttcattttgattttaaaatcgaacatgattatcattggtttttttacttttcagaagttccgaacctttaaaaattgaacttgtagttttatttttaataatttttagaagtgccaccaaacgatgtcactgtgtccctgatcacagcccgtctgcacctactctttattgtcattgtgattctaaaaattatttttttttactttctagaagtcccggcaaccgtcttattcgtttgcttcacggcctccctgacgtctctccttttaatcgtcattagactctatttggtgttttattaacaatttttatatgtcatatcaaccgccaccactctactcctttatagtcatgttacttaatatatctcgtcatatattttagatggtattttattttaataatctttatttttatcaaaaaatttagttatttataaattgtattcctaattgaaatcttatttttcttgctctaatttcagaatttatttttttcaaattttaattaatatcgtattgtgttctttttttttcaatctcagttgtttcaaaattgtattcctacttgaactctcttttaatttttctaattttgaatattattttattttttactttgaattttaattaatcttgtattgggttctgttgacagaaaacacgaggcctgggagatctgcttaactccagtgcaggtccaaagctcgccttcggatgtatgagcgtgctagttgatttgatcttgaaatcaacaagaaatagaacaaagaaaccgcaattaatcctataaatgatagccgatcggctaagtgccgatgacacatcatttatttcaagccggtgtcatgtgtacatcgatcgacaaatatcaataagcaaaccagaactaaatctactcgatcggctgtagatattaatgatatataatccttatatcgatatatacttaaatcaaatgattgagatagatcggtcgccttgccgagacagtataaatcacttagatcgaaatatatattaatagtaggattatatacattcatgtaacatcccggtctagggcttaataggattaatagaatactcatatcaacaagttgcaacttcttttccggaagccaatctccaaagaactccagctccagggttaagcgtgcttggcgtggagcaatttgggatgggtgaccgacccggaaattcttcccgggtgcacacgagtgaggacaaagtgtgcagaaaagacatgtgttggtctgtgagggtagtctatgacctatgaaagctatcagacgtaagcgggcttggcctgggggaaggcgggacgttacaaaatggtatcagagccgactctcgcggtttcacgggcgcgtgtgt

SEQ ID NO: 65319 - DNA, 6708 bp, Oryza sativa
  unsure (1)..(6708): unsure at all n locations
acttgaactctcttttattgttttctaactttggatattattttattttttattctaaattttaattaatctcatattgggttcttatatggattcttttttcagtatgcttatttttaattccgaatttcagctaattttaaattgtattcctacttgaactcttcttttattttctttttctaattttatatttatttatttttattccgaattttaattaacctcgtattgggtttttatatggacttttcttttaatatttcttatttttaattccgaatttcagctatttttaaattgtattcctacttggactcttatttgcttttctaattttggattttattttatttttattttgaattttgattaatctcgtattaggttcttatatggaaacttctttcaatattgcttatttttaatttcgaatttcagctatttttaaattttatttctatttggactctcctttccttttctaattttggattttattttatttttatttcgaattttgattaatcacatattgggttcctatatggactcctctttccatattgcatatttttaattctgaatttcagctatttttaattgtatttctactttgactcttcttttctttttctccgattaatgtaggattttctagcccccacagcgaacgtggtgtcttcgtttcgagctgtcttaataataatagatagatagatagatagatagatagataatagatagatgatgagggctgtatgatagtataagttattttccgacaaggaaatgggccgtttaccgcgagaagttggtgtgggcccggctgcaggcccaatccccccgaatctcgcgccgcgtagtgagctgagagcgttgctgttcccctcgacacagaccgtcacgccggcacgcacgtaatcctcctctacaccaaccgaatcgttgccgcgcacccacgcacgcacgcacgcaatcggcaatccccacgagaaattccccggagcgatcgctaaacgtgcggtgcacataggcagggagggtgacgaaacgggcgtgtggtctcatcttaacgtattggatattttgggtcgcggaatcgctggaatctcccgtgcaacgcgccgttgatagcgaagctcctgctccaaccgcgcgggcgggcaggcggacgtgggaggcaacgctgttcgcctgttcgggccgaggagatcatcatgcagtgatcagacgacggctgatcgcgcaggggggcgcacgtcgtcccgtgaaaacaacagccgcgcccgcgcgtctctatctgggcatatcacatcgtcttccaccgatgggctcttcttctcctacgccgccgatcatgtagtcgacgccacggtgggggtggtgtgtgtgtggtggtggtggttgggggggtggggggtggacaaaggcaaatcatgtttgttggcagcgttgccgtcggcgagattagcggaaagttgttgtgatagcaggccggttgacgtagatagagagcggcctaggcccaacacaaatttgctgcgctttgggaggagcgaattgggctctcgtcctatacgggctggaatcaactatcccagcccaccttggataatccgaattgttggaagcttcggcctaaggaataagttcatctaaggtcccttaatttacaccgaatccaattttcatcctttaaccccaaaaccagatataatttgtccatgactgtcaaaaccggtgcaaataagctccctcggcggtttggaaagcggtttttgctgacatggtgcctacgtggctggtttgactaggtcttcatcccacgtggcgctgacgtggcaattatatcttaaaaaaaataaaaaaacggtgggcccacatgtcagctacacacaaaaaaataactacaaaatggtggggcccacgtagaccccacatgtcatcctcacttctcccttcttcctctcccctctcatttcttcctctgcgccggctgcatcagggacgcgttcgacgctgccatgaacaggacgaacaggccgctctgcgagctccgcaagaacgtcatgctctactacgactgcttccagctcctgttctccgacgtggactttgtctccgggtacggcaacaagccggagtagccgctgaacaacaccaacgtggtggacaccttcatcgccggcaggttccgggagcacgtcgcggtgctgttgaacgctaccgtgcacgatggtgtacgctttggtgcagtgcacccgcgacatgaattttattttatttttttcaaatgttcaccatatcctgattaatttgtttctcttgcttggttgctgcatgattttggtcgtggtgcagaacaatcgggttctgatgtcccctccggcgttgtcctccacctcggcgtcgccctccgctctcggctccaggaggccgttggtgatggggaagcgacgacgccggctttggtgaagcaacaggacaacacgagctcgtggctcgccacggctttagctccttcgttcctcttcccctttcctatacgcgcgtgccccggggggagtcaggcgcggggacggcggcggctccgggacacggagcagaggggcgccgcggcgggcgagcggagtcgtcaacgcccgcctcccccgcagcagcgtccggcgccggccgaacctgtccctcctggccgaccgttgcacgaccccgcgtgagctcgccgtcgtccacgccgccatgctcgtctccggccgcctcgccgacgacgccttcgcggcgacccgccttctcgccgcctacgccgtgctctccccttccgacgccgtgctccgcctcttcgccacgagccacgagcggcggccggaattccatgcgaagcgccgtcgcaacaagctctgccgcctcgtgctggctgttgcgtcggtgtagaggcggcgcaggggaaggaggatggaggcggtggtccggcgagggaggagcctggcaactgaggcggcggcggcggcggcggcggcgaggttgccgaggtcgccgcctcgcagcctcgctcgcctacgggaagaagatgaagaaaagggagagggaagaaagggggtgtgaggatgacatgtgggcccacggattttattatttttctgagatataattgccacgtctacgtcgcgtcagcgccatgtcaatgtcacgtgagacggagacctagtcaaaccatccacgtaggcgccatgtcagccaaaaccgccttctaaaccaccgagggacctcgtttaccccggttttaacagttcagggaccgtttgtatttggttttggggtttaaggacgaaaatcggattcggtgtaaaattaagggaccttagatgaacttattcctcggcttaaacccaaaactgcccccatactttccaaagcctgggcaccgaatggtatgggaccattttaggtacactctaccaaactggtgtctagtggggatgtccactcgctgtttgcatgtcattcaaataattataaaaaattaaaaagattataaagatatattaacatgtgttatatgatatatcactctataaacatgcaagtttaaattcaacctacacatctcgtaacaaaaaaataaatttaactttgaatatgcgttactagttgtagtttaatttatttttttttgttgcgagatgtataagttgaatttgaacttgcatatttgtgaagtgatataacacatgttaatatatctttttattttttaatttttttcataatcatttaagtgacatgtaaataaggagggataaaatagtttcatggtgcatgccgagagacatgtatgcacagtcaagacacaacaacacaatgcgaatatgttcatatatagcacgtttataagcactggtcggctctgttctgatacaaataatacacacagtaaacacgtataacgataatcattgacacgtactgcggcgaggaggggagaactagtaaatcatctgcgcctccgcctctgcatctcgccgttattaatttcacacttacgacaaacctgtagccctgtagcacacatcgttgttgcaccaacgaataaccgatctaacatatgcctgcagactgcagacacatgcatgcagcaagcatgcaagttgagatattgcttgcgatcgttagaagttcaccgtcgatatgtacgacatgccgggcttccacccggaagggatgacgttgctggcgacgagcgtcttgccggagctggacgtgaggcggatggagaacggcgcctgcagtgccgagccggcgttcagcttccagacggcgccccacgactgctgcatctgcgtccaggcggcgccggcgccggtctgcatgagctccacgccggagaggtcaccgtctccgttctcgtacttgacgagcacggcgaagtagttggggttcgagccgacgtccacgacgaaggtgagcttcactccgccccagttgcacggcacgctgtacacacatcacgtgcgttcgatcggatcgtttgaaagaaaccaacacgagaagaagaattgaaggacagttgcatgcatggaggttatagctgaagcagtgcatgtgccccggtggccggtggtccatgcgtggtgataagaaaagatgagtgaagccgtgataactgcaagtgttctgctgcttggccgacttttggccattgctgctgcagcaatttttgcacggaagtgaaagatgctcgcttaccggttgtactggatttggaggacgccggccgcgcgcagctggtcggcctggccggggttcgccatggcaccgaacgccgtgccgctcaggtcgaagtggaccggctcgctgaggcacgggcctccggggcactcgtcggtgaggacgacagtcaccgggttgcccgagcaagcgctatttccagtgcatttcacctgaaaaattatattgttgatttccaatgttagatgcaatacaggcatatactccctccttccctaaatacgccgttgacttttttaaatatgtttgaccgttcgtcttattcaaaaacttttgtgaaatgtgtaaaactatatgtatacgtaaaagtatacttaacaataaatcaaatgataggaaaagaattaataattacttaaattttttgaataagacgaacggtcaaatattttttaaaaagtcaacagcgtcaaacatcttgggacggagggagtacatgtatgtgcacagacttaattatactagatatatattctgatctgtcggtatatatgtacctggtagcaagagccgcagcccaagccagacttgtagatggaaggactgccggcggcgatcatagacgagaacggtgcctggaagacggcaccctggtacccacatgcaccacctgtacacacagatattgcactgttaagacatgacatacataggcatgaattttcttttcgaagaaactctcatctgatgacaacgtatttaccatcacttccggcgccatttgcagcgccataccacgtagctccgccattggaccagctggagagcttgcggtggaactcgatggaagcgcaagggcgtggaagcatggtgacagcggcaatgacaacgaaggtcgacaaaatcagctggaacctggaagccatggctgctatacctgcttagctaaacttgctaggattgttgttgctttgcaaggatttggaagatgcaagcaaatgagtcgatgagaggtggtgtgggctgtgtgtgaggtagctagggaaaggaggtgatctatttataggcagcagacgatgggtttgtgtgggcatatccctccgtgcatgcatgcgtatgcagacaaatcgctctgcttgcttgctctgttggatagttccatatccatgctaatgcacatggctagggtcaacatgtttaagtacagtcgaaaagtaattagctatttacgtagtagtaggccggtccttttgtgtgtagttcacttgtccaatcctcaattcgatcggtatcgggaccatggcagttttaccggtattattactagctttcagtttctgcctgcctggctagatctggcaagctagtgaatgaagccataccatttggctggagcccatctttggttaacaaactcgtgaatgtagcatacatgctatgtgtcattgcaccctgaacctccagggcggcatgcatgagagaaaggtgctaatacaattaatgtgcatagcttgtgttaatctgcaacagagggtaactgtacatgattataatttgtgcataacattgtcaataacttgctggacgacgacgcttacgtttgcgaatcctgcctactactattggcaaaatggaaagtcaaaagtgcacaggagattggccgttatttcggttgatcactgcacgcccgcacgcccgcgcgcgtgatgcgatggtgaccgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 65320 - DNA, 2686 bp, Oryza sativa
  unsure (1)..(2686): unsure at all n locations
cccaggagaaatctgcaggaaaaccaaatgagggagttgcggataaagctccacagaaaactgcagaaaagggctcagaatgcaatgtcagtatcctgaatatacaggttggccttattcgcaaagcatggaagcacccatctgctgacaggtacccataacttttctcttatgcacaattcaaaatggttcaacagttgtattgtgctctttgaacaaatattctaactggtctctcttttcagcctcttggttgaggagatagatttgggagatggcaatgtgcatcaagttgttagtgggcttgcaagttcttcagcccagaggaacttgttgtgagtatttaacagcaacaatggacttgaattattcctgttcatttttcttgccatgaaattgtttcatccaagattctgttttctgtaataaacaactgccttttccttcacagaatcggcatgttgtattaatcacgaatgtgaagcctgngaagctgcgagacgtaatgtctgccggattggtatgttctattccataaattatatttatgctcgtgtacaggcaaagcatcttgatatgtgtcaagcagttgatttataaactacatccaacatgtgacaaaagatccatgagcctatgatggaatactagctttaaataggcattgctgtagaccccaaatcattagggcatgtgtatgctcttgaagtctactgtagtacactaaaataggcaatgtaacacttctcactgatgaaacaatgaactattttagaagtgaagcctcaccatgtgcttggtatcacttatttagtcatttgtgttctttctccagtcttagaaatggtaggaatataaactttaagttaggaagtcctaatttccaaatgttgttttcacattgaacatattgccaggtcttgtgtgcttcaaatcaagatcatacagttgtagagccattgattcctccagaaggagctaagcctggagagcgtatttcatttgcagggtaagaattatgttgtatagatgtgatatctgcattaaaattttaaaaaacgtgtttgtgcagttctggggagcatgttctgttcaatttgacctatttgcattcatggctttaaagtcagcttgcacaagcttatatgcaattactgtcttttagattgttatacaagttgtcccctaatatgttggtcgtaagggaagtccaaacaggatggacccatgttgtgtgatgatctttctgtcgtctttcaaggaaaataatattttagcgtagttagcatttcggttgttattagtagtgtcttgtgctgtagaaattatttgattgtgtttggtgtcctgcaccgtttgtgaagaaaaaaaatgtttataactgtccacctttcagttcagttaaattacttatccttcacatataggtttgatgggaagccagaagatgttcttaatccgaagaagaaacagctcgacaagatcacaccggtatgcttttaccaatgcgctatttttgcatgatgctctaagttatttttcccttttagcaatcacatgattagtctgcccttccagcacaatctgggtgaattaaatcagttgtcatttcttttgcacatctgggtgtcattttttacattgccttaacaaattcaataattaaatacagacaattcacaaatcgtgtttgctatgcgctgagtgctcttgaaggctgttgtgtatccatttgtatatatactgcatgaatcaaccaataattaaattttatcatgcacccaggatcttcacactgatggaaatggaattgcaacataccgaggggtacccttcactacatctgctggtccatgtagatcttctgttcctaatgcgagcattaagtgagcagttattttaacagattccaaacattgttgtgctataacacatgctaggtggatgtactatttcatcttgcatcttattacatgccctatcaactgttgtcagcgtagcgtccatctactgtgatatctaatagaaaattttgactagccaatgtgaagaacatttgtattaccttgcaccaaatgcaaaatccttcatgaacacggttgttttcaggcaggatttctgatgagtcaatttctctttaccatttagacatttaattcaaattaatcaatgcaattctaatcggcaaaatcaaagtaattgctggtagctgttctcaggagcaataccttgcttctttcgagggttagcatgaggccatgagtatcgatttctttcttgtggagttctttttgcctgccttccgtcttatgtctcacatgcaacagcttggcataagcaatgtatgtcatttgagtctttttctttgtatccatcgtgctgacattgctccatgaggagggcaaatgcccctcctggagaagctttgattgcggtaatcaataaaggaatcgattgaaatctgtgtggttgaaatgaaactgggtatgtatctgaaaaagaaagttcaggctgggctcatagttgagattcaatcggttaggtattctagtgtttcagattcagggaaaaaaaacagctataacatccacagggcttcttacggttttgttttggtctgcccccacacgttagtgcctgccactgcatcagcagtacacagtcgacaatctctactgtaggagac

SEQ ID NO: 65321 - DNA, 2789 bp, Oryza sativa
atcacgtgggcattccctttggtaactaaaatgcattacatatttttctttgtagaatttccgttgataattaatttgatactggggaattgacaaacacgtaataaaccgagaaagtgtgtcattcgttgtgtaggcactttaatgctgccttgttatgtaggttctcaactttagttcatggacctgccctgttttttgtaggtacctttcttaccgtaggaggtttcctgaacttcatgcttactgggaggacatctgcaattcgttttggtattattcttggctttgcgctgttagctatgggcatctcaagtttgagatctcaaaagcaggtggccgtcgtcctcgtcttctgctgaaaggacaagctggttagttcatttcttctgtcttttcttctcttcagtttgtatgcccttttcataatttaagtggcataagagtagcatagctggtctcttgtgttgatccttgatactcatgttctctgtttttatgtgacatgtctagttactggatatatccatattagttcaagttaaatcaaacagggatgacaagtatgaatatttcagacttctagctattatctaattggaaattaagaattcatcatcattttacattgaaaaatgaacccatgatttagcttgctgaaccaagtcattggattgttgtccttttacattgcaaatttattgacatatttgactttcatgcagcaattgcaagtgtcatcttcttcagggaattattaattttcttccacgtatgatttctttctttgccttcaattgcattgctaaattctaatattcatacttgttctcaccaccataatttagttttaacctttttttatttgttatatggtgtagtatgggtggtttccaaatattttcgtggtccttctcaggtgagtgcatgcttaatttttgtacttgctctgatattgactaacagacatctagcaatgtgttaacatgtaatgtggtgatccttgcatatttttggttcctacgatgagatttcttaaaaacagtttctttctatgactagtaagcgtcaattccttgtacagaatttgccttgattatacaagaattttcttacccatatgcctttgatgttcctgttatcctgtgttttttcttatagatttcttcttatttactgtacatttccccaaactgtatctatcacctagactgcaatccaatgtgacagtctgacagttttttttttacatctgtcacaaatactacttttcgctgaatatcacctgagtgccttcttttttccacagttaatagttccattttttatactccctccttccaaaagtctaagacctatttcattctttggtttttccaaaagtccaagtcctatttgtagtcaccatgtgctaaattaaattcccaagaagtcattctattacttattggttgtatacatagtgaatgaattaattgcttcttggtcttggtgcaaaaagaaataggtcttagacttttggaaggagggagtaataaaactgttggcacgttgtgtgctgcttcaaaactaaacttgtcaaaccaaacatgagcaatgttcctttaaatgcagtgacctgtaagtagttgatggcaaacaatatatttggccatgattattccaaatctccaatgacttactaggtttcattttgaagttgttcattcagtggttatcgtgctgtgttttatttctttaggggcgtgtcacatatcacagtttttttttattggggtcctagccactatggccattttaagcttatacagaagaaatacatttgttgtatgtatgaaaacctttatttttttaaactagttttgaattgttctgcagtggggcggtgacagccttttacactcatcgtattatgactggtggtcacaaaggtccaagctccgagagtactgcagagaactaatggtaacacttgacagttttactttcatgctattttcccatgcatgtacagtatacaaataggtctataaacactgcctatgtgctttgataaatgataactgaactagttacatgatgttacgcataaatgataaaaccaattgtcgttgaactcacaacatggcatttctctaggttacacatcaccctggatgaatcagatgatcacaggaacttgggtttgaagattgactggcccatttgctttccgtttccatccccatcaaactcaagcaaccctagtttgtctttagtccccaagtggctgtggactttgacggttgggttcagaagacgacttgcatgcatactcgtcctcgcagttgcgctcctttgttctccccatgtaatatacacattcgcctcgaacaacaataagaaattgacctccaaaggtcatagatgtacctagctgttttctgtttcttctgtttatttgatgcaacgttgttgtgctctaagcttgtgatattcaacaacatccagtgaaatccagcaaaaccagtattcgtttcagcttgttgctattggtggttaaactaaccatctgatccttaaccctgtaccaagcatgatattgcaattgagtgtcactactattaccattattacaactaatgaatccattcgttcacatgggacatggtggccggttttttgttaccatcagaagtgcgtcagttatgcgtcaagctgacggtcttgtgttctctttggctgctcttctggacatatatgcttgcaagtagtaggagtagcaattctctattattacctgctctgtt

SEQ ID NO: 65322 - DNA, 1324 bp, Oryza sativa
acgtccagctccacctctgacgagaaggagggagaccacccctgcgacgtctcgctgggagcgtcgccgtcgcagctcctccgctcgacggcgagcgacgacgccggctcacgcgaggccatgttccaagcggcggcgaagctcgacgcgccggagttgatgacggcaggtggcattagttccccgtcccggcacgcggcggcggcggcggcgtcgcctccgcaggtgtgctcgccgtagtaggcgatcacgaacgccgcggccgggtcgtcctgcgactgcgactgctgcacccgccgcgtggcgaggcagccctggcccctgaacgcgcagcggtagtagagcctcgggtgcttgcagccattgatctccttctgcccgtacttcctccagatgaacccgtccgtcgtcgtgccgctcctcacctccctcaccgcctccgcgccacgcgccctgcgccaaaccaagaaatcacctgttactaccttgcatgatagagtacaaaaccgtaccgttaccacacgattatcgcggttatcatgcacggtaaccttttcgatttttaataccacgatatatcttacggttaccacacggttttttcgatttttgataccacgatatgtctcgcggtagccgcgccaaaaaacaataaggggaacctcaccttcttttggtcggcgtgacgggaagagaaggggaggtcacggcggcggcggcggcggactccgccgccttccgcttcttgccggtagtagcaccagtggctcctccccggttcagcttggcgatgacgcggtcgcagcagcggaggatctccgcggcgagctcctgctgctcatcccctgcctgcgccggggacgccgcccggagcagctcgccgaggtacgccgccgactggtaccccatcgtcatcagctccagcaccaccgccgacgagctccccagcatcgccatgctcctcactctcgcacgacaactctcagcttgggaaaaccgcgacgccgtgcagtgaagtgaccccgcacatcgcgtcgcgtcccgtatttatagaaccccgcccccaccaacgcggggtgggaaggaagcccgcgcgaaccaacgccgcggtcgcaacgggcccaagggcccaaggccaaccaacgcgactgacaagggagcaaatcaggctcagcgaccgagcacccgctttgctgctgcgcgatcgacaacgagatctccgccccgccacttcactcggcttcggcagctcgatcacctggccgcaacgtgattccccttccgctactacagtacccgtacctactctgtcgatgtccccaat

SEQ ID NO: 65323 - DNA, 1422 bp, Oryza sativa
accaatggacggcgcatattttcttgccgcgagcacaaggccaaaggtttgattgacagaacgtccactttaaaaaacccggttgaaacagctgaaaacgaaacgaattccagcccaccaaacacaattacacaaacacctccgagagctccgaaaccgaaagccccctcacacgaaaaccccaccaaactcttcttcttcttcttcccccattttcctcgcgttcccctcgtgccgcccgcctccgccgtcgcgtccccgccgccgccgcccgccttccccgaggggcgcagccgcggagcgccccacccccccccccatggccgcctcgctcgtccacgccgcggcagcctccgcctcccccgcgccggccgcccgcgtgggggccttccacccgctcgcctcctcctccccattctgcgcctggcgtgcgccaccgcttcctccccctccacccgccgccgccgttgcctcgacgccccgctcagggcgctctcggcggggtcacgcctcgccgccggatggggcgccccgcggactcgccgcgtcatcgccaccttcgccggagaggaatctgtgagtagtctcgccctttcgagatcctacccgctggtggctgcttctatcgtattcctcttgttactgtcaatccgatctgtgtggttttatttggttgactagttttttttcccctcccattttctgtgcgtgatgcgcggatgacataatctcggtgtgcttttacaattttttgctgcgtcaagtgatttttgtctgactatttcgaagcgtaaatacgtaatgcataccaaacagttttgcctaatgttaatgcgctttttgagatgccaaatgtcttgatcagttcattgcgctaaataaatcccatgtttgactaatgtcggtgcgtttcgtcagggttttgaactgagttcttgtggcaaattccttgtttattctgttgctaaattgtggtgcttaaaacatttgtctagagttcacaacttatgtggttgagtttgcctgaattcaggtgggctcagaatcgggtgatgacaaggaaaaagggaagggtgagatgaagcctgaggaagctcaagaagtgtggaaggagatgcttaagcagttcaaggatgaggcgcagcgaatgcacggcctgacattgcaggcgtatggtgtctactcccagagggcaagggaggtgctattagaggcctcagagaagctgaagatccacgcagacaaagcacagaaggatctcagcgtgattgccacagaggttggtgaggagggacaggagtatctaaaactcgcggtcaaaactggcagactcaattaaggatattatcgagacattcaattctcttggcaagttgaagatatcagagtatgaggattatcacgtgggcattccctttggta

SEQ ID NO: 65324 - DNA, 1002 bp, Oryza sativa
tgcgtttggttattttatccagaatgaagggcacatgtacttcatgttgacaacatatagcaacaaactactacttccattccaaaatataagcaaatctaggttttctagcaaagactaaggttaagcagaaaagactatgatgcccctcataaattagggtggttggtgagtgaattagtactctagacgtgcttatattttggaacaaatttcaaatgctagatgtgcttatattatggcacggaggtagtatgaaaaaagatactaacaaagtatgatagtacaaaataaataaagttttatttcgaacctggatatagtccatccaccgcaatacatgtggatatttctgcaactcgttttcaccaagatgactctgaaacaagcagtaaaaggttaaaatctcagaacttctgcttttatgaatgaccattgatggtggtcatacaaatgagtaatcacatcatacttaccacaaaaacttgtatggttgcaaacacaacaatatcagcaactgatggtttaaaaccattacccaacagaactgatttctgggacaagtcttgattcagattaccaagcaatgcatgctgttctccacattttccaacaaaattgctggaaaattcaacccatttcagtacctatcagtgaagaaatctgtcaatatataagtagtactacgtgttattagtgtacatgcgtggaaaaacagttacctcatcttcactcgatttcacaatatgtgagaacagggtggcaatatcactctcttcaatacttgtactggatattgtattctgtaatattcagcgcagaaattagtagaagcttccagcccaggtagaactcaattgtgcaattggagatttataagagtgagccaggcaaagtttgtccaaatgaactagtaatgaacggtgaactgtgaagtgcatataagtgggccaacagtgtagcaatacaacaaacgttgtgccttgtacaccagtcaaatat

SEQ ID NO: 65325 - DNA, 16918 bp, Oryza sativa
tctaattgcactgcttagagtaattaagagaactagagaagcacgaagctaatcaacagcaaggacgatcctgttcaatcctggactcatggtttgcatagtggatatagtatatgatgcaaaaaatccactactgctcccatcaattcacggcctgccacaaatcgaacaattgtacagcagataactgcatatctttcgactccccaactacgtactatacgcttgaagtaaccataccctaaatccgacagcacaatacaatcgcattatgagattcacctcacgagtctatcaaatactaaatactactactacgagtgaactaatccccccgaagaacttcaacaaccaagacctcaacacggaaatataagaaaatcggcctttagcctgcacaacgacagcactaaacaacaacaatagcaggagaaagcttttgcttcgaagcgaccagaacagaaatccacggttttatggctagagagtcggggaatcaccggatcgaggctgaggtgcttgcagagcgcgtaggccatggcccgcttgctcgccgcgaagtccgccgccgccgccgccattagcacgtcgagagaggttgcgccgagcttgggggtgagatgggggaagtggagaagagggcagagatggttagggtcaagttgcagttggagcggccaatgggccaatggcccaatggatgctggccttcggagtgaattgggccgtactgaggcaatatttggagcgttttgagcccacgggcttcttttctgattaatttacgaacttcacttcctgtgctagttgcgcccgagagctcgtggctggtatcgagctcggcttagggggagaacaagttcttttcttaaactccaaacttcatcttacttatttttcgtcaatatatttttctaactattaaatgatacgttttttaaaataaaatatagaagttgtttaaaaaaattaaagaaaatcattttttaaatttataatagttaatattttattaattacatgctaatgagttttatcgtgcgctaaaaatttctgtagtgttggatggaacgaacgcagccatctcgtaatcttcattcaccattttccactgcgctccctttgtttcttaaagaatgaatcgtcatgtagtaccacagtatcatccatggccgcttccgcccaaggaaacaatctagccctcgaaccatgcaggaacaacataagcacacaactttagccgcacaatctgatcaccgcaaattcacataacatgtcgctatgtacatggagatgaaatctcctctctctttcactgtcttataccaaagcacgagtgaaagcaaggtcaagggggttcggagataaaaattccgaacccccgtagccgggtttactcttttgggttctttctcgaacgatgtcactagggtttgaagattagttgacgagggcaaacgcggcggaacagaattttaatctccggtcatgtttttctctttcttaatcaacgactgagctgtgtttagttcagcgcaaagtttgaatttttattgaaattggagatgatgtgactgaaaagttgtgtgagtatgacaggttgatgtaatggaaaaggactgaagattggatccaaactttggatctaaacacagcctgaatgaggctaagagcaaagtatagccaactactaactccaattcatctatagccaatctaatagctcattcatcaatagttgcatactacactattaatacctggtcccaccagtcatacacacactgcgtcttggagtccgtgctacagctgactacaaatctgtagcccgctgctcttctttctccttatttatcttcttaaaatatgtttgcagctggcttatagcctgctattgtacctgctctaaaggggttgtacgtgagtggctgcacctggctattattgtgccactagtactccaaacatgttaagtgaatttatacgcgtgctaaaaaagccgatgatatactctatctccatccataaaagttagacatgtttcacatttgagtttttcaaataagttgttcttatttgtagtctttatacatctaagacttaaatgaagagataaattaaatgtttgtgagaacccaatgagtaatctaaatattcattgattgcttgtttacatttactcgttgattttgtaacatccaagatgatttaatttctccttgatcttggtgacaaaagtaatatgtgcaacttttgtggatggaggaagttgtcgacatttgatgtcgcgatttcagtatttgcatagtatggggatcgttggtactaggatatacgcgagattgtagtaaaagagacagagacgaggatttttatacaggttcgggcccctgaattgtcaggtaataaccctacatcctgttggccgaagccggtcattgctcttattcaccataatcacaccaatacaatacttggggtagcctatctaactgttgtcgacttggcggtctgaagttctaactcatagtcgacaccagggtagacttcctcctcgaatccgcatccggcgagatcagagatagcgttatgtctctcctgacggtagccataggcaccgtaggggactagtcatgcctatctctgaagttgatatctggcgtcttgtcttggcgtatgttggcttgtatgttgatcttctgtcttgatctattgttccgtgtcttctatggtgggtgtgtcccctctcctcctaaggggccttgtagttatacccataggtgtccccttgtccaagcagaactaggaaaaccaatatggatacaatctgagagttcttgtcgtttccatgtagaactctggttctctttccttattcggaactccctccatatccgaggtcagttttcgtataagacatggtatatggtgggtcatgccgagatttagtcgactactattaggtatgtggtacccataaccctgacagaagtattatacagtatatcatctaatcacctagattgactagactctcgaccatgagtcggagtctagcgtattcatatatcatccatggctactgccgaggacagaaacaatctagcggatgaagcatgcatgaatcagcacaaagatcggccaacaataaaggcggtgttcttttctcctaaagataaagattaagttttttacgcaaaacgaggtaatattaacgtatgattaattgagttttaattgttataaacttgaaaaaaagattaatatgatattctaaagcaactttcatatataaagttttcacacgaaacacatcgtttaacgatttaaaaagcgtgccacgagtatctaaaattttatccaacttttgttgcagaaagaacagggaaaattacatgatgactaccaaagcatcgaggtcaaggggatcggaggttaaaactccgagtcttattagccgattttctaattttaatctctggatatgtttttttctcctttttaattataacgaatatatacgaggccaaatgggtccaatggactgggattttgttcggctcgtgtgctcgtggcgactccgagacgcccacaacgtgcccaactaccacgtaacactagactactagtatgtgcatcacgtactagtcaaacagcatgcaagagtggacgacacatgcagcccccacaccctcccctccccgtagcagcacagcactgttgttgctgtctggttgacggctgacacgatcgattgcggacacaatctaatgggcgagctgtgtggggcgaagcacccacacaatctaatgggacacattttgtttccacggccacgacgctcacagggctctatttggaagattagtccagagctaattttgacagctaatatttagtcataaattgttaggctaaacattagcctatggtggtatatttggatctatgggctaattcaaggctaaaaggtggggagagagtagaaagagaggagagagaaggagagaaaaagctgctttttgatagtccccacataaaattagccccatcagcaccccttggaggggctaatgttttgaggggggctaattcacattagcttaaaattagaccacatgtttagatccttgaggactaatttaagactaaaaggtgagagctaaacattggcccatgaaaccaaacaggacccaggctcacacccacacacaccaccaccctgccgcccaccataaatgagcgcccccgaagccccaagcccctgccttcgccgttcgccatcgcacacaccgtcccaccacgccgcatccgcatccgcatccgcgaccgcggcgcccaggtgcgcgggcgcctctcctgcgaaacgggcaaaaatcacgggctcacagcacggtaggagtactagggcagacgaccgttcacggcacggcacgggacagcgcgcgcgcgtcgtccacggaacatctcgggatacggtttttcttcgtaggagaagcccgtaggacagtaggacaacatgagtagcgtttctttttttgtcgtggtcaaaccatgtgtcgtcaattggcattggtccgagtgcgagccgatttcatcgatctccgatttttttttttagaactttcctctccgaatcttcgcaacagcaacgcgacaaacccgccccagcgacccccgcggcggccgtgacgattttaccatcagttgattgccgttatcacaggctaggctagcctctttgacactgctcgttccatcagttgagtagaaatgatttggttttgacaaatcactatctattacatatatacaggtaatttttagggcaatgcactggctccggtttttggcacagctacaaaggtgtgaggatgatggggaattcctaaaggctgcatgccgcaggttggagtcgatggttatgcaactatttgccaattatgggtggaggttcacaaatagacttcaataaatgtgttctccttattttggcttggttaccattgtttttgtttagtgtgttctttttatctgaactacacttttttttgaagtgctactttataataattggttgtagcttttttttagcaaaggctgggatgttatatttcattatctaaaaaaaatcgtttattcgaggcctcgtgacgtggccctttaagcaatgcactcttgagtaatgagtagtgctcattacatcttgacgacaatcgatatcatattttgctatggatgttccttctgagtgaatcaaaagcaaaagtcctactccagataatgaatcacacttgcaataatccactctaagaacatggtagtactgctatactaaaacgatggagtaattagtgaaaccctaacgataatggtatttttcatgataagttggtttggataacaatatttgttgtacaaatcaacttgcatctctttgttaacctcatcacattttagcggagagaaattagtgaaaccctaacgataatggtatttttaatggtaagttggtttgtacaacaatatttgttgaaattgcgttcgtcgatagtatttttagaataggacgtttgccaatgacatttgttgcattttttacatatctaaactgaaacggagagagtgatggatttctaccgtctattgaggccttgtttagttcccaactttttctttaaactttcaacttttccatcacatcaaggatgtgtttagttctacgctaaaattggaagtttgaagagaaaagttggaagtttatgtgtgtacaaaagtttcgatgtgatagaaaagttgaaagtttgaagaaaaagttaggaactaggcctaaaactttcgtactcacatcaacttccaacttttttctttaaacttccaattttggtgcggacactcggtatattatagcactgttctgatttgaatcttcatcatcacaccctcaataatttgttcattgcatggattcattctgtcggtcctttttctttttacgtggctgtctttctttcattctttttttttttgccggcaacgaaacaaagtaggagcagtcgagcactccactccaggcaaaggtgtaattgagttgctcctgcaatacaagcatccttcaaccttactcctgttttatcctgagcatgaaaaaaaaagaggagcaaattgaaacatgtatcctacagaatctgaatataaagattcccaaacccaaaatctttgaatatttcccgagctcccagcttaatctttgaatatttcctgagctcctagcttagggtgtgttttagttcacgctaaaaatgaaagcttgattgaaattagaacgatgtgatggaaaaattggacgtttaacgaaaatgttgcgaactaaaccaggccttagcacaaatcgaaacggcgtcctcacaccaacaccaccgcaccacagcactgttgctgcggccgatgccatgaaagcccctgccctcttctacgtttactgcgaagctatgaagctactccactcctgcagatcagggaggaggaaaggtagagcgagtagtaaatgcagcccgcttgccacgcactccatccacagttgcacgaggtggaagaagaaggggaggaggagcaaaagggtaggtgctgcaattaaggccatctattcaattcctgtggtggtggtggtggtgaccgccggagtggtgcggcagcaggcagggcccaggctcacacccacccacacaccaccaccccttctaaaaaacgtcgacgagaaccgggctcccaactgacggtcacgcgagagctgcacgaaacgagcctcgacgacgatcccatccgtccgtccgtcgctgcggctgctgctgctgccgccacaggcggtcagagcctctggcacgatgccaacacgcgggcacgtggtagggcagcacgggccattcaggtggtgtttggatccagggacttaactttattctctatatttagacactaatttaaaatattaaatatagattacttacaaaactaattacataaatgaaagctaatttgtgtgataacttttttaagcttaattaatccataattagagaatgtttaatgtagcatcacataagctaatcatggattaattaggctcaatagattcgtctcgcgaattagtccaagattatggatgagttttattaatagtctatgtttaatatttataattagtgttcaaatattcgatgtgattataaacagggtctcattgcccatgtttttggaagcttcaaaggacaggtgagtccatggatcctcgcgcaaatgggggcacccctgctggagggaaggcagagggatactgttccctattccacagggtcaacggctgccaaaactctaccaatcatgaaacaatgccaagcttcaagtgatggttcagtactagtagtactactgtacaacattagcatctcttgattattttctgtacatcttttgtgatttactttagtcactggtgaagtaaaatacagtacccctaattcaagtacaaacaccctgctgtggcttgggctgttggtattgacactcaccagtacagtggagtcaaatctaccacacatttgaaagcaaaaatgttagagcaacactactaagggtgtgttcggacccaagggttcccaacacctctccatcgttttccgcgtgcacgcttttcaaactgctaaacgatgtgttttttacaaaaagtttctatacaaaaattgcttaaaaaaatcatattgattcatttttgaaaaaaattagctaatttctaattaatcatgcgttaatagaccgctccgttttccgtgcgaagaagatttgttcccaacctcccccagcaaacacagccttgtttgggtgatagagagtaagaatgcacatcgttttccgcgcacacgcttcccaaactactaaacggtgtgttttttgtaaaaattttctatatgaaagttgcttaaaaaaatcatattaatctatttttaaaatttaaaatagttaatactcaattaatcacgagttaatggctcacctcgttttgcgtatcttcccaatctcctcaatcctcttatccttaaacacaccctaagaacatcatcattcattcagttgtatgactgtgtcacggtgtgagacgtcatatgcggcaccgaggcaatgcccacatggcaaaacaactcttccaagaaatggatcaaagaattgccgagaagcaacaaaatagccttgcaacctccctaaaacttcaagcaaactacaagcatttcacgatccataccactctttgctttctctgatttcttcccacctagcattacactatatgcatctcattaaaacaaaaaggaaaaaaaaacgcctagaaccgttcagaacagagttggcaagagacattaaaccagctcgtcctctagactatcctgaggactcctcaccagctcaagaatgttcaccacttcgcccatgtctggccggttcgatggaacccgcgaggtgcaaacaaggcccagcttgatgattggcaaggcctcttccatggggaattcaccacataacctgggatccatgcagtcctccagcctaccttcctccagtgcgcttctcaccaaatcacatagcacaactacatcatcttccaagtactcaaccggcctcctgcccgtcaagacctccagcacgagcactccaaagccatacacgtcgcacttctcggtaatcttcacagtcttgcaagcaaattctggtgccatgtaccccagtgcactctggatcttactgctcagcacataccggtccagcatcggcaacagcttggcaagaccatagtcacctaccctgggttcaccattgctgtccagcagaacattgctggacttgagattgtaatggatgatcccacgctggtgcagatgtgtcagacccctagcaactccaaggataatgtcaaacctttccatccaagagagcgagttgtcctccgtgcactcatggaggtgtttgtgcaaatttcctccgggcaggtaatcatagatgaggagctgcagcgacgaagtccagtagaagcctcttagtgcgacgacattgtggtgtcgcactttgctgagcaacttcacctgtctctcaaagtcatccttcgacttgaccaagctagaaacggtgagcttcttgatggccaccggttggccatctctcagcactgtcttgtagactgcaccaaaacctcctcgaccaagctcacaatccttattcaacaaggcatgcccaccagcgctgaactctgggctgccttttccaaacataacaagcttccctgagctagcatcattctctggggattggctaagatagtcatcagataatgcagtagcaggagctgaccgagaggtggtggcacgggcacgacggttgagaacagatatgatgatcaccccgataataatggtaccaccacctgcaatggcaatgagggtggaaacacttaatatgatcttcttgtggtgcatgctgctaggggcagtcggtgtggcctgcgacaatgggtttgtcgaggagttgggattgagcactatgggctttggcatgatagcaatgcaggagttgttcttccgcgagctgcagaggccctgattgtcagacaagaaggtttcagggatgttgtcgaagaaacgactatttgggaggtcccctgatagtaagttgtgggagacatcaaagatgcgcaagctgggcagattagatagctccactggtaaggtcccattcagcttgttctttgatagatcaaccacctcaagactggtcagattgcctacggtgctagggattgaccctgtgagattattgtgtgacaaatccctgcatttcaagagcaaaacattgtcttggttaaaaacttaaaatggttcataatgttaaatcgccgtaaccaaataatatgacggtttgatcgaattgatcagtttaatactatattgaagcaaatgctcaagatcctattcatgtacatttgacttcagttttgagtgtatcgaagaaaatgagggcccaggttacactgggatacgagcaaaaaacatgacacagacccatattttgcggtttgggggtccaaacagaaaataagacatcaggatctcttgtctcctatcactttctacaacgtctctgcacaacctacgaaactgaaagccaacaaagcatgcaggaaataatacaaaaaacaaatagaactagtcaacctcactaacaagcaaccgcaatgacgtcgaatttgatttaattcaataaaaaatacatgctaaaagaagtaggagtaaaaagaactcacaatgcaacaagggaactgcaattcccaatctgcgacgggatgtggccggtgaatgaattccgccccagccgcagctcccggagcgccactgcgccgccaatctccgggggcacgccgccgtcgagacggttggcgctcacatcgagcacctcgagcagcctcatcccgccaatgccggcgggcagctgcctcgcgaaggaattcgaggacatgttgagatactgcaaacccgcaaaagcggtgatctgcggcgggatcccgccggagaacccgttgctcgacaggtccagcgcgcgcagcgccagcgcggcatccgccggcaccttgacccacccgtacaacttgttcccagcgaccgagacgcgctgcagcggcaggccgaacacccaccaggggagctcgccggcgagcgcgttccggctgaggtccgcctccaccatcttcttgcatttcgcgatggcgtcagggatggcgcccgagaagcggttcccggacaagtccagccgctccagcgcccacatctccccgatccacgacggcacctccccggcgagcgcattgccgccgacgccgaggaaccgcagcgcggacagccgacgcagcgactccggcaacccgccggtgaagagattgtgcccgacatccagcgacttgaggagcgccgcctccccgacgtccgccggtatctccccggcgagaaggttccggctcaagtccaccgcccgcaacgagctgctcccggggaagcctccggggacactcccggagagctcgttgcccgagaggtcaagcgaccggagcgaaggcaacgaccagaggccatcagggatggggccagcgaggcggttggaggagaggttgagggacacgagcgacgcgcacgacgtgacggcgggcgggatgtagccggagagctcgttgcgcgcgagggagagcgcgcggatggagcggcattgcgcgaagagctcggcggggacgggggcggcgaggcggttggaggagaggtcgagggagcggaggcgggggagcgcggcgaggaggcccgggagcaccgggccggagaggttgttccgcggcagggagagggaggcgagcgcgtcgaggcggagcagcgcgcgcgggaggcggccggagagcgaccgcccccgggagggacagcgacgtcacccgccccgcccgcgcgtcgcacccgaccccgggccaggagcaagggcggtcgtcgtcctccgtccacgcggcgagcctgcccatcgggtcggcgacccccgtcttgaagaccaccagcgcgagcacgtcgtcggtgagcgcggtggcggccgtcgccgcggccgccacggcgagcagcgccgcgaggagccgcgcgagcggcgaggcggcggccatctcgcgcgcggaggaggaggaagcgggagaacgcaatggggaggagggatcacagcggcgccttgtccatttgcggcggcaaggcaagtttttggagaggaggtggaggtggtggagtggtggcgcagtgagggaagcacagaggagaggagatggggggccttgtgctgctattaatgtgctacgagtagaacaaataggaatcgacaaaatgatttctcttggctttctggatttctatggttttatcttgcagagaaaaaatggtggtacagctttaatcttggcttagctcatgttgtcgactcctttttttgggtattcataggtggaaactatataattaatcttacatatgattgatattaagtgaattttaattgcttgttcgaagataaattatcttccacagcttcatttgttgaaatggaattaaataggttaccattatggacttgcaacattttcctccaaacatcgtttgataagcatggagtcccacaatttatatcgcctccgatatcactgtcaccgttacgtattcctatagcattatgcggtggcggggctgcaggacgacttcaggctctgttgttgattactccacaatgaattactacctttgacgttcacagaaactagttaatcgtccaaaaatgctatttgtttccttaaactaaacgacatcattggcttcgctattgaagatatgatatgatatagtaagtatatatcttcctctttaattagggcctatttagtttcgaggaattttgcaggaattttaaaggagttgagcttactagtagaagtattttgatgagtaggagtagagcacaattttttagaagtttcgttctagtgtaacaaaacggagtttgttttatacccccaattttccaaaccctctggaaattcaccacaaaggaaaagagggtcagaggttttaaaagctcctggttcctggcctacggctgtctgcagtgtctgaaggttgcttgtattcaatgcgtcgcaacaaccttcatttacagcggccactccgaatggcagcatttatgggggaacttattgcgatccggagcaaccagggcaagagtagcgccgcagcacagcaactgggacaccctcacggtccggttggtgagcattgttcagtgcaacttatttgaaaatttaaaatttaccgccttgcttgctcaggagtcaggaggcaccgaggacaatgctggtaaagtagaatcctatacagtttttgctagtagagcacgtacaataatagaactataaacaactaaatacgtgtgtgtttagttcacattaaaattagaagtttggttgaaattgaaacgatgtgatggaaaagttggaaatttgtgtgtgtatgaaaattttgatgtgatggaaaagttggaagtttgaagaaaaaatttggatctaaactcggcctacatatcaagaaaaaaaatgagagaaaatagcagtgtgctacagatttgtagccagcgcccagctgtaacacggaactctaatacacaatttgtgtatgacaggtggaaccatatattaatagtgtagtatatgtttataggtaactattatatgaattagctattaaattgattatatatgattttgagctagtagttgactatactattaaacttgttcgtagtactacaaagtaaaatgtgcagtgtattgttctaaaataaaatcatttcttcatatatcacctcttcttaagcaattataattatttttaattaatttttcacatactttctcttttcaaccaatcataatctttctctaatcatttacacatattttcttaatactcgtggctatcttaagaataattatatggtgcgacggaggaagtagcaatcactggggttaaaaaaaactccaaacttatatgggttggatcaactctgacttaaggctgtgttcaacactagtggttgggaacggttccctcggcacgaaaaacagagcagttcattaacgtgtgattaataagtattagctattttttttcaaaaatgaaacaatatgatttttttaaacaacttttgtatataaactttttgcaaaaacacacaccgtttagcagtttcaaaagcgtacgcgcggaaaacgagaaggaggggttgggaacccagacaaaggaactgagccttatagtcataatgagtcaaaccgagcttataagtttttagctctctagcactctactctactctgttttgaattagtttgttgttctaagtttatcctaagttaaacataactatttttttactatagattttatttacaatatgtgaggtttgacaacaatgttaattatatgttagtaggaaagtatgtttcatgatggattgaaaatataaaacctataatgataaactatatgaatttataagaattaatgatcacagattaaaatgttccgacttaaaacaaacttagaataagacttctttctcatctatagtactccctccatttcataatgtaagattttctagcattgctcatataatatataatgtttagataatgtttagattcattagcatctatatgaatgtaagcaatgctagaaagtcttacaatgtgaaacggaggaagtagtgactagtctctttatatttgatgaactctttattagttagcgtttgttattatattaatatgtgatagaatgttttgatattataaaggtgatataaataagatgaagctcgttaaatagaatatatcttaagagcaagtttaatagtatagccaactactagctccaaatcatacatagtcaatctaatagctaatttatataataatcaactacaaatatacagtacatcattaatatttggtcatacctatcatacacacagcgtcttacctatcatacacatatcatcttaaagtccgtgctgcagctggctacaaactattgtccgcttctcttttctctactcactattcacatgtgcttatagctgatttatagtttgttattgtacatgttctaacgagccatttcaagagtcaagccgagcctgacttttataactcattaaggttaattaccaaggtttggctcgttatctacctcattaagcactaaagtttttcttctcttttttacggaaaaatgtagagccagctctactattttgtatattcagtacaagattacattgtgaacaataagagggaagttaaagataaaaggacagatagagttaggcgagagaatgtacaaaacctaaagatccaatcaaattgactttttttaatcgcggtttaaaaatacgcaagtgagatcagaccaccccagattccttgtcagctcattcacgtcactgtcattgtgaattcccagtagtaacattttctaaatgcagtgttgcttaagccaatgacacttaattaacagacagccagtgtatagtaagcatgtgccaatgttattttactgccgtggatcccagacacagcgacgagggtgctgcgctataacagtttaagcggaaaagtgagatttaataagtgaggcaggagagcaaacctcaatgcttgtggtgggggaagaaatgaatcatgcaggcttttgctgtcttgctgatggtgtcccccacaggctgctagtgttactgctgtctttcataatgcaatctcaattagtctttctgcacaagttaccttctgagatccacgtccacatgcagatgcctgtagctttgctccaaacaatcatattttgcattagtataatctgcacccttgcataaacaatgaatgttattcttaatgccacccagcagattttctaccaattgactttacagatcactcactgtagctgctttctgtgaggatatgagatgttgtatacaaatatgtttgggcagtttgttgattgaactgatagcgtctgctcgaatgtggtagacccagtcaacaaatgtttcaggaaatgtgtttctaaagggaacagttatcatcttttgctttcttttcacaaagaattcaaccacagctatgcaaagctctgaaaaggttgcgctttgctacaaaataaaggtattgtgttgcggaattcagctagtatatgtttctatacagtataagagagagtaagcagaagagagcagaagcaatagaaacaaaaagtatatggataattgcatatatctgaaggcagttctgcaaagaaaaggaatcaggatgaattaaataaaaaaagatctgatgttcctcagaaaatatttaattatgattttgcttccagttccagggcaaatatcaacatatgactgcattcctaccactagaactaagtgttgaattccctttctggtcacatggtttacctgccccaaagttcctccacatgacacacaaaagtagaacacaatgatttctggtagcttagatagaaaaattatccattcctgccaatgttaccatgattagataaggaataaaagcaaatcacagtataagtccacctggcaatgcgttttgtcatcgtgacagtcacaggttggaccattggcatcttcttccttcagcaaagcaagaattttaaccaagcctctgccaagaggtctcgtacttgtcctgcagaaaacatgtaacagaaacgtctgaaatgtttgatactccctccgtttcacaatgtaagactttctagcgttgcccacattcatatagatgttaatgaatctaggtatatatatgtgtctagattcattagcatctatatgaatatgggaaatgctagaaagtcttacaatatgaaacggagggagtacatcctatcacctttccaagtcacactgtgaagaactaatgtagggactagggagtatttttcgctgtcgtgaatcaacaccaagcaggccaatgcaggaactacaagccaggcaaccatatgagcatgtagagcattgataaccgtacaactcacttttctttaactggagaagaacatgctaacaacaagaagactacccactatatgcaatacaaaggggatcatatgcccgtaatcaaatcatctctcaaattctctgcatgctcaagttgtccataaatgacacaacaacagtaccactgacgatgcgaaaatgcccatgggaaatataacaacagagatgcattatgcat

SEQ ID NO: 65326 - DNA, 1861 bp, Oryza sativa
aagttgagaatttaaattttagctgataagtataagcataagcataagggaaaagatgaggccccaaagtttagatgatggcggcgttatttggattgggattattcggcctcatcttttcgtttatgcttttacttatcaaacaaattttgaattttcaactcttaatttggagttggttttggggttttttcattgaggtttatttttcagactttgcttttagatcattaagaacatgaacatgtataaaaagttttattcacaaattattttttatttgtaaatataccgtttggcttattcacacatatgtgaaacgatggggccgtatttctttgtgtttggggaaatttctttgggtaacacttgttaggcccggacttcataatttggtccgaaaggatgcattactttacatgggctttctcatggactagtaatgtagcccaatgtcatcgtcatggtcttggtagagtcccatctattaattgttttgtttagttgggatacatgagaatttttgtgggatagggatagagaattgagggaggaactccctccttttcaatacctgggtagtggtggtaattgggacggaattcctcctttactttgcctaaacaaatctcagccattcattttcattaatgaactaatctccaactaaactctctatcaatttccactacctctaccaaacaagatactgggattaaaaatcaaattctcattttaatctcaccatcaattccctcgtgtaaactcccaatcctattttaatctcaccatcaattctaaactcccaatcctcttccctgcgttgccaaacaagcagtgtgcgaaatagcgtgtgaacttcaatttatactgcaagattgatttatacaacatatactatgaaagttcaacaaaagagacaggtccagacctgaacaatgttttgagtgcaataaacgaaactcataaagctcgtcgacgcggcgatgcttgcctcactatccacgtcaaactcccacaactcgcaacttttcgaacggcaacaatggcgttatagcaccactgcctaacactactgatcaatgtcaatggagccggcgcgacagctagacggcggcggcattgccatggagatagtcgaggaagaagacgccggcgccacaggctggggcggctcagcctcagcctcgacctgaacggtggcggcggcggcgcgttccgccccagcacgctgctcgacgagtacgagcggctggccatcgaggcccagctcgaccgggccgtcctgcgccggagctactccgagccgagcccgtcccgtctcgccgtcgtcgcgccgcaggacaagcaggaagccccgccgggcgctgccggccgacgtgccaaggaggaggagaaaccgggagcgggacgtgcgccggcgcggaggtcctggctgctggaggcgttgaagcggctgctctgctggctcggcatcggcggcgcgtggggcggagggcgccgccggggcgaggagccggccgcgccgtgcccgccggcgccgccgccgaggatgcagcttctcgactacctgactactacctccactacctgacgccatgtaactagccgtgtgatttgtgagtcaacagcagacatgttaaattgccgtgacgaccgaaattttaatttttgatcgatcaacgacgcaacgtgacaatccgcgtcgcatagttgcttgtgaccagtgtttagtttctgtagctttcttcatgatcggaagcaaattctgtaacttaacatttgtaactttatcatagagaagttagaaaatcttaatcatccgtattacctgatctgatcttcctgatcgataatatcc

SEQ ID NO: 65327 - DNA, 2086 bp, Oryza sativa
ccatccgatcttccaaagagtagtttatctaagctgccatgatggagtcgctcatagaccaacatcctttcattagattcttctcttgcgtgaaagccgattagtttacataagttgggatgctgaagtgatgccaaggtattcacttgtgttttaaactctttcaaactctgcatattaataaaatgtgtgttgcatcagtaccataaccagttaaattgtaaataatagatcaggatggtccaataaacggtgctgcaacattaggtaacaccaaagggggtatcagatttagacacacacacacaatacaaagtctagtgaaccactgaattcccagaactacacaataacactacagtgattttttagattccttcaatactgaatacaagtgagggaagatcagaaccatgccaataaaccacataaagtggaaagcatgagatatcatatatcaaagtatcaaacaaacgtcaaaagaaaatctcgctagtcactggatatgattaggaaggagtggagaaagcatctaggagtaaagtgaagaaagaagatcaaacacatggtctgccttcaaagtccagagcatgttacctaaccccaccaatggtgtggtcctggtttgcattcacaaaaatagaaagagttatttctgctggagacagcatagctgtaacattaagagcatagatcacatgcctacaaaaccagtccgtgcctctagcctaaggtcagcttcttaatagaagaaatgctgcaaaatggttaaagccctaaaagagtataatccttacagtgtacaagcattttgccaagtcactactcactagcaagagagaaataaaagtaagccataacatgccaaccatctgtttgacaagctgaccaacaaagcaaaatggcaaagctaccgctttacatccaatacaacttccttccaggggaaaacaaagaagatgaaacacataattcaatattacggagaacagtacctgagtggaggagagcaaccgagatactattgcttcaatggtctttgggtcggtaaaatcatccctaaaggacgccttgtatgatgttgatgtcaaactttcggaaacacactggtcaccagaaaaccattggcaagctgatgaaagttcctcataggagaaattcttaagcccatcacacttctttggaggaagtggcagagggcctgaagcatcgagtggtccacttgcattgatggctttgaagctgccaaagttcctcaatgattttccttctggtgatgggagaggaaggggcagtggattagagaaacggtggccctttatagaacctcccttgcccctggagtcatcttgatcatcgaattcggcatatggaagaccatcctgatcaaccacaattaggctggaaggagcagacagcacgcgcgctctgctgtaagaagctttcttttccgattggtggattttagccttgttcctaaaactaggaggagcagattgtaacgatggcacatgcgcttctggctctgggagtcttgaggacgtgctttcccttgcatcaaccgatttcttggtgagagcaagaggcttcttcttcttggatctcaggacagtgaagcaacccatcatgtgtacaatgagggaaagctgctacagaatttcaaataggatcctgagttagcacatagcacaaaagtagctgccccatcacaatatagcagttagtcgtcggcaacaataaaaagttgtcatgtattgcatctgctaaagctaaatgcagtacaacagaaggtgcaaaaggcgtcgaaccttgcatcagcaaaaaaaaaaaaaaaaaaaaaaataactatgatatctctccttaagtacaacacctctcaatgtattctgaacttccaaaccattactggagaagaagagacagctaaactactaaaactgcctcattcccacaatcagttcactgatctatcaagagacaagctgagacgaaggcttataggagccaggtggtgtgatgcattggtccgcagacgcaacaatggacgttcaaacacaccactccatttagtttggtttccaatgca

SEQ ID NO: 65328 - DNA, 9790 bp, Oryza sativa
ataatccaaatgagaaagatccaggcagcaacggaaaaaaaaacatcagtaaccacccatgaaataaccccaaaaaatccacctataaccaagcaaaccgcacacaacaacagcagcagaggggaagcaaagagaccgcacctgtggccgctggaacgccgctccgggagcgcaaccgcgggggaagcgaagaatgggaggggggctccccagcggtgagggtcaggccgcggctggcatctaggggaggaggccgaggagcaggaggagaggggggataggaggaggaggagaggaaagcggatataacagcagcgaggagaggcgaagaggggagaaaagtaaaataaacggaggaggaggattagctatggtggtggcgaggcgacagagaggagagggcgcggcactggtcaaagccggtggaggggctccgaggcaggcggcatttttatattccgccccccgctaaccccgcttttacccaactaatccatgtaattagcagtaattaactacttttaggagcaggtacaatagcaggctagtataagctagctttcgagccaatatattaattatatagtatatgtttataggtaacttattatatgaattggctctaaaattaactatagttaatttgaagtcgacagttggctatactaataaacttgctctaacgatgcgtttgcaaaggtagggtaatgggagggtggggcaggatgcacatgagagtgtgttggtaatggtaccacccatcacagggtgattttctaaagcggtgaaaatcaaatggtgttttttttttttttgccttcacaagccgacaaaggtggtttgctcatgaacattcagctgcagtgctccagtattttcagaaacaggtttcaggttttcctttttcttctgaatagtgcgtgtgtcaagatgacgcaactgtgtgttgataggggtaacacattgcttgtacggttaattatagccactggttatggtttttcttttaaaaatgtttattgtgtaaccctttctcgcccacaaaattattctgttcaaagttaagcacgaagagttttgtggaagcgtccattgggaagaaatcaactttaaccatgtagcctgggttctacagctttgatcatcactataagcaaaagtgtaattgggaaactggaaggcaattcgagtgattatggtctgatgctcatattgatttgatgcatgcgtggtcgaggttgttcaccaatacaacttgacaggaaaagaaggatgacgaactgcgtgtgcaaaattctaacatgataaaagggcatatcgttctccagttgtttttctctctcgctaccattcttgttttgcttttcagagggagaaagatcgaataaaatgcgaccgcgatggcttcgaatgtttgacaagttgccactgcttgcttattcgctatcctgccgtctgaagatcccggacgaaacgaaaacatcaatgaaggatcatagtttatttgccttgccgtctgcggttcagtgtttttaattcttgttctaatcgaagaagagagtaagaaagtttgaagtattgacgatggaacgcaagagattaattcgccatctgcgaaaaggatgtggcatctcttgttttgaagtcactgtgttggctttttgctcattgttgaattgaacaagaaattttccttggagcacacagctctttcatctagaaatagctccagaatgacctggccattgccatactaaaatatagggaaaatactggtgctacatggcaagaacatgaaagagtttattcaaagatcggtgattcctatgttcaatgttctgagtctttgaatcatcgatgcgagatcgccagtccgacatttgacgctgcagtttgattaagagtgagcttcagggacaattattgagcttgacaagctgtctagtggttagttctgcactagtagtacatactgcattgctaaattatgacaactaaccgtagaggtagactgcttagatgaaaagaacaactgagactgaaagagattcagacgactagcagatgacaattctgcagcttgcccttatggattggcttcctgggagtccaaacataggctgtgtttagattcaaagtttggatccaaacttcagtccttttctatcacatcaacatgtcatacacacacaacttttcagtcacatcatcttaaattttaatcaaaatccaaactttgcgctgaactaaacacagccatagagaagttaacctaaatacattgcaactgaactatattaaagagttagcagaagcaaatccagagttaaatttggttagtacaagtcatgttgaatagtggaagatttcccgtagaaacttatgcagcacgccagcacgagttcttcacttcttctccctgagctcatggagaagaaatttcagaacaaagtccctgaggaacaagtacaaacacgaccagagaaaataaaagtatttttagagggtgtgggatgcaaaaatgtgcaagatttgttagaactagaaggctctcttgatcttaaaattagtcaaagagaatggccaagcaagggagaatatccacaaattccaagcgcaagcaagcaagcgtggtcatagatatggcattgtggtggcagtggggcccaccgccgacgctgacagcccggtcaaagacgagaaaaaaaaatccgcgagagagagggggtgcgtgtgtgtgtgtccagttttccaaggtgggccgggccgtaaggtgggtggagtcaaacgggaaagggacgaagcgggggatcggactggtcagcatctcggccgtccgttggtgcatcggacggcccggatcggtccagcgcctcacatcgccgggccgggcccgccggtcggtcgggagtaataagctccgggggaggaccacgcacgcgagcattgatggagctgcccgagggagggaggggccatgattgggcaatcatcgtccgtcgcctcacgggaagagtgcacgaatctcgaggcggttgaacagtgagccaggacggctgtacagtggctgctctaggatgtggttggggtaggctccctgtttggtgcgtaatcctactggagggtttggatggttcatgccggtagatcgattttggagggagctcatcttggcaaaaagaagaaattgagtttcttctttgaaattaaaatacttcgtaaaagtttattctttcacatggaaagaattcatattgtctccaatttcgtcacagtaaacttgctatactagtaaaggccctttttaattgtatgaaaaaatccgaaggaataaaaaaacacatgattatgccaggaaaatgcagatataaaacaatggactacaaacacaaaaaagctcatttaattcgaccacggaaaaaaaacataggaaacggatgagagatatattcttgctaagttttctccaaaatttttatatgattatctattccataggaactttaaagaataaaataagatttaatcttttgtttcaaatgttttcataggattttttccctataggattgaaatcctcccaaactccaatgtttcccctacaaatcaaagggatcctaacattgttttgttgttggttttaacttatatggctaggtagaataaaaattttatgccaagggatgaaagatatggaacggcatttcaaggtctctaaatggatttttcatctaaaaaaattacttaatcctcgcaaaaaagcacaaaactttttgaatggtaatgtcctctgtttctgttagtgattctacaaaatatcaccaaggctaagttcttttcgccaacttgaaatggtattttcttgtttttcattagcaatgctccctgaacttttaatattatattttgtggaaataaatcatatagaagttgtttagaaaaaaccaaaaacaaatttattttctaaatttataagtcacgaactgtttcacctgaaatgctcaaacaaatgcagcctaagaatttgtttggttaaagggttgggatggattagattgggttgaacccatttttcagtgttttgtttaggcacatgtgggatatgatggtccccgacaaggaatatatcccctaggatacgggttagtggcccttaaaaaactagcggaccaatcgaacctacttttttctctcactaacttgtggacattccttcaaaagtagatcatcccatcccttatgccaaatagatagataggatcattccatcctaaaaatagggatgagtccaacccatctcactttgtttctaaactaaatacatgctaagttcgtcgtatgagcccctactacaaaatctatgtaacaagaaatttgtttcgcattttttaagacaaaagccagtagggctagtacacactgcatgtcctctttcatgctcaagcaaaacggtactacgtcaatttcatgccagattagtttaaggtcaaaaaaacaattccttcccctcctcttttctccattgcatgttacacacagttcacacactcatcactacacacggatctgtcgttttaggcgtggctcaggaccatatctttgttttgcagtgcgcatatgcaattagttagcactctctctggagtgtggatggaggcgcccccaccgtttaattttggcctgaacgctggaatcttgggcttagggatggcaattttatccatgagttcgggtatctgtggatacccgacccgatggacatggacgtgggtgtgactttttacccatgggcacgtccgcccgagacccgaagacgtcatgggcaactggcgggtttcattttttacccgtaggtaacacatgcccgacccgatacatatgtattagctaattttgactcatttcttaattcttataccatttcttttggttcatttgtgatgctaactgatactaagttgtgatgtaattcaaattattgtcaataaccgataatttggtaaattattgattttatttctctttgttaaattacatatctttcaagttattattcatgcgagatctattgggtacccgtcgggcatgggtacaagcacggaattttgcccgctaactctagtgggtagggttcgggtgggcaatgttaggcattggatcgggcatggttttgctctacccgtacccgacctgacccattgccatccctacttgggcttggttcacgagctacctggctatcaagcgtcgtcgcgctcctgcccgtgcggtgcttggtttcacacgctctcctacttcccctcccccacctgctgccccgcgacaagctagctagacgctttgccgtcttcggttttcgcatgggatttcgctggaaggatggagcagaagcggcggcgcgagagcagtacaatagcactataagtcagctataaccacatatcaagaaaaaaattaagggagagaattatcccacctccttatttctcatcttgatttacttttatcttacatttttattactattaaatttatgattgtgtgtcttatgagagaagccggagatataacccattttcattttctaaaagaagagagaagaaagcgggctacaaatttatagtcagctgcaacacggactccaaaacgttatgtgtgtatgacaagtgagaccgggtattaatggtgtagtatatttttatagttacctattttataagtggactatttgatttgttatagatgatttagagacagtagttagctattaaacttgctctgaggtcgcgaggcgagcctgcgggcagcaggagccgggagggaggagggggaatgcgtcgtcatcgtcgttgacggttacagtgataacagtatcttttgccagcggtttctccggatcgctttcgccgtcgctgtctgccggcataattctagaactttcttaactataatataaaatttggtctccaattggtatcaatacaaatccattcatctaaaatgctaccctaccaaaatattgatagtgccaaaacatacctaagttttcgcactaccaatactttaatactttagtagggcactaaaccaaagaagcccggaaacggattcgccgccggtggctgctgcgttgcgtgacgaccggtcggtgagcaggggcggccgggcggtcgggacgagacgagagagttcttctccggcgcgctcagtggagctatcagctcgccaccatcgatccatatcgctctcgggcttacgcgagtgccctggccgcgacgccatatacatcgtttcacgtttttgcagtatgatcaagcgagagcgtgtgcttcacatgtttcgtggaattcgtggtcagacgacggtggttgatggtctatgcccaatttcaaaagatcgatgttacggcgtgatgacgctaatacgtcgaaacccgagtaggatgagccgtaatgtcgtactgtatagtattatttttgagattcgaagggtgccgctcgtacatagtagtagctcgtttttagagtattttgagaaatattactattcgaacaaagctaaatcaagatggacttttcagaatcttataccaaggcccgggattagcagcacgttgttctcgtaatcaggcatagatgtcgatgctgatagactgacagcacctgcacatgactaccttcttgtcagtattgcccgttgaatcacagaaaagataatgcgcgcgcgtttcggcccagagggcccagccccggcgcgcgcgtcctctgactttttttttccttttttttccaattttttcgtttttgttcacacttttttctgtttatttttttaatcttttatcatattttgagtttgaaagtttttaaattcttgatttaaaaacttttaagttcagatttgaaaatttttatttttttcaaatcttgatttaaaagttttcgaatctcgatttgaaagttttcgaatcttgagttgaaagttttcaaatctcatattgaaagttttcaaaattttcaaatatggacttgaaagtttttgaatctcgattcttgagttgaaaatttcgattctgagttgaaagttttcaaatcttaagttgaaagttttcaaatctgggttgaaagttttcaaatctgagttgaaagtttttaaattttaaaacttaaatcgaaagttttcaaatctaacttaattttttttattctgtaagtaaaaaaatctcccaaaaaaatagacagaatcttttctaattactaccattagtgttaagtatattaactaatataagtagttaagactaaagagaaggggaagtgctcgccaactgctttcctggcgcgcacgcgcgtgctagccacccccctattcggaaaagctaatgcgcgcgcgcgtcctcttaccttttttttttcttttttttccgattttttcgttttttttcacacttttttctgattatttttttaatcttttagcatattttgagtttgaaagtttttaaattttgagttgaaaattttcaaatttgaacttgacgatttaaaaacttttaagttcagatttaaaattttttattttttttcaaatcttgatttgaaagttttcgaatctcgatttgaaagttttcgaatcttgatttgaaagttttcgaatctcaaattgaaagttttcaaatttttcaaatctggacttgaaagttttcgaatctcgattctcgagttgaaagtttcgattctaagttgaaagttttcaaatctcgggttgaaagttttcaaatctgagttgaaagtttttaaatctgggttgaaagttttcaaatctgagttgaaagttttttaaatttgactttaaaatttaaaacttaaatcgaaagttttcaaatctaacttaaattttttttaatctattagtaaaaaaatctcccaaaaaaatcgtcagaatcttgtctaattactatcattaatgttaagtatattaactaatatagatagttaaaactaaagagaagggggagtgctcgctaactgatttcatggctcgccacccccgttgaatcattccttctacgggggagtagtatttactactacctctgtggcttatgccttggaaaattcccgtaaggtaactttgattgccacgatcgttttcgtccgtgctccagacctccagtaacattccaatagggtcactttctctcgttctatcatacagtacacgtcttgttgctctcatttatgtttctacttggtataggagaaccactaccacaagttcattttttttcttacatccattttgcattctattgtgtctgattgtttcgcggtcgtggccttgtatcaaccaaggaatcgaaaagagagaatttcttatatactattgaaaattagtctgattccttatatgccactcaaaattgacttttttcttatatgccattgtttcaaatttgtgcaccctctcatgacactcacatctgttgaccgtgtgttgaccgttaactctcaaataaaaaagacgtatttatcattctgattatataacgatcaacacacgggagtgacatgagagagtgcacaaatttagaacaatggaatataggaaaaaaacaattttcaatggcacacaaaaattagaccaattttctgtgacgattctctccgaaggaaaaggcctgacgactgtttgcatctgcagaaaacaaccccaaattcccaactccccatgctgagacgtcccctagcctgtagcctgtactccctccgttccaaaaataagtgtagttttagcactattcatgtccaacgtttaaccgtttgtcttatttaaaaaaagattatgattaatatttttattgttattagatgataaaacttgaatagtactttatgtgtgactaattttttaaatattttttataaattttttaaataagacggatggtcaaaaagctgtgcacgtatatttatggctgcacttattctctgacagaaaacaaaacaaaacgctgctgcttgtttttttgtcagagaatacgacgacgacaaaaaccggagatcagaatttcaacagtagtacgcaactgtggtagtttgacgtgcttgcaggccagtgagctgccaccacgttttcatgaaaggtttcacatatgtaaattagcagtaatagatactgaaccagaacagaagaccacagccacaaacaaaatagtggtagtactttgatgataagatgtaagataaacacgcacagatcgaccaaacttgtccaaggttcaaaccctggtcctttgggttcagcaggcagcaaaacctaactgtcaaaaagaaaatcagacgaaaactttgaactggaactcggattaggtgatcgcctcactactcggacactctgcattacaggtgttcaaatggctggcctactcgtgtaatcattaactaatagtactaataatctagtaatttacagcaagttttccacgattccatctgtccgtggcgaggcaattaccagatggttcacaccgattgtgcggtgtgaaactgagactgcaattaggcaatgtaatgctattgtggtatcttttgtttctggttttctggatcaggagagacttgtgaaaagttcagattagtcacctggaagaagttggaatgctccgagtcgatctgcgattctgcataatagaccaggacagcaggactgatccagaaggatataatcatataacaagcagcctagtacatttgaagctacgggcgggtagtattctcttcccttgcac

SEQ ID NO: 65329 - DNA, 3294 bp, Oryza sativa
cctgtcagttacactaaaggtaaataaaaaattatggggcccacgtgtcaaccctttgccgctccactgcgccccgaggactctccacctgcatcgcgcggcgacgcgggagctggagggcggcatcggcggagaagacgttggagctggagggcgtcggcagtgggaggaggacgtcggcggagcagaagcaggtcggggcgtcggcgtccgagtccatcttcagcgccgggcgtcggccttgagagttgagcaggagagcttccaggggcagccgaggaggcagaggacggcagggaacccaatgaggttgaggaggtggcagagcagtcgacgatgtcgggagcggaacaaatatattcaacttttaatacatccagacagatgcagcaacaaaaaagaaaatcccactttctgaatcaaatcaaatcaaaaacatttcctcaatgaacagctgcaaatcgagcatccagatttttctcccgcggaaagaaaaaaaaatcatctccagctgcacaaggatgaacgagcaaagtccctcaaaaagtgacccagatcaagacgggcggtgaaatgataggataggtcgggcggtgcctcacctgcttaagcgatgaggggaacatggtccgctcgcactcaagcggcggctgcacgatggagaccgcggcgtcccgccaccggctgcaggcgcaggcgtagaccaccacgtccagccgcggcggccaccaccgccgatgacgtcgcagtagacaggcagcgacacgagtgttggatagtatagggagaggaatattgcgtaacgtggatcacttgtattgagcctcaggggccggtatatataggagtacttgggaggagataaggaaggattacagatatggaaggagtccacacaaatcaatcctatcctaatatgactctaactaccatatactctaacatccctccgcagtccaagcgtgagcagcgcggacacttggactgaagaagaaaccaacaagagtactcaatacggatgataaccctttgtgccgtagtcgatgtagccaaagcgaagggtgcgagggagctgtggtcgatgaagctgtgcgtagagtagctgtggtcgatgtagtcgaagtcaggaagctgatgtcgaggtagccgagccgcagggagcgcatgaggcgccgtagagtggtcgtggacgcacgggaggggcgtcgtggaccaaggtgcacgaggatgcactggagacgaagatggtgacacaatcgcggcagtcgtgaggaagatgacgccgaagagccgatgtagtcgaaccgtgaaggacgagacgtcacatagggtttgccagaccccgggacaactcgggacgaatccgcgcgccggtgttgccaataccgcgcgggcgacaggggaccaccatgaatcatatgccaatgttgcaggagactagcagagaaggcctccaagacggtcgcgacgcgagaacagcgtagagggagaattgccggagcagcgcgcagttgccggagaagagcgaaatgtagtcgagggagatacggcgacactggcgatgaatcatgctggacgaagacgaaggcctagtagtgagaccaacggcctggatggcgatgttggtagccatgtagaggtagctgcaccaccggcctaaagtggcgacagtggcagcttggagatgcggtggcaatgctcgaaggcgaggaagaagaccctgagcggctgacgatgaccagtgcggacgacgaggttgttgatgtgcgaacggcgatgaagacgacgaaagcggcgaagctgcggtccgagaggacagcacagctgcagctccatgtcgatgcagcggcaagaagtccaccggtgatgtagaaatgctgaggagggtgcctcttagcactgcaacaaccagtggaggtgtggaccacaggcagcggcacttcggcccgaggggagcgaacgcagcggcaccccaaagcttgatggtgtagacgcatgctcgatgatgatcggttgcataagtcgttgtagccgggcgcttgaacgggtgatcaagctgaatatgcgcgaggcggaacgatgaagttgaagcagagtcaacaccgatgtcggagacacgtggatgttgacgaggcggtgggcgacgcaaacccgttttttgaaaaggggaaaaaaacaaggatacatgtagcagcagaacagcatcagtagcaagctcacacgtgcagctcatcctctcacacatggtccataggccaagtccacaccaccttgtgcaccacagcagggaccaaagtcatcaagtagcaatcctttgaccggtccatccaatgcctttccctgtccccaatcctatccatccacacacgcgtagacagatagaaaagtgagacatgaagcaacagattgatggcgaggcagacagaaaaggtcgacgatgactcagccggcgaggagacggcgagagccgcgaccctccaggaggggacggggtggcgccgggtggaggggacctagtggccggcgagcgccggcgccggcactggcggcctcagatcctagtggtcccgagcggcggacgtccggtgagccggtggaggatggtctcagcaggacatgcgaggtggtaggcgaggaccggcggcggagaagcagcgccgggagctcgtccccccagtcgacggtggtgctggagacagaggagtcgggggttgcagggggagaccggtgccggaggtggagcagccgagctgcgtcgtccgtctgtccatcggggctcgatcgttggccagtggaggcgacgacgacggcagggcccgtcggtgaggccggcggagcagaacggacgctaaagatgaagccgacgacgggcggcctgacggcgatacaagagtgccgcgcacggaggtcggcagaggagatgcaatctgttgctgctgcttgacgacgactagactcgacgaagaacaatcgtgaagatcgatctctccaagacgacgacgacgacagcgacaaggaagaaaaaagaaaaaaacgggtggccgcccccgggagcggcgtcggcggaagcgtgagagcggcgctagatcgcccgctctgataccatgttggatagtatagggaaagaggatactgcgaatattggacacattgtattgagcctcagggggccggtatatataggagtacatgggaggagataaggaaggattacatatatggaaggagtccacacaaatcaatcctatcctaatatgactctaactaccatatactctaacaacgaggatgacg

SEQ ID NO: 65330 - DNA, 3056 bp, Oryza sativa
cctagtgccgctccctctccgtcgcgcctgagagaggagaggggagagagacgaagacatgggagatgtgaagaaaggaggaaaaagaggtgagaatgacatgtgggggcccacgtgggccccatcattatttatttatttgtgtgttaaactgacatgtggatcccatggggtttattatttttctggatcgaattgccacgtaagcgccactcaatgccatgtcagatgtagactgagtcgaattagctatgtaggcgccacgtcagccaaaaccgccatccaaaccgctgagggaccttatttgcactggttttaatagttgagggacgtgttgtatctggttttctggttgaaggacgaaaatcgaattcgttgacaagttaagggaccacaagtgtacttattcctcgccaaaaccagcgccggttattaaaatgtagctcgaatcttgtggctcggccagcttttgtgttgtggttttcttactgcgatacgtttccatgggccatcaagtttgtgctggactgctggatccaagttacgtaaggcctcgctgttaagctcatcataagtagagaaatcgatcttctctgggccaaaagagtacggagtaatctgtttcagtttttacagggcacgcaagacattgacgggccaagcccatatgtattccctcgttgctttgcttcgtgataattcttgggtggaaaagtctattttgcttttcctcaagtctgacttggcccctcccgacaaaatcatttcgttttatctccctgaacgatatgaacgttggttttgtcctatgtgacgtgtaaataacgcctacatgacacggagacttgatcatctgatgtgatgcttacataacacttcaatcaaagaaaaataaataaacaaaaaaaatcaaaatcatataggccctatatggctctcagaaaataaaaatgatgtaggtggcatcatctctctttccctcttctttcccaatgacgctagaagctcaaggttggatgcgtagttggccatcggacccctgcacgggctccctcaacaatggctcgttcgatgtcttctccatgcttttcccaccaagcagatcgcttctgggatcctcccggacattggtttaggatggcagcgacgacggcctcaaggtgtggagtccatgcgacgcacttggtaagtagaggacaacagggatatggcgcgaatgacatcctccatgccgagaggctagagctcacctacacctgctacattggttagcgtagtggatcgattttttgagggaggcattgtcacgctcaaaaatttaacccaaattttcagactattttgcgtattaaatccctgtccagaaccagccagggtacacaaaacgacaagtaatatacagttccaaacgtaaaataagcgtaaaatacttacagaagaggcacttagtcctcacaccgaaacaaaagcagtagcagcggaaaaaaaaaatgatcctagcggggcttcagctccactccacaggcaaaactcaactggggtctaagtcttggtcctctaactccatcttcagctcagaagcactacacttctgaaaagggggaataatagcaaggctgagtacaaccaccgtactcagcaagccacaccaacgatgcagacgtgcaaggggatacaaggatggtttgtggctatttgcataaaggcggttgtaaaacattttattgagcaaaacagtaaaactgttgagtaattaaagtaacattaaatctccattgatcaacgctacaccacgttgaacaggcccaaccaacccacctaaactacagtgtattgggtcgatttattaagatgagactaatcacggtgaatctgatcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccaacaaaaccatgcacccacagcccaccattcagttgcattttagttggataattacgaccatgaagcatggccagatgtctcgagcacgcagctcactctgatactaaaaaggtctaatactgtaattatcccatcaactgagctagtggtaattaagcatggctaagcatatagttctagctaggtcatcaaagtaacacaagctaggcgatttattacccatggttgacaaaggacagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcacttggatcttctgaactcttatccttgcgaacgcgatcttccgaaacgacgggaactacacgctggcacgcaaaacgagaaaaaactctaataaaaaccaagaaaacagtacataaaaactaaacaaacatgtagagctcaattttagatgaattttgcaagtggaatggctcaattcggagttcgaatgaattaggtatgaattttagaagttttaagccatttaaatgaatttctagaattaaactcgatttattgcgcaattattatttatttttacaaaggaaatggtcatcgctgacgtcagcaaggggtgaggcgcggaccacgtccacaaaaggggcaggccccacacgt

SEQ ID NO: 65331 - DNA, 7094 bp, Oryza sativa
ccaaaaattggggaaaagtgggggatttggtggaggaggtgggggggaaccgattttatgcggtttgggcgcgagggcgcgagcgggaggagccggaatcggcggcgacgtgggtggcaatggcggcaatggcggtttcggctctagaggccgaaggtagaggaaggacctgacaggtggggtcgtcgggcccacctgtcggggagggagagagggaggagagccagggggttatttagactttgcgcgaggggaagttgatcggaccaaaaagggaggggtcggcccgagagggagaagggaaagagagaggggcgagcgggccaaggaggggaaaggatcttgggccgaaagcggcccaaagacaaagaggggaaaattttatttgttttctttttattttaattgattaaatgaaatttgtgctattaaaattatttctcgagctccgaaaattcacggaaaattccggagagtattttagggcacaaagaatattacaaaatattcccggccaatgatttttaagggaaaattttaattctcccatcaattcattcgaataaattgctttaacttttaatataatttctagaaatgcattattaattgatttttaatcccgaacgaaaatcggggcgttacaggcatggcgcctggcgatgctaattgggccttctttcctcctcttatctacattgagctcgctaacaagatgagaatggcgaggacggctgctgagccatgggcgtcgccgttcttcatgttctcgacacgacatgtcgagcccttaggaggtcctgtatccaccatgccaatggctagttcctcatgccaccaagaacggtcaagtgagcacgacaacggtttttcaaaggtcttcggttgagaacatgaactcgttcatttgcattgaagtcgggtgttactgtcatggttatgtataccacatacataatagtagttgactaagctcgatagggcccaccaagtaccaagtcttatacggaattatatctcgtatatagaaggagattcggataagcaagaacgaatagagttctatatggaaactataaggactactcggattgtatccatattagtctctctagttctacttagataaggggacacctatgactataaatagaccccctaggaggagggggggaggaacaaaaaaaatcaagacacgacatacaacagatcgagccaacacacgccaagacaagctgccggatatcgatatcagagataagcctagacaaactcaatatggtgtctacggaggccaacaaaagagatttagcactatctctgatctcgccgagtgcgaattcgaggaggaagactactgcgttgtcgactacgtgatggtattttaagccgccaaatcgacaacggttacataggttattccaaatattgtactggtgcgattatgatgaataagagcagcaataggagtaggctattacttatcagataagaggcccgaacctgtataaaaatccctgtctccatctcttttaccttaatctcgcatccaccctggtaccaacgatccccataccatgcaaatattgtagtcgtgacttcagacgtcgacaagggcccgacgagctccacctccacattgccaccatggctccatcgagctcatcgcaatatggtcacactgctctgcaccctatgcaggatgcttaccatgtgctttcaatcaccggttgttgaggactaggcagccatactaggtagttgcataaggaagagttggcagggatgcatggttgccactgcttcctccaccataccaccatagctgccttggtgtagcaaagaggaggggaaatatattaaagcggggggagagggggaaaagagggaaaattaaatgaggattagagcaattgacaccgtaatagactaatcggacctgaaagagaaaatatgatctagagattatgaagtactaccaagttttttttttctctaaatgtaaagcggtaaacaaaaaatccaagtaaacataagaggaatgtgtatcatgtttatacaactctctacacgtgtagtactgatatgtacatccaagaatctatggggtccacatatcgtgagaatactgcactcaccccagtcttggggcctgttcactttgataaaaaaaaaaaccttaccaaaatttggcatacttgccaaaattttggcaggatttcttatatagtcaccaaaatttgacagcaaactaaatgtagccacttttttggtaactttaccaaaatttggtaatgttgaaaatggtatcaaagtgaataggccctttgatgccattttcaaccttaccaaatttttggcattgccaaaattttggtatagttgccaaaattttggtaggatttcttatatagttactaaaatttagcatcaaactaaatgtagtcacttttttggtaaatgtatcaaaatttggtaatgatgaaaatggtagcaaaatgaacaagcccatagtactgcatacaaccttttttttttcaaaatacaatacaagtactcgtatacacatccaaaaagttgagattcacgaatcttgaagttaccatagttaccttgcttttaggtctacatagtataggtgcttatataaatgctcgtacattcacccctcatcctacctgtacaataaacgctagcatactcaccacttaccttatccctattagcacatctaaaaattaaatcttgatattgacagagttatcataggcgtctagttgttgatggaaacatcattctagtaccatttaaaaaataaattatcgtaaacatgttaaatctattacttaaattcggatggacaaacacattccatcaccagcaagtttgcaaccccatgttcccaactcctcttcctcgttttccacgcgcacgcttttcaaactactaaacggtgtatttttttaaaaaaagtttatatacgaaagttgcttaaaaaatcaaattaatccatttttttaaaaaaatactaatacttacttaataacgtgctaatggatcgctatgttttttgtgcgggagggattagttcccatcccttctatccgaacacagcctaatacgcttctaactgttactagtattttgatatgacaacatcatgtgttaccatcacatcaactctcgaacagatcactgaataactcaaccagcaatggacttgtacacttttcattttgcatataatataacgccgataatgctggatctttcataaaaaggcaatgtgatatgattctagaaaatccaggagcgaagccactgcccgacaaagcctcgtcggttccctgagcgtttatgttattttagctgtttccgtgtatctattagcagttcccgctcggtgcaagcatcaaattaaacttgtgtgcatatgatcccgcttgtaccaacaaatatacggtatttcctcgcaaaatgatactacttatacggtaatattacaagcctgtacgtaactgtaagcgtcctgtacctcctaacctccacaacaactgcccttgctagccaagatcgaaatcgaatggacggtggactactgtgagtaacctacaaactgaacagacgagcgggcccacccgtcatcctctcacagcaccaacgtcggaaaatatctcacggccatgggccatggcctggcccaaggagagatttttttacataggtccaaaacaagaaaggagattttttacatgggtatgttacactgggcccacagcggctgggggaagcgggggcccacctgccccggtcacgcgatgaccaccgtcacggcggcggcggcgggggcgtcaacctcgctccccggccgccggctgcccgcggcggcggcggcggcggttggtttgtgcttggtggtggcgccgtggaggacggagccccggcacgtggggcaggagtcgtgggagacgagccacgtgtcgacgcagcggacgtggaagccatggccgcagcgcggcagcacgcgcaccttctcgccgtccgcgaactcgccgaggcagatggcgcagacctccgccgcggcggcggggctccctccaccacctccgccgtacacctcgatggggatgctcctgagcgcgcgcttcttgagcccgccgccggcgcccgccccctccacgccgccgccggcgccttcccccgtcgccgcccgccgcgcccaccggatgatgagccgcgcgagcgagttgagcccgagcgcgaacagcagcgcgaagagcagcgccgcgaggatgatcaccatgttggtgtcgaagctggcgtcgctgccccctcccccgccgctgctcagtgcgtgctgcgcctccccggcgctccccggcgacggcgaggccggcgtccccatgtaccagctcatcgacttcgtgtgcacccccatggcctccccccaacttactagaacttagaacaacacgctaagcttcccggcaaattatgcgccgaatgtacaggtccaggtcagtggaaaagctactactactcaccagttatctcgctcgcgaaccaatccgtaacacaaaaggacgtggacgtagtagcgactgccactagctaatacaaaaaggtgaagcttaactgttgctaaactgtaccgatcgatcgattgatggagtgagctagccaagtaccttctgtgatctctttcccacacgatcgagctggattagtatttcgggagatgagatgaggaggaggaggagaatcaacaacagcaagtggagttgagccgtagtagtagtagcagtagacagcgatccgtcgcgagatgccacgagagatttataatgggtgcaacaccaacaccggcacaccgcacggcggcaggtggggccaggcagatgtgggtggggttcggctccgggtcactttacggtgggccatccaaaagcggaggcctctctcctctcgcgtgacaaatatctttgcccccgctttggcgctttgccagttggcagcggctcgcgacggccacgcggttgctggctgtgcgggtgggcggcaggtgcgttgccacttgcaaatggatggatggacggcccacgccgccacgcgcgcgcgcgcggatggagatggagatgaaacgagactcggcgtgtgcctaccttggagcaggtaggcttagaggaggcagaaagcagtacacggcatttgcggtgcagctggtaggctgtcacgtttgcaagcttggagatgtatacaggagcccaaggattcattccagtggttatacctctctagtatggggcatgatcttcttgtcggtcggacaggacaagttttagggagagccagatatgattagcttatataaagtacagttcaatttgttacttagtaactctctcttttttggggggttgggagggaagaaggccagcagatgctgcgatgagtgctttgaagctactagaagtgttctccttttccgacaaaagcctcaatatttgttaaaaaggttaaaggttcagttataagcagatcatatcgatatcaagacagcacaaaagaaagagcagtttactagtatttctttttcaaaacaacatcaatatctcaggcaacttacttttgcaactgcgcgagcgtgcattagcctttattcattttgagggtgaaagatatgcaaaaaaagaaaagaaggaacaggtgagttttagagtcctagcatggtctttcgaccattccacttatcagagaggcaacgtgcatgcttaccaggactccgctcgccgcagttaattagctagcttcgttttggccttttgggaagtaacaatcaatcgctgggttcgttttgtcgaaggttagatgctagctaggtttagatagtagtgcgcatgcatcagtgtatcggatcatgacactaatgagatccgcagccaaattaattcgtctaatctaatatgtttggcccccataaagatccactaataagaaaagttccccctttaaccataaaatcagtatgccggtgacagatcgtgtgtataggctgggcacttttctgcaggcagagatcggacaaggccagctcaaaaccttatctcctaattaaatccgactgtcacagtcccgaattaaagcactaatacagaatgagatgttaactaaggcgttaagcatgcagcttgttgtagacttgtagtgctcatctaatccctggataaacaacacaaaagcacccgtgcaaaaaaacggcagttcttacagcttgattctctgtggtactagctacagatggttatcatagctatgtctaattaggacaacaaatagttggactgaacaacaacacttatatgccccatgaaactaccaattgcaattttgtttttaaacatattttttatttcgcgcgcacaaaagaatagcatgacaatatattagaaggaaaagagtttttgttacacaatgcaatcggccagacaagctcacaaacctatgccaagggaaggaagaaaacgaaaaaacaagaaccgcaactaggtaaaagaaaggtaaactactacggataaaagctactcaaagctacgggagggtggaggcggagccacactacatccccaaaaaatctagaaaagtagcaacactagcggaagaccacatgcgaccctccgagaggatggactctagaaccacggagaccgagaaaagtgccgagtcgaaaactttgaagtcatgctccttccacaactgacaagagactaggagaaccagagagtcgaagccggtacaaaaatgctaaggtaaacaggccctagacgacggccaccagaccgctagcgagttgtatatgtattactttacctgtaatgggttcttttgacttaactattgtacaattgagttataataaagtgggatttacatatcagtgacttaattgcatgttcagttatgtttagtttgaattatgttagaggatctgctccttactttacctacgaaaggtttgaattatggtactacagatattacatacatatgcacacttgataatattttagtgaggctagggatttattgccggtctt

SEQ ID NO: 65332 - DNA, 13024 bp, Oryza sativa
aaatcttcttctcccccatcttcagccgtggcttccttctatagggttgccgttgatgatgttggtcatggcgtctaactttagaactcttatcccaacggctcattggataacaaaagaacgcaccggaggtggataggatcggaggctgagttatgcacgaatctttaagtgaattggaccttaaggcttatattataagtgactccactacatcgtattactggtttaacttcaaagttagcgtagcttaacttgttatgttatttataatggaatatgttcaccagaatttaaatcataaacttaacatgttgatgcttgtatttacgaaagttctaaacttgacacgttatgctcgtaattataaaagtcttagacttgacacttaatatatgctggtcagtctctcgatgatgcttataagagtagggtgtgcatgtgaatagccctgcttgtgtacagtgtttttgaaataaaaaaaattatatgtacaccctcgctctgcttggttgtatttcttcttgtttttttttttaaaaaaaaagagctacctcaagctgttgttatggccgtaagtaaaagaaaatatgtaagtggtttataagatacaaggaaattaaggggagttaattttagaaagttgtaactaatttgtcaaaaatgtagtttgctacaagtttaactcatcatttcagagaaccgcaacaatagtgtaacatgggagttctttaataaagctgcgactttatttgtctcataaatttgagcccacatatcatccaaatatgtaatactcacatcgttttaagttggccttacacgccatacacatagagaatgtagttatagttttctaataaaatcatttgttattgttataattttgtgaaatacccaattaaaattgtagcaaagtgattagtgatagtttgaactaaacaaccatagtttttcaaaatttacttaggccttgtttggccatttcccatgaaaaaaatattagatgggattaattgaacaaaatcgtaaggataaattaacgccaggaacatatgaccatttggctgtgacaactgacaactaacgatgccagcgtggcagtttttccgctgaacatttgccatgaccacaacacttaccgtggacttcttctgtaaactttgcattttcttttggtcagcgcgacagctagacacctgatcagtgatttctgccaaactgatgctcgctggctggctagagtgacggacggtgtgaaagatatttgcggtggaccggggccatcttggctgtttacctccaccgaagggtaaagtgaaaatatccggtgctgacacggtaacactaggaggcctggcagcaagtacgtatccctggcccgttgtgtgcatggctcattgggcgtactccaactcctcgagctatctctcaagtctcactctccgcatcgttcttctatctctgatcaatcgtgtcatctctcggaagctcagtatctttttagcaaaacctcaaaagccacttgacaagactgcattagcattagcattagcgatgcccggctggctgacggaggaaacaaaggcagccgcctgctattcgcctagtcttctttgtcgagtatcctttcgttgcaggcagtagaaggtagtactagtactagtactatagatttactagccggcacacgctgcagaaactttttgtacaacatgggcccttttcttcatcaccatcatcgtcgtgttcgactgtcgtgttgtcatcggcggcattgttgctgtcgggttcgaatttgcaatcaacggcacgcctagcaggtgagaaaaaaattcgtcgggtgatctacaccgttaagcttgttgaaacggacggtggagaattaggcgcgattctctgtggccgcaatcaaccaacggagcaaggacagatcggcgaatctctacgggcgtcggcacacggcgatcgtcggcgccgggccgccggtttggcatcgagcaatgctactgctttaccatcctggccactgctgcaaacctgccaggctgccacacgcacgcgtaggcagtaggcacggagaagtgggccgtttggccccttttttgggccgttctctcaaaattcggcctttcaactgaaacgagacggtccttttgtacggtggatagaaagaggccggaactgggctttcgaattaagcccatatattacctcagcagctcagtgcattgagggtgctataatatttatcggtaatctacaacgattttgctaaacatttattgataaattttctcccaaaaatcaaaattaaatacaatataattatagtgtaattatattgtaacttgtatgtaactttcatataattttgaatagttagatttactcaaaattcatgcaaacggctaagggaaaaaatcacaaggcatgcacgagtgggagtattctaccccccccccccaacctccactttatgagaaaatttattgaaaaatatatagatagttcacctacaaaagccacaaggaaaacgctctcgaatttgttcgccatatctctttaactaacgaaaagtgaaacacgaggattaaccacatcatctgaaaaatattagccgtcggattcactgggagacaaaagagggtcaatcaatcttaaccattgaattagatggatgggaaatttcaagaggattccagaattgcatgaagctatactggaaagaaagacagaaggaaaagaaaagacctagagaataagcaggggaaaagataaggtggtgcatataattttgctatactggaaagaaagacagaaggaaaagaaaagacctagagaataagcaggggaagagataaggtggtgcatataatttttcgatatatgtatatatacatctatagtaaacattgtttataaataatatcctcatccttgggtaagctattcatgatgcactcaaaatgtatggttatgtgtgtatttttttttcatggctatagccttagagctatatatagacttgatatttttcctactatatcaatggaaaacatagcactatattttagttgtttcaaaagaacgtgtttgaggaagaaatcattacaaggatatgtacccacattccttccaaccaggcggccatgatcgcctaggtttttagaataatttcataatggttttcactgtatataggtttaatgattttgcacaaatattataaaatacatatataaaatatatgtgcacaggctataaaacacacaccgatggaaaataataggatctcattaccatagtaggctagttattgatgaacggattatttgttccattttctgaaaatatattttctcgaaggactttattctacttaaattactttaaacaacttgtgttaagctgtttttttaagtttattttttataatattcacccttacaatcaactagataatccgtaacaatgatcgagtgataagagcgtggtattgctaaatgatggcgttcggaatgtcttttcccgtgcatgtgaagagggttcatatgcatgttcagaagttcagcttgatactatcacacacagtacatactgcagatttgcagaacaatggacggttgacacagttcacatggagaacatcaggaccaaagctagcacaggcgttacataataacaccaccttataaagtgcacaatatagctccaccatcgcccaagcgacactatagtaggaactgtggagacatacgatccctaaactgctaaacaccacagaggaagaaagggatcgattttcgtaaagcttaactagctagcttaatttgatggtactaatgacattttattctcctctcgtacgggaggcgcgggcacacacgtacgcatcaggccggccgccctagtttatcctgcacaaagaaagaaattaaatttgtctgtaaaaattttctacttcgtttaatgagagtatgagagtgtttatgcgtgcacgtacgcgttgcagttgacgctggtgctgatcttgtaagggagggagacgttgcacttggaggggagcgcggcggcgcgggtgatgtaggggcccccggaggcgccgttggcgacgttcttgaggcagccgcagatggtgcggcgatcgggggtgttgttggcggcggcgagcaggctctgaatgccgccgcagcacgccctgggcaccgtgccccccgcctgcacgtacggcaggcacggcatcagcgtgttgtacaccgccgagcacgagatagccgcgcgcaccgccgtcggcggcgccaccacggccgccaccagcaccaccaccaccgccagcgtcgcgcaccttggagccatgtcagctaagctagctagtctcagtctttgctgctgtgtacgtacgttgttgtgctctctacaacctacgtgaacactgaaagacagctgaaacgtgtggatggaatggggcttcctgggggtgtttatatagcggaggaagcttagcttggatttactaaggttgttgagtgcatttaggggaggagttaagaacgcgagctggtagcagatggccgtgtgtgtggtcagaatttgactgaaataggaggagggttttttgggggatgcatttttaccagacgtttgatcgttctgataattctggactctgtgatggtgtagtctgcaagatgcacttgctgtttgagctttttaacgtatgccatgctcgatttgacaattcggtaggattaaccatacaacttttgacggtgaagcgatgattaattcattttttttatgaatgtgacaaggaattacacgtcattctattagaataagcaaaagcaagtttttacacgacacggcagccggacaaccatcgcccgggattcgggaacaggaaaagaaagagaaactagaaacgctggctaagaaaccaataagctccagcaaaaggaagagaagcaaaaacagcaagcgagaactcactatatgtaagattaaatcacaagaactaaaccaaccagagaggagtgaatggttggtatacccaaaaacaaaaaaaatttagcgaaaataaaagttatcctcgaaatcgatggatcgcggtctgaccgaagtagtagcgccggtctgaccgcctggatatcgtcggtctgaccgaggttgtaacaccggtcgaaccgccgagatcaatcgccagctcctgtcgccgccgccggtctgaccgcctcgccttagccggtctgaccgccagtaggtcgccggtctgaccgccggtgagatgccggttagaccgccgaaacctggtgaaacacaaatcgaagaactctcaaagtagatgacaactttattgcttctctctgtgtttacaaagtgcaacaacagcattccttacaaaaatcttgactaaactcgaaaccctaactaaactatcaactccacgctttgaaaagcgataaaaaagcgataccggaaagcctcacgctccccctctatttatacatgaggtaggcagcctaaagccacgaaccaaactcatactaagagtcctaaacaccttacgaaaccctctagtacaagaaagaaactcaacataaccaatcgtaccaaatttggactccttccaaattcgactccgcatcccatacgcacacaatacctccatcgtatgccatatggaatcttcaccaaccacgtgcatcaactctagtcttagtatctcgtatgatatctaaccaccacggatatcgtcttaccactaagccgactcccggtccatcaccgcaaatactctcccgaggcatcgagtcacctatacatgaaacaaacaaagaaaccatatttcgagaccaagctatctccaacttaactcattcgtagcaaacaacagtattatatacgtatagtatccatctataagccataaccatgaaacaatcacggatatccaaagaaacaacccgaaaccgaaaccgacacagcgtcggccggtcagaccgcgggcaagccggtctgaccgctcacatagctcctgtctgaccggcaacaaccgcccggtctgaccggtcccgacaaatcagtaaaccctattcatctcctgaaaattgattatctccaaaaccacttcgacgataatctccaaatatcaaaaccgataatcacatatgtcaattgttcatcacagaataagaatcaaaacacacattgatcttacactataatcatgttttgttagatcaatatggttagtgcagatactaattgagatccgacgtgttgcaagagactatgggtgtcgatgtatatcctaatcctatcgtgtgtctagctcggttttttgctacaataatcagatcgacgaacaaattctgcatggaccgacgtatagtcctgcagactccagattgttcggccaataattcgagaccgtccaatatgacgcagaattgcacaggttcgttcaccgacaggcgacagcgagtccgtaacgcgtgactgttgcatggagccatggagtacctctgatttaatgacttgccccggacgtggcctgcctaaagccattgcacctctgcgatcgagcgtaaatggcggagctagatgagctagatgctggtcgatcgggttcatcagatgctgcttccttacagatttagatctgccaacacttctgacgacggggttgctggctctgcttgtgtaggtggcaaggacgaatttatgaagctatacgagcagcggccatgtgagagccatctgattacatttacagccgctgctgccccggtctgtgaggccagcagcaggaggcgtcaatgcgatagccggctagctagctagctctcgccttttatttactgcgtacgtctcgatcgtatgcatgcaacattgcaacatcgcgtctcgtacatgcgctgtatgaagcaagttcttgttgcgatcaacaggggaaagaaaatggccaatagtgtgtgcatgcctgtatggtgcgtgccgactgttgttgattacgtggtagctgttcatggcagtggatagaagaagtttgttggcaggtgaaaattaagtgcacgcgaactactcgctacattttccactgatgtctctgcaccgtcattcatttcagaatagcgcgcggctattcggggacctgctgtaaatttttcctctcctttttttgctcaccagatttctccggtggtcaacagggtttcccaaaccgttggggctagggttaccgtgccccggcggtaagcacggttaccgcgcggtaaccgcaaaaaaccgtacaaaactgtgtaaaatttatcaaaaattcaaattattttttaaatttatttgaatttaaagaggttaccgcggtatttatattaccgtacccccgcggtaagcccgataaccatgataaccgcgcggttaccgacggtaagtcgaaccgactggtcaccacaagatcaatgcagtttaatcagtgcacttccttaccattctcagccattccaaatttcgatgataccaccacgataacacaaccttaccattttttataattctaaaactttatagtctacaaatttttttaacaaattagactttctcaaaacttatttcaaaacttgaccgtgtaaaaaaatttcaaccaaaaaaagaccatcagttcaacgccagggacactggccctaaggttgtacataccaacgccagctacgttggcgttgatcccttgcccacatggagccgaggacaatcccctcgccgacgtggcagggtctcaacgccaacctatcaaaaaaaaaaagggacaaaactagtctcaacatttaataaggtattaaactaaatactacatatcttcaccttaccttatcaaaatttaacattgccaaagtttagtaggtttttatttatagtaaagtgaagaagccctataattcaataaacatgtatgcgaactgccaaacgtagcaacaagcagctgttatgaacttatgccatggtgccgtggaccggtggtgatgaaggtaaaagcatgtacaccaacatgtacatgaagttaccgacatggaaatggaatgaactttcacatgcacaatttcacaggttgatgctacagctgttaacttttgaggaaagaactagacgagcccggagataaaactataaaagggctctgtgagcaatttcgatgtagcacagatccatgccatggactcatgaaagaataagttcactccaggtccttcaacttgacgtcgagtctcttaaaccacaatctacttctacttctacttctacttatatatatatctctacttaaaaagtaaaacttgtttccgtcgtccgtatgaccgtaaagaaaaacacgtagaaaaaaaacagcgagaaaaagacttctgtcgaaaaaaaaattctgactcctattataaaaaaaacttccgactcccttgaaaaaaaggacttctcgtccgtaataaaaaaaattcaaaagaagtccgactcaggcttaagttcgatcggtagttttaaaaacagatttttaaggcaagtaacgataaacctcattagcactcattagcacatacatgagtactacttaaaaaattaaagatttttccatcgttcgtgataaaacatataaaaaggcgaaaaaacatataaaaagaaaaagaaaggaaagtctgagtcatcaatgacgcggagaaaaaaacctccgttcgtgataaaaaaaagggcgaattttttgttcttcacggagaatctaaaataatcatccaatcggacaattacacaaatcgagaaacctaaaaaaaggggaaaaagagaggaaaaaaatcacacagatgagcaagcttgccgtcaaatccggttgttccgagctcgtcgccatcgccgccgaccgcgctcctgtcgtggccttgcccgctgggcatggccacactcggcacatcccaacccgcgctggcaccccctccctctacccggtgccccgccctccgacgctctcctcttgcttggagacagaggagagaaagagaggtggatggccatcgccgaggtctccgcgccgtaggctcgtagccccgccattgaggctgacggggagagaggaaggggaaggatggtcgtcgccgccgtcgtcgtcgctgtcgtacccttgccgtcgctgcactgcgtcgagcactcactgacatgtgccatgccggcgagactggaaggagagggggagaaggaacgtccccgccggtgggggaagggggagtgtcgccaccgatgggggagggggaaggggagtggtgctgccaacgccgtcgtttgagaaagagggggggaggggaaatgatttacgattagggttagggctgccgacgttttatatatgttcggatcaatcgggaccgtcgatcagataggacggctacggcttctcccactcgggctgctaacgccacacaattgggccatatgtacgctccgcatggataagttcagttttggtccctccagttgtcccaaatacttactaaaccaaggccaaaatcagattcaagccatttaaaattgctgggaaattatgatcaattatttaatcagttagtagattatttttagataaatgaaaccaacaaaatgtttatctagaaagtattaattatatgatattgtatttgaccaacgttaatatggttttatgtcaaaataataattatttccttaaatattaaattatttatagaattcaaacatattccactaaagattttatttcgatactataaagtgtgtgtttctttcccattgcagacgctttgtagcactgaaaaaactgaaaacatactatagtagagtgcaacaaagcaacgaaacgtttaacctcttttactaaatcccgttgcaacacacggacatatttactagtaccaaatataatatgtatctaaactcgtaaaaccgatgtaccagagatcccagggcagtataaagctcggctttggttgaacgagttagctacgtatggcccacctaggcacccggctaactcagtgtggccccgcgtgtcagttgccaatatttcttcctcctctctctccgtctcacccatctctcatcaggttgggtcactggaaggcaggagacggccgacaggaacaaggcgagccgccggcgggaggtgagttgcgggaggccgagccaccgatcgaggcagcacagacttcatcggtaggcgatctctgcattgttagcatgcatgtgtatgtcgtggactccaaggtaggaatgtggaatacttccaccgttttaggttataagagcaaagtcaataatagagtaagcagcaagctttaatttttttccaactcatcaaagttatcagtatagcctctgtatacaatagctagctatactgctgggtccatctatttcactttgcattagaataatctacccctctctcgtaatgttctctctttctccgttgattggctagctatccatcatcaatgcttcttatctcgatagatgtgtgcagctcggcgatagatttgtcgtcggctcacgttctctctctcccctctctcctccagctaatcacgacagttgatgtggcattcctatcgtcagtccacggtggattattgtactcgctctaagacgttttgagtttgatcaaagtcaaactacttcaaatttgactaagtttatagacaaatatagtaatatttataataccaaattagtttcattaaatcaataattaaatatattttcataaaaaaatgttttgggttgaaaatgttattattttttctacaaacttagtcaaatttgaaacagtttgactttaaccaaagttaaaacttcttataacctgaaacagaggtagtaggagacagagaccgaagagcatgtgaaggctacaagttgtgttagacttcagggtggcggtggtggatggcctcaagctgtccaagcgcctcgtcctcccaagcagcaagccctattgtgtcccgttgttgcgatggactgggtggccgcattagacgtcaccttgctgctactaccggcgtcgatgacctacaccgtggtgatggacccaggtgccatccacagccccagtgtgcctagctaccagccacacgtttgtgactgcctggacccgccatacatgaagaaggaggcggtgaacatgaggctgacggcgaccatgacaacccacctctccaccaagcaaccaaacaccttaaacccaaatcccccttccctgaattcgccctaaattcatcgctccccgctagagatcgacccatcggacgccgatccagctagtcgacgaggtcaccaagtaatgcgacgtgactcggtgcttccgcgcagagtgcggtgagctcaaggcgcgggcggacaagcttggcatcggcagcagggcagggtcgttgacggcaaccgtcttcaccctgagctcatcgctgccgcctttccgccgatgagtgagcaagctcaagctcgttgcccagctcctctccatcggtgctaatgccaccctactcctctccaccaatgttcttgtcgcctatctcctctccgccgctcttctccctgccggccactggccgcgtcgccttttcccgtcgatcgtgtgctcctggaaagagatagggggaagtggagattggagaagctgtggtttcacactttaactgacatgtgtggcccatatgttttttgctttttttttttgtctttagtgccacatcagagccatgtcaattaaaactgcttacaatattttcttgtcctcttggaactatatttgtactggttttacaagttaagagatgtgttatatttggtattacatattgaggatgtaattcgaactcgacgctaagttgaggtactataagtgaacttattccactcctgaattcccaagccctgcagagtttcagtcttgcacttgcacttgcagcaaaggaagctaggcctagctgtgtgggttggtcagaacgtggtgcggcccacaaaagttggttagaaccggattcggaaaaagtccatcgaaggtccctgaacttgtcatcgagttataaaaacgtccccaatctgcaaaaccatatatcacacgtctcttaactaatcaaaaccggtcacaataaatcccttggcggttttgatcccggtcttgtcctacgtggcggctgaatcagcgtagaacctatgtgagccccacatgttagcatgccacgtcagcctcttctctatttcccctcttctctccattcctcctctctctctctcactcctctgtggggctctggacggccggcggtggggaggaggtcgtcggggcatggaggtccgacgccggccggcgatgaggcggcggcgacccagaagggaaggccggcggcggcggcgggagcacggagagcaacaccagcgtcttgtgccgcgtccaccgcggcgtgccagcgccggcggccggcgaggtcgtgttggcggcgccggacattgctgctgctgctgctgcctcccggaactcgatcgagacacatcaagggatccaccagctgggatttatctacggccatcgcagccattaaatcgggaatcaaagcttgcaattttggcatccagcagaaacatgcaagaaattaatctcgtgctacaaatgccatctcatcatactcatctcttcttatctcatccaactaagaggccatagaaaatcagtgtcattctactggcaaatcacaattaggcaaaaaaaatgcaagaagttaatctagtacaactaccgcagctcgcagaagggcaccggcgaggagctcgccggagcgccactgccgccgttgcctcagggcccttatcaagggcttggtcgccgaccacggcgaggccgcgccggccgtgcacgcacacgcggccaagctcggcctcgaccaccgcctcgtcgtccgcgatgggctcgtcgagctctacctcgcgcgcgtcgagctcgcctccgcctgggcgctct

SEQ ID NO: 65333 - DNA, 12414 bp, Oryza sativa
gtttcttgtacggccatggcggatgatagcggcgtgtgcatcgacaccgtcgccgccgtcgcggcgttctcggcgtgcgtgcaatcggggaccttgcgctgggtcgggagctttaggaggatgcccgtgaagaagaacgtcctcgtcccggccgccgccgccacgtcgcggccggccgtcggacctcctcgccccggcaacgacctccccaccaccggccggcttgcccaatccagagagaagagtgggagagagagaagggaggaaaggagaggaagggagaggctggttgttgacgtggcatcctgccgtacggggctcacatgtgtcctacgactcagccgccacgtcagataaatcggggtcaaaaccgctgagggacctagtttgcaaagttgagggacgcgttgtatccggttttacggttggaacgattttgtaactcgaggacaagttgagggaccttcggtgtactttttccatcggattctgacgaacggcccatattagttttgtcggaacgggatcgtgagttcgtgacggacatatgggctgaaaagtttggcccggaaggggcgtgtaccgtgagcccatattgttgggctggaacgaacgggctacataggttaggccggaacggtatcgcgacgagcgtgaagcccatataagttgttgggccagagcatgattctcgttcgatctccatcttgacctttcacgtcgctaactccggaaaatttgtcgatgggcggacggtcgctctcgcaccatcacacaggcaccggctgtctcccatagtcccatgttccagtgaattcacaaggtacaccatgacacctactaaaaaacaaactttagcacatgaaggacttgtggctgccgttaatgaagccatcggaagttcacaaaaaagaggccgtcgtcaaatcttgtgccaaacatcctgtttcgttacagagagagggggaggacatttcaacgtgcaggcgttgccggtgatagaatttggttcctcgtgagcaggcgtccttgcggatatccagccgtcggtccaaccagccacaagcgtactaccctgtctgccgaaccggtcgagttgaagatcccgtccaatgtagcgcgcagtacacaaacatcttatcccgtcgatcggcacacatcggcagtacagtcggatcctgttcctccatcgccgtgaacagcgagcggtcgatcgatcgatcgcgacctagcttcctcgccgcacgctcgatcgaatggcctcctgcatgcctctaggccgacggaccacgagaacagcccgcgggcagcgactcctgagccgacggatgacggatcgacgagactcgacggaaatgccgctttgccgtgcgggggcgcaagcacatggcacatggcaggcagcagcaacaggacgcgcaaccgcgacccgcgcgccgctggtgcatcgcgtgcggccatccgtctcatcctccgggatcgcgcgcgtgcgtgcggggtgacgtacgcgcggtgcggtgcgggctccatccaaccacccgccgcgcgacgcagggcaggttttcgccggagagagcgacgcgggatggatggatgagtaggcgggggggcgtgcacggcgccatcggttcggttgggccgggcgctatcgagccaataatgaacggaacggtccgaactgggaagaacgcaagcctctcccaccgtcgttacgcgcgcggcccacaccgcgccatgataggatcccacttgacatgcacttgccgtttcgtgtctaggtaagacaggagtagttagctaccgttaagtactactagctccctttctttggaaatgagagcgaaccgcttgcaaattgcttttttctcgtatgattgagcgtgccctagctaacgcaattgatgagatgtttaagcgagcgaagagcacgattctcctcgacaatcatggacaaccaccgaccggggcaaagaaaaccttccttccaaccgtcattaaccagtgctgtaacaaccacgaaatgcatgatggtgtctctgatgatcgaggcggttggatggatgaagaagattttgcagcgccctactgctacgagagattctcttcagacgagtaggcgtggtgttccattcgtgcatgatgaatctctttttgtttgggtgcgacctgcagatgagttccctgggcttcagtcgccatcacggcaagattttgtggtccgttttggtgtactcaccacatgcttgctcctcgctctctctccatcttccaaacagtcatggcctcttcagcgcatggcgtgaatagttcaatgccttcaatgtgagacctggttctattatactccctctatctacaaataattaaattatttgatgtttaaattttgcctataatataacggatcctacattattacttttccaattcatccaaccattacatttgttgctcaattttatttgcatagttggcgttatctttactaatctggtaaacctataggacaatttcaccccagctcaatactatactactgttaaataacctagaacccctaatatttacggacaaaagaaacacttcgcatgttaataccatcatttatagacgaagggagtactgtacatgctaatgtcggtggtaaaaattttgacgagcaaaaattggatttaaaatttatattatatggtatttttaacttatttatgatggaagtggttcacataatccgcctctaccaaaaaccacacaaccaaggtaaattcgcatattgtatgaaatgcttatgatcaactgtaattagatttagtatgtgtttggttgaaagaacggaatagattgagatgaggcgaatccatttttcaagttgtttgatttaagaataagtgacatcggatcatgggatggttcgtaatcccataagatttgggtcagttttacacctcagaaactaacggactaatcaatcctacccacctcctctctcttattgacaaatgagccacaccctccgtaaagaaaatataacgattctatctgtcatgacaaacatatgactaaaccattccattcataaaaaatatagattatctcacctcattctcaaaccaatcacgcacttagattatactccctccattacataatataagggattttaaatggacatgagacattctaatactacgaaactggacaaagagtatgtccaaaattgtaagactataatgtgtcacattctttcaaaatcctttttattacgggacggatagagtacaatcctgccgcagttagcagtagaagttgccataaaagagtctttgttgtactattgtctggagtgaaaataagccccttttcaaattagaagtgccttagaatttaagactcgtgtacgctctacgcggttcctacatactttatcgaacgtgagtgatggcagattgcagagcttgctcaatgctcggctagctcaaatatccgtcggtacagcccaagtaaccaacgtaaacagggaaaggaaattgtggcgtgaaccttatgatgctcggagctgaaagctcgggacgcttgcaaaataaggcgaatcaacgcatggtagctagtaggagattgcccgtgatgtccgggcggcccatgcccatgtgcagctaacatggcgtgggggcacgaaatggatggttaattagtcacttgatagactacttctttttgaaagattggcacgcatgttctctttgaaaggaacggattatgacgggaaagctaaccgcgattttgttttcttgtcctccaatacgtgatctttgaaacatcgatggttccgaattcatcacgctatcatttccgcctgctaggagcgatcagctgctgccctgtgctgctagtataaaacttctcctgttgcatggtagtgataatttactaaaattacgatgacatagaagtaatttgtactgttaaactaacaatgacgcatctccgaaagaaaattttcaaaagggctttatgaagttggttgggggaatccattaaaacttcgtgtttgacctctgttgtgtaccagcaaaggaagcaggaatcacgatacgcgacactgtcgaaagaaaaggtgctacactaaaagcaactgaagaaatgcactgcaagttcgcaacgtgcagatcatgaatatactcccaagcaaaccggtggaagagcgcaccaatagtcccattccttgagccactaaccaacatttcctgcaggccgatccttacaggaggcacgaggttacatcgataaaatcaggatcagagtaggtttggagcgagtcagcgagagacgtgttattgcagccacctgtcactctgccacatgtcacaggaaaaagaacagtactatatgcagaggagatgaacgaagaatgcccattcaggtttgtcagagcaaaaaacgtgaacttggacaaacatgcctgcagtttgtctgaagatttcgatttttatacacctttttttgatcgcctacgtacgtggccatgtttatgccatattgccatgtgaaggtgtgaacccttgcaagcacccatgggcgtcaggctatatcctagtcctaaatcctaatagtatctgagcttatcattgggagttcgcactggtaattttggcatcaagcatgtatgcactagattaattgctgcactaatctatattacctagtcctaccaagtaaagttactcgcggctagtcctactattgattcttgtatactcctagtcctacatgatttacatagccgacagaaaaatctggggatagtcactttgcctgatggtgcaatagtggcttcaatcttcagcctactctgctggcgcattacaatttacaattgtgagaacggttatgccttttagagcaagtttaatagtatagtccactgctaactccaaatcatctatagctaacgtaatagctaattcatataatagttgcttactatactattaatacatggtcccacctgtcatacacacattacatcttggagtccgtgctgcagctggctacagatctgtattatagttagtttatagcctgctattgtacctgctcttacaacatcgaccggctccgatttttcggagattatccaatgaacgagaggttcttaaccgaagaatgcaaccttcgaatcttgcgctacgtcggaaaggtgcgagaggcatccacgaacatggttcacactttagaacgattggttgtcattcggtctctttttcgtttctcgcattaatctaccatgcatgcaacttgatcaacagttcaagaacataaacaaagtggtttactttagagcatttgagcaaactgtatcgcgtagtccgtgcatttgaccatgtctatcctggcacgtaaaaaaaacataaacctgcacgccaagtcatgtcatgcatgtacacttcgtgcatgaatcacacgagagacagcccacgacgcgcagccacgaagcatggccatccacgataacgtaccggcgtgtaatcgaattcgtgaagcatatgtctacatgatcacatggtcggtatggtcccttcacacctgcgaaattcgtggcccatatagcttctgcgagccatgtggcaagtatcaaagttcgccgatttctcgtttaaaaaaatgctcggtgatttttattgtttttttttcttttgctgcgattaactggacttgttcctgcagacacacgggcagttggtgtctccttgtgcgtgacgcgcgggtccgacgaggcgatgcgacgagcacttgcatgtgcggggctgatcgccctatttgtatgtgttaaccgccgtcgtggctcgtggccggttatggtgggctcaccttcctctcgccgccttttgtctccttttccggttctctcctctgtcgttgggcaaaagctatcaacgattctaactgccaaggaggagtcgcctataagtacctgagcccgggagcaccgctctcttcacaaccaagcaaccatcgattcgatcctagcttaagccgagtgaagtagctagcaggacattgttggtagtgtgatcttctccctgttttgcaacaatggcctcacgcagtagtgccctgctcctcctcttctcggccttctgcttcctcgcccggcgagccgccgccgactacggctcctggcagagcgcccacgccacgttctacggcggcggcgatgcgtccggcacgatgggtacgtgtgcactgctcctcgtaacactttgtttttttttcttttggacgcattgacaaaaccgggagtaatctgactcgtgtcgtgttgtttgtgtacatgaaaaggcggggcgtgtgggtatgggaacctgtacagcaccgggtacggcaccaacacggcggcgctgagcacggtgctgttcaacgacggcgcggcgtgcgggtcgtgctacgagctgcggtgcgacaacgatgggcagtggtgcctgccgggcagcgtcaccgtcaccgccaccaacctgtgcccgccgaactacgcgctccccaacgacgacggcggctggtgcaacccgccgcgcccccacttcgacatggccgagccggccttcctccagatcggcgtgtaccgcgccggcatcgtgcccgtctcctacagaaggtgagctctacttgggtcaatgggtcacgagtgagtggcaaactgtttgcaacttgaagccatgggccccccgtgcggtgtgtcggcttcgatgggccgatccccaatcggctgatcaggccatgtgtaggtgggccacccggcagatttggtttgtccacgatctgtccgtgtcggctgtaggcaaagccatgcacgcacgacttgacaccgacgtggacttgacttcgctgtcccggaattactttacgcatcccatttcacatccatatgattaatcgttgcaacaaatagtaacaaattacagttaattctactgtttcactgaactttgctttttttttttgctggtgtgttgcagggtgccgtgcgtgaagaagggcgggatcaggttcaccatcaacgggcactcctacttcaacctggttcttgtgaccaacgtggccggcccaggcgacgtgcagtccgtgtcgatcaaggggtccagcaccgggtggcagcccatgtcccgcaactggggccagaactggcagagcaactcctacctcgacggccagagcctctccttccaggtcgccgtcagcgacggccgcaccgtcaccagcaacaacgtcgtgccggccggctggcagttcggccagaccttcgagggcggccagttctgatcgagtactcggctaattccgtttttcagttcacttttctgcagaaatgtcagtgtgagattgagattgaggtggaggaggagggaggcctctttgctatagtaaaagagaagaggctttggctattctgaggctgcttattaattagcacccgcttaggcctttgctttctcccataggtccagtagacataaataagttatcatggagttgggcattttttttttctgcattgttgtagccttggtttaaaatttggcaaggcaatttaaggattatattgtagaacagcagggaggtggtgtcttgtaacttttgttgttacattgtaaccccccgaatcaggccacatgggccggaggagtttgtgggggagcaccggagcactcttgtgcttttgggaccatgaactatgctagtttatgggtctatgtatatgatatgtttgtgatttgattatactttcttttgtcgccttatcaagtaccaatcattattaagtactgtacgtagtctctgagtgataattttgaaatctttgtgagcgcatattttaatcgaagttgaaggctatttttgttcgccattttttgttggattgtcaggatgatttgtaggcaaaagttcacaagagaatttatatgttgcttcttcaaagttcaaaacgattcatgagtgagaagaaaatgatttgtgacaaagctttgtgcctttgtctgttttcagttcgacgtacgaaacaaataaaacgggcccatatctattccaccgcagaattccagcttgaactatcaggccattacaaattcggcccactagagcatgtattctcaaaagcaaaagctggccatatctatgctaccgcaaaattccggcctggactttcaacccattaggaatccggaatactaaagtagtagtacgaagtagtattcttcaaaaaaaaaatttctttgatatgaagtttgttttgtattgcaaaatgtggcttgactatccagtataagtgtataactattctgttcacgtatgctgataaaacaccaggtagactgttcaactgattggtctcacacccgacctaacggctaacgcaagaactttatgcagactggaatactggattcatgagtactaaatgagtatgtaattaagggcaacaaagttttttttatctgttacaaacatctattaattttttaggtatgatgggttcatcattgactgtttcaagagtaggctaaagagctgccaaagtgacaaattgtcgttgcagttcggccgttgtgatgacaacgatggcgatatccgctaaattggcctgtgcacggcgcgggaatctgcatgtctggtaggtcgtcaccgtcatcagaaatcgttaacttgtctctccttatgccaaatgctaatttttcaagcctaaaattgccggggcggacggtgaaatcaaagacgaacttgaatttttagccgcatcgtttgacagtaagccaagcattcaagttaagttagatggactttttgatggatcgatgatcgaccaacagactgacgtagctctgttcactccaccaaactccttcgattgatcaaatgactgtttgattatggagtagaaactgtatatgcgtagcatccgacaataagcaagccagtgaagtccatgaatctgcagtgcggatttggccgcattctgaagaactggacgagaaatgctgacaccgcctgagaccgagaggcatctgtgtctggccagagttggttgagcccgaacaaatccaccaacattttaagcaagacaacgagcaaccacccaccaccgcacggagggaggaggatttctgcctctcgtcgcattcgtcctctctccctctctcggttctcgcggtggtggccacgggcgcaggtgaggggatggtggacggcaggatggccggcacggcggcggcgctgggcctgtcggtggtgtcgtcggtgtcgatcgtcgtctgcaacaaggcgctcatgagcacactcggcttcgtgttcggtgagccctgaacttatccgagttatctcgcgtacagtctgtttctgttggacgccattgttcgagatgccaggaacatcttagcggtttatactgcctttaatcgatgcgtagcagagtccccgttgttcccgtcttgtgcatcgcctgcgataatgatttctgattaagctcagtgacggagaatgctttggcctgcgtagaagacaggaggcggcggtgtacggcttgcaaacgaggagtaatttgtgaaaaaaaaacttttatatacatgttcttagcgaactaaaagcaaatgctgaaaaataaagttcgataaaaatacaccaaaatcagcttcaaatttaaagttgaaaatttaaattttggctgataaatataagcataagcgaaaagatgaaacaaatagtttacgcaagtacctcctacaagtacactgcagtttatgtgtcactcgaatggttataaaaaaataaaaaaatattaagaatatataaataatatgtgatatattatttcacaaatatatatgtttaaatttaaattcaaaattaaatggacgggaagtgtccatccatttttttgcaaaacactgcctgctgttaggattggtgagtggcgattgggagttttgcgcgaaaaaaaaaaactcctatgatgaccgttttattgatagcggtctttttgtgtagtccgcttccccttctgtcttcgctagtacggtaggagtaggaccctgtcaaaaccacgccgccggcggcggcggcggcggccggagagcaacatggccgcgtgttcgctgcagagcatcccgcccggatggcgttccggggaccggggatatcattacgctcctcagcctccggtctcctctgcgccgtgctcctcagccgccggtggcgccgactggtcgccttcgccccagccctcggtcctcgttccaccggagatctccccgcctcgcgctcgcctacctcggttctatcgatcaccctcttgaacctacctcgctcgcctactttgcgcttaaaattccgcgcacatatctggtctgtttgctctttgcagagatcttggtaagtagatttcgagtctacgaacatcttattcaattcccgcaaaaaaatcctttaaattcctccattccaagggaggcctaatactattgttctatttaatgctagcatctagcactctgtccgcatacattggactgcggcaatacgagcttagagcaacgcaaatgactagataagtatgcactctaggtgttctttgaattgcctcagtgcagacttgatgaccattttctgaacatctctgctctgctgcatatgtgagtcaaattcatggctccatgggacaattggaaattgcacaacgttactgctatcctattcatgtatttgttgaacaaaaatgacatccttcgaaaattcaggaaacacaagttgcctgatggacacggttcattaataaggcacacaaattctatactactttatgagtacaatatgacgaacaataccacctgagaaaactaactgtttcctaagctatataaccatgcaaaaatcacagcactctcctaatttctttcagctactacgctgacaagctggcatctcctggtgacattttgttcccttcatgtggctcttcagatgaagcttttcgagaacaaagatttagaccccaagacaatcattggatttggaatactaaatggcatatctattgggttgcttaatctgagccttggattcaactctattggcttttatcaggttggtttactcttcagaaatcaggccaatcttgcatttgtttatttttcctattttgagatgaacatattcatcttcagcaaacgacacctgttggaaactttaaaacttaaattcttgctggaaatttagtagttgaccttgattcatgcccaatctgaaaatcaacatgcacacaatatgttgccctgattttattggggatggaatgacacaattcaacagtctctagtttcagccaattcatgttctttgtctacagacctaactgtgcttgtgtaattagtctactgctttgtctaagctatctcactctatcaaatgcatcaggtaaccaagctggcaataattccatgcactgtatctttggagactatattgttcaggaaaacattcaggtctgatccaaattttgccttgtcttatgtaaaaaaaaaaaatttgccttgtcaattcacgctgaaaaaaaccattaactactaaatatatgatgattgttggtatccttgtgaatacaagcatggtacttgaatatttgaattcctcaatacctgtgggtcttgcaatcctaatgtcatactcccataaaacaataacttgtagtactatcataaattgaatagactataacaatattttcacttcatgcagccggagaatccaaatggcactggcagttcttttgtttggtgtaggtgttgcaacagtgacagacctgcaactgaatagactgggatcgctgctgtctctatttgctgtactcaccacgtgcatttcacaaattgtatcctctaaacaaagtatacattcaatattattttctttgcactaaaataatgacacttgattctttgtttttaatagatcaataatcagacatatgcattatagaaaaaatggcttttggtgttagctcatatcaaatatatattaatttaccagataaatagtttcttatatctattttgatatgcattctcttgcacctaaagtggatgataacttttaacatactctgaaactctgatagtttctacgacctccgtcccaaaatatggcaacttttggctatgatgtatccagattcatagctaaaaatgcttacattttgggacggagggagtaggtgtttctcaatttaagtagctgatctgatacacgttgttttttttctctccatttttttgtatcagctataaatatgtggatccaacgtagtatattgatttaacatcatatccttcttctgctatcactatttccttccccatacagcttaac

SEQ ID NO: 65334 - DNA, 1613 bp, Oryza sativa
gaggaacatattagggattcttcttgccttgttaggaatgatcctgtattctttcttttgcttgatggagaataaacagaaggccccggaattgtcagctccatttttccacactaaggtatcagatagcacttcttttctgaagccttaatgctacatttgcgacttgcagctatttttttcatatctcgtccttgcaactttagctgacccgttattttctttcactaacttactttttcgtgaatgtgcaaaaggattacacgtcaatatattagaactttcactaacttactataattccttgcttctcacccatcggtaatcacccttgcttatcaacctggcaggtgaaaggaggtgaagcagggactcttctcctagtacagaacgggtcagctaaagttgcagatggtgttgtgactgagggcccaatgtggaggtcaaacagagacttggacgcatgatcatcccgctcctgcagaagggatcaagggactgacatatggtctgaaaccggtgtaattttcatcggcattttgctccagttcactccagctagctagttctgaaggctccttgctctgcgtcttgtacatacatattcggcacctatttttgctacgactgtacataacatgtccacggctggaattaaacaaacatttgcattcatactattatatgaagatttcatgtctgttatttacccgaagagtaaagtgcacaatgcgtttgttggttggggatgggaactaatcccttcgacatgcaaaacagaacgaaatattaacgcacgattaattaaagtacaagttccttttctttttaaaaatggatttatatgatttttaaaaacaactttcgtatagaaagtttcaccaaaagcacaccgtttagtattttggaaagcgtgtaggtcgaaacaaaaatgatgaattcacttgtagacttttaaatggttagactatgatgaagaaatattgcatgcttatatttaggatgaagggagccactttgataatacaaaatccattcaagtatttaccaaacttttgtacaaaagacaaaagtgttcacagatctgctacgcatttgcaaacggaggtagttgtagtagtacgttacgtcggctgttctgttcccttctctgatataaaagcgtgtagggtgttgcaaagcggaaagtggcaaatacgctttcgcttatgaaccccgtgggccatggcccttatatattcctacctgacaacttagaccgtcgatccaacacacgaacggccaggatgctttgccgcttctcccggttctagtataaaaggccactcgtggcgcaaaccctagtagaggagagattaccttggaggcttctgagctcgaaccccccgccgccgccgccgtcgcctcctccatccgccgccatggtaaggccttgcttccctatgcttaacgcctagattgctttgcgggattcagcgtgaactgacctctcttcttgctgcatcggcgcagaccttcaagcgccgcaatggcggccgcaacaagcacggtcgcggccacgtcaagtacatccgctgctccaaccgcgccaagtgctgccccaaggtaaggcg

SEQ ID NO: 65335 - DNA, 2045 bp, Oryza sativa
tacgccaaggtgcatcactgtgtgtcctgtgcaatccatgctcacatcgtccgtgtccgctcccgtgagaaccggagggaccgcaggcctccggaacgcttccgccgcagggtacctgatccccgcctcttaactattatatctagtgcttaattgatagtgtaattagtatatcatgatcggaacgatttcctttatctgttactgcagatttaagaaacaaagtctgatatactaatagacgtaatgattttgcacagtatttgtagatatctcttatctgcacatatggtctaatatctttcaagcacgctgaaaaattaaaattctttagtgtgctgattctatgaagtttaccatttagcttttagtcaaatgtaccggcatacttaaggaagtatactcattcagccagcttctataatctgaaatccactgttcttttttggaactgcatgtcttccctgatggcaaatactacatgttgcctgtgggataaacaggtccttgagattcacagcatcattttcacaattggctgatggtttatgtgtaacatttatgttgggatatgtatgatatcctacaaaaaagccagctaccaaaattttgttagggcctcaatccaaaatggccctaacatcaagtaatcaattttcatcgaattcagtagattgtaagctagctagtctgttgttctttaagacaaccttaatttgtgttaacctgttctaattatggaatgctgattgttttgtgccaatgcttacagtatctagcttcttgctagtgggtttgtgtccctctttgttgcatccagaattcagatgcgtttgtgatagtatagtagtatcaaagtggctggcctatgtatcaaaaccacattaagatatctgcaaatatgtccactcatcctagaaagtgattaagaggagcgcatggtgtagttgcgattgatgtgtttaggctgctgttattgatgggctctattgtttgttattttgatccatatttttttgttctcaagtctatttattttggagcgatcttaatcgtgagattatatgtttctaaactagttgccgctattttgcaggaggataggccccaaggccctcgtccaggtggtggcgctcccgctcctggtggagctgctgctcctgcccccaacgttgctcgcacctgattgtctccggagtgataaaccttttttcagtcgtttccctaaatctagcatgataccagggtgttgaactttatctaggaccaacctgttctttttcaaatatcggatctgctgttactggtttcatctttactaaatgtggtttaccatttattcgattcgttctgttcctactcacgccgtgtcagacgttatgtgccgtgtgagtttttctgttcctgctcatgcttgtgagagcaacatcgtatgttctcctaaatcccgagtatgttactttttctttatattcagccaagtgaaacacaatggatgctcaatgtacgttcctgaccaaaatccagaactctaaaggccatctttgtgcacgaaactctgctgatcgggccaaaccgcttggcttttggttcaagctttttaaaaaactgtaactgaattttacattttttgtccagatttgtctggcttatgtcagtttatctcgcggaatccgacgatagcgatggattgtgaatctgatccggccgtccaacttgaatcagacaccatataagatgcctttttgtgggtgggaaatcatttccatttccaatttagccaaacattgcctcaggctgtgagcctgtgaccccaccggtcagtcggccaccgccacctttgcgccatactgcctcccatctctttgtcaagtcgtcagccagccagcctgccccgtcgtgcctccactttcccaccaatttaacacgattccaaaccacggactccatctggaccgtccaccagcgcatcccacggtcacctcccgtccccacgtttttctttacacccacgcaaccaccacccaacctcaagagagcacgtc

SEQ ID NO: 65336 - DNA, 2932 bp, Oryza sativa
aattttgatgtttcggaagaaaatatcagtggaacaataataaccataatattctgtttctttagcctgagtgggatttccgctgattcttagcgcagttgtcaaaaactcaaaatacaccaaataaatatagccatgaatgtcgaaaattcaatggatatgcgaacgggcctgttctacaataaccccattgggactttcataatggaatttttgtgtacttacatcagatccttcacttcctagggaaaagatggagattgttgcatccaaaatggaggatcttgcacaatgcgttatgagagttctatctgataacgccaggaatcctgaagactctgctctgtctacaggggccgcgtcaatactatgtctgacactatataactgtaacaagttgaaaactcattggagtgagtttggcagcaccaatcctccaaactcgtacgctttgagcatccacctctctggacgagaccaggaaatttgtctgcggaatcagagcgggtcaactttcttcagtttgccggcaggctctatgcttgttacaatcggcaagcagattcaggtatcaacagaaccattgcttattaccatattacttattgtaattctaacggaaacttactaagagtcctttttttttctactcagaacttgctaaatgaactcttaaccaatgaattgaaattttcttatacgcactgaacatttgcatcatcctttatatactatcaccgtctcatactttcattgacatggtggtccttgaatccttaccccaggtctgccttgtcagtacattttcgtaagtattcggtgccatatatgggatcaatccaatccatgtagcctttgtaggctaaattctaattttctatccatctttcaagactgtaatatgagcaatgggcagtggtgcttgctgtatgcacagtttgatccttccatgtgtggaatgtgacacagttttgctatgtgcgaactcaggaatggtccaatggggagttcaagaatgctgttggtgagatactatttgagctgactgatgaaccaaacccgttcatttccctggaactcttgtactcaccgggtcacctgcgtcttcctgatgttggtcgacacgcaagatgcattgaccatcccaagactgtttctttcagggaccagattttggttgctctggttctgctcgttttcttctacctcttctggagataattgtacccaggtttgctcattaatcatgccctcctttgtcaaggcaacgaagccgtgaggtcaagtgtcctagaaggcttatttttacagcttttcttggacttagcttcctgtacttcttcattaatcgtgggggagagcaccgcacgggtggcggtgatgacaggtagtttgagtttttgcctctgtggtttcaaattcagattttgttgctgttaaacaatacgtgatagagtggatatccaacttgaagaaaatgatactgggtggattttgatttgttgattgaggcttgattttgctgttgaggtattgtttggaggtgagatttttattctattacgatggaggagttgtttgtaaagggcaaatgtttttatgcttcacaaaaatatattacaatatatgatattattgccatgaccatgtgaaaattgttcattgtatgcccgcaagttgcaactattaccttcatcccaaaatattgctatgtaaaataggatgcgatattatttagtaccactataaatctggatatgacatattcgtattactagatatatcatggatcctgtttagatttgtagtatcacatcttgtcttaggtgactgtaatttgggacggaggaagtatcacaattttcgaatgactattattggccgtacactcgtacttatttatcacctgaaatgatcgttctacgtcctatgctcaactcggttgcttttctctacacagtttcttcgttgtgtcggtccagcatgtggtgaccacccctcccccccaccccaccccaacccacatactcgacctgtggagtttcatggtgatagatctccaaaagtacgtacctgccctgtcatgtcccgcgctattacagtgtactagtgtactactgctctgctcctacttgaccatgctcaatcgatcaaaacctgagctttctttcagtaaaaaaacgaaaacggcgttgcagactcggactagtccgcagcagtaaaacgcggcaccgaaaaaaaggatcacgaagagatccacgagaggggagtaggaacggaacggggcctcgtgacaagaaaacgggggtccaactcgaattgaacggccacccgcagcgcgacgcaactgcaggcacacagtcgtcgccagtcgccgctcgtactctctccgcgaccatacgtgacgccgtgacggccccgtccttttctcgccaaaaggcaaagctctgcacgtaggtatagctcttgcgtttggcagcgacgacgaccaaagaacgcaaagttgcaaacgctgtgctctgcctcttcttctcgtcttcttcttcacgggttggttaccttgggtttctggcaggttgtaggcacctgaaagatggacgtgcgaccaaccaaaacgccgtgctccgtgaccgcctcctcctcctccttcttcgtcgtcgtcgtgttgcccgcgtggtggcggtgtgcgtgagagagtctgggggccttcgctgataataaatgtgggcatctctcggacgattctgctgttgtgctgctaggaccaaggtggtggcaacaaggagaaggagaaagggctgtgggggggactggtgggctacaggccgtgatgccaatctctcaacctccaccgtcctgtgcgcgatcgatgttctagtgtacggtacaggcagtgtcatcctaatcattgcaatcattggcgccatctttg

SEQ ID NO: 65337 - DNA, 1298 bp, Oryza sativa
  unsure (1)..(1298): unsure at all n locations
atcgatgcttcctgccgtcgatcatggtaaactagaccgtaggtcgtgtcctgcgatgagtgaaacactgctgtctttgtcattctggtacattgggccattgggctgcttcgtgatgccgtgcgcttttgcagtactactagtaagcagcaccggctgcctgcttttgcctggtaaaacgagtgctgtgcacagcataacggcacctcaattctgatgtgtggcggtcactcatgaaggctgctggtagtagtagtaacatttcgaggctgtgccaaaagttacaccattgaattggatctgcaaagggccgtagttacactgcactggaggttgagagacatgaaccattcactctgcactggacgagcactggccatcagccgtctcttcttcagtctctttctctgctgcaggggtgtcacagtcacttgtttgctggagttaattaagctccccatttccattgttactactgcattctccctgctctcgatagtcggatgtgatgtctcaatgttaaagcccttcactgactaatcactgaggcctccgagagagaacgtagtgaatgcccgatgtgtgtggctgcggcttgcagctgcagcgccttttgtcaggcttacatgtacagtagtatatgatgtgtgtgtagagtaggagtaattgtgtacagcatactcctactgtagtagaggaaggaggttctgatctgcagcttgtggggtgcagtaggagtaatactccgtgtactccagtatttgacactggatgcagtgaaactggttcttctgcttcttggcagtcgttcataaacgatctttgcgagaacggtaaacaaaccacgcatacgcagtactcatacatccatgaatttctctctgaatgagtcgaagctgcaaaccgggacacagattgccgtgtgcatgcccaccacaaccgattggcttccaatcctgtcatttctcagacccgatcctggccgaagcttccaacaacagtacgctatgcagtaatcctaatactatctcgcccatgcacagcacagcctgaagcagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 65338 - DNA, 11134 bp, Oryza sativa
gggaaccggcccgagagagggagaaggcgcgcgggccgcgggagaggaaggaagacttgggccgaaagaggcccaaagagaggagagaggattttaattgttttctttttattttaattgattaaatgaactttgtgactttaaaactatttctcgagctccgaaaattcgcggaaaattccggagagtattttagggcacaaagaatattgcaaagtattcccggccaatgatttttaagggaaaattttaattctcccattatttcacttgattaaattgatttaacttttatttaatttctagaaaatgtattattaattgatttttaaacccgaacgaaaatcggggcgttacaaatctaccccccttacaggaatctcgtcccgagattctgggatggctagaaagaaagctggtgctggtcggcggtctgactgatctgcacattgaactgccacatcctgcttcgaactgattgattgactggttgatcaaacctgcacgattgaactggctggattcgacctttctgttcctttgctttgccaaaactggaccgactggttctgcttgaactgacccagactaggactgcggatgctcctgaaacttacttatcttggactgaactgttgaggttggcaattttggtaacctgagaattcaccacgctggctataagaggatgaaaattgaatctggcatttgtaaatcatttaccctatgtccgcttcgactggtcccaactcaaatgacaagtaattccaggaaacctgcttgacctgtcttttgtctgaactgcaaccgtccctgatgctgcttctcaaagctgaactattgacctggcctcaccggtgtacctcagaattcaatcagataacttgagatcggtgtaactctgctgacaccttgcaactggcttcttcaagtactacccggattgttgcactgggttgaaccttcaactaaaacagcgatgaggtgagccaaaactcatctccgagacctatccaccttacagggagtagtcttactttcgcctgactgggaacaattagactattgtccttgaaaaataaccaacacttctcttgcttacaaggaccctcactttgaaaactgaaacttcaccgattcatcaaaatagagcaatgacgacgcactttcatcccagcaagatttggaacttaatcctcagttgctgatgggagattccacataaagaaattctcgtttagctcctgattggtacaactttcttgcttctgacttgatttttggtgtcataagcctaaacagattgcatagttaacattccttgaaacaagcactgatcacccaacagatccaactcaagaggtcctttccatggcatgacatttcacttctttgaccatcctttgctaactcttcctgggttaacagactatagatcctgtaatagcttttcgaaaaatactgcaatctgatcaactatcggaaactgactttgatgctgccgagagtttctgcactttgatcataacaacttcgctttcatatgttcggtaaagatggtttgttgaaaagagattctatgccatataccttgttgactacacatttctatttctggaccaaactctcgtatcttcctgactcatgtatggaacaatttctttttcaacttctgggaaacattgagagttttttttttctggaacttatagcggttgccttgaactatggaaaccattcttgtttcataatcacaccactagggtgtaattgccgcttaccattctctaacagtttccaaggatagagattccttgtatgatgttacttccgaatatatatttttttttccgttactccttacacttgaatacccttggtactgcctttggagagatttcatagtgtcgagcaccatggatccaaccattgtcactttcaaatattccatcactcttttcatttgagtaccactgatgctgcctttagaaagacctcatcatgtcgaggtgttgagggtctaaccattttcactccgttggttaaccattcctctattggctcgcaaacaggttttggagctcaacagaattgcgatgagttagaagagaaactcttggtttcttgagacaccgacagatacacattttgatttacttttgcatgctgaagatgaatcttaaaaggagaggaactggctgactcatattttattcaatatttccttttcattacatggctgccataaacatatacgtacaatgagaagtactacaaaatcaaacaattgtagactgctgctgattagaactgcccttttcacgactgaacttgaaaaatagaagtcttgtctagaattgctattgcttccattattcaaacatgactgacttgttcctttagttcctactaccagaagtctcaccgggaacgttgctctgcttgttgatctttgatggtggaggggcaactgtcttgtcagctgtaacgggtaggatcttcttgcccgtggggttaccgagcggtgatttgtcgatgggcctccagattggagcaataccaggtgcattgctagaactgacaacagttggacgacctggtgctgacaacacttgccgcgggtgctgacgaaggagcgtaccacctctttgtagctgtagcgagctgttgttctcctggcattgcttaccctgctggcgttggtgctgtaggcttgaaacggttgccggtggaacaatgcgacctttgacggtgcccttgacgataatccgttgaggcggaggttgcacattcaggtgtcgattggtgtcatgggcaatgctggtaacttgtgaatcacgacgaactgcctttgctgctcttggaagaggacaatcactgaaacgatgtcctggcttacgacagttacggcagaatcgacttgcttggtcccgaggtgcaggcttctgattatgcactttggcagctgaaacgggaacaagcagagacttatgaacatccttggtgacgttgcttcttccatggttggcttccactggagctggagttggaggaagagcagaaggattgtgaccgctgttgtcgattgtcattggttgacgaatgggttgcacggttgtcccttgttctttcttggtcttagctatgaccgcgttcaactgacagtccttaggcacatgatctgttccttcacacaagaaacatgttaccttccttaaagggcatgcatctgagtaatgggtatattcaccacagcggcaggtggggaggcataaactagcagtgtgtccgactatcccacatctagcacatgctttgaactccaatcctctttccatgaaactgttaagggtcgtatcatcatcgtcatcagtatcatcatcatcgtcatcagcagcaaaccgctctcctgattcatcatcttcgggtctgggcggaccgtactttatgagatgtcgggttagctggcgtgctccacggaaggtatttcttcctctctgacgcttgggtatccttgctgcgtcttcaggagtaaattctgaactggtgatgatcatggtcctgccattatccatcttccatatcaccttcctgttcgctccaaagttgtgctgcagagtaccatctttcttgttagtagactgacttggagcttggttacttcctgggcactgcttctcgtccttttcaggtgacctggcgaacaccttccatggacagttccttatataatgaccttgctcaccacaatcataacaggtagcacttactttcctttggtctgacattgacttggctgtcgttatcttcggggatctggaccgcattttgacaggggtcttcggtgccgatattgggaactcctgactctgactcggattcgggtcccgggctggcatctgatctcgcacctgtggtgggtgacattgacgtgactcctgacattgtcgttgcatctgttgcatctggtatatttggtatcgacgtcgcatctgttgtaacaactcttccactgtctgagtttgattagccatgacttggggttgaggctgatcttcaagaggctgacgtggaatattattagaattgcactgagttgccccatgaaactgacggggtcttgatccggcgaaattgtccctcttgcagaccatctgctgcaggcaccagagagagggggaaacgggaggggttactagagatgaggtactaaaccacttgcctattgatctgttgtgaatggattttatgattcaagttgtttaagcaaacaacctagtatggtcgcatccccaccaatgacgcaaaccatacccctacacacaagcaaacaacacacgatctagaagctaacgaaactactcttctgggacagattgggtttaggtcaacttcgggaaaactcttcatgatcttcgcggaacgacgactctgaactgatcttctcgctccttgcacgaagcttgaggctcgacttggcttgacttccgaacagacatgaagctgacggctggtcatctaggtgtgacaactaaaagaattggagagactgggaggagaattttgaaaaaccgtttcgcaaagaaaagccgaagggcgaggggagacattttgcaaatagggttttcagaaagcttgtccttagggtttgcccatttggctcaacctacagtcgagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcgggcttcagctccactccacaggcaaaactcaactgaggtctgagccttggtcttccaacttcgtcttcagctcagaagcactacacttctgaaaagggggaataatagcaaggctgagtacaaccaccgtactcagcaagccacaccaatgatgcagacgtgcaaagggatacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattgggtcgatttattaagtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccgtgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaaggggcgagctatacttcagatcaagcagttacccactcccgcttgtggcaagcgctgtaagtcttccagggtttcccgtgaaccggtccttaattgccatgggtgcgactcacaaaaccacgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacacaagctagtcgatttattacccagggttgacaaaggatagataccaagtaaacatggcacaagcgagcagataggtaaaccctgatcccatgtaattagcaaaacatgcatatttatttgtaaacggtaaaacatttataaattgggatcaacatgctcaaggggaatgtgtgacttgccttgcttcttcacttggattttctgaactcttttcctcgcgaccgcggacttccaaaacgacggattctacacgctggcacgcaaaacgaggaaaaactctaataaaaaccaaggaaacagtacataaaaagtaaacaaacatgtagagctcaattttagatgaattttgcaagttgaacggctcaattcggagttcgaatgaattagatatgaattttagaagttttgagccatttaaatgaatttctagaattaaactcgatttattgcgcaattatcatttatttttacaaaggaaatggacctcgctgacgtcatcaagggggaggggcggcgccggcaagcgggccccaccggtcagcggcacatgggcgccggtccaccgtggaccgggaccaccgaggctgtccaccgccggtccacgggaaccgacggctcggatcggcacaaagccgatcggacggtcacgaggcggcgcggctggggcacgggcacggcatgagaccggctcggccgagccaaggcgcggcggcggcatgcggccaccggcggcagcagccggcgacgaggaacggcggtgggcggcgggcggccggaggacagcggcgcgcatggggacggcgacgcaccccaagaggcggaggtcggcaagaaaggggaacgggaaaaaaaggaagggaggagaggtcctcaccgaaagcggcggccggcgcggaggaagatgatggcgacgacgattgcccgatggcggcttgcgaggacggagggcggacggggtcgcccttgaccttcagaaagagatgagggagttagggaggggaggaccgatgcggggtgaccggtaacgacggccgaccgcgacgatgtgagaaggatctaaccgacgaccgaggaaggaggagctccggcggattttcggcgaagaggggcggcggccgaggttctcctcgtccttgcgaagctgagggaggcaatggcgcgggtcggcgtcgaccgaagcggcggcgcgacgcggctggagtcggcagcaagcggcggagagaggttacacggtggggaggtggttccgatggcggttgaaggaaaccgagtggcgaccggcgtgcggcgcgggatggcgaagctggcggtggcggcggctcggcgcggcaacggctgtggcggcgggaaacggcgactggagttcgccggagtgtggcagcgcgtgggtgcggcgtggggagagcgagggagagtatgccgggctcgggaaaaatggggaaacggacgaggggagcacggggatgctttttatgggctcgggaaggcgggatcgaggccggacgtggcggaatcggccggcgaagtggggcgccgacgtggggtggtggaggggttaaccggcgccgattttcgcggggagagtgggggaaatggtggaggacgtggaggggatcgtgcccacgtcgttggatgcgagctcgggtgcgggagggcgccggattttgcggcgacgtgaacggcaatggcggttggggtcggccggcgagaggtaggaggaggagctgacgggtgggaccgccggttccacctgtcggcgaagggagagaaggagggacgcaaaacagacttttgcgagcgggccaagtgagaggggagccggcccgagagagggagaaggcgcgcgggccgcgggagaggaaggaagacttgggccgaaagaggcccaaagagaggagagaggattttaattgttttctttttattttaattgattaaatgaactttgtgactttaaaactatttctcgagctccgaaaattcgcggaaaattccggagagtattttagggcacaaagaatattgcaaaatattcccggccaatgatttttaagggaaaattttaattctcccattatttcacttgattaaattgatttaacttttatttaatttctagaaaatgtattattaattgatttttaaacccgaacgaaaatcggagcgttacaacaattcattagagaaactatctcttgttctatctcttagatgatgtgtacgatttatgagctagcagttgtcttcaaaggacctttgaaggaggcctaacatggggaagactagggagtagtcttgtctagtcagtgacaatccgataatatcaaatgcgtaacaacagcatgccgcatgcgtggctgtctacatccccgggccgccggccgcaccacagcgtttcatctgtgcggtgtttgggcttcgatcttgaatactagcggcataccatgcctcaatggaacgaatcacgctgcctatatgtcccatccaattaaaagttgctatattttaatatggagggagtagaatggaggaagtgtcaagtgtcaaccagcttttcaaactaatcggggtagtcgttttcgttgaggactagcacaaacaactagagtggaaaataacggcgcatgagacaagctattactgggccgttttcgagaaaggctgctgatacttgtgctcaaatcggcccatcaggaatagtgcgtttggccgatgatgattcgacagttcttaaaaataaggaagatgatgtgagactttttttttaaccaataaagatgatgtgagtgagacagttgccagttgccacggatgaagcttgggattgggagtttccgaatttggtatcaataccgagctcacatacgtacgtggcgagggaccacagtgttgatacatacgtgcagtcattgctagtgctaacacaactcgcgatccacgagtcaacacacccatacatgcacgaactcaaccacaatcccatacatgcacgaactcaaccacaatgattaaatttcctagctaattaagccagacagctactgtgacgaccggctgcctgctcgtcctggtacgtacgttcacgtccaaccggtcggcctgatgtcacagtccagtacagatgtcggcctgatggaacgtcctctcgtacaatgcaacacaattgcaaatgtacagtgttgcattgcacgagagttcgttccatgcactggtaattcttaaatttgtaccatatatgcgtacgatcaatcgatcgatcctctcatcgacgacgtcccagcagtctcccatgcactcgtgtcgcgcgtgtaccgcggccacaccgtgtccgcgatccgcgccgcgacgatgcgctgcacgtcgccgtcgtcaccgatcaacacacggtgatccgctgctgctgccgccccgaacgttgactgatcgtactggccgaaacagtagtccatgtcggccatctgcgccgccgccgcctcgtccgccacgctctcgtccgcggcgctcggcgagtgtcccgccgcggacgccacgaacgccgcctctggggccgatgtcggccagatcaacggcggcggagcggctgcggcgcctcctccgctgatgaccgccgcgaggcacgtgacgatggcggcctcctcttcggcggcgctgccgccgccgccgacggcgtggggtaaaagaagacggctaaagaggccggcgccgttcatcgtcaggtccaacatttccgccggcggggaggaggacgactgtcgttgccggctcgtcgtcgtcggcgagctacctgcagtgttgggcgtgccgggaacagcttgcggctgctggcacgtgtgctcgttgaggtaggtgacaaggaacatgggcggctcgccggcgtcccgctgctgcacttgcttcttcgccgcgcaactccgctcgcggctgaacgtgcacttgaagtacaacctgcatgcgttaggtgacacgacgggatgagagtcctctatcataaatgttattatcaggatgtggattttcatctctcgaggaatattacctcgttgtctgcatgtcatctaaatagttatcaaatttttttaaaaaaaatagtaaatatattaatacgaaatatatcactccacaaacatataaaatcaaatttaacctatacatgttgcaacaaaaataacaagttagactaaaaatagttattgcacattcgcaactatattttttttatctttgttacaacttataacagttgaatttaaacttgcatgtttgtgaagtgatatattttatattaatctatgctgctatttttttatattttttatgaccatttaggtgacatgcactaaatgaggggttatcccttcaagggatgaaatcactttttcttattattttacacacatgtgtaatatcattgttacagaggacgtgaaccggcacgacgaagcataggtcaagttaaagaattaattcaagtgatttgttttggcaagtgtatggctaaaacatgccgcctaagtttttgtctagactttgaattatttgatcgaggagtacgtgtgtatgtacgtgtatgacgattgacgacgaaggttaaggttgaccatgttgacggcaaagtcaagtcactggactggacattgatatgctgcatgcatggatgcatttctgtaatattgaacttccagaaagcatgttctgatctgatgctagctatcaactgactcagtctgtagtccaatggactaaaacagctaggttaattactctgaaattgacttggacattgtgtgtgttgcagtgtatattggttaatgcttaccaaatctggaggttgacataacagttcttggtagtactttaggaatcatgtggtttaagttgtggttagttaaaattggtaaagtaccatgcatattctagcgaaacaagtagaaagtagaaactacactctacccaccttagataattgctgtcctgaatgttcttttgcccgtattttctccactggtagccatccttgtacggggaaggtgtaataatctccgtcctcgtaaccacctcttctctgccatttctgacaagaacctcttcactcctacagtagtattccatatatatcaatttgtcatcaacaaaagcaattatcgattcagaacatattgtaaacatcgataagaactcttctgtttacctaacgcgtttaaccctcgccggagtgtgcaagcaaatgctat

SEQ ID NO: 65339 - DNA, 1929 bp, Oryza sativa
tgacgcataggcatagacaagctgaataattaaagacccgtgcacggtctggtttttctacggcctggaccggcaagcgcatttgacccgccagttttttctctgtcaactccagcagattgcatggcgagggcccatcacattttagaatgttccatccacgcatgcgtagttagtttcacgcaacaatacaaaacaacgctcaaaatctctgcaatttatattataaaccgctatgaagtcgctgtagcttgaggtctctgacagaaatctgttctgcaacacacgtacgtgtgttttgaccaaaaccggtcggggaaattaaatctcccttgtgatgaatatatactagtttgtttttaaggtcgatgaatatatactagtataaaaaactgcgaacacgcgcactgacgttctactgaccaattagaatttctcttctgtaggagtagttttgacccagatcttcgcatttgtcaatataagcataatatatatgtattccctggaaaatggcttccatggacggtgcgacgagctcggagttacttactgagtgatgcttacgcgatggcacgcggcaactaagcgactactcgcttcgtcgacttcattatatttgtagcaattctcacacatatcagtcatgtaaaatgaccatgatacctagggtttatattttcgatgcacgaaatctcgaggttttgacacgggttgaaagtagattatgaatgtaattttgaataattttttagaatccaaattggaaacatgaaaattcggatgaaatttgatcaaaaattgacaaaaaaaaatgttagactgctaggggtcgagatctggcatcaattggaaaccctaggtacgtacccactaattaatactctttgttaattgtattttctaggtagacttcagttaattagatgcattagcctgatttgcaataatccctagaaatcgtacggtgatcgatcacaaattttgaacgacttagtgggatagagggaaccggaatattactgtcagcttgacactaatattttcctattccattatctaacaaaattagtgtcagtctgacttagctcaatgattttaacacgcgctttggccagtaaaaccatgaagcccttggtaattaccagccaagaaagtgacgctactcaaaagtaagactggtgttgtttcagctgtctgcttgtgccatatgtaccatgtcaaatgtagcgtctttgaattcgtccaattgtccagctgatgccgacttaacgatcgagccacggccatgcatgtacggaagaaacggcgagatgatggtcggcaggtcattgatttggcaattatcgtgtttcttaaaccaacttggtgagtttcttctgtgaccagccagacgcccagagtccccagaccaacgttgccagcgttcagtttctgttgatacgacatgccatgcaaatatggaattgcagtaacaatttataactgacccggtaattaactcgagattctctgaagagaactcggacgccatttcagtgaatggctagctgcacagttcatccgggacgacaccaatatggtcaccaaatatctctatcagaaagacagacagaaacatggaaatgaacctctgtttcgagacccgggaccatgaaatggccggtgctgcagtaactgaaggtcacatcgcgtctcggtaggcagcagcacacactggagcggcacacatttttgcaggaaaccgtgtgcatgaacctgtcgccgatctgtccgttggtccgatgtcataggttacggcgggggggacgcacgtgtagcacgattagctagccgagtttgtttgcacggtttcattcaacgggaccgcggttcaacaaattctctcctaatgaccagcttagctagacatgcaggagtagcaatcat

SEQ ID NO: 65340 - DNA, 5190 bp, Oryza sativa
cacactgttggtcacataagggcattagcagtgcatccggcttgtttcgtgtgaccatgtgctcgacatagacaaaaaagtgaatgaagccacacataacaaattttaatctcccacagtacgccggcctccctctcccctccccaggtcattcccctaacctccccaagccgacatgtctcctccccttccccaccaccactggcacaactccacttctcccgaccgtcggtgcagctctccctcctctccgtcgctccccctccctgtcggcgcctctcaatcgtggacgccgcttgagcccagctcgacggcttgcggcggctgctgcctccgacctctccctccgtcgtttcctcctcgtttccggcctctccctccaccgagctctctagatccggcccgtgactcaccgaatctggacacgataagcagcaatgggccggcggctcgatgacgatgctggcgacggctccatggtaggcctacggcggcctctcccttcttccctccggcaccggcgcgacgtccctctccgttgctgtaacgtcgcacctctcccaggctgggcccacttacatctggcagcttttccagatccggcccgtggcttctcccttcttccctccggcaccggcgcgacatccctctccgttgctgtaacgtcccacccctcccaagtcaggcccacttacatctggcagcttttcttggatatagattgccctcacagaccaacacaagtcttttctgcacactttatccttacttgtgcacctgaaaagaatttcctggtcggtcacccatcccaaaattccaagcacgcttaaccacagagttctttggagatcggcttccagaaaagaagttgcaaacttgttgttatgagtattctattaatctatcaagccttgggccaggatgtcacagttgcgaatcggagagactggccgacgagctcggcggcgcggagaggagaatgacgagcaggggcggcgacgaggttccctctccggtgctgtagcagctctctccggcgtcgcacggggccacgaagcgcgaggccatgacccccacagagcggccgtgccgttcttccctgcgtcgcacgacagcttttctaacgaagaacgagtgcccaatgtgggctacgtgaaccttgttcggtcacgctccaagctgagttggcggagaatctcgggttagccgaacgccacgcacgcgcattgtgaatgccctaatgacaaatacaacatatggtgccctcccctttctcttctgttgggaaggaaaacaaagagagcgtaaatgtcacgccccgaacaagtcccgagcggaactagcccgtgacgctccaaattaacctgttaatcgataccagtcccaggaaacagtgctggtatcacaggaagacagaatatcacagcaacaaaggtctctttattatagagtaggagtacagtcatgttgggctgcggacagatcccgagctcacaactgcattacaaaagggaagcggaagccaagacttatgggaaataagtgtttaatgcaggcttcaaggaaaggctgttgttttttttttgcaattgattttatttgaactcttttctaaaacaactaggtgagtgcttctcaaacgacacggatgagacagtgcgactcatccggtcggagtatgtgcaatgtatcagtcttttgaattgatcaagattggcacccagccaacagctttcaaacggccacccgggcctggctgatcccatcagccgcagattttccaaacatcaatcccgaaccacatcagcaaatttcacaaagcagtagtcaaacaaaactacgctaggaatcacctcacatccgcccatgaccgtgggcacggctgttcgaacagtttaataacctctgcagagggggtacactttacccacacgacattactaacccggatcatccagcccgtgcagaacggccacgactagagaccttaaggctttcatgacaaggcatttcgagagccgacacaggttcaccatatgctgacgagaggggtcccagaccaacaacaggttaggtcccagaccatactgtgccaggaagcccaggggtcctccccgacaccaccccggcgaatccacttgtctctcagcatcaaggctcccctgtttagctaattactcagccagggatgtcccattccacccatgtggtcgtacttgtcttatgttcggatgaaattccaaggaaacggtccttaagtgcaaaagcgggaaaccgtacacccgatacgttccccggtccgcgattttggaaattcatttaggttcgcaagcaccgacccaggtgtcgggttttccaagtcttttgtaaaacccaagttttacccaagatgtttctcaaattttaagtttgaaggcgaccgtcgatactcgtgcagagtgcacgattaccgaggcgcaactaggtggttacaagggaacatggtataacaattacaatggaagggtcaaatgcaacaagttaggtaggtccgccaatctgccttgcagacgggacaagtagattaagtgcgatcctagcaatgcataatatttttcaagcaacataattaagttcaaatataggctcaagatgttcaaaggtggcttgccttgctcgatatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgagaaattttagaagttgaacggagtcaaacggacttacggttgggaagatattgaatttctaagattattggatttttggtctaaaggaaaaggatttatttaaatcctttttgaaaaagaaaagaaaagaaaagaagaagggaggggaattagactttcctcgggcggctagggcgcgacccgagagaaggggtggctcggccgagcttaatgggccggccgggccaagaaggcggcccaaggcgcgcgcgcgggcggggaggggagagagagagccggtgggccaggtccatcccgcgtggtcccaggtgggacccgcttgtcggcgactcggctcaccgtgagcgaggtgcacgcggggcgtgctagggtttggggagggaggcgcggcgcatgcgtgcggttcgcggaggacgcggtgcggcggagcgaaccatggcgatacaggcgaaggcgagtacaccgggacgttgcacaggacgaggggagacgagccaacgactcagattcaccgagggtgctcgacggcggcggattgcggtggcggcaatcggcggcgggagaaggggaaaacggcgatgaggtcacgaggggccgattcccggcggcgagagcatccacacggctacgggaatccaccccttacgccggattaggaggaatcgcatcgagggaggccggcaacgagaggcgcttccgagctcgggcggcgacggcggcgagcacacggcgagcgacggcagcagtcggggcggcgccggctagctacggggaggctatacatgctactaccgaaaactaaggggaagagatggattgaggagggagaacggggagatgcactaccgtgcggacggggcgcagcgacgatgggccgacggcacgggagcgatctctccggcctcgggccggggaagaggaaggagagggtgcgtccggagtccccttccgcgtcctaacgtgcaccgactccttcggcacacgtgacggtggcggtcggcgatcggcgatcggcgagacagaggggacgacaatggcgcgggcgaaaaacggggaagattgggaggggaaaaggaagggagggcgcctgggtttatagggcggcgatgttggtttggaaaccgacctaggacggtcaagggagggagctagcgctcgacggtcgcggccaaagcggcgacagggaggggaggatgacgccggcgggagggaaaagggaaaaagggggagagaaattgggcttgcctccttgccactttggggaaaaggaggagggagagggagcgatgcagcagaggggggcggggctcagcctccgtcccttggaagccagcgcgcggcggtggcggggccgggtcgatgacgacggcgatgacggcggaccggtttggagtggagcggcaacacgggcgacagacgcggggcaggcgcggcaggcgttgacggcggcggcgactggccggtcggccaccacggcgcgcgcgcacgcgcgggcggcgcggcgatttgggcggcatcggcgggaatggcagcgagagcgggagggagggctcggcgcggctcacggaagagcggggagagagagagagagacagagccggggagggagggggagatgggccgagagggattcggcccatcgaacccgagggaggtaaaatagacttttgcggagggatttgatttgggaaggatttggattcgggattgaactcgacaatagattggggatttgaggtctgagatggcacggacactagacaacaagcaaagaaacagatttcgcaactagggtttttaagagatagttttcccgctaagcgccacgacggaacgggtgctacagtaaaattcctttcttttatgggaaataacaagataggctcctactgtggtaatatgttaaaaagggaaagatatatacaaagaaaaagaaagaaagagtcaggggttgaacatttagaccggcgatgagcgctcattcgcatgtgctaccactgtgcaagtgttgtttttgtattagttacatgaaagttatatatggattatattatagttgcatgcaagcttatgttataaggctgtattcggtgggaagggctagaaacccttcctacgggcacgttaaaccaagcagtagattaatgcgtgcttaattaagtattattttgtcggtgacatgggaccgggagtatcatgactagaggcttgggcagccgcgatcacccacgtggcctgaccccctcggggggggggggggcgggcccgagggtgatgtggccacacctccctttgtctccccgaggggtcggactgctcccgtttcgaccccgagggccggggcgccccgaccccctgtgggtttgccgccacgtatatgggtta

SEQ ID NO: 65341 - DNA, 14549 bp, Oryza sativa
ttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaactggcaaaggggggcccgcgcggtctcccggtgaggagccccacgctccgtcatctggcgcgccaggtagggggcgcgtgtgtttttctaagctctcatcctctttcgtgtgcgccaagcttttcccgttcagcccaatggccgaacgagcaaaagcgcacaacctctctccgagcgctagcggtgacgacagcgagcagaacccgcgtcgtcgagcttgtactccgccgcccccctctcgccgaagtcttaggcgggaggaggcgctcgagggggtcgaaagatccgcgacttcgccgcccatgagtgatggagaaggacggcgagacggggagcgtcgtctcctcgtctacggtgatggcagcacgccccagggcgcgctccaggctgcgggcgcgctcctgcgtcacccgcccgtcgtccctgatcaagagactccaactcgacgttggctagatgacgtggccaacttggtcatgacggcgcagcagcgtttaggcgccggcgggcggtcctccgccaccaaggccactggcgctgctactgccggctccgtgtcgtcgaggcggagggcgcggcgagcggcggccgttgcccgccgttcgtccgccattccctcgtcaatgcctccgacccaagaagatgtgcgtgaggggccggatgcccgcctcaatatcgagcgccggcgcaatgatcgccgtgctgcccacgcatcggagggcgcttcctcgtccggagcgccacttcggtccgggcacggaggccagccccccgtgtccccggttggcggtgccggctgtcgagactttgtggcgagccttcagaacgtccgttggcccccaaggttccggcccaccatcaccgaaaaatacgacggaagcgtcaaccccgccgagtttctccagatctacacgactgggatcgaggccgccgggggtgacgacagggtcatggcgaatttcttccccatggccctgagaggacaggcgcggggttggctaatgaacttgccacccgcgtcggtccactcttgggaggatttgtgccagcagttcaccatgaacttccagggcacatatccgcgcccaggtgaagaagcggacttgcacgcggtacagcgaggggacgatgagtctcttcgctcgtatattcagcggttttgtcaagtccgcaacaccataccatgtatccctgcacacgcggtgatctacgcgttcagggggggcgtgcggcacaaccgcatgctcgagaagatcgcctccaaggagccccagaccactgcggagctttttcagctcgcagaccgtgtggctcgcaaggaggaggcatggacctggaactccaccggttccggtgtggcagcttcagccgcccccggatctgccgctcggtcagggcggcgggacaggaggaggaagaagaggtcggcccattccgacgacgagggtcacgtcctcgccgtcgagggcgcttcgcgggccacccgaaaggggaggcctgcgagcgacaaaaagaaggaggccggcgctcccagcagggagcgcccgaccggcaagtggtgcaccgtgcacaacacctccctccacgacctcgcggactgccgcgcggtcaaaagtttggctgagcggacgaggaagtgggaggaggagaggaggcaggagcgccgtgagggcaaggccccagcggctccctctggcaaccggcgaagtgaggccaagcagaaggtccccgccgaggacattgacgatggcaacgatgacctagggttccaggagcctggggccaccatcgccaccgtcgatggggagcatgcgctcacgtttctcgccggagcctcaaggccatgaagcgagagcttctggccgcggccctacccatgaggcgatgcggcgtgcgtggtggtcggaggttgccctcaccttcgaccagaccgaccacccgccgtgcgttgcccggggaggacagatcgcgatggtggtttcccccaccgtttgcaacgtgaagttggggcgtgtccttatagacgggagagcagccctcaacatcctttcccccacagcctttgacgccatcaaggccccggggatggtgctccggccgtcccagccgattatcggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcgacgagaggctcggcacctccgtccccgccgccccgaggcagcggatgatcacgtgcgacgaggtcccggtcaaggaggttgccctgggcgacggcccgtccaagaccacacgaatcggtggtctgctggacggcaaataggaagacgcgctcgtctccttcctgcgggcaaacgctgacgtcttcgcatggagaccggcggacatgcccggggtccccagggaggtgattgagcaccgtctcgccgtacggccgggcgcaaggccggtccgtcagaaagtgcggtggcaggcctcggaacgtcaagccttcatccgcgaggaggtggcgcgacttctggaggccggattcatccgagaggttatccatccggagtggttggcgaacccggtcgtcgttcccaaggcgaatggcaaggttcgaatgtgcatcgactacaccgaccttaacaaggcatgtcctaaggacccttaccccctaccacgcatagatcagattgtcgactccaccgcggggtgcgaccttttgtgttttctagatgcatactctggttatcatcagatttgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaaaacacgcaaccaagagaccttactctcggatctagcggaaactttcgaaagtctccgcaccgcccgcataaagctgaaccccgacaagtgcgtgttcggtgtgcctgcgggcaagcttctcgggttcttggtctctgcccgaggcattgaggccaaccccgagaaggtacgagctatagagcggatgcgcccccccagcaagcttagggatgtgcaatgtgtcactggctgtatggccgccctaagtcgattcatatcgaggctgggagagaaagcgctacccctatttaagctcctcaaacgctccgggccgtttatctggacggaggaggctgaacgggccctcactcagttgaaggcgtacctcagttctcccccagtcctggtcgccccggagccagatgagccgttgctactttacctggcggcaaccccgcaggtggtcagcgcggcgttggtcgtggagcgtgacgaggacgaccctcgctccgcgcatccccaccctgtgtcgactcgacccgggagagagcagggaggagaggcccccgagccgaacggtggcccaaggcccccgacggccggagctggccctccgcccgcttgtccgaaggtgccaggcgcccccgacccccgggatggccacggggccactgcgggaaggccgcgcctgtcgccttctgaccccgaggtcgtcagcacagaagccgagtgcgccccgcgcggcctctcggagcgtgacgaggacgaccctcgctccgcgcatccccaccctgtgtcgactcgacccgggagagagcagggaggagaggcccccgagccgaacggtggcccaaggcccccgacgaccggagctggccctccgcccgcttgtccgacggtgccaggcgcccccgacccccaggatggccccggggccactgcgggaaggccgcgcctgtcgccctccgaccccgaggtcgtcggcacagaagccgagtgcgccccgcgaggcctctcggacgaagagcgccctggagatgcggcccctagtgaagaagatcggccccgccgaaaggtgcagcggcccgtctacttcgttagcgaggccctccgggacgctaagacccgataccctcaggcccagaagatgctttacgctattctgatggcttcgaggaagttgcgccattattttcaggcgcatcgggtcacggtggttacgtcttaccccctcggccaaatcttgtataaccgagagggtactggacgggtggtgaaatgggcaatcgaactctctgagttcgatttgcgctttgaaccacgccacgcagtcaagagccaggccctcgccgactttgtggcagagtggaccccggccgctgagcccatctccgtccccgaggccagctcgggcccctcgcagctgcctcacaccgcctattgggtgatgcagttcgacggctccctgtctcttcagggcgccggtgcgggggtcacgttgacctcgccgagcggagatgtcctcaaatacctggtccgcctcgactttcgggcaaccaacaatatggcagagtacgagggactccttgcgggactcagagtggcggctggactggggatccgccgcctcctggtgttaggcgactctcagttggtcgttaaccaggtctccaaggagtaccagtgctctgacccgcagatggatgcttacgtgcgccgtgtgcggcgtatggagcgccattttgacgggatagagcttcggcacgtgcccagacgggataacacggtcgccgacgaactctcaaggctcgcctcctcgcgagcccagaccccaccgggcgcctttgaagaaaggcttgcccagccgtcggcgcgacccgacctcctaggggagacggacgcgcctgaacggcccccgaggcccgtcggagtccaggcctcgggacccgaggggagcgatcccagctcccttagattgattgcttggatcgctgagatccaggcgtacctcgcagataagactctacccgaggaccgcgaagggagtgaacgcgtccagcgcatctccaagcgctacgtactggtggaagggaccctctatcggcgcgcggctaacggagtcctcctaaagtgcattcctcgggaacaaggcgtcgagcttcttgccgatatccatgaaggcgagtgcggagcccactctgcctcacgcaccttggttggcaaggcctttcgccagggtttctattggccgacggctctcaacgatgcggtcgacctggtccggcggtgcagggcgtgccagttccacgccaagcaaacccatcagccggcccaggccctacagacaatacctctttcatggccgtttgctgtccgggggctcgatatcctgggtccgtttagatgggccccgggcgggttcgagtatctgtatgtcgctatcgacaagttcactaagtggcccgaggcttatccggtcatcaagatcgataagcactccgcacttaaattcatcaagggcatcacagcccggtttggggtgcctaaccgtattattacggataacggcacccaattcactagtgaactcttcggtgactactgcgaagacatgggcatcaagctctgcttcgcctcccctgcccaccccagaagcaatggccaagtggagcgcgccaacgcggaaatcctcaagggcctcaaaaccaagaccttcaacatcctcaagaagcacggcgactcgtggatcgaggagttgccagcggtgctctaggcgaaccgaaccacgccaagccgagcaaccggggaaacgcctttcttcctcgttacggcgcggaggcggttctcccatccgagctcaccctgaggtcccctcgggccaccatgtactgcgaggctgatcaagatcatcttcgcagagatgacctcgactacttggaagagcgaaggcggcgtgcggccctccgagccgcgcgctaccagcagagcctgcggcgctaccatcagcgccacgtccgggcccgatcactctgcgttgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcaaacaccttcgtcgtttctacccctagtaggggtcgggtgtcaggtctcgggctcgggccaaccccgcaccccccctgggcgtgcagggttggccgggggctaccacatgcatatacttatcttttttctcttccgtatttcaataaaagcattttcgatttcctaaggactgtgtctgtgccattgtttcctttcaaagagtcttggcttgaattagcatgctcgtgctcgaccctgccctcggtgtcccgggccggcggaaatcgccaaacagggcccagaatcgagccgtgccccggggcgtggtgaactccgggggggaatcggcaaaggcccacaatcgggtcatccataaccctcggtcaccacgttcccggcctggccagtctcgacacgtggatctccccaggcactagccccgacccgcgccatttgaggctgggacctgggcacgagccctcgttcaaaccaagacatagaaggaccacggcacagaccatcctcgtctcatacacacaacaaacagagctgacacaaaaatttcctctttatttgattgcagattaaattagtttgtacaagaagggggcccgaatgcctcggaagaagaaaggaaaaactatttaagattggcgggggcctgggggctcacttcgaggctcccgggtcgccggcctcgtcgtcgctgtcgtccacaccaccgtcgccgccctccacgtcggagtcgagggcgaacgcgagccgaggggccgtaccctcgaagctgtggacgatgtgatcggcggcgtcccggacctgcgcgcgcgcgtcgtcctcggttccgggagggaactcgtccagcgccgcccacggggagaagtccgggtccctggcctggtagcttgccagtacaagctccactgccccccgggcgaggtctctcgaggatgacttgatcgtctcctcgagctcctcgaggagccgctggagagtcccggccatctctgagaggcgctgggcgaggaccccatggttggcggcatatttcgcgatccgcccgccccagaggcccgcctgccgcccagcgcggtctagacgggagacggcgtcccgaagcatgccgggccctacctcgcctgccaagcggagggcctcgacctccccggcggacgagtccagcgcgccctgcagctcggcgatggtgtgttcggcagctgcgaggcgggcggctagatcgccgtcgcccgtggccgccccgccgctacgcgccctcgcatccagctcccttgcccgtgcctcgagctcagcggcccgctgatccagtgcggccctctcggcgcgggcaccttccagattgcgacacgtttgtttctccagcgctgcctcacgaagggcaggctgtccgccagcctttgcgccgcggcctcggcctcctcgagagctcgctcccgctcggtgagcgcatcctcgcggaggcggagtgcggactcctcttcagcacaggcggcttcgtgcgccgccagtgtagcctcccggatggcaacggcggcctcgcggtccgccaggtccctctccttcacacaggcgcgctcttccagcgccgtggcacgggcctcaagggcttcttcgcgccaccgggacgccgcctcggtctccgccgcccgccgtttccgggcagcagcggcttcaaggaccccccgggcggcgtcgagcttctttcctagctccgccgcccagctcccgtattgaaggcggaggtcgtcctgcgcctcgttcatcactgcggtggcgatgagggcagcctcccgctcctcctccacctccctggcgatctccgccagctccttccgacgggcctcgagctccgaggtgtgccggcggtgtgccttgcggcccgcctccaccatggcctccaccgagcgtcgcccctcttcgacacgtgcccatgcagcgtcgagctccgcccgctctgcctgcaggacctccatctgggcacttaacccgtccaacactgtcgtgttcgcggcggccaaggcctgcagaagggcctctgcgctcagtggggcagcggaaggcatgggggagagccgcctcggtgaggatgccgcacggctcggcccgccgatcgacgtaccggactcagggacgacccccggacctggcttgtcctgagcgtcgcccgaggggtcgggcccgagcggtgcgcccgcggcctcgtcgtgggtggcctcggaagtcgtcgtcgcctcgggcggagtcgggtcgggggcttggcaggccgcctggcgtgcgcgcgccgcctccgcctcccgggcggactcctcggcccggcggagtctggcctcctcccgagcggcttcctcagcccggcgagcccggacggcctcctgggcagcctcctcggcttcccgaaggcgatccgcggcttctcgccggtcagtttcccgtctccgggcctccgcggtcgccgtatcctcggcctcagaccggccggacttggaatggcgggaggggcgcgacgggatctcgctgaagcagaagaaaaaccagaagacaaacaaaacgggtgagtgaaaacttgcattgggagaatgaatacagccacagtgggcgcaggacgaacctgcgaggaggtcggttgaacgaccaccttgggggggagataaggtttccccggtatgattcggtcccccccatcttgcagagccgtttcttcttccgctccccctcgggctgcggcgtcggcgcggccccctccgggcgcctgctgctgacacgcgccgccccgccccctcggggaggagatggggagggggtaccctcttgcttcctcttccctcgggcgtcggcagggcggctgccccccgggcccctgtcacggggcccagaagcacgaccccctcctggggtagattgttctcccctgcggctcccgcccgcgccatcgtggcctcgaggagcccgctcctccgacgccccgaccgccatcatgatggtcaggatgttggcacgatctggatcgctgcagagggggaggactccttgggggatgagggacgcctccacggagctgagattcagcacccgttggaccactatcttgaagtcctcaggggcctagtcccatctgaccccttggtgggtcctcatgtagtcttcggacccggtgtactcccaggcgccccgggcgcgccgctggagcggcgcaatccggcgacgaaggtagtcgccgtacagcatggcccccgtgagcccctgggatcgcagacccgccagacggtcaagaacggcgtcgtagccatctcccagatctagcggcgcccgccaactggaggcctgcgctgggggctggctccgaagttggaggcgcgcttcgtcggcgaggggggtgtagaaccagtcactcttccagtcgtcccacttcttgcggaggacgcagggaatgtagcggctcagcgccggcccccgcggctggaagtagcagccaccaactaccgacggcggcgacactggctgtacggtgaagaaccaccgaaactgccgaagagatgggcgcaccccgataaacatctcgcacaggtgcgcgaagatggccaacgtcattatcgcgttgggggtaaggtgcgccatctggaggtcataaaactccagaacatccatgaagaaagaagagaatggcgggaccagccctgccattgcgaaagggaggaagaagacggaccgccccgggtagtgtggtaccgggcgtccctcgcctagctcgaccacctcccggccggtggcagatgccggcatgaatcggcgcggcagcccggcctgcctctcgctcacgatgcgggaagacggcagcacgctaccgtcgagtggtgcggagccccgtgccatgacgccggcggaggaggagcttgaaaacgagtgagtgcggcgagggtagggcacaggaaacaaggagttagggcgcaagcggcgaaggcaaggggaataatgacgagaggaaggaagcgaatctcttcctcggcgtctttatacccttgccaacgctatgcccggctcctcgcttcccgcgcccactatctcgccccctcgtttctcgcgcccacgtctccactaattccgctcgcccgtttgcggcgcacgaggcggatgtgcggctgtggcagttgagatgggacatatcgtgcgcgcgttaactacgctcgccgaccgaagcgccatcatcatatctccaggcaaaacgaaccggctcgtcccgattcgcgtgctactcgagtaatgtagcggtcttgaagagaccgctcattatagacagtcggttttccgttgctgatgtgcgcgatttgcgaccgctgggtttctgcccgcctgtagagaccggccccacctgtcaccaggcctaaggagtggcgtcacgcccgagcgcttccttcgaggggggcgatcgccctggcataacgccgggggctactgtcggtgacatgggaccgggagtatcatgactagaggcttgggcagccgcgatcacccacgtggcctgacccctcggggggggggggtcgggcccgagggtgatgtggccgcccctccctttgtctccccgaggggtcggactgctcccgtttcgaccccgagggccggggcgccccgaccccctgtgggtttggcgccacgtatatgggttaggtgagcacagcggggctcacctaaccgcatttattgcgggttggacgagcgcgtcacgccgcatgtaatgcagcgcagcgcgctcgcttatccggtccgtgaccgggcgcagcgtgtgaccggtcacagaccggtcagatcgcgggttaggtggtggcaggtggcctgttacacgcctcgccccgtcccgtcggattgatgagagcctccaggcacttgtccctagccggagacggcgtgccagctcctgaagatggcacgtcggtcccggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccggtgtcagataaaagtacgagccaaatcttgctcaaagtaggatgggtccccacccaaaagaagggtaggtagaaatggtatatgtggtatccccttgagatataaaaggaggaccatgcctaccaagaaaaagagagaaaaaaaagaaggagagaggggagctcgtagaaaggacgaggggaaaaagagtagggagagggtctctagagttcaaaggctcttgctcttcagctctttgtaattccttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaaccggcaaaggggggcccgcgcggtctcccggtgaggagccccacgctccgtcatatttaataaaacttttaaattctattaatataatcttttaaagtaacttcgtttagaatacttttacaaaaattaccattcagcagtttaaaaagcgtgcgcgtggaaaatcagaaaatagaagtttggaagagaacaaatcctaagttacatttgtaaatttttggatgagttttctatggaagttgtatatctagtccttattttctaagcccagtaattattgcagcagacatgaaataatgcaattgcccctgaaaaacaaacattctctggaaactcaagctgaaggcacatacttgcgattatgttggagtccaaagtgcttggatgcaaaattccctttgtctctactcgctcacgtagcgcttgctagcattaagaaaggactcgctgtacggtcgtagataagtcccccattccgcgttaaagcgttttcccgcacgggctgagctggtgcacctcccacgagccttctcatcccctccggcccatccacctcgtttcgctagctagctgctctccccacctatataacagcgagcccgcccaacacccgctcgccctcctctacttctgccgcgccaccaaccatccatcgctgacgcttccaacccaactgaattcaaacgaagcgaacaacacgaaccatgcaggcgcaatcccgcctcgctgctgccgcgagcggcggcagcggcagtggaattagcgggagcggtggcattagcaggttgggtggtggagcgggggaggagcacgaggcggtggtgagggagctgacgcgcgggcacgagctgacggcgcggctgcgggcggaggcgctgcgggcgctgcgcgggcaggggcaggccgaggccaccgctacattcatcctcggggaggtctcccgcgccttcaccgtctgcctctccatcatggccagcgcctccccgtccgcctcgccgccacaaccggacgagacgccgccggccgactcagccgtctcgccaccaccaccgcgcgcggcgagagaggacaacgtcccgcgaaagtgagttattctgcacgtgctatacagttatactggaagcataaataaatgcctagctagctagcttccagccgcagaactagtagctagctaatcaattagtacaagatcagctgggttaaatatgctataggaattgagtacgagtttatctgattcatcccgtgcattgatccacaggagattattgacagcctctccttacgacgatgggtaccagtggaggaagtacggtcaaaagaagatcaacaacaccaacttcccaaggtttaaattaatttctcaaccccgtgcctgcaggctagatatatcatataccttaacccatggattaattaatcgacaaccctgctcatgtcaaaatgctcagataattaaccatcgcgactactcgttttgtttttaaatgtaacgagattatggttacgaatttagatacgcatgcatcttctcttgtccagattcatagccataatttttatatttagaaacggaaaaagtatatatttagcaaaaatgggtaatttaccatgtcgttgtaaataaaaaaccaaggtgagtacttttggaccatgacggttctagctagctagagacagcgtataggagaaaaggtattattcgtgatgtattgattggactttgttggatagcgaaggcgtggcaccggggacggaagagacaaacggaaaatgtcgcttgacacgcaccctacaactttatagattcttttgagcagccaggcgaattaattgatcgccacatgtttgaaaccatccataaagttaagccttatcagttggagaaaccaaagttaagctgattttttttctgtcatgtggaaattaagctgttctgttttcttcacatgatcattttgtccctgtgtcacgttgtgtagcgcgagcaaataactgtggtttatctgcgtgtatcactgtgagctctctgctagtttaaagctggagtttgggttatattatatcggaagcatcttgtgacgtcatcacctaataattatttcttgtgatgtgacctcatcaggccagcttgctagctagccgccatgttcttggattaggttacctaattatgtatacagtacacgaatcttaattaaatcttaatcgtttgttatactgatgattcttcctaaacacgcaggagctactacaggtgcagttaccaccgggagcgcagatgccccgcgcagaagcacgtgcagcagcgcgacggcgacgacgtcccggcgctgcacgtcgtcgtctacacccacgagcacacgtgcctgcagggggcgcccgccgagcttcccgacgcggcgacgaacggtggcgccgccgccgccgcgttgccggactactttccc

SEQ ID NO: 65342 - DNA, 10092 bp, Oryza sativa
ccgggcccgtcgacgctgccggcgaggagctggacgtcatggactacgacatgacggacgcgctgttctgggggcctttcggcacggacagcaactcgtacgacggaaacctgacgtcgacacgctgttttgatctaattaattaatcaggcgcgcatcgatcctacatgtggttcggtcgatacatatgacgagtcgcggtgcgcatgtccacggctatcggtaggccgttggattcggatatactactactactactactactacattttgcatgaatcgtatactacgtacaagcgtactactactaatttgcattacgtatgtaccttgtgtgttgtaaaattaaatcaaccctgtgttgtgcaactattatgattgcactaggttatatgggttgcgtagttgattaagtttggtccggtcggttggagtggtttttgtatgcacacgtaccaatatgctgtacgtctcactgtctcggtgattctcacaccaaataggcaaagtgcaaaattagcaaaggctgtgtttagatttaaagtttagatccaaactttagtccttttccatcacatcaatctatcatacacacacaacttttcagtcacatcatctccaatttcaaccaaaatccaaactttgtactgagctatacacaaccaaaatacacaatagtgttgtatgacgtgtggctttccctatttgtcaagcaaatagcaaatctgatatacagtattgactacttgtaccactactggtataaaagcgttctcttttctctaaagaaaaagtgatttggatccagacctgtttttcatcaaagtagacatgtgtctaatcaaaagtactactctgtatatgaatataaggccccctttgaatcaaaggaaaaaccataggaattctagaggattttatcctatgggaaataatcctacagagtcctttaaaacaaaggattgtttcctatcaattcctttgaaattcctatggaatgaaccttactagagcaattttggaggaaaataagcatgagatctcacctcatgttttctttcatgtgtctaaggttcctgcgtttttcctgtatgctaaccaaacgacagtttgaagactttcctgtgtttcaaaatcccataggaatccaataagcgcggtactcaattcctacgtttttcctattaatatgttttctcaatcttgcgattcaaagaggccctaagagattatgagcttttttttttgttaaatgatgatggatgagagaataaaatagtataaattatgatgggtgaggagggtaataaaccaataaacctttcctcctagaaaaaatcaatttcgattatgagcttctttttagaagttaacgaagtagtaaaaaaacaaagcatggtacaaataatgatggttgagagaataaaatacaaaatatgatgggcgagggtaatacacctactcccagaaaaaatgattttctttttttcataaatgcgtaaaagaattgtacgtcaatatattagaagaaagcaagagtttttattacacaacacaatcagccagacatgactatgcctgtggagggaaaaagaaaaagaaaaaaaggctgctgggcaaaagaaaagaactactattcaaacgctactccaataatgcgggaagttggtggtagagccacactacactgacaataaaccctccaaaagcagcagctcctgcagaagaccacagacgactttccagatggattgaccccataaccactaagatcgaggagagcgaaagatcaaacaccctagagttctgcttcttctataactgccaagagatcaagaagactaggagccggagcctgcacgaagatgctcgaataggcatatcctagaagacagccatcagatctaaagctaaaaaaatactctttttgaaaaaaaatgataaatgagaagtagtaaaaaagataataggtgaggagtaaagcacggggtgagtatggagtatggagtagcagtaagccagtaacacaagtacccatcaaaccagaggcgtcgccaagataggtcaacgggtcggattctaactacagattagtgcatcatgacatgatagcctgaagacagaatttcctttctctgatgatcgcgacgattgccacagtgaccctatcggtttgaccaccgcaaggaatttcgctgcgcggcacgcctgcagcaaaagatggtggatggccgaaacggggacgaaaggcgacacggacaggtgagatcaatgtgcgtgtgaacccacgcctcaatcacacgcccggatgcccggaatcccgtggtaattaagctcgattaattaataacaatactaacagtagactactactcgtagtacttggggtaagtactatgggcatccaagcacaaaccccaaaatgccacataggactaaatagtgaggtggaggagagaataaggaagagagagaaatagtcaactctcatgcaagaggcaacctctatacaaacttcaataaacatatgagagtgttagagatattggggattgtgtggtagagataacctattatacgtatcacctcttaatttaattatctatgtcatgcatgaaattggatgtggtagtcatctctactataaaacttgcccttattacgttctccctccgtaaaaaaaagacaaaccctgaattttcgtgtccaacgtttgactgtccgtcttatataaaattttttataattagtattttcattgttgttagatgataaaacataattaatattttatacgtgacttatctttttaatttttttataatttttttaaataagacggacgatcaacgaacgttggatacataaacctaatatttgttttttttttatggagggagtaacggctatcagcctatcagcaaaagaaactactggaaggcaatatatacacggcagatgcacggatctgattagccggccgggtagtacgtgatttgaccgtatttctggcctcttcggccccaccccgctctcgcgctagcagcctgccgcctgccggctgcgtggctggctgggctggctcgacggtgacatcacgacgcgggcgtcacgctgcgccgctgtgggcaacgtcacccgtgtgggcgtcgccccgagttccccacttgccgccgtgcttcgtcaggcagcgctatagctgccgatggcgaagtccgcggatcgtaccgcgcccaagtgagcagaggaggcgaggcttcgcgggccacgtgaagttgacggatgagaaggcgatgtacgttcctccgcttccgattccgcgcgcgcgcgcgcgctcgtgcaaagcattgggcatactgggcggcccggtgcttgactgaaatcgacgtactgtacgtcttttttggtactgtacgtgcggtgcttggctggctgcaaggcgatgtgtgcggtgcggccttggccgggcgtcctttctctttacggtaaagacggggagacgttggctgtttagtttctaaaaaaaagttgaaagtttaaaaaaaagttaattttttttaaaaagtttaaagtttatgtgtgtagaaaaattttagatgtgatggaaagttgaaagtttagggtagttgggggtgaactaacacggccgctattgctacaaccacctccatcagctcgaggatgtgaaaacacacctgaataattgcatatgagcgatgatggtaaatgcgtatgctactacatggtggatgcatggatgtcaaaaaacgggggcgttttttgttctatgtgtttttggaaggccgaaaggtagatatgaatgctctgcggaaaaatgtacgggaagcaatatgatccgtcgccgcggcggccagccggccggcaagtcatccatcggctcatcgtcagacagtgatgagtgatggactgcgaggacggatggcacatcgccgtcgaacaactctacatcctgcgccgtggcgtttcttccatttgtgcttgggctttgatcttgaacggcgcggttcatacttcataccataccatgccgcaatggtcgccacgacaccgagaaaactgggccggcgcggagccgtcatatgtgtgcatgtgtggacgtcattcggactttctgagtttgtcctttggcttatcagtcagccatcaattgctacctccttacttatatatttttatatcaaacgtttgatcgtttgttttatttaaaaaatatttttttaaaaaaaatagtcacacataaatttttatttatgttttatttttatgttttattatcgaataacaataaaaatactaataataatttttttcaaataaaacgaacgatcaaatgctgaatataagtagtacaaaattagtatagttatttagcttacccgagccaagtcaaccaactgacccaaccaagccaattcattgttgtcaatgatagagcgtacacatccttagggtacccacaatggttatctataggctctctataagagatccatgtcagcatattttcctacttggaagagattaaatgaagagagagagagagagagtaaagctatctactaacctggagatagtctatagagaaaaaacgagacaatgtattagagagctatagatacccatatagacatactattgagatggtttactattaatttagtctattgttgagatgtacatgttttatagatagcaccttactttaccattgcgggtgctcttatttctgaaggcaatggaaacaagctagaaaccccaagggaaacaactaaataaattttaggataacttaactagttagatttcttatggtgcaatctaatctacttaaatttaagttttagacttaatacatatgctcatatttagaataattattctttcagcagtagacgacatacctgttgagagtaggacgtatcttgatttcgttagtctcaaaatatgcatgtccagttttcgaaggtactcatcgtgatagggtgaaagtgagagcacgcacatatataaacacctgatgtctgtagtgacttcgctatctcaaaatatatatgctggcctactttattgaggtgcatatagggattaggtgtgagcgtgtatgcattaataacagtggcagagtgcgcgcgtgtaaatgaggacttgtgtttttacggtattgaaaaaaaaacctcttgttagggttgtgtaactaaggaacagaaggtgattttctcaatgccaacctctatatatacagaggtgaactctagaaagggaagagactctctctcttttttttttcccacgttggttggttcaaccattttcccttagcttaagggtacacgtacctacttgttatttatgcaacaacaattggcaccgtctgtgggaaagatgtcaagaaatgttaggtatagatcagcgaagctcaaaggttgttatgttggacgaatgccgaaatgttcgacgaagcttaaaatatgacaaaaaccgatcgatatgatcgacaaagccgaaaatttccgacaaagaccggtataagatcgatgaagaccacatatggcctcgaaaacctattctctaaggcttcctccaatggtgccatgtaagctatctcataacatgtccacgtcatcatgtatcctatgtggaggaaagagaaggcaaaaaatcaatccatctatctcctattcccacgcctatctcgctcagttaccgatgccgtatgagcctgcgcaagagacaacagtcgactcttccacgccaaaatcagatcccgtgctcccttcccccaaattgccccgccgcacctcccgcccacccccgcacgctgcaccccgttcaagcccaatcccgcgcgctgcaattcgctcccccaccccctggcgcgccaatttgctctcctccgcgcaaatcctccagccacccgcgcgccaatctttcccttgcaccctccctcttttcttctccagtgtgtgaaatcttcctcgtcggcgtcgacgtatccgtttccacgagcccaacgacgaatccactcctcttgccaacgacgacgagctgtagagcaggatgagctgccggtccaaacgacaagtagctccgcggccgccgccgtcgtcgtcgccgccgccgccgccgtcgggatctgcgactgcctctaggtgcttcgatgctgcctcgtctgccttctttcaggccagtactgcaatggctcctcctctaggaggccaaccacgtactgtaccgtacactcaaacctgatggggattgtagtggctctgccttgcttgcttcctggatgttggagtagaacaataagctgatgatgctctcaactcctttgaccctgcatcctcagattggtaagaaaccaatttgcttgtgtgttgtttctgcaagaaacaagcaaattcctttttgttgagactatttagattgtagaattaataatgttttagcacagataggaaatgtgttgtttcttcctcgctcatagtcatgatttttggctcctgatatttcagtggtatggatatacatccacctggtggtttcctaagcatgttacaaactggccaacagccattagtcccacctcatgttttgttcccagcaacatggccacctatgccacctatggcaccagcaactaattcaggcactacgcatgctagatcaaggtcaaaagccaaacctgtcatcaacttagatgatggtgacaatgttaggactgctaagcgtcttacatgggcatcagatgaggacttgcggttggtgagtaaaattttagacaacttgcagggatttgtaccatcattctaaaactttactaatacataatgctaaatgtaggtgagtgcatggctgtaccactctaatgatccgatcaatggaaatggcaagaagaatgagagctaccggggagatgtagttgaattatacaacaacactacacctattaaccggaaaagggaagtaaagcatctcaaagatcaatggcaaaggattaagagatgggtgggatttttctgcgcctcctggaagaaggctgcattagtttatactagtggatattcagatgatcagttgagagactttgctaatcagttttatgtgaatgactatcctaacgaaggtccattcacagttttgcactattggaaggttcttcatgatgaacccaagtggcatgctgttttggaggagcttgaaaagccacacaagcggagcttggatgatggaagtgacacactatcacaaaaagatatcggagaaaaggagcgtccaatggggaggaatgaagctaagaaacaacgcaatggcaaaggcaaaggtaaaggcaaggatgatgatgacagtttacatgaagatatgaagaagtacatggatgttcaagctgcagctagcaaacgacatgaagagtttttagggactcagcaccgtatttcagatgcaaaagttgaagtagcaaggcttaggagagaggctgtcttgacggaatcatatcaaaaattgatgagcatggacactagtcaaatgactaatgagatgaaagctgagcacgtgatgggtctcaagatgttgagggagaaacttcttggcgatataatataaggtattttctgtcaatcaccatgcactttatttttagtcaatgttcaacaaatgaccatgtattgtaatatgtattcttagtcaatgtaccacaaataaccatgcattgtaatctgtattattagtcaatgtaccacaaataaccatgcattgtaatatgtattcttaatcaatgtaccacaaataaccatacattgtaatctgtattcttagttaatgcaccacaaataaccataaattataatttgtattcttagtcaatataccacaaattaatctgtaccatgtgactatatattgctctgttatattcagcctagcaaaacaatccagcactgtcctcctctgttccttctatccagtactattcttcctattctattctgcctcatttgttccttccatctagtccaacactgcctcatctgttccttccatccagtaaaacatgtcggatgagtttgacaattccatagacccagccgagatttacactacagatatgttcatggcagagcatagtgtccttaactcttttgccgggcggatcgacaaaaggattaaggccagattggaaggaggtacatctaggcgtacaagtggtccaaggaagtacatcaataggaaccatgaaggagcccatgatcaactatttgctgattattttgctgaagatcctctctactctgctgcaacatttcgtagaaggttccggatgagaaggcatgtgttcctacacattgtggatgaactaggcaagtggtcttcctattttacacatagagtagattgtactggacgccttgggcactcaccattgcagaagtgcactgcagcgatccgtatgcttgcatatgggactgctgctgacgctcttgatgagtacttgaaggttccccagagtactgctctagagtgcttagaaaattttgtggaaggtgtcgtcgaggtatttagtagtaggtacctgcgtcgccccacggctgaggatctcgagcgtttgctccaagttggagagtctcgtggattccctgggatgttgggaagcattgactgcatgcactggcgatggaaaaattgcccaaacgcatggaagggacaatatacccgaggtgaccaaaagtatccaactattatccttgaggctatagcttcatatgaccttcatatttggcatgcattctttggtattcctgggtccaacaatgacattaatgtgctcaatcagtcccctctgtttattgaagcaataaaaggtgaagctccccaaatccaatttgctgtcaatgggacataatacaacacgggatattatcttgctgatggaatttatccggaatgggcaacctttgtaaagtctataagatctcctcaactagagaagcacaagctgtttgcaagggaacaagaagggaaacagaaagatattgagtgtgcttttggggtgttgcaagctcgcttcaacatcgtgcatcgtccagcacgatcatggagccaaaaagttcttcgaaaaatcatgcaagcttgtgtaattctccacaacatgatagtggaagacgagggagaaatggcagaagatcctattgacttgaatgctgccccaggaacatcaattgttcttccaccagaagttcatgcagggagtaatgatcacccaagcttcagcgatgtgcggcgaagaaatgcttatatccgagccaaaccaatccatagtcagcttaaaaatgacttaattgagtatatttggcaacggtttcaaactaggcaaaataattagtcactgttatttcagtataatgtaagctctagtgtacaatttcattgtaattttatcttagactgactgtatttatcactttcacttactgtacatgtttttctctctaccggggcgaacagattcgatgtcttttacttgtttttgtggctgcggtccagcttttggtgatcttgttcaaggaatgggataagcacttatggttgctgtccagcttttggtgtttgtcgaactcttctatcacttctgtgacgtgatgcagtcttttttttcccttcagtttgctcttttccgcattgtactaaagtgccatgatatggctatgatgttatctggttgctgtagtggaccgtgagttggaagaattgcacttcattgttatatactctaagtcgatgttgtgctatttatctatattcacactatgctgagatgttcatttttaatcgacagatcttttgaatagcatcacatgaaggaccatagagatattgtgtagtttatcaccatgtcatttactacccatgctgccataaaagcaagaagagataaccttagagacagttgtcacgcccagaaatttagcccaaatttccagactattttgtgtattaaatccctgtccaggaccagccagggtacacaaaacgacaagtaatatacagttccaaacgtaaataaagcgtaaaata

SEQ ID NO: 65343 - DNA, 1621 bp, Oryza sativa
ccacacattgccaaactgttcaagaagctgcaagtaaccaaacgagttagttacttagtttgcataccaagaaagaggaaacatgcttgagtgtaaaggtagcaagaaaaaagagatggctaggtgaaacgaagatctctccacaagtgcacatatgctaatgaaaatacatacaccaactgtgccagttgaacaaataagattgccatcgtagcattactgtactcatgatttatgctaattttttagatcactggttgaaggcaaagaggagaatcagaaaagatgacactatatgagagttctgacatttataggtacaacaacaaatggttaacgacaagcacaagagccaaacatttcaatctctccgggtgctggtgcaatccaagaaatgcccactgtggcaaatcgaaaaatctgagcttttccaagtaacagaaaacttttatcttttatttcttttccatatatttggactttggatgcaagctactactaataataacttagcagaagtaaacacattttaacactagttttcctcatgcatctgtcttgtttgttttgttagaataacaaagcctaactactgtgtttacatttaggcatcccatcactagcagaagcaactctctgagtatcagtacaaggttaagtgcaaaacatgttcaaagtgataagttgtatgtaatcatactattgtctagagtatgtctctggtgcttgtattggcaaacacatgcatttgaaatcctaacagtcctgtagctgagaggaccaaagttacatgtctatataattgttttgtctcctgactatcaacttatacacaccggcagaacaagatgcactataacccgtgttttagacaagacaccagattttacatggatatttgggatgctgtgtgttgatgacctgaatcatctggttcagattgcaggatcagctactatgatgattgacacggcagggatgctgtcatccaatttttatccccagacgacatcagccaacaagtccccttactgatcaagttttctcattgactgtgacggctccatttaatctttcgaatatatgttcattttatcatgcatttcaataaaataccattttcttcttgttttagcttgttttagttcacaaggcccattcctcaattttcgaaattatctaccccaaaacttgctttttccaagccaaaaggcagtgaagtttcacagaagacagggactaaaaagacatgccagagtataatctagcctctacctatactgtatagaaattggatgaaatatttaagttcatccgtgacaaacctctgtgtggagttttgccataggcatccattctccaggaccacagaggtcagataacactgttgcaacagatgacactacatccttttcttctgcttgcaggatgtgctggttatccatatccctgtcaccccttgatcttatttctgatctgctgtctgcacaaacaattaacaaaggaaggtggttaagatcagatcaaactataagatgtttcttcaatggcacagctatgaataaccagaacacacactaacagtccccaaagttgaatattcggagttggaaactggaaa

SEQ ID NO: 65344 - DNA, 5390 bp, Oryza sativa
cagctatatttagtgatcgtctgagtgatcaagcaaaatcgcatataatttatatcgaaacagcaacgccatcaatgcagaatcaacatgtactatcttttacaagaaaacaatgacaccaggataaaatggaaaggatatctagtaagagtggagagcaacgattaccaccttcaccgagtgtcccgattgcttcaacattgatccggtgcccgccatacatctccgactccgcggacagcttcttgttcctcttaatcaacttccccctcatcccaccactctcactgataccattcccaatctcatcaccctcccggccatagtcaccctcaaaggacctgtcatgaaattcagacagacgagggcggcctgtccgcacataggatggtggaggcatctgctgcgggatgataggcggatgccgagcagcggcggcggacgcgaagatggaccgggtgggcagcaagaagtagaacttcttgtccccaatctggagcagatcctgggaatccagcttcacggggtggttcccggggaggtggaggacgccctcgacgaggcacccgttcttgccgatcacgtcgagcgcgaagcggcggcgctggaagtcgtagaagatccgggcgtggtggcgcgagatgttcatcccgccgccgaggctggagaggtccacgtccaccgtcgacttcttgctgttgcgccccagcatgatcgagtaggtctgcatgtagtactcgaaatcctccccctggagcttcgcgaacccggcctccacctcgccgtcgccgcccgaggatcccgccggcatcgcgccaccgccaaggttggccatccaatccacgaaatcgacgaaatgatcctgagcttggcgtggcgttcgggcgcgggcaaggcggccggcggaggaggggaggctcaccggggtctggagtgtccggcggagggggcgcggctgcgtggcggcggagggaggcggccggccgccggcggcggcggcggaggatcgcctgggttggggaagtggggaattgggggacagacaggtagatggagaaggggaacactcacaggacaatcggattatgttttactacctctgtcttaaaaaaaaatctccaaccctaatttttcgaggtgaatataaaagaaccaaaatacccctaattaatagcaaagttatattatgagtgggtaggtgagggttactgaagataattttccaaggtgaatataaaagaaccaaaatacccctaattaatagcaaagttatattatggggtgggtaggtgaggggtattaaagattattttccaaggtgaatataaaaggaccaaaatacccctaattaatagcaaagttatattataggtgggtaggtgagagatattgaaaagataaaattctcgatttacagatcgatgataggcaaaaaggtagaaattggtttatttgaaaatgttataaaatatttatttaaaacagacggcaatcttgcttaacagacgacaatcttgcttaatcacttaatcatttaatcattttgtaatacaacgaatctgaataaaaagtatctcatacttcatccgtttcatattataagactttctagcattgcccacattcatatagatgttaatgaacctagacatatacatctatatgaatgtgagtaatgctagaaagttttatgatatgaaaccgagggagtatatctctaaggtttttttttctgagattgagggaagtgtctcatcaatttctaagttgattttgttagaccaagggaataattagcacgatatcctatgcaatctattatatactagtataatttttgcatgtcaaatataatcttgaatatcctatgtaatctattaggctctatttgagactgctgaaattgaaatgatctaatttttctagttgtctgaggagtcgaaatgttgttttagaataccatatagtttcttttacatgaggcataagcttagaagcgtgtaaacgaaaattcaaagtcgagaacacaaaaaacacgaccataattgaatacattgtatatttatcccgctgaagtcaaagcaacgaattgtcccctataaaatgaaacaaaaaataattataagtggtaaaattgcttgcaaccgcacaccctaacaccatattcgcacacatgtgagtgcgctctaataagaacatgtagttataatgacgaagaccaatgataactctcttatctcagtaaaatcttattagcaaaaaggcatatattttcttaaaaaacattggacaaacacatgtattcacaacacacacgtactcatccatacgaacgtatatatgcacactttacctcccaagcacaacaactatactgatatatattaagatttaagattgacgaactcattgcatatatctctgtattgacgggtacatcgtttaccgctaaacattaattagccataaatacaaacaaccgtgggcaggtttcaccgccataactactcccttcgtcacataatatgagggattttagagggatgtgatacatccagtacatgtttagatttttagtaatatgatgtgttacatctcttcaaaatcttttatattttgggacggaggaagtaataagtatcttctgaatggatttattttaagtgtatttttaaggaaatgatgcgttgaaaaatgccaagcatttcatacagagtaacacccctattgggaaaaaaacgtttttcgccaaacatcccctctctctctctaatgtaatccaagagaaaaattggataaacaaaacgacgataaaataccataatgggattgagagggaacatgcagccctatcatatcgaaggaaaaaagagaaacaatatactatttgcaaatgaaaaaaaaaaatctgtgtataaaacttatatacatgttcttggcgatataaaattaaggcccctttgattcaaaggaaattcataggaattttagaggatttcattcttataggaatttttcctacaaagtcctttgaatcaaaggaatgaaccctatgaaatcctatgaaattcctatgaaatgcctcttcccatataagttttggaggaattttaacaagaggtagaacctcagggaaaaaatcctttgagtctttatctctcctaaaattcctgtgttttttctgtggtacaatcaaacggtcattcctacgtttttcctgtgttttgcaatcctctgttttacaattacattcctgtcaaaaccctatgtttttcctattcctccgttttttcattcttgtgatttaaagatgccctaaaggttaaaaaataaactacgatgagaaaatttcttaaattaacttcaaatttaacattaataatttaaattttaaccgacaagtataagtataaatgaaaaaaaagtgagtccggtaaaatgtggttatcaaatcataattggaagcgcaacgcgaaggagagacccgttgccatcggtgtgtatcccacgaaggaacaagacgaacgccaaggctcacatgcgacgcgacattgcctacactgtgtcacgttcgttgctactcctccttgctagtgcttaccacccctctccctcctcctcctcctcctcctcctctccccttctctcctctcctccctctccgccgcgcgccggtcgccggagtagcagggtgactgggagggattcagcgaggcaaaaccaatgggggtgctgggggacgggtcggggtggtgcttctgctccggcggggcgaagctggagcggatcaagaactccgtcctcgccgccaagggcgccgccgtcgccgccgtctccttccccgccggaggtggaggagggggcagaggtgggagtgggttcctcatccaccgcgccctcctgctcaccacgcacggcaccatcccctccgccgccgccgccgccgccgccgaggtccgcctcagccacggccgcctcccggctcgcctcgtgccgcagaggtattgaaccccctctccgccatttcttggatttcttcctccgcttcctataataatcctattgggttgttcaaatgcggtgcccaaatgattttacattttttttgtggtgggtttgcgggtttcgaatggaatcgattggtgctgcattgcgccatgagaggattcggttttgaaacctaatgcgacgcctttagcattttttcttttcccttttgggttgcacgcccgcaaggattgctagatgtttgtttgcactatggtgtagagagatctaattttcatcattcgatgtaaagctgctgcaattttgttcaaaatcaaatgaatctagtctttagggagttcatgagatagtcattttgggcttctgaattacaagaaaaagaaaacttttgcttgctcgaaagttcaggacttggggacattgtggtggggtggggttgacttccatatggttcatgatactatcatttggggcttgttaccatgggacctagacaatcttgatgttattaatgcattctgttattgtagcatccgtacttttgtagtggggataatatatttcctttgtttggtcgttcaggatcaaatgcaactatgtacaaataaatttatttatcttcttcatacgattttggtggatcaccgaacagatttatgagccagcagatgtatgtcaggaagcattattgccattggctgagtaaagtcaattttgtgcaatagctgcgagaagcagatatagcatcgaggattacttcacatctttgtacaagtagacataaactctattgaattctggatgcctgactagaaaatttaaaatgggaggcaatatttgctgaaagtggtccatggttcaatttattcacttgattgctgggcataggacatgttttaaatgcattctttgtttctttacacaaaatcaatgtagggtcaatctggatttctttttgaacactttatttattgggcaaccacccaacattcgaaacttaattgtaataacaagaaatgaaaaggtgaccgtatagaactggaatataaataaatgtgctgtgcatctctattgcttttagagcgggaaacttagcaagtttttactctgaaattttggagtactgaaacatttatttgcccaagtgggccttttatttccatcttttactatgaaaatttacagttatttgttttgtttcattattccagattctttatcactagccccattttggaccttacaatagtgggtcttgatgtggtgaacgatgaattaaattcacacgggcaacagcctcatttcctaaagacctgcctgaaccccagcttggaccttggcagtacagttttgctcctgggccacacaaagagaaaagacct

SEQ ID NO: 65345 - DNA, 5031 bp, Oryza sativa
ggttatcgtgcagcaagctgagaaactccgcatgccgggttgctcatgggcattcaagaacgctgtgggcgccgttgcccgtagcaatgaaggcattgtcaatgcgaggatggagttcttgagcagttctcttggttgctccatggaaaagctccgctctgcggtctgcaagtgtccacaaattctgggattatctgagagcaaacttcacagtaaaatagagttcttggttggcaaagtcggattggagcctgactacattttgcagaggcctgtactgcttacgtacagcctggagaagcggttgctgccgaggcattatgttgtagaagtccttctggtgaagggattgataaaaaaaactgttgatttttacggttgtgtatgtgtgagcaacgaagattttgtagcaaggtacattgatcaccatgagaatgctgttccagggctcgcagatgcctatgctgcagtttgttctgggaaattgcctgcgttggtctaactctacatcttcagacagagatattggaggttcatcagtggaagtgccttcaaagtataactattagcctattttgatgggcatattggagatcaattatctttcaagcctagagctattgcaccaatttgttctctgaggctcattagttgatgttaattcctggtaatgtctgttttgaaattctggtttcaacagtaccactaccaataatttgatcgctcataatggtaggcaagtttcaatcatcgatattatgcagcaactggactgttttaatgttgcggcccttacttctcatttcatggatcggtacttcaacagctatttccctgttcaggtactttgagcaaacatgattttggtctcattacctgcatgttgaggtttacattgctcggtaggattattggaaagtataacgcagacatcaaactgcatatgctatgatatagtgtacagttgttgtccaagttcagtctaaaccattcttgaatggtgaaataccatgatggattgaactgtagtaattatagacgagaaatatcatgacatgctggcaaaatgaagggtgtggggatatgataattgataagggtgatttttcaagtgtctttttcagtctctggttcatttttcattggctatcactgaaaaagcatctatgcatgtcatattgtctctaatcgtactgtcatttatttaccactaataagccttctaattatctacttcaaaattacaatatgttaaatttgatgcttacaaggttcgctgaacgctaaagctaactaagtgttcattggatgcctaccacaattacacctagacaattgatcaggaacaggtgtggaagatggaacaaggtgatattgccttggttgctgcaacagatggctgccactccttgtgttgaagcctgaaggcaagccaaaaaataggccaggccttctgcggagatgcctgaagcatcgaactgcagtgtctcacactggttttgcagtactagcaggttaaaacaaatcttccatcctgcagccggtaggattgaaaaggtctcataagtaatgatgagaagttttgaaatagcgtaaacatattaaggggtggcgattatgtgatgttgtcagactctacgaaatcagtagaacatcaaggctttatggttgatttgaagtcgatgtggttcaacttctatccagatcaagtgaagggctttctgcagcattctgagaaacaaccacagattctactctctcttttttttttcctgatgagaaactccacataaagataaagagttcttggttaccgaaattgggcttcatggtgaggcctgcaatgctcttgttcagcctggagatgatgctcttgttcaacctacacaagtggttggtgccaaggcataatgttgtggagttgttgatggaaaagatgttgacttgaactataatctcttctggtgagaacgatttcttagcaagatacattgaccatcgcaagggtagtactgttcatggactagcagatggtcatgctgcagtttgtgctgggaaagtgcctacaaaagccctagcttagcatatctggacctagatactggaggttcattccatctttctggctcataggctcatagctaagacctcgctgtaaacctggttgagttaatgtaattccttgtaatgtcttccaaatcttgatttagtattatagtaacaactaactatcttatccttcttagtgctatgcaagttcaattcgtggagtatgcagcaactttattatcttaattttgatgctctgctgctcctgtgaatatgtgaggtcttattgcttctgccattttgttcttgttctgataattttccaaatgtcattttcgcttcatttccctgttctctctagattatttactggattgtttgctctgtgctttgaaaaactatgttttatctaaaaaaattctactatattgcttagctcatttcttttaagctagtacttattaagtttgtttctcaaaatatttaatttatccttacgatcgttcactggaaagggattatgtgtgtgtaagatatttgtgactagtttattgaatatattttgataatatgtttgtttgatgaaaaaatattacatatttttctataaacttggtcaaacttaaagaagttcgactaggaaaagtcaaatgagtccacgtatcctaattgagccaggccaacacaacatgaccaaacatctcactagaccgtgtatgggctctggtattagcacgtgggccaacacggaatagtccgttcggtgagtcgtgcctaatcgggcagcgcacaaacgtacctattatttatccctatactatatatagaaaaaaagataaaaattcaccgtctcaaaattccagccacatgagctctatttgaaaaatgggattaggacaaatattataaacgcccagtagtgttccggttagctctatatgatggtgggctagctagcctagattcgaagcctcacaacttcaattcattttatattgggccattctatagtatattcgcgttatttaaagttattattttcatgtttcagattttcaccaaacatgtttgggacctttgggtaggggtggggatggggcgaaattactaaagtaccctcgattttttgacgcctctgtcgtctcgtcagtttgcccctgcccagttgcccaccgcctccggctccggcgatccccatccatccggcgagcgagcagggcgccgtcgttcatcctgctgcttccgccgcatccatcctggtgagcacatcctccgccaccgccgcctgcgccgatccccatccatcgcgcgagcgatcgagcagggtcgccgtcgttcgtcctgctgctgctgctggtggtggtggtagaggaggagttgacggcgaggggatcgagagggagggagggatgcggcagcagcggggcaggggcgtggggcgtggggatcccgggctgctgacgagggcggtggagaaggtgttccgcctcgtccgcctcgccgagttcgagatcctcttcgtcctcttcttcctcatcgccttcgtcctcttcaaggatctcgtaagtgcgcaccccccctcgtctctcttctcgcttacacatttcacctctagtaacaacaggttatgtttagttatagagataggttggttcgtgaccgatttgcatggctttgatcaatttggtacagcatggccttgatgaactgaaaatattagaagatttgggtattttagttgaaggtgaactgaaaatatagaagattgggtattttagtagatgcaaaacactactgttcgatacataattttaaatcttgtttgatgttgccgactactgttcgacacataacttttgttttatgttgctgtatgacaagtagattaatggtgtttttgtcgttggtagatgatttctctataaaaatgtaaagataacctttcatgtgtatcagcgcaggggcggaatcaggcatggggcagctagggcttgggccccatgcctagctccataatccctattataatcttgaaaaatgctatgtaatttatgaaaatatttgagatcccattagctcagccctaggcgtggaaattttctggcaacgccactgtatcagcgtgatattttagttgttgccttgatatgcccgaatagcaaatcatgtccattttgttaaaccttgacatcaagtgtactttggatcatagtcttttaggtcttttttgggctggagttatgtcttctttaactattgaatgaatgaatttacctgcagatgtcacgaccagagtacaactcgatctttgtcaagaagcctgatctagatgggagatggccaggactcatgtaatgtttgtgtagtgtgatcaatgttgttctttttcctcttgcccaaagtacacttttgaggtgcttctttgacttcagttcttatgactactaatgttatctttcaagatgatgaatatagtttttgatgaattgccttctttggttttctgaaagaatcatttgcttaatgctattggcatggtttcttggtatgggtcttgattcttcttgtttgcaagcttaccgctggaattttgttaagtgtcatgctgaagttactgccaacagcccttgtttgcaccatgttgctgtccaattttatgggtgaattgtgatagccatacccatcagtcctgagagaagcttggtgtttgatgttttgataaccttgcttcttttgttaaggccctgtttaaatcccaccccaaaatttttcaccctttcacatcgaatgtttgaagacatgcatggagtattaaatgtggacagaaaaaaaaaccaattacactgtttgcgtgtaaattgcgagacgaatcttttaaggctaattgcgccatgatttgacaatgtgttgctacagtaaacatttgctaatgacggattaattaggcttaataaatttgtctcgcagtttacaggcggatta

SEQ ID NO: 65346 - DNA, 1441 bp, Oryza sativa
gcggtcagtggcccgtccactcggcccctcctctttttaactctctctctctctctctccggccgccaccccctcgccgcgccgacgtctcgcctccgccgcctcgttctcgttccgatggctagacgcgtcagcaccacccgcctcctcctcctcctcctcctcgtcgccgccgcggcggcggcggcggcggccggagaccaggtcagcattccaccctcgcctctcctcgcgccccgcgcaccacctcttgtctctcgcactctatctaaaccctgcgtcgtggttcatctcctttctccaggaggacccgcgtggcggcggcgacaacggcaccgcccgcttggatcgccgcaccaaggtgaggagctaggacccgcgcgtgtgcgtctgtttcgatgtccggattctgttcttggagctgtgggggttggtggtaatctcatcgaggcactggcgatccccgtcacagatgttcctgcacgcggcgcgggcgagcgacggcggcgccacggggatggagaaggccgggctgggtctcttcgacgccttcttcgctagcttgtccatgattctggtcagcgaggtagtaggtgacatttcgggatggaaattaattagtcttactactctagctgctctgaatttgcttttttctttttgtatctgtatctgtggagtgatcacttaacttagtgttgcttgtttatgcattgcttggtgaagattggggatgagaccttcatcatcgccgcgctgatggcgatgcgccaccccaaatccaccgtgctctcaggcgctctgtcggcgctggtcgttatgaccgtaggtgaaactgcagcttgcagatgcagcggttgtctgtcaaggcaagattgggctgcagtgtagagtctaactaatccttacttggctctactgttgtagatcttgtccaccgggcttggcagaatcgttccaaatttgatatccaggaagcacactaacagcgcagcaactggtatgactgatctgattgctacattattgcgccgtgataaagcctagtatgaagtgatgtgttagatttttctattgaattatgtatcacgagcctggaagtcggagaaaagtgatcgaatcatcataataaattaagtggtatggttaattgctccaaaagcatctacagacatacaaacattattaagactgtagtactggatttattgtttcaagttttcgtactatactgctgtgcactagatagtcagcattgccatagttatcaagggaccattgtcagaaaatcagatgttacagtttcacagtacatcacatgaaagttcagacatttaggcatgcacccgcattggctactagttgcttcaaaaacagtgtcccttagatatagaaacaaatagaagctgtttgaaatctcatgctacggtaattaaagata

SEQ ID NO: 65347 - DNA, 11710 bp, Oryza sativa
tcacaagtccattctaccatctctgcttcaaaatgcaattccaaatacttgtctattgatgcagagagttgataccctgcgcgttatcgcaagaaatgtcactactccgacttttcctaactactactgagaaagtgtcagtcttggcttctgaactaacttctggctcactgaacacatcatcaagaacagcactgacatttttccctacatcacttcctgattctatccatgcattctctttccttagtgaaggccctatatcttctggaacatgggcatctgtttttgtcaaatccatttcctcaactttgacatcaggtaacatgttttgaggaaggaaatcaacagtctccccttggaccttatccttctgagtctgcaaagggcgacatacagcatccttgctatgaaagatctgttcaactttagtagaatctgcagaatcaagcatataattttttttgtcctcatcagtatcttcatgaaatcagcaaccatcattctctacatggtctgaaatacagtctttatcctctatatttgattatttgaaacttcttttcttcaaggatttctgtgtactttaagttaaccaacaatttggagcaaaatttattatatgaagacaaggagaactcaaaaacctagagctatcttccagtggcaagaataactactgcactgtaacatacagctatgacatgctataattgcagaaacatcctgcaggttctaatatttctgtagtatatttaacagtcaagccattaactctttccgaaaaatgccctttttcttatattgagcaaaaactaacaaataattgtggtaatatcagagttttctgcattcactcaagaaaaattccatgttctgagacacccaacatgttgcaggcactgttaaaaaaaatgttgcaggaatgttgaacattgttttcctttcctttcattaggcacaggagcacataaacttaccaactttcaaaggctcagaagttttcaccaataccacatcttccaattctgaaggactttgagaatcactgtcttcagcaatagtatgaatcttttctgggttacgcttgtcaacttctagttcagcatggatcttctgttgagatttatatcctttagtcctcggtggagatgcaatacttttggattgagttggtggaaggggcaccgagagatcatggaatgcaacatgtgaaactgaactaaatgagcaacatttacacgatatgtgagaagacagctgaccaccaaaaatggaatcagtaactgtaggagtcactgcatcatcttgcatgttaggaggatttgtccccctgtcctcctcatccaatttttttcgcaaacagcaaagcaattcatggttatcttgcataaaagctcctatgaaccgtgagtccgacttgcgtacataagccaagagccaagtcatgtccagcaggcctcctgtattgttcacaccgtatgtctgatcaaaaagatcgtacagtattgtaccaagggtccccagtggagtgtccggtcctaacatccttgcccgcagctttccaagcacaaggaggcactgcaccaatgaattcaagtagcaggtgtttccaagattcagtatccctttgatagcatgggcatgcccatcagctaacccagacacatgtgacctctgtcgtaggctttcccccatcatcatccttaacgctgatttcgctgggctctcttcgcgcggcaccccattgttgtcagtcatccccccatcatcatccttaacaccgatgtcataggcttcttcacacttgaagcagtacacccgattcaatctctcatagtacaaagcaatcgaatgctcttcttcgtgcatggcgtggatacaggcgtggttggcgcagaggcgcaactcgcattccaagcacaccatgatatcgttcgccgcggtgacgtcgcaggtgtaatcaccgcacaccgggacgtcctcggagaacctgagccccgacacgatgtaatcgacgtgatcctggtcagacatgaagtgctcgcaccgctcaacgccggtgccgctggcctccagcaacatcgcctggaaccactcagaatcgtccgccgccgccgacgccgacgcagccggcggctccaggcgcggggatttccacgggctcccggcagtatccgccgcccttgccctcttcccctcttccatcgcgtcttaaaccccaattcaaaccctacagattagcgagatcaatcaacatagccaaaaaaaaagtgagaatccaccaacaggatcggaaatcgaacatgaacagcgccgcggcgaatccgcacaccaaaaaaaatagaaaaaaaaacaccaacacccaccgatcaaaccgcccatcggcgacgaacagcggggtttagggggtgtgtggaaatgtgggaggaaacttaccggaagaagcgaggaggacccggagtcgactagcgccgcggggtgaggcgtccgcgacggcgacggcgacgacgacggcgagaagttggaggaggagaggagggggggagagcggcgaaggcggcgtcgctggtcggggacggcggcgctcgggtgggtgtatattgggctaaatgggcctaggtggccgtcgtgagttcaacggagcccatggaaagtatatatttcctcctgtaaaaaatgaaagtaaatttcgaaatgtcacgtatactaccttcgtcctaaaatggtttgaccacggatattaaaaaagtaggtgaaaataatgaaggaaagttgtgattagttaagtagagaaagtagatgagaaaattagtggataatgtgtgtgattggtaaagatgatgacaggtgggtagataaatagcttcatttttggaaaaactactatgctagaaatagcatttagtatctttttaatagaaagcatgtatatactcatggcatataaccgcagagtttatgatatgtgaaataatatttcaaagtaatagagagttaacccaatcatctgaattttaaaaaacaaataatttaaaattctgtagacaccttatggcatgaaaatttaattaaatatattatctggattatatgggtgtggattttctggaatcctgggactataatatcagaaattcagggttgcatgccacaagttatactaaggttggattatgcaactttaagttatcttaaatttacttaaaagaaccctctttccagaattccatgttctcctttttatgcttttcttttccaaatgaggttcagttttttcattcgtgatgtcaggccaactcgattgcacaacacttgggcaacaccaacgctataaattgacacctccaagagagttagttaaaaacaaatcctcctcttgattgcttcagaagaacagcagtgatgcaaacaaagcaaatgtccatctcatcatcaagacatcagcggagcagtagggtctcatactctaattgcatgtcacattgtatccattctttcctttcaaaaaaaaaacattgtatccgttcagaaaagataggtccaaagaattgctcttgttatctctactacttctcaagatatatgattgtatctgaatcatcttgcatacaatgtatcttgccatcacaaaaattattgaggcaaagctcaaggtataaaagaaaatgtgttcctgattttacagtactgtaaagtaactacaagtaacagtaacatccgacaaaattgtaccagtgcctatatattcatcttgctcaatcctctaatgcaaaatgtccaactttgatgttttcttttcaaatgaattcctaatatcgtcctcatggacaaaagagaagtggaaataatcagttgttcaagaacaacccaaatctctcaactggtatgtacgtgttgcgctcatgcaatgactcagacaaaagcaacgaaattcaacttgatcacgagcctacgtcagtacagtatgtacactgattaaaattgaatccttcgtgcccaaataatgcttgataatctgaaaacatctgcttcctttgtgattgctattctgattagcagctggtggatacaggattccagacaccttagccttcaatcctctcatagaaaagaaggtaagcctcgcgcttgagaacttcttctaaagagacttctgtgatatcggtatcacttgcacgaaaccatgaggaagagccattggtctgctgcggaggactggtctcacataagcaacataatgccctgcatacatgctagggcccaggtgctcaacaaaaccaactagacgatagcgggaattatctctgtcctcagagctgaagattagagaaaataaagatgatcagagcagatctaaggcttttaactcattatagctcgatgtaaataacagaacgcctgtccttgtaactgaatattgttagcgagatatctgtcagttaaaaagattggtatgattcatcttaagcaaatatccatgatgttatgataatctctgaataaacagtcataatttcaacgatgcaatggaaaatgttaggtgggcgatatcgttcatacactaaaatactgaaacaagaacagaactatatcgaacagcccggacttctaacaaaataaaaaggtttccaggttagccatttgaaggcacacccctaaagaaaaagagctaaaagcttctagcctagagttaatctaaggatgtatgatctgatctgactgtaaagggtaggcaagagcaagagagtacaatcagatcgggatgttaaaatcacccaaaattcaaattatttgattacccaaatcacaattaaattccccaaatgtagcagaatcattcacgttgtcaccttgtttcgttgtaatcatttcataatatcagcgtaacaattgaaatttacttgcaaagggagctagacagccatcaagaagcacaccatttcttatttaactatggttaattttacaggagacatctagaatctagattacaacttgacacaccatacaataatccacatactcatagcaagaaaacatgagaaatggactaaattactttgacctgcaatgctagtgtcatctgaaagcattcttttaggggagaagtgtaaaacaaatgggaacaaattgagaaaaataacatttatcagcttactacaaataagaaacttaattacacgggcatagaacaaacagaaatctaataaacatcatcagtcatatgttttcggaaaaaaacagatgcagttgtcacttgtcactacctgggatccatgaactgccccacatcaaggatttccttaaagctcacatgtcctatcaccttcgttaaatcctccaaatatctcatcagatgaatggtcaatacaggtggcaacttgcgaataagacgtgtttgaatgggacattcattcttatctttctgctcattttggttttcttccacttggtgtgcactcttctctaactgttcactctggtctccagctgttgtgtcctccttagtacttgacatgatgcctggcttcttaagaactttggagcagttctcacaggtccattctatctctgtttcaagatacaattccaagcatttctcaatcgatgcaagagagttatatcatgtgccttgtcataaacaacatcgctaatctgagttttccccttgtcttttgtagtaacttttgtgaggaagcggtcatcttggcttctgtactaacctcggttgaacagcactgtcatttttctcttcgcttagtggagaaacaaatgatggtgaagcaggatcttctggaatgcggggaaggacatcaacaacctttccttggaccttatcctttctagtctgcaaaggaccacctgcatccatgctatgagatatctgttccactttggtagaatctgcagaatcaagcatataagtttttagttttgtcctcaacagctacttcctgaaaccagcaatcttcattctctacatggtttgagaacctttatcctctacatttgattatttgaagcttcttttcttcaaagatctccacatgtacttaagttaaccaacaatttggagaaaaaaaattattatacgaaaacaaggactcaaaaccccgagctatctccccttggtgataattattgccacacttgtaacaaaaatctatgccatgttaaaactgccgaaacatcctgctaatgtaaacatcctgttgtgcagtccatgtatgaatcaagtctttaaacatttttcttcatgtagctagtacgatagcgccgttccagaaaatgcccttttttcttatcttgagcaaaaactaacaaacaatactggtactatcaaaggttgctgtgctcattcatgaaaagttctatgttctgacttctgagacagcatgcacatttgtaggattgttcagcattgttttcccttcctttaattaagcacacaagcatataagcttaccaacttttaaaggctttgatcttttcaccaagaacacatcttccaattctgaagcaggactctgagtcttttcattgtcacttttgtgtttgtctattgctgaaagcaggttgatacgaatcttccgtggagatctgcgacctttagtccatggtgataattcatcacttttggctggagactcctgtggtagtggcactgagagatcatggaatacatcatgggaaagtgatctaactgagcaatgtttgcatgaactggtaacagacagctgaccgccaaaaatggaatcaataactgtaggagccactgcactgggagcaccggcttgcatgttagacagcttcattgccctctcctccttgtccaaaccagtgcgcaaaatgcaaagtgcttcctggctatcatgcataccattgcctttaaactctgggttcagcatgcgtacacaagccaagagcttctctgggtccagcaggcctcctgcattatttacactgtctgcatcatcaaagagagatcgcagtgagctaccaaggagccccaatggagcatctagtcctaatatccctgcccgcagtcttccaagcacaaggaggcactgcagcaatgaattcaagtagcatgtatttccaagattcggtatccctttaataggacaggcatgcccaataactgacccagatgcatgatcacctgccacattgtcaactctcattcccttctcatcctcctcacgtaaactgatgaaatagtcatcctcgttgtccattaccaccccaaaatgctcagttctgatgaaatagcactcttcacacgcgaagcaatacgccacatgtggctttttgtacaccaaagcaacccaatgcttgttgaccgaggcgtgccatttcccgtgtgtagtgcagaaacgcgattcgcaatccaagcacgccgagatttccctcccctcagtattgccacaattgtcagcattacacattggggtgtcatcgcaggtcttgatcagtgctatggccaaattaatgtcatcctccccatacaagacgtgccggcaccgccgagcacggcagtcgccgccgaccgatgccatccattgtaacgccacgactttctcccaccaatcgttcacatccagcgccgttgccgcagtatcccctggccttgctgccttcttctccacgtctatcacgcctgaaattgcaagaatcaaaagccaaaaaaactcgcgtgaatccagaaaccccaaattatcggtaaggactagggatgagaacatgaaccaagaactgaagaaagcgaaaataggaggaggaggagaacaagatcatagaagttcaccgagagaggcagcatttgggtcatcgagctccttgctcggattgtttttgatcaacccaagcaaggacttgagaccgactccagattcggcctgatctgtcgtcgtcggaattcggtgcaccaggcgcggggatttccgcgggctctcggcagtatcccccaccctcggcctcttctcgtcgtccatcacgtctgcaattgcaacaaccacaagccaaaaaatctcgcgtgaatcaataaaccccgaagaaaaccagaacgaattagggaaaaatccataaacctcaaagcacgccgcatgagttcaccaaaaaaggagaccgcgaggagcaaccaataacagcgcgaggagcaaccaaaccaagaaaaaaccgaaagaaatcgggaaaaaaattccgagagaactccaccataggagagcaaggggcgagcagcatttgggccattaattaagcaagggaagaacaacgcgaggagattctagggactagaaaccgaaataatcggagaaaccgagagagaactccaccaataatcgaaccattccggcgaggacgaccagcaaccacccgcgccccgccgcggattcgcgaaccaataaacccccacccaaaagcgcgcgatcaaatcaaaccccccgcgtcggcgacgagcagcaaagcatcacagagagagggggggaggaaatgcgggtgcgagaactcaccggagcaccgcgcgcgtgctcggaatctcgaacccagcgcgcgctcgagctggggaatccggcgacgagggctcgcgcgcggcgaggccgaggaggaagcttggaggagaaggcggagacggaggagggagggagcgagaggaggaagaagagggtggcggtggcgtgcggcgcgttgggctttttggccggtttgtgttaatcacctccgggattcgtgaccgcgtgagccctgcgttttattcatcgatcgtgggcctaatgggccgaggtcgtcctggcctcgcggcatgatgggccgggcccaacgatgagatgggctttcgtcttgctctactgccgtaacgatattgaggctgtgtttaattgctaggattggaaaccttctatgattaattaattaatattattaaaaatatttttaaaaattattattattaaaaatactttagaaatagattagtatgatttttttaaataatttttttacagaattttttttgcaaaaaacataccgtttagcagtttaggaagcgtgtgcatggaaaaggagtaagtggaggtcaggaatacgaagaaacaaactcacgccgagtgttgtctcattctgtaaaacttgttctttttttttatatgtttttcatatctagtctgattttttgatctgaagaaaaataaagtgtgtggtgtggtatgcgctgtggtggtgtgtttgcactttccacatgcctccatgtaattaaaaatgaaaagaaaaataatccctcccctcattattcctttgggagaacggcgatgctaaacagaacgcacgatatctcagaatcaacggtgaccattgaaacagcatgttctcaccctcccatgttggcatgttatgtcatgttcatccacatccaaaaagcaatggaagaaagaaagaatgctcttgttattgctacttcaacgagtatctgaatcaccatgcatacagtgtagctcaacaaatcaaatgatatgttacaaattttccatagtactgtacagaaattgctaacaacagtacaatccgacaaaactgtaccaaaggcctaatgcattcttctcggacaaaaaggtagataagaatgcctgtaactagatcagctagtcaaagaacaaccgaaatctggaacgtatatgttgcggccaaattgaagtcctgcaatgactcagccaaagcaacagaaatcatcttgatcgcaagccaacagtcagtatgtacaaatttgaactggattcttggccatccaaagaatcctgtgtgattgctattctaattagcagctggtagatatagaattccacacatctcagccttccatcctctcatagaaaagaaggtaagcctcgcacttgagaacttcttctaaagggacttctctgatgtcggtgtcacttgcccaaaaccatgaggaagagccattggtctgctgcggacgactttgtctcacataagcaacaaagtgccctgaatctttgccgtggccatggtgctcaataacactagctagacgataaattgaattatctttgtccactgagctgaaaattagaggggggaaaatcagaccaggcgtaagacttttctaatgtaaacaacagcacgtctttcttggctaaaatatctttgtaaatgaatatagtgttagcgagaaaccattgtggatggtttttttatgtaggctgttattttaaaagacaaggatctaaagaacagtgaacgatactctgctacagtgaatttactttggccaacatgatggatattatcaacaagcctagagttactctgaggatgtataacctgactctaaaggataggaaagaacaagagagtagagagcaatcaaaattgggtccttaaaataacataaattcaaattactctaaaatccaaatcgcacataattccccaaatacagttgaaacatttacattgtcaccttgttttcatttcgcaggaaaacagcgtactgttgaaaattactagcaaggggggccacaaaaccgtcaacaagcaatccatgtcttatttagttatggttaatgttacacgaggcatctagatgacacactgaaatgcacagtacaaataatccacaattccacatactcatagaaagaaagcatgaaaaatatgtcacccaaaagcaacctattgcaggagagatgtattcttaaagcaaaacgaacaaattaggaaaaataatatttattagcttactacaaattagaaacttatttaaactggcagagaatcattagaacggttacattttttgtcgaaaaaagaaataaatgcagtaatcagtacctggggtccatgaacagtcccacatcaaggatttccttaaagctcacatgtcctttcaccttatcagactgcaacaatgatcttttcagatgaatgactagtacaggtggcagcaggctaagacgtgtttgaattacacttttattcagcttctgagcaaacttggagcagttctcacaggtcagttctaccgtctctgcttcaaaatgcagttccaagcactcctcaatcgacgcaagagagtttatatcctgtgccttgttacaaataatattgctactccgagttttccccttgtcttttgcagtaacttttgctgaggaagtggtcaccttggcctcagtactaacttctggccgaacagcactgccatttttctccacatcaatacctaatgctacctgtgcatcatcttcccttagtggagaaaaggttggagctggagcaagatattctggaatgtgggaatctgctcgtgttgcatccattccctcaactttggcatccgacaacacgttttgaggaaggaaatcaacagcctttccttggaccttatccttctgaatctgcaaagggccttgtacagcatccttgctttgtgagatctgttccactttagtagaatctgtagaatgaagcaaataaaattttagttttgtcctcatcagctgcttcatgaaaccagcaaacttccttttgattatttgaagcttctttttttttcaacgatctccgcacgtacttaagttaaccaacaaattggagcaatatttattatacaaggaggactcaactcccttagctatcttcccagtgccaataactgctacactgtaacgaaaaacattgccatgctaaa

SEQ ID NO: 65348 - DNA, 16060 bp, Oryza sativa
  unsure (1)..(16060): unsure at all n locations
ttatttcccttctcatccttcttaggggtactgattgggaagaaatcctcatcggccgtccccccaaacctcacacggctgatgaaataggcgtcttcgcatgagaagcaatacgccacattgggtctcttgtgcatcaaagcaacccaatgccggttcatccgggcgtgccatctcgcgtgtagagcgcagagactcgaaccgcaatccaagcaaaccaagattcccctctcctcagtggtgccacacttgaaagaatcacacgctgggccatcaatggaggccttgatcagtgctatgcccagatcaatggtagcctggtcacacgagacgtgccggcaccgccgaatactactactgtcgctggttaaccccgccgcttcctccaacggatcgcttccagaagagcgccgcttcaggcgtggggatttgccggccctcgctttctcgtccatcaggcctgcaattgcaagaaccacaggacaaaaaaacttcgcttaaatccataaatccaaagaaccagtacggattaggggatggactcatgaaaccaagaaagcaaatgaggagaaacaaaagaaaaaaaaacagcatttgggccatcaagctcgcatcaatcaagaacttcgggaagaacactacggacaaggaatggaccaagaaatcgaacgaagaagagatgcagagagaaccccgccaacaatacagggcgaaaccggacatcccggagagcaccaagaacagcgccgccgcggattcgggagccaagaaaacccaacatgcgcgatcaaccaaccaaccaccactcggcgacgagcagcaggaccaggggaggaaatgcgggggcgaagactcaccccagagcacgcgaggagccgctcggaacgagcagagagcgagatggagaggtcgcgatgaggcgaggagaagttggagttggagggaggaggaagcgagaggcgagagcggaagggcggcggcggtggtggtggtggtgatgaggatggtgggcttggacgatttctgttagaaataagtccacttgtcatccctcttctttacatcaagtttaattgaaatccctataaatactaggaatcttcaccaatcaccacccttcattttcgcaaaaccgtctaatttaggtagaatgagcactggcatcctaatcagcaaaagaagtaaaaaaaaacattggactcacatgtcagccacaacttctttcttcaccctctttttttttccccaaaccacgcatgcgcgtttatggggtggcggtgaggaaggcagcgagcgaacctatccaagcttgagctcaagcggcctgcgtgcgagaaaggcggaggcaggatagggagggggaggtggtcggcaagctcgtccgagcttgagctcacttagccttcatgcgagtgaggtggaggtggccaacgagctttttcgagaagaggagggagacaagggggccagcgagcttcctccactatggcacgccgctccttacggtgccgaagaagatggacataaactctaaggcggaggtggccccgtgagccctgctccgtcctggagggcgaccaccatggaggaggagaggcatctccgtgacgatgccatttatcatgcccatatccacaccactcctcaaatgaaagcaatggccattctcaccgtctagctacggtcttaactcatggtggctgccgacgcggctggctcctgccccgatgagcagggatgccaggccacgcgcgtattgctactgctataggactcaagttgtacagttatgtatagtttaggggaaaatatttctcgtattgaggataaaggatgtcaattaaacccgacgtaagttgaggatggcaagtggacttatttctttctgttaatcagccgggatgcgtgacctcgtgagtaaaaagcctgcttattttaatcgtgggctaatgggccaatatcgttctgactcatggagttatgggcccaatctaggtatgggtttatccataagcccacaaggccgacaacaaacaggctattttttttttggagtaatgaagaaaggaaaaaagaaggcaaaattaatgccatcatgttcagggtttataaaaccgtgcggttatcatgtgtgataacattttcaatttttaaaaccatggtatatttcgcggtaaccgtcaaaccgtagagcagcggtaaccccactctaaacgggtttggtaacgctgctcctgttactgatacttcaagttcaaggtgtatttgaatcatcttgcatacaatgtagcttgccataacaaaaacattgaggaaaagcacaacgtatcaaatcaaatactccaatgtgttccaaaatttccccagtactgcaaagcaatcgtaaataacagtaccgtcctacaaaactgtaccaaggcctatatgtcctactatgctgatatttttccaaatgaaaccctactgcattcctcacttatccaaaaaaaaagagaggagagaattggatatgcacaaatcagaccagctatttaagaacaactgaaagaaacaaaactcttcttgattttgatccaacgtgagtacgaacaaatcaaaaattggatatttggacatccaaagaatccttttgattgctattctgattagcagcttgtggatatagattccagacatctcagccttccatcctctcgtagaaaagaaggtaagcctcgcacttgagaacttcttctaaagagacttctctgatgtcggtatcacttgcacaaaaccatgaggaagaaccattggtctgctgccgaggacttggtctcacataagcaacaaagtgccctgaatctttgccgcggccatggtgctcaataacaccagctagacgataaatggaattatctttgtcttcagagctaaaaaaataaaaataaagcagatgtggctttaactcatatagctcgatgtaaacaacagcacatctttctaggttaaatatcattgtaaatgaatattgttatcgagaaatcgtaatggatggtttcttaaggagattgtgatttttcaaaacaaaaggaggtaggtatccaaataaaagtaaatgatgttctgctgcagtgaattaactttggtcagcatgatggatattatcgacaaacctagatttagtctaaggatgtataatctgactttaaaggataggaaaaaacaagagtagagtacaatactacaatcaaatctagttcttaaaatcacacaaattcaaattattataaaatccaaatcacacctaatttcctaaataaagttgaaacaatcaaattgtcacaaaacatcataatctgtgaaaattactagcagatggagccacatagccatcaataagtacatcttgtcttatttagttatggtcaatattacacgaggcatctggacaacatcttgtcatgcacaataaaatcatcgacatactcatagcaagagaacatgaaaaatgggcatacagattattcattgaccagcaatgcttgtgtcatctgaaagcaactcattgtagaagagatgcattcttaaagcaaaggaacaaattaggaaaaataatatctattagcttactgcaaataagtaaaatgattaaactggaatagaatcattagaagttgctgtatagaaatgctaacagttacaattttgttaaaaaaaatgcagtagtcagtacctggggtccatgaacagtcccatatcaaggatttccttaaagctcacatgtcccatcaccttatcaggccccaacaaagatctcatcagatgaatggttaacacaagtggcaacttgctaatccgtgtttgagtagcacctttattcctatctttctgctcattttggcattcttcgacttggtgtgcactatgatgaagcttttgcttaccccttccttcatctagtgtggtggcattttgatcctgactgctcaacaggttgtcctgtctctcagctgggacacaatgaggtacagcgtcttgaacaccttcagggcattcaggttttttgttggattgctcactttggcatgttatcttctctgactgttccctctggtatccaccaactgctgtgtcctcattagtacttgacagcatctgttcactgtatgtaccttcagtgacatctgacttccgagcacctttggagcagttctcacaggtccattctatcatctctgctttaaagtgcagttccaagcactcgtaatcgatggaagagagtcgatatcctgtgcctttccacaaacaacgtcactactgcaagttttccccttgtcttctgtagtaacttctgctgagaaagtgtctatcttgtgttctgaactaacttcgagaatagcattgccatctttccccacatcattgcatgattctaactgtgcattctcttcccttaattgagagacaggtggatgtggccctatatattctggaatgcgggtatctgttgttgtcgcatccattcctgcagttttgacatcagccaacacattttgaggatcttgtacatagtccttgctttgtgagatctgttccacttcagtataatctgcagaatcaagaaaataggtttttagttttgtcctcatcagccttcatgaaaggagcaacctccattctctacatggtttgagaatctttgtcctctacatttgattatttgaagtttcttttcttcaagatctctgcatgtacttgtcaaccaacaacttcgagcaaaatttattatatgaagagttgaagcattgagcattcaacacccatagctatcttccccgggtgaataataagtgttactgttacactgcaacaaaaagccatgccatgttaaatttgctgaaacatcctgcttgtctaatgtagacatcctgaaggttctggtatttctgcagtccatgtataatcaagtccttgaacaagtttcttcatttatctagtacaagagcaccattttgcaaagtgacatttgtcttctctagaacaaaagctagtaacaaatatttgtggtactaccatagtttggtgctttcaatcatgaaaagttttatgttctgacttctgatacaccatgcacgtttgcaggactgtttaatattgccttccattcctttactcagtacatgagcggagcgcatgaacttaccaacttccaatggctctgatgttttcaccatgaccatatctttcaattctgaagcaggatcagaatcggcatcttcaacaattctatgagtcttttctgtgttcctcttatgtattgcttcaaactggttgatacaaatcttcggttgagatctgtgaccttcaatccatggtgttgattcaacacttttggctggaggcttcttcggtggtactggtactgagagatcatagaatacagcgtgggaaactgaacaaaacgagcaacatttgcacgatctggtaacaaatagctgaccaccgaaaatggaattaaaaaccgtaggaggcactgcaccagcagaactgtcttgcatgttaggaggcgtcctcatcctctcctcctcatccaaatttttacgtaaacagcaaagcaattcatggttatcatgcataaaacctcctacgaactgtgggtccaaattgcatacacaatccaagagcaatgacgtctccagcaggcctgttgcattattcacactgtatgtttgctcaaagaggtcatgcaatgcagtaccaagggtccctgatggagcgtccggtcctaacatccttgcccgcagttttccaagcacaaggaggcactgcatcaatgaattcaagtagcaagtgtttccaagattcggtatccctttgatagcatgggcatgcccaataactgactcagatgcataaccacctgccgctttgtcaactggcatcctcttatccccctcaccaatgaggacaaaggtttcactacacaggaagcagcacgccacatacgggttatggtacaccagaccaaccaaatgcttggtgctctcagcatgtaaactggagtgtacagtgcagaaaggcttttcacatcccaagcacacaaagatcataagcacactgatgttgtcacaatcactacacattctggtgatatcgcagaacatgatccgtctttggaccaaatcaacctcatccttgttatacatgtcatgcctgcaccgtggagtaccgacatcactgagtaaagccaccatgagggcgctttcataatcagacaccatagatgcatgaacacctgcctcattgttgaccgtcgtcattcccttctcatccttcttatgggtaccgatggagaagccattctcaccgaccgccattccctccccgagactgtcggttctgatgaaatagcactcttcacacgcgaagcaatgcgccacattgggcctcttgtacaccagagcaatccaatggtcgttcataaagacgtgcggcttcccgtgtgccgtgcagaaactcaactggcaatccaaacacaccgagatttccctcccctcagtatcatcacacttgttaacacaacacaccggggtgtcaacgcgggtcttgatcagtgttatggccacatcaatgtcagcctgctcacacaagacatggcggcaccgtcgagtacggcggtcgccgccggatagtaatgccgccgctttcccccaccaacaccaatcgctcacatcccgcgtcgcattcttcttcttcttctcgcccatcacgcctgaaattgcaggaacccaaaaaatctcgcgtaaatccataaaccccaaataactgatgaacgtgatgaaccaagaactgatgaagaaagcgaaagacgtgttggcaccgcagaatactaccgttgctggttaacggcgccgccgccgccgccgccgcagctggccgatccaggcgaggggatttccgcggggtctcggcagtatcccccaccctcgccctcttctcctcgttcatcacacctggaattgcaacaaccacaagagaaaaaaaactcgcgtaaatccataaatccaaagaaccagtacggactaggggatgaaatcgtacaaagtgaatcgagagaggaaaagaggaggagaacaagaaagaaaaaatcgccaagagaaatcaacatttgggccaactcgaacccgtcaataatcgcaagaggaaccctacggactaggaatggatcaagaaagcgaacgaagaggagagaaccatatggagaggctccaacaagaaaaaaaaaaaaggtcggcgaggaccaagaactgcgccgccgcggattcaggaaccaagaaacccaccaagcgcgcgatcaaccaacccccgcgtcggcgacgaacagcgggacgagggaagcaaaatgtgggaggagaacgaacctaccggagtacgcgaggagcgcctcggatcgacccaccccgcgctcgagctgtatgctggagaatccgcgacgagctcgaaagtttgaggagagcgagagcggaaggaaggtgatggtgctttgccgtcttgggcttggtcgatttgtgctaattaaccaaggcccaacctgataatgtcgaacctgatgggaataagttcactttgggtacctttatttgccggccagtccgattttcgtccttgatcgcaaaacgggtacgacaggtcgtccaacttatgaaaccgtttaaataaggtccctcgggatcccggttttggctgaggtagcgcatatgtggctaatttgactcgatctttatctgccgtggcattgacttagcgattacgtggcaattcaataaaaaaataataaatcctatgggacccacatgtcagtttcacacacacaataatagataattggtggggcccacgtggacccacctgtcatcttcactaccccttatctctatcccctctctatcctctctctccttctctctatcccccactgctccccatcgccattgttgctctcctctccgtcttcctccgtggcgggcggcggccggcggagcgggcgacgagcggggcggagcggccctccaccaccgccacgacctcaccgcctgcctgctcccccttcgcgcagctccgcggccattcagtgagctgctccgatgacgctggagtccgcgccggtgcgaagagcccggcagccggcgtgcggaggcgaggtgcgctcctccgccgaggccgctggtggtaggccgaggtggcccggctgtcaccgtgctcgtgaacgatggttaaggaaaaaagtgaaaaggatgtgtttatttagccggtaattaattaacagagctaaccaaaatcacaccaggttgcttctggtgtccgccgagatttcatgcagcatttcgctgacgagaattcagccatggcggcgccgccgctgacggcccgcggcgagccggttgttgatgggcgatgccgcttctgccatggagatccgcccgccgctgcctcccgccggcgagtggcgacatctccggcgccaccgcgtggcgccgaactgctgctgcatccctccgcccacgtgcacggccctgaactcctcgagcccccgcgcgggctctgcgccggcgccgcggacgaagacgaggagtagcttctcggggcgggcggcgccccccacgcggagcccctccccccaacgctctcgccgccgacacccagccttctcccgtttcgtcgttgtcgcgtcgtcggccaccaccaccggacctcctcgtgacgccgtgaagagggagggaggagaggaagaagagaagggtgataatgacatgtgggatccacatggggcccatcattttattaatttgtgcgttaaagtgacatgtgggtcccacatggattaatatttttctagatcgaattgccatgtcagcgccatgtcaataccacgtcagatgaagactgagtcaaattagccacataggcgccacgtcggccaaaaccgcccttcatactgccgagggatctcgcttgtccggttttcgtaagttgggggttgggggacgggtcatacccggtttgcggttcagggacgtaaatcggactaagcaacaaaatagagggacgtaaagtgaacttattctaacctgataatgtcggtatcaggcctgatgggcccattttctggatgggcttcatttgatctgtcgagaggcggcgtcctgatcgagagcctgatattcaaggaaacgaccaatcggttcattccaaattactattccctccattcgaaaacgattttgctatatatttaacgacaaattttctcctaaaaatttgacaaatataattacactacaatcgtagtgtaattacactgtaaataaagtgtaacttgtatgtaactttcaaaaatctctctgtaatatgttatttcggtaaaatggaggttgtgagaacaaatccttatacatatgtgtgtgctgtgatttttttcttcctcacctaaacaaatcttgtaatagatttaacgattcaaaattacgtgaaacttatatacaagttatgctgtagttacatacaagttacaatgtaattacactacaattatactataattacatctgttatttttttaggagaaaatttgtcgacaaatgtataggtggtcccttccaaaatataagccacaaccactcttaacccaaagaccaagaaatagttattattatcttgtagtttggatcatcctaataaatataatgcatgcatccaataaagttaaagaatgtgacagtgaaggattttaaaaaaagtagtaatttaataaaaaatatgttatagtttaaaaccttatattatagaacatctaagaaaagtggctgtctcttatattatggaatggagggagtagctacgagcaagtttaaatcgttgatacatttggtcaaaatatctcatatttctcatctgcattcaggtgtggtcacttcctaattttgacacgccacctcgtcaaccacacgataaattagaggcttcgaggagagagaggaggaagaagaagagcaaaactgaagcattttctacaagaaattaaaagtacataataaatatggaggagaagaagaaggacctgctccggcggctgaccatcatctcgatcccgttcgtgttcatcgccatcccgtcgatcgtgatcatcgtcgggatgctgtcgccgcacgcggcggagccccgcgaccagtcgtcgccggcggcgccggggcggaaccactcggtgtccatgctgagcaccatgaccggcggccagatgatcctcagctgccgcaccgccttctccggcaactgggagtacttccactacttcatcctcgacccctacaagccccagcgcgccttcttccagccaccgccgccgccgccgaactccgccgccgccgtgccgtacgccatcctctgcaagtgggggtacatgggcaacttcctccaggacgtcgtcgtcttcaacagcagcgccgcctacgcgctgcggtgccgcgtcgaggaaggcgggtgccactacctgttcgaggacgggaagatgttcctcgtcaccgggcggcgcgccaccagggcggcgccggcgcggcggagggagaagaggctcgtcggcgacgtggtgctcagggagtgcgcccacgtgctcggcgtgttccccaccgtgtgcaggtacaagccccatgaacacaactacgtcggcaagatcatcggacgctggcgatggtggttcaactactaattaactgttattatgatgatgattattgatagcattgttaattagatgattaattactactagattaactagctattgttttactagcctattatagccggttaatttaactgttgattttctggcatttggcgatgtgatctcttcaaacaaaatgtgtgtatatacatatgggctagctggattaacaatgagttagctggattcgacatgggccagattccggcccaactagaacgcaggctcaattacatatgtgccctgcacgtcagcccatgacaacttatccatcacctgcaaacatcactattaggaataagttcatctgaggtcccttaacttgtcaacaaatccgattttcgtccttcaaccggaaaaccagatgcaataggtaggtccctcaactatcaaaactgatgcaatatagatttcatggcggtttggacggaggttttagctgacgtggcgcctatgtggctaatttgattcggtcttcatctgacgtaacgtctgaagcaaaatttaacaatttttttttaaaaataaaatacatgtcagtaaaataataaaattaaaaatagtgggacccacatgtcagtggacccacttcctccacctcatcccatcttttctctatctcctccccttctccttctcccttctccacgacttcaccgacggtcggtcatgggcgacagagaaaaaggtggctagcgggagcaccacgccaaccgagaaggaaaggtcgctagcatctggcggtcagccgcgggcggaagagagaagggtggccggcaggaacatcgcgctggcggagaggaagaggtcgccggtgagacccatcgcgcggaggtcggtgtcggtgtcggccatggagcgcgcgagctcggcggcggagatgaagccattgtcgtcgcggtcaaagggcctgaatgcctcaacgagctccacctctcttcatctctctcccctctcctcactccaggcgcaacgaggaggcagcggcgcnnnnnnnnnnnnnnnnnnnnnnnnnnncaactcggccccaccaccgccaactcctctccttcttggcgatttgggagaggagggagtggcccgcttggtcctccgcgacgcgtgtcgccgttgcctcttctccttttccgcggtgtcctctgtcactgcacccagagcccacggaagcggcggtggcgcagggatggggacgagggggatgacgagaaggagaggatccagccagccatcaccaccgtccgcggcgcagcaggaggagtcggcgccggcgggccgaggtcgtgcagatcctctcccacaacagccaaccgctgcccaaactgaagatcaaagagcattcctgttgctttgcataacaaaaagtaacaaaagatgtgtgtgatgtatgttacagaacatgccacaaagcttcccgttatattgtgctgaagagatgcacttgatagtgaagtggtaagggctgtgtagtttcacccgagattccgtgttcaattttcaacacactcacatttttttcttaaaaaatgtttagagggggcctctcttcctccaaatctctttttttttttcaattctgtgctgaataaaaatggtggggaattggggattttaaattggtaaaatactttgataagcattaatgtttgacaaggtggggacaatccgccacgatcaagaagagatggcagaggtgagcacagattataaatcaaacagacctgatagctacactaactttgcaagctaaaccgaaattatgtctgattgtctcaagcacaactgcctgactgactcgtttttcatttcaagtgttgatccaacttgcattggcatttggagtaacagatggtagcagagtgccattctcatatgaccatgtcaaaaagttttgtccattgtaatccttatcatgaaactctgaataatgtaggagaaacatgtcaatagagaccagcttagtttttgcaagaggttccaaattgtacatctttttcaggcgaggagctttcaagggattccaaatttctcctgaaaatgcaatcaacaaaactactcctgaaaatgcctctgggagagcacagagcagtaaaaactactccagtcgaaacaaactctgttctctgacttcagtctagggtagtttaaaattccctgaacaagatgatggatcaatgctgaacgataatacaattagcacgattagaatcaaaccatagcaggaatataaaattaagtcaaaccacagagtcgcacagcgttattactactactagtactattattattatgctgataaatagaggggaaaaatataatttcccctacaactaagatggatccatgccaaatactaacgacgattattcagtttatcttcctaatacttcctcctcctgactgatcttcttcacgacaatcccgttgcggaatcttctccggccagggtgagcaactcgtgcaggaacttcatcgtcttcatcgacatcgacatctccatcgtcaacaacaacctcgtactcggcatagcctttggcgtagtactgcttgaggacgtcctgcggtttatcggggattttgtagatgttctcccgttcattgcggaggacttcctgtagcttcttccgtctaacaatctgctcctcctcagtacgttccatagcgtacaacttgtctacttgctcctgccccattcgggccaggcactccttgctcaacaactcagtcagcttaatgactttgatgtcccacaactcctctgggttagcaatgcagtattcgatctgctcttgagtatagcgaaccatcttttttttcttcttcttttctatgattggcgccttactttcatctgatacaaccgtagcctgtttagccttatcctggttagagtcatcaatcgccagaagatcatctttccctgcacttgtttcctcagatggatccatcgccagcgccagaattcctgttatttgtttaaacattattttcttccatgcttaatgaaaaagaattcagaaacgagaaaggagatgattttttttaatcaactgtcaactacggaagatcatctcaacacatcgatctactctacgttcgcacagaaattctacaaatccagaacgagattagacaatgaaaaggagcgacacctaagcccctcttaaacctccaaaagccaacagacgagagcagaaggcgcgcacctgatgaaggagacgcccccccccccccccctctcgtctggatcgtgaatttgtgataataaatagtgtagtatccgactccaagccgaacaggttgctgtgggcgcaggcctcaggtgcggcttcgacaacgactggaatagtcgaatcccatcagcaagattccacgccggacaaaggcaaactgaagcttttgtattattcaattattaataggaaagattagcacatctctatctctatctcttatatatactacttgaaaataaaagaaatttccatcgtctgtaaaaacgtaaaaaaaaacgcgcgaaaaaaaagttccgtctccactcttccgttaaaaaaaaagcaaacaaaaaatgtgaaattttttttctgtccgattaaaaaaagacgtccgtataaaccggtcaaaaaaaacgttactggagaaaaaaaagttatgtcatccctaccgtaccggaaaagaaaaaaatacgcttttctaaaaaaggaaaaaaatagtgcgaagaaaaaaggtttcggtccgattctaaaaaaagagtctgtataaatcggccctcccaaaaaaaggttagtggaaaaaaaaaagttccacgcaatgttaaaaataaatccgattccactaaaaaaaccggctgattttccaaaattacctcaagaaaaaaaaggttggctgaaaaaaaaaatcccctttcgaattactttttttattcattcaaattgtcatatattaaaatcggcctaaaatgtcaacgttaatataaaccgcacgagaaaaaaatcccttataaaaaacactccgaagaaactgttagaataaacgctccgaattaactgttagaataatacgccgtttagaaaaaacgtccgactcaatgcgagaaaaaaaacccattgagaaaccgtacgattcaacgcgaaaaacatcgccatttataaaagaaccgctttgaaaaaactgtccgactcaacgcgagaaaaacgccaccgtttgtaaaaaaaaaaaaaatctggtttggcaccgtgcaatgtgaaaaaaaactgtccgaatttagaaagaaaaaacatccgattccattaaaaagattcataacatttctatcgtccatcatctcccatgtccgtttggtttttttcgaagctttggtccaatgttctgacatctgtaactaagatcaatcttgtttgggccttttttttaagaattgatggacgcttaggttagataggatccatcgatttttttcatcttttacacggctattgtttcctcatttattctcctatattggtggtcctgtatgtctctgtaggcaattaccatactactatagctactattctttataacatattatatgaaaataatattaaaaaatattatttccatcgccagcgccggaattcctgtggaagcatcagtataatacaatatcgatcagaattcagaaacgagaaaggagacgatttttttttatcatctgtcaactatcaactacggaagatcatctcaacacatcgatctactctacgttcgcacaaaaattctacaaatccagatcgagattcgacaataaaaatgagcgacacctaagcctccaaaagccaacaaacgagagcagaaggcccacacctgatgaaggagacggaggagccctttcgtctggatcgtgaatttgtgattctcaataaatataaaggtccgattataattggattcggtccaaaattggctgacctgtttgatgtatccgactccggaccgaacaggtcgatgtgagcgccttgtttggaggcctccaacttcactaggccttgtttggatggatgggccacagacccggcccatccacgtaggtggcccgaaattggaataagtccatattttatccctcagcttattcaccgagttcgattcacgactattgaaacgggactaccacgtaggaggaaaatatcatcaaaaccatccagcatgaaataggtaacttgatccgattttaattgttgcggcagcctctatacatagctttacagttcacggatacgaatcgaatttgacctatagtcgagggaagtaagatgcaccccc

SEQ ID NO: 65349 - DNA, 1712 bp, Oryza sativa
tttttagtacgtgtttgaccattcgtcttattcaaaaaatttaagtaattatttattcttttcatatcatttgattcattgttaaatatacttctatgtatacatatagctttacatatttcataaaatttttaaataagacaaatggtcaaacatatgttaaaagtcaacggtgtcaaacattttaaaacggagagagagtatatcgtaaatgtacaccggttgtcgcaaactaattcaatcggaaacctacgtagaatagatttgtgatttcaaacaaacaatacaaaggttgcacactgctgcacatatgtagcgcctgcgtttatatttcaagccagcatgcttggctgcaacggaatatacacccccttggtaggatgtcatcagttcatcacaaaattcacaatggtgggtagaaatatgatgacagagagaagccaaggaagaggaggcctccaatggtggccactgtgccctgagatatcttggatgccagcatgctgccacccaccacagcgaacgatgtgcagatggtgtgccccaaggttgctcccacagcgacccctaccgcatttttgtgagtggccaactgcattggcaagaaatgcaacaagtttacggtttgtgaacaagaaaagaagtgctggggaattgagcaagaagagaagtgttggaaaattgctgaaaagggggtaggccttaccgcaattgtggcaatctgacttcggtcgccccactccgccaggaaggtcaacacaaacgactgcattttcaagtcgttcatacacattggatgaattcatttaaaaagacacaaattggatcacgtgtttatcaaccatttgttggtaaaaagtgagtgtttgataattcagtatccatctgaaatcagatggcagcaaatgcacttttgccaagaagcaccaaaatttataacgataagagcggaatgtacctccaaaaaaataggagtacagaaccttgagaagatgcgtctaaatgttgatttcccttgtcctgcttccagcttttcctctacctgtgtatgtcaagggattcaaaatatataagatggttcaagtagcataccaaacaattggacgatatcaaaggtcagagccaattataatgcataatataaacaaccaaataatagtaattaaaaggactaccaatagttcaatacagtaaacatgtatcttcccaaataactaaatatcttcagcagtctagttctattttttaagcacaacagggcaaagaaatgctgaaattggtccagcagagagtaatccaaagtcagaaagctccaagagatattcagttacactggatacaacaacaatagatgctgcaaattagagattctagtatactgaatatgcacaaaaaaggataaaattaacgcaacaaaatataaactaacaatattaagctaatgcagttttctgtcaaaagaaaaatgctaatgcaaatctgtagaggcaaagagtaaatgtataaaatgtgcgtacttcttcaatttccttcttttgtgatgccttagaatctgacctccaagcaatgtacacagccgtagcccaaagaacgcataaaggactgagtacaaaataccaaagaggatacaaaatattaggtgagcacggtgaattgttaaaattaactggatggcatgcaaacagttgggatgccaaagaggagttggtttc

SEQ ID NO: 65350 - DNA, 1397 bp, Oryza sativa
tagctttggatcagtgccaccgtaatggtgttggcttattaaaatacactacacggtgggctgtgggtgcatggttttgctagttgtgcccatggcgattaaggaccggttcgcgggaaaccctggaagaatttatcgtgcttaccacaagccagcgtgggcaacggctgggcttgtagtgtagcttttctctagccgacgtacccaggcgagggtgggcgtgatggagttgggtcggccgaggtgtccggttgatcggcttctggattcactgcggcacgaaaggggggctgcccgttgcctgctggggacgggggcgaaccctaaggtgtggtgcgatcggttagaggggggttatgcgaagggtcctgtcacggcctctttccggtatgtcgtggtggcatgtcggcgcacggaaacgtgtcgtggggttgtgtcttgtgggtacagttgtacacctctgatcagagtaaaactattcgaatagtcgtgcccgcggttatgggcgatcgaccagattcaccgtgattagtctcacccctagtttagcttaatgaactggtgtagttcaggtggttggttgggcctgttgcaacgtggtgtagcgttggacagtgacgggttaatactgcttaattactacaactgtttttactgttttcaactactggttttaaatgcctgctttatgcaaatgaaccccgtaacctcttttggttatatcctgcatcatacctcctcttccggtatgacttgctgagtacagtgggtagtactcagtcttcctctcttttcccccacaccagagttgaagtccttctcagttgaagatgtctcgaagaggttggtttcgtcgctgccgtcaaggatgcctgtggaatggagtcgtccgctgcaggagtcaagtcttcaggctcagctcgcttttatctttttccgctgcatttgtaatcttttatatttttgtaaaacgtggatctgtatgtcaatagttgtcgtttgtgtatcctggctggtcctggacaggggtttaatgcacattcagcttagaaattctggttcgtgaatttctgggcgtgacaccacgcctgaaggcgtagccactgttggcccaaagaaattgcgctaagctttcactcggaacccccaactgccgtggttcgtcgcccaatccgaatccaccatctaaacatcgcgtcaacagtggcacatggcttccgccacacccgaccgatgcccttccgccagctagcttcgagtcctgccaacaacaagactgccaccacaccgcaccgacgccccttcgtcggccgacttcatcaaaccgtcaccctgagagctggcccggctagcttcgagtcctgccaacgacaagactgccaccacaccgcaccgac

SEQ ID NO: 65351 - DNA, 7353 bp, Oryza sativa
  unsure (1)..(7353): unsure at all n locations
gttagttagtttattgtattatttcttaaagaaaatgcttgctcctgcctcctgtgatttgcatgaaccatctatcgcgttagtatgatttccaagtatatatgagtccatattgtacctggttagtagtttattgtgttattgcttcaaaaataaatgcctacgcctgtgacttccatctgctcagcttgcttttcaataaactttttatccattacaattagtaatgcgtgagaaacacccatggttttctggctaacttgtggtaagctcattggtctggattcgaagtctcaccccttctatttatttggtattaggccattccttaatattcgtcgttgcacctatcagtgaaaatgcttttgttattatctgtttggttattctacatctctctctccaattgttcttttaatatttgcaatgtacccattggtaataatttcgtactgatctatggtggtagagagttaccatcaccacctactttttaaaaatcttttttaaaggttagtgtcactacattttttttatgcaacaaaatggcgcaagatagcatgttgcttgaattaatcgaccggatgatgaagcgaagttatatggtaacaaactaacaattgcagttttcttcttgagaaattaaaatccttactcgctgatttgcaaatacttgtggcatatatatacatgcaggggataacttttataaacatacaatgcaaatatttgactgcatagacattgacacatattttaaaaaacgcacgattacttatggagaaggaataagtctaggaaaaagtctaaatatccccccttaaactttagatgaaagtccgtttaacaccataaactttaaaaccggacatcatccaaccccttgaactttgttatgccatccatataccccctaaggtggtttgggttttggatgatggttttgcatgttttgaaagcttaaacgaccaattttgaataactaatataacttatttgcatatcatcagttataagtcattaatttatccttatacaatgatatcatgctattattaagttggtacttgtttataagtgagagccaataagaagcatgtgatccaactcatnnnnttatatacaagttagaaaaaaaaaccactatgcaaaaccaccttaggagttatataaatggtattataaagtttaggggttaaatgtccggtttcaaagttcagggtgttagatggacttccatccaaagtttagagggttatttggacttttttctaaagtctaatataaacattttacaacttttgtaggttcaggattccacacttatcatattaagtacaataggcactttgtgttcatcttaagagttaatattaaagtattaatagtattaaacgctcccagcactataccaccgaccattttgtttgtgttactaaaaataatagagccaacaggcccaattgtaagaaaatcactcgactctttgggaaaaaaactctaaattgggcccatatacttttggtatgatatatttgacctcattgctagctttgcattcctcaattaacatctttcaactttatttttagtttgcggcacattacattataccatgtgtgatgtgtctatgtgtttcaactccgccttcgatggaaaaatggttttataaaaattggtattatatttctctactacccacattcatcgtctcaggaccaatctttggagctccgtttttacatcaccaatagaaagttactttctatcacttttatcatagctagctgctttagacccatttttattcatctgattcgatgaatgtgggatgaagtagaaccccagggtttccaccacacatagccacaaggatttgccataggctttacttaatttcaagaattgaatcttgagatctatgagtggaatttggaagacacgaatgctcacttctccttttccaaggaccggagaaatgttcctagatcttgagaagccagataactgtacttatccactgtactgtgacataaaataaaattatactaattgggccttgcatttattgaattggcatgggaagctcagcccaataatgtaattggtccagcaccaggtaaccatcaaagcccacaaattttcaacttgatttcttacatttctcgattgtttttccttgatggtccccatttgtgatttataatattgagatttatggtgtggtagagttatcaccaccttcaactgaaaaagaaagtttagcaccgcctatatattttcaaacaataaaatgaaagaagagccatgttgcttgaattcaccggacactgaggcgaataagttatctggtaataattgctgatttcttctagagaaatcataatccgtaccagttgattggcagtactttggacgcacacaatatttcacaatgacatagacatgcagatgataactttttgacacatacaaaccggtacaaatgacagcatagagctgacacacacatattaaaaaacacaccacgtgattatttatggagaagaaaaaccttatattattatatatatcaagtctaatataagtattttatgactagccttttgtaggttcaggcctcaaagcttttcaaattaggcacatataaacacttcctattcatcttaagagttactccgtctgtcctaaataactttattttttatctatcccactcgtatcaatagaaaaaataaaatacccctactttattaaatctcaatgcaactaattctcactttatttcattcagtataattattttccactttcacaaattttgatgcgatgattagctaaggcatgttcggctggcagggcaaccagctacagtagcaagcaacacagccgcgcacaacatacatcgccgcagcgctgccacataaacggctaccaaacaaagagacagaggacgtaagattatagatttaaacagattatagatttaaacgctcctagcactatgccaccactcttaaggctcctttggattgaatttttttttaagaaaagtagtaaaaaccaattaatccaaaaaaataactcctatgtatgttacttatttggtatatagaattaattcgaaggaatttcaaaggacaggaaaaacttctccaaagggtgcctttatatttcttctctttgataattggcatggatctaattgaaaaacagttggaaaaaggaacccatatggatttgccactgccagccataccacgtagtgtaattaatccattgaacaaaactagctgactccctcgatggtgacaggtctgaagaagcttggattaataggacagatcacaaaattgttcattggaaaacttgacctgacatgcattggtataaggcagatatatatttaaaagtatatatatggcccagctaaatcttctgataggtgatggccaactctaaaaaaatgcagaaaactcctcctttttcctcttctacgttaacaaaaacatattggttgtgtgcccaggacggtaagcgaaaggtacttccattattaaaaattaagatactgtttgtgcaatcatgttattattaatctgagcttagtgggcttccttaattgtacatgtctctcttcattctgctgcatcaatgatatttatgtgtgtgacatgtatgtcgagttcgttaaccaactcgtctgcaatggaattctgtgacgatttgctcgtggagattctctcgaggctcccgttcaagtcgcttgcaagattcaagtgcgtctcccgctcatggcgcgcgctcatctccgcggcgacctccgccgccggctcccgctgctcgccgccggcttgttcgtcggcgacggcggcggcggcgagccgaggtacgccaccgcgtgctccggcgatggtgttgagttctgcgacatgagcttcttcccgctggcggagacggcggcgagggtcgtcgacgcgtgcgaggggttgctgctgtacaggtcgctcgccgcggcgtcggcgatgtacgtcgcctgcccggcgacgaggaggtgggcggcgctgccggtgccgcggagggaggcgcagctcccgctgctggcgttcgacccggccgacggcggcggcggctcgccgcgctaccacgtcgtctgcttcgtggcgtggcaggagcgcggcgccaccgtggacgtcttctcgtcggagaccggcgcgtgggcggagcgcgacgcggcgttcggcggcgtcgaggcctcgtcgctgtcccccaccacgcactaccgcggcggcgtcctccacgtgctcgcgtacccggaccgcgtcgtgctcatggacctcgccgccacgaccacgacgacgacgtcggtggcgccgggcaggctcgcgccacggctgcccgacgacgtcgacgccggcgcgcgcctcggccactcccgcggccggctccactacgccaagtgcgacggcgagcggctgagggtctgggccctcgacgtcgacgccgcctcgccgggctcatgccaatggatcttgacgaacaccgtctgtgtcaacgagatgaccatcaatggcgggctctgggcggcaagcgaggtcaagttcttggcgttccacccggacatggccgacgtggtgtacctctcgtcgccggaggggaaggtggcgagctgtgacatgaggaggaaggagatggtgagctcgtggaagctgggagctgagcaccatgtcgtcaggttttggttgcttggtttctcctcgggtttgatgagctgcctgggtggcgagcaagcatgccagattgccggtgctagctagctatagtatactagtatattttttttctgctatttcttttccatttgaccttcgatttgattgcttcagaactcatatatcaaaacgcagttttgaagaaaaagttaaatggatggtggcggcgtgtggcaacgataacataagcccttttgaattgtgctttggtttgggtcggataggtgttgtgtgacttagtgtttcttggtggagttggagttgccgatcacatgggtgatggtgtgatgataataacgtcgcgtttttgccagtgtgggagttttgtttacttcttgcttgttgcttggctttatcgttcttgtgttgagcagcattgttaagtgttgcgcttgcctaaccttgcttcattgcgttggcaggttaagtttcttggagtatttgctgctgtagttttcgctcaatttttcttaattaattatctgtttttttaaatgggacatcttcttcttcttatatgtaaaacatcggcaatggtctgtccgttcgtaaacaaatagtcaattatttatcaaagttcatacatttcagcagtgttatactcccccttataaaatatactatctccattctcgtccacaagtgaattgtctttgtttttaaaaaggaaaaagtacgaattaccccccctccaaaaaaaactagcgcggtcgtccgaattaccccctgaaccaaaaaaaccggacattcttcacccctatctatgcaaaccggacgaattacccccctcgacctaatccacaatggttttggtctacgtggcgtacgcgtggcagtccagtcagcattttatttattaaaaaaaatgtgagacccacctgtcatactcctattccactattcctatctgtcactcttcccctctctctctcttctctctctatgtctcactcaggcgcacggcagtaggcgggggatagggagcggcggcggcagggtgcggcggaggaggcgagcggcggcgggagctcacgctgctgttgacagaaaacacgaggcctgggagatctgcttaactccagtgcaggtccaaagctcgccttcgaatgtatgagcgtgccagttgatttgatcctgtaaccaacaagaaatagagacaaagaattcgtggttaaatctataaatgatagccgatcggctaggtgccgatgacaatcatttatctttgagccgatgtcatttatgaatcgatcggcggttataaatagacagtaaggaactaaatctattcgatcggctgtagatattaacgatatatagttcttatattaatatatacttaaatcaagtgattggaatagatcggtcaccatgccgagacagtataaatcacttagatcgaaatatatattaataacaggattatatatgtttatagcatagccgatcagatagatctagcatgtatcagctaatactccgatactactctatataaagatatcaaaacaggtataatataccaaacaaaagcttaatatacttaaatgcaataagatcttgacataaagggcggatttaacatgtcactgaagcatatagatcgaatatggttaaattagataagatcggctgaaactccgatactaccctaatcggcaaccagatgacaggctagagattgatattctaagcacgacttaatagatcaaactcaactgatgcagcattaagtatgaaaagaagaacaatatctagacaatcaagccgttgggtgtttcataaagtggcagatatcttatataatctaggacaacgtcgctatttaacctaatcggctgtcttctattaacagatgttagccgattgtaggttagatgacaatattgccaaagattatgtaagacatatgataactcgacgaattatatagacaagattagagtgtcataaagatggaagtactcatctcgagaacacaagtcgtcataacaagttttacctcttgttgaagatcgaaaccgatgcagctcaacccgaaagcaagaactcgtcgaaacaaaactaaagcaaaaaggtggcgatgcgccgaaattgtattgaacatgtgtgtcttaaaaattacatagggctcggggtctatttatacccgagaattacaagatatgtccataccggacacgaccactatctctaacaaactctaagataccataagtctttgcggcagacttttgcccaaatatatctctaaggaagttacataaaacatcctaattaatagatacaattgccttcttaggactctatccatgtgcggcaatcatcttgaagcacctcaattcaacccgatgtcatacaccaaattacactgtcggaatcggctgcatcggcttacctagtccgactcggacctagccaatcctaaccgtagtcgatctggacttcagccgattcttgctctattctcggatcaagctccgccttcgactccacctcgatctaatctccttttccgatgctgatattaccaaatttggtcgttaacagctgctcaaggcaaggcgaggcggcggcggcg

SEQ ID NO: 65352 - DNA, 7202 bp, Oryza sativa
ccttctcgtcgcgcgtcgcctcctcgtctcgtgcagctgcctcgcctcgcaccgccagtcgccacccagccgcacctgcccctgcgccgccgctcacctcgccgccgtgcttgcctctccaccgccccgcctctccgccgccgcctcgccgctgcctcctccgccgcgctcgcagcctccgtcgtcgcctggagaagagagagagccccgccgctcgcctcttcgccgccccacctcgtccaccgccacctcgcctcgccgcggcctcctccgccgcgctcgctgtctctgcagtcgtccggagaagagagagagagagtgtgtgtgtgtgtgtgtgtgtgtgtgtgtgtgagagagagatagaagagatagaagagagagagaatgatacgtgggttccatattttttttataaaatagaatgctgactggactgccacgtgtacgtcacgtagaccaaaaccatcgcggattgggtcgaggggggtaattcgtccggtttacatagttggagttgaagaatgtccggttttgtagttcaggggagtaattcgaacgaccgcgatagttcggggagggtaattcgtattttttccttttaaaaaagtttacttttgagagtttcataaaaataaagacgcgtatattatggaaggatatattatcaaataattagaatgggtgagacttcaaacacaaatcgtctaacctagaaacgctcagggctcttccggctagctcacaagcgtttctcttcagcagaaataaagattaacgagaaaatataagttgggattgagatgagaaaatgagtgagaaattaaataagaactatcctagtcagatttgtatatatgatttatatagaaaagtgaactctcagaaggacggaggtaatacatatttttgaaagtttagtagaaaaccaaagttaacggaaaaataattgtaattgattgagatgagccaatgaggaaggaagtaaacagaaatgctcgatagggtaatagcaagtttatgagtctgatcttagaatttggatcagattagaacatgtccgttccttctatcaagcagtgatttttcttcagaagattttaacaacttgagtttgatccagtaaagatatactattaacaaaatctgcaccatttattgcatttacagttaccaacaacatgaacacacgcacaatgcatccagctacacgtcggtggcgtaaacgatctctctctttacacttcgcaagcaacaaactaaaataaaataattgaaacagatttacaaattaattaaatcatcaacacttcacgggacaatgagctaagcaatccgataggtagcacgacgacggcacgagccacgccttgacgacacgattcctctccccctcaccaaactcccaagcttggcaatggcaggtcgtcgtcttcctcctcagatcgtgctccaccaccttccatggcgaccacgtgtacaccacgtcctcctcctccgggtgcatcgccaagaacctcacctcgcctcctccatgcgcgaggtgttccaccttgacggcatgcttcggccgccattggtcgtcgtcgtcgagctcccagaccttgagaagctcgccgtcgcggaagatgtagtgcagccggccgccggagtgcgcgacgtgggcgtcgccgccgtccaccggctcggggaggtcgatcaccgccgccgtggatgagaagtcggcgaggtttagggagacgaggcagtcgggttcggaggcgaggatgtagaggatgccgtcgtggtagtgcatcgagccggagagcgagctcgccgggacgccgccgaactccgtgtcgcgcgccgtccacgcccacgtcgccgatgagaacacctccaccgccgcgccgcggtcgcgccacccggtgaagttgaccacgcggtagtccggcgaggtggacgggtcgaacgccagcacggacagcgtcgccgccttcgccggcgccgggagcgccgcccaccgcctcgtcaccgggtcgacgacgaagaactccggcgtgccgggcgatcgacagagcagcaagccattgcagccgtcgcataccacaacgccgccgcgttccggcaagaacccgaggtggcagtcctcgaggcggtgaccatcgttgccgtcggacgccgcgcacgcgaaccgcgggccacctccacctccgccgccggcggcgacagcgtcgtcgtcggggaagtacacggtggtcatgagcagcggcagcctgcggcggaggtagtcgtcggagacggcggcgcgccaatccttggagacgcaggcggagcgcgccacggatttgaacgggagcctgacgattatctccgaagaagatcgtcgccgatgagggcgatctcactgtcaattgaacaactcttcagaattgccatctcttactatctctctgttcgatctgtgtgtgttctgtaacgaattgaaaggattacttgatcagcagcaagtctctccgagtaaaatgcaactgggcgtgccaattttatactactacttcgtacttggttttctagattggggtataccggtgacgtgtccaggtcgaagcgctgcgtgtcctgccagcaagctgccacgtgtccctcagtagtagcccagctaaaaatgagacttgccgggtggaggagcatacctgtaaggcggtaaccgtcagatctcacgtcgcgccacgcgtatagcacacatgcatgcccaaatttggccggtttccaccagtcaaaagttataaaaagaattccgagaaaagaggggatagcgcccgcaatccagtccctgccgtcggttgttataggtcgtagcggtttattagtaataaaaaaagtttatgataagttaaaaaaaaagtttatgattatttttataccccctccgtttctaaatatttgacaccgttgactttttaacacatgtttgaccgttcgtcttatttaaaatcttttgtgaaaactatatgtatatatataagtatatttaataataaatcaaataatataaaaataattaataattacttaatttctttaataatatgaacggtcaaacatatttaaaaaagtcaactacgtcaaatatttagaaacagagggagtatatttttagccgcttagaaatctatatccatatttctatctctactattataaaaattgaagatgcttttactaaaatttggtccctcaagtttattagctaataaaccgttttcaattcctactcacctcgttgttcgtttcaaattcatgtgcgtgttcatcatcgcctgcgtgggagtcccgttcaaattttcggcgtcgttcgtgtatgacggggtcctctagggagtagggacgcggcatgcaggcacatgcaagccttcaactgcatgccatccagagatcaagccactcacacgttcaactgattttgcatgttcacaagttcgacttgcatgcatgcggctttgcacctattcaaaggtaaaaaaaaagttcaaaattgaaacaggccaaaagctaaaaatatatggatatttcatagtgtgtgtgaatatttcaggatggatccaaaattaaaaataactaaattactataaaatcataaaaaaacaactatatgaaaaagaaatatgcaacctaacaaacacaaataattttgattacaaatttagtactcgcagtacgtacaagatattataattttgttttaaattcgttcatttttgaaaatatagtagcagtcgtataagaaatttcttttaaaaaagttaacttacatgctaactttagatgatcgggctcctaattatagcttatgatttcatgggaaaaaaatatatatccaagcgaattcttataatgaatttcaccttaactaaaccatataacaataataaaattaaaataaccttcacctgttacagcgcacgggtattttttttctaagtcaatgtaaaagtttcttaaaagcaaatttaaaatttgagattttcttttcagcaaacgatggggcccggagagggtgtcgtggatgagcatgcaccgccgttgtgatcggcaatccaaaagctagtattggaatttggggagagagagacggcgcccctccaaaaattcattttagaaaaaaaaaaattgtaaacgtgttaaggattaaacacgaaaccttagaattatgggtggcggccggtgcaaacgtgggtttggatgaaggcagcaagggatcgaagcacgggaatcgtgggaagccatgtgcgttccggtgccgtgacatgacatgggtagtgcttgctacagcgagcagagcacgagctgccgctgacttggaacgcgaatgcgtccccaaatattcaacgggaaaaccctgcaattaagggagagggtaatgatcattacgtgcaccgatcctaacccactttaattaattaatttcttcccgctcctgacactggataatactactccctccaggctgataatacttgtcgttttggacaagggtgaaatctgtcttttaaatatggtgactacatgtgtagattagtcttaaaaagtattttaataagatcatatatttgttaacaattttatatatattataataaaaaataatggtcaaagttttttttttgataccgtgcccttgtccaaaacaccgatggtatggatggagtaagcatgactcctgtgatccctatccggtcagctatacttaattagcgcgttaatcgcatcgtgcaagcgacatactcccccctccctccggtttcattttaattgacgctttggacaataacatactctacaagatattcctttgaccttatttttctattataatatatacaataaataaatacatgtttatctttattatagtgttttgaaagacaaatctatatatgttttttctagtttttttaaacgaaatatttttaaagttattgatggttaaagttataaaagtttaacctcaaccttatccaaaacgtcaattaatatagaaccagagggagtatatagctcttgcctacaggttgattatatcattagggcatccacaatgtactccaaagtggtccataagcaatataatatttgattcagccacctagcaacattgtggaactagtccataggaaagaaataacaaaaactacccataagcatatgggatgcccatagagaataaaatatattatttgtctctatctcttctctcctgctaatactatttgttatccatatacattgagaatgttataatagttaaaattcatatatgtgggtctcatctctatggactacttttgccatatacattgttgttgcccttataagcgtaacaacttattaacgatgaaaaatgatttataaagtaagttttttttggtatattttgcagaataaactgaatactgtcatgggcttagattcttgggccgcttgtcaccatagaaatctcggggaaatctcggtttatgactagtgagggtgttcggagaataaaattccgaacctccagggatcggtgcattgcttaaaatctatagcaaagagtagtactagtcctactcaatgacgacgtgattatacgcaccgaatgtctgaattccattttgtggagctcccttatgaatgtatttgctctcattgaatctagtcacattctgaatctcttttcctttttccagtgtctgatcagtctttagtgcaaggatctgaagcattctgcaacaaagttgagaaaatgcatttgttctgatcaatcgtagagagatctttgttcttgtttgctttcttcatctgacgagtgtttctgaacatcttatgccgaccatatattagagctctttaatttgtttcatgttcagtacgttctttgttctgaattttttttcccccggtgtctgatcaatagcaggagactagatagctctttgttcttgtttgttttcttctcctgaccagtgttttctgcacattatggcacagtatggtgctgtatgttgattatatacaggttgagtgcaacctgcatatagccgtatgcagttatgccgattgggcgatatccaagaacgagctaatcaccaatatcttcaggagtcaggactagcaaatggtaaagcagcaattttagccattagccaaacggagcctcaagccgtcaccaaccgttggattaaaaacgtgcagctgttgtacatacaggccgcggcccaccgatcagcccagcttactaaagcccatccaggactgacagcccaaaaaagcctcacggcctttgcttggtctgacttcgtcagacacgagattggcaaaaacgagaggtcgccatcgcgtcgaacgtagaatggcccacatcgtcttcctccgcgcctccgccgccgacctcaccgccggcaagccgccgctggcgggcgtcccggcgtccgcgccgctctccgcggcggccgcggccatcccggcgtcgtccgaggccgccgtggccgtctggcgcgtcgacggcgcctcccaccaccaccaccaccgggcgcccaccgcggcggccaccgtcgtcggcctgctcagctccatcgacgtcgtcgccttcctcgccaaccaccccggcggcgccgccgccgcgttcatgacccccgccggcgacgtcgtgccccacgaacacgccctcgtgcgccaggtccagcccgacacgaggtcaccatcaattcatgatctagatatcctgcattgcaatgcatccatgagataattgcgactatggccttgtttagttacacggttcaaaagttttagcgtgtcatatcaaatatacggacatatatttggagtattaaatatagactaataacaaaacaatagatttcgtctgtaaactacgagacaaatttattgagtctaattaatccatcattagcaaatattccctctgtttctaaatatttgacgccgttgactttttaaaacatgtttgaccgttcgtcttattcaaaaattttaagtaattgttaatactttttctatcatttaattcattattaaatatacttttatatatacatataattttacatatttcacaaaagtttttgaataagatgaatggtcaaacatatgctaaaaagtcaacattgtcaaatatttagaaatggagggagggggatggattctaatagctcgagtgg

SEQ ID NO: 65353 - DNA, 6892 bp, Oryza sativa
gtcgtgcggactggccacgacggctcgcgggtgattcttggcgagatctccggccacaagctgtggaagaaagactacgcggccgccgcggaggcgatggcgaccatgtcggcgatggacttcgccaccggcgtcgacgagagcgggccgtcgcctaccgccaccgccgccgccgccgctggcaatgtcggcggcggcggcgcgcgtgcgcggatggggagcgtcgaggaggagatcgcgcctgtgccgaggctgacgaggttcagcagcaggaagatcgggttctcggcgagcttggcgaacatgatcatggtgagccaccggaagaaccgggtgctgacctgcaaggcgacgagctcgctcgccgccgtcatggcgcagatgctgtcgcacagggccacgcatctctgggtcgtcgaggatggcgacgccgacaaaggcgccgtcttggttggcatgattgggtacatggagatcctcagggcggtcactagaggtgttgttgtccctccggcttgactgctggctgcaaatccagtttggattaaacaaattttggtagattttattgtttgttgagatgtttttggagatggtattgttttcttgtttgagttagtaattagaatgtgttaattagctgtacagttattataattgttttgcttagatgggtgagtgatgaactgactaagtgatctgaattataaaagggattgcccaatgggcaatggcagctgtttttgtaactgtgaagtttctccatatttgagcagatatttcagttctgttatcttctgactatttcagacagcttgttactcgagcttcattcaggggttcaggcaatgcaagaaaaattcagtgagcaattcagatacgcatagttcagatagaaagactacaaaatgtcttacgtaaccacttccgtaataatggtgaacactgaataatacaacggtaatttaaatacatctggcaaggaaaaggcacattctgctagtaactgaatggtattgttgttgcacaggtacgaggtggtttgatagtatcccacgctaatccttccttagctcaatgaactcacggtgagagccggcgctgttgatgacaacaatctccagtttatctccctgcaaaattcatggaacaaaattagaatttgaatcaatactgtttagttggccactagtgattaacttcgagcaaccaaagagatttaaatcatcatacagtgtatatgtctcgttctgtggctgatgcaaaaacgtccttaaccagatcgacagcatctgattgagataatggtgtcactgcatcctgcataataacagtgaattattagagctctcattcgtcagaagaaacatacttgtatctcataaacgaattatattgttttgttttcacaattcttctagagagtcaagcactagctgaaattatataactcacccgagctggaagtagtaatgggctaggagattttagctgattgtccagaacaggcatcatcaaagctgcacctgtcccctgagcactataacctgtcctttcataagacccaacagcatcatatgtgaagacacatcctttacctgcaaaagaagaaaagatattctcacaggtcgtgatcatacgttcatactgatgagcggccactgtaagaggtaaagaagtaaccccaaatcataccttcgctgtcaagtccacccaacacattgaaggcatagtatgggaagaaccttttgtagtagagcgtgttggacagtaattgcgccatcgcagggcagctcattttcttgttatggttgtgttcataaagctataaaagcagaaatgatcataagcttgtactgaatagaaacactgttcatgatcaaaactttgaataaacaaagaaccatgtaaaagatcagataatcttcagggtcagggcagatagtagatcagattattgcgataaagttgtcgaaaatgtggttaatcatgaaaatttcttgcagttacagatggttttagagaattgttcagacttaccaattccttggcagtaaggttcctctgcaaagctttaacatcaccttgaaatccagatgaggccaaaacacatttatccgctctaattgaaggtttagggaaacggcattagcactttattcagaaaaaaaaagagagagagctttccaacaaatatgttatgcgcagctgcgtcgtgattatttggtagcaatattttaagggatagtttgcagaagttactataggaaagtttgtgcactgaaacagaggatttgggctgaaccttcatccaacgatacattcagattcaatttactcctcacgtataatttcgggtgcagaaaatcaacatcagtaatactacccaataaattcatgcgcactccacaaaatttcagctaggcctattttatttttttcaaattcacaacatatgcagtctcttcccttcccttctaaaaagaaaacatgtgaaatctctgtctctctggtaattaaaaaccacaaattcatccctagcaacgcatccatgattgactaactgactaactaacaaactaactataagcgggggattaatcagaatcgccgaatccaaccgagtccaattcgcaaatcggaccacacatcatcaaacgtgagtaggtaggtaggaaggagggtttggaaaacatacaggtgggcgatcttggagctgtcgcggctgaggatgctgtatccgacggagaggcgcgtgtcggcggcgaccacgcagtagtcggcgccggcgacggccacgcacgtgccgccgttgttctcgtacacctcgaacctcgccatcgatctctctccctcgctctcgctcctcctccttctcccgccgcctcagctccctcaccaacctcaaacctcggcgtctctctctctccctcaggctggcgcggcgcggtggcgcggtgcgttgcggcgaggcggacgggcggcgagtgcggcggcgatcgggcggggcggggcggcgcggcgtcgcggggaggctagttttatttcggctcggcttcttcttcttcttcttcttgtgctgcaagaagagggagaccggctcggaggttgcttcgccagtgggccgagtccgagtcgcggaagaagctaagagaggctcggtccggcccggaacggcccgtcttggagttggctggaaaactgggggccgtaagagatgtttgggcttaaaagcccggcctacaattgggccggtttatatgctcttcatcggcctaggggaagctagcttagcccatggccatagatgaacgtttttgcttgtttgtttttactcttttaacattaaccgattttgctatcgatcactagcgtgatttttttttgctgacatttcacgttttttttgcagcctcgtcagctggcgtgtcggacaccagcacgtcagccttcgtgtctgtgtctagctagcccaagcgcacacgataatggagattggagaagcacggtaacacagtggcctctgaccggcgagccagccgccggtagcacggccaatactgatcagcgagagacaccgttcctctcgtcatagtcatgaaatataaaattacagtcctatataactaaaattacatttgtaaatttagttgatttgataggtaagtgtactgtaattttgataaaaaataatgtgtaagtaaatatgtacttattattttctttaaaatataaaattacagtcctatataactaaaattacatttgtaaatttagttgatttaacatgtaagtgcattgtaattttgataataataatatgtaagtaaatatgtacttattattttctttaaaatataaaattacagtcttatataactaaaattacatttgtaaatttagttgcactgtaattttgataataatattgtgtaaataaatttgcattagttattttatttcaaatataaaattacagtcctatataactaaaattacatatgtaaatttcgttgatatgacatataagtgcactgtaattttgaaaaaaatgttgtgtaagtaaatttgtattagttattttattttgtaattcgttggatgcaaatccaaggaaagaaaaaatctgggtgattttatctcaaaaatcacccgagtgatgcataggcggtcccaacattaacattttattatctcggttttcattagcatactctttaaactgctaaacgatgtatttcatgcgaaaattttctatacataagatactttaaaatattagataattcaatttcatgtttaaaataattaaaactcaactaactatacggtaatgactttcccttatgtgcccatagttcatctttatctgacatgaattcgaatggggctaagttactaaagtttaatagtagtagtagcttattgataccattcgtgtaagttgcaagattaatatagtcccactttcctagggcaaagacaatataaggtcccttattagttgtatcgttttgggacaattaaattttgcaagaatttcacatgaaaaccttgatttttttttggtatgtacgatatgaagtttagattggataacccagattaatctgagagcctcatcggttgcctgtattacctaataagccaaaacagtttactaggaaataaaaattaatttataggtaatttttttaatatatttgttcataacgatttaaaagtcaatgctaaaaatagtttgcattgaaaacatcttaaaatcaacttcagaattaagtttgaaaattcaaattttaatttttgctttggcttattatgccaaccgatgaggctctgaaataggggcttttaactatttgccacttttagatttggcaaaaaactacttgtcacccctatctcaatgacatgtgggtccacatgtgtctatgacatgtgggacagtggcaaaaagttaattgctgcatctaaatgtggcaaaaagttaattgctgcatctaaatgtggcaaatggttaaatatctcctgaaatacgtgcaactcagtgaattttatgtaaaccagctgggatgttttcatttgatcagccaaggcgtccaccttggtacgcacacagcgatcattttcttttctaaagtgtatatgactctatgagcaactgggttgaggtccgcgtcacatcgagtgggcagaacggtggaacagctcagctcccctgcagccaaaaacaaattcagttcaccagcaaaagaacacctgggtttaaacaactccgttctttaacgtcaaaggagatttactagtctatttctcgagccatgacgccaactgctttcttttgctttagttgccaggttttaatcttgtccgtgaatggaaagatcaaagtttgtgctaaatttggtttagaggagccaccactgttaagttagtgcgctgacctacctgcaggctagctcctctttaaaattctctccctttttcattgccatccaacatgttttgatcagacttctcttgtttcaggatgaaaagattgtttgccaaagcagtagccgtctatatatgtgctagcttacttgtttccgttcatcttttcattcttttcgcttcacagaatctctgagttgagtctcattgtaaagtcaccatgcttcatactagtttatagccctcattttaaaaaaaatctcttggtatggtaaaaaacagctagagccgttgtttgcatcttgtctttctctctctgttctttttttaaatctcccatggcggcctagttgcaatttccttttttctttcacttttcacagcttatgtcaaaaccattagcaacagaggtagtaggagcttgcaaatggcagatgaactaaatgatcagaattcagagcataaattcttgcgtgtgggatcaaatttttcttcaggtggatgctcggatatgttggggtagtagtactagtttctttggagtttgtaggacaagttgatcgaagccactcatcaatggtaagcatgtgctgatctgctctcggatagtggagttctgacgcaggaaaacatattcgtagggctattttgaaacgtaggaaaaaaacatataagaataggaaaattgtagaaataaaataattcacggctcatttaatactactggaggtgaattcacaagtatttgtaaaaaatgttgttacctagcactacatgaaaacataggaattttaagagaaaacatgtggtcatgtctctttctaatttttttttaaagataagcctcgaaagagcacagagagcacatgtttttattcaagaataaaatgttttgtctagtttttagggaaaattgggcccaaaaatctcacgtctgacgtctctttctaattttcctttaaaatacttatgaaattagctatcccatagaaatttcaaaatattttgtggaggtcatttcttcgttttaaaggggcatgtagaaattatttccaatggatttcaatcctccaaaatccctccattttttcccatgttcccaagcagccaacattctctcaaatgctacaatgaaatcaacatcgcagttctgaacatcaatgcgtccgtgcgtgcgtctctgtcgttcacgtttcccaggttaactattaccaacctcccgacttcgattcgatcactccctgtctctgtagcactaatgcgaaaatgctaagcttagctttgtcagatcagaatcaaattcgcatgtaaatatgtgagttcaatccgatcgctcaccgtgtctctaccacaagtgcgaaatgctttgctagcttgtcagatcagaatcaaattcgcacgtaatatattcaggtctacgtcgagcgtaatcaatcgaactatcggtctagcgcagcgc

SEQ ID NO: 65354 - DNA, 4468 bp, Oryza sativa
agcgcaatataacaatataacacaatataaatctcttgctggaaataaaatataattttcaacagaattaaggtaggagtttttacgtattcattggaataaaatgtaaatgtagaaaaaatcacataattaggccaataatgtgttataagaaccaatataaatctagacttcaatacaacgtaaatttacaaaaaaaccatgcaaaatggaaaattaaatcctagtgccgcggtaaacgacttaactccaatacaacgtaaatcacaagaaaccacgcaaaacaaaaaattaaatcatgcagatagaggttttacggtgttaacgcgtaccgttatacctatgcggtaccttttataatttgagagacgattctacccttttctctctactagtaaaattatgtttttatccttagtacctaagtacctatatcaatacttaaatatctttaacatggtacctgtgattgaggagcgttggatctttacctcttttggaatgcaaacaccataaaacctctctatatatattcagctagaaatctgtaccagtgtgcaccaccattcattcgagtagaggtggaaaaaaaaactcgaagcttgtgacttggatcaattcaaactcatagtcttaatgagtcgatccgagctccgtttagctcgtgagcttaatgagctagcttgaactactcaagcttgagtttagctcgtttgtaaatgatatcatcatatctttgtatacttagtgcttgttaactagtccttcatttttttaattacatcaaaactattgtatttagtgagtttaatgtttattatgttaatatattacaaaatcataattttgaaattattaacatgatataaatgagatagagctcgttaaccaggctaacgagcttaacgagccatctcgcaagtcaagccgagctagcctcttagctccgaggaattttgcgattcctcgaggtacttaaattttacactattacttttagtatcttaaggtacttactatctatactatctagaggtatcgaattttacacgtatctctgtaaaaattacctttcagctcatcaaaattaacaaactgagacgaactagctcattaaaataactgagttcaaacgagccaagctggcctaaattccatggtaaaagctattagctagcaatgtctccaccacgtcgatatcgatcgagtgcaccctccatttactaattacttccatattaaagctatcatcaatccatccaatatccatcgtgcactgacgaaaccagctgcattctgctcccagtaagaatcagaactcaattcctccacatatatgctctgcaaactgcaactctgcaactgcatccatcgattgatagatacatgcacatagctgcatctgcatttgtttgttcctgtcacctttgtaccatccaattccaaccccacatttcatcctcgatctttctggtttgccgagccaaacagagcaagcacagctagtagctagccaatattcagataagagagtggagtcaggaactcattagaagagacatctttaatttgctcatggccattgggacccaatcacccaacacatttgataattgatactccattttgattcctcttcttccccagctctagctatatataaaccactccaatggcagcacacaaattcatgaattcccagttcagagtttcaggtactctcaatctgaaacatatagaggagctagtagcaaagagaagtaattagagtgagcttaagtagtaattaattagaggaggttaattaattagggaagatgataggatggggagatgtgtacaaggtggtgggggcaatggcgccgctgtacttcgcgctggggctagggtacgggtcggtgaggtggtggaggttcttcacggcggagcagtgcgccgccatcaacaccatggtggtctacttctccatgcccttcttcaccttcgacttcgtcgtccgcaccgacccgttcgccatgaactaccgcgtcatcgccgccgacgcggtgtccaaggcgatcgccatcgccgccatggcggcgtgggcgcgcacgcgctgcggctgcgccgccgccaaggccggggcgcagtcgtggtccatcaccgggttctccctcgccgcgctcaacaacacgctcgtcgtcggcgtgccgctgctcgacgccatgtacgggaggtgggcgcaggacctcgtggtgcagatcgccgtcgtgcagtccatggtgtggttcccgctcctgctcatggcgttcgagctccgcaaggcctgggtcgtcggcggcggcggcggcgtcgggccggcggtgatgtcgtcgtcgtcgccgccggagaagcagagcgacgtcgagatgaacggcgccgtcgtcgcggcgccgggcggcggcggcggcgtccggctaccgttctgggcgacggcgaggacggtggggctgaagctggcgaggaacccgaacgtgtacgccagcgttctcggcgtcgtgtgggcgtgcatcgcgtacaggtatatacgcgtcagccatgcattgcatgcgccatcgccatcgccatcgccgtgaagtgaaactcaagtttctactagcttcttgacgtcgccgtcgccggtgaacatgcatgcaggtggcacctgagcttgccggggatcgtgacggggtcgctgcaggtgatgtccaggactggcacggggatgtccatgttcagcatgggtaagctagcatcggcataaagtttttctttttctgaatagccgaataattttgcgttataaagttggaaaataggtttaaagctgttgcaaaaatcgcaccatttaggaggccagttgcagggttcaaaatcccgataccagatcgaagtccactcacgggcggtttctttggatttcacataatccataaaaagggataaaaactgatgaaatccgaataaattttaccaaaagaattaaaacttagtttaatttttttaaaacttagatcgaaaaaccgagcggtatgtgttttcgacccagttcgaaaagttcagatttcacgtaattcgaactagattctactggatttatgtttgatgattcaagttgttagagaaatgttgttgcaataatggttgttgttgcatatgctgaataattgctgatggatatcatatgtagtgattggatatgatatatgatgagatgcagggttgttcatggggcagcaggagagggtgatagcgtgcggggcggggctgacggcgctggggatggcgctgcggttcgtcgccggtccgctcgccacgctcgtcggcgccgccgccctcggcctccgcggcgacgtcctgcacctcgccatcatacaggtacacctccttaattttgccttgtcgggaacacaaactgttcacgtcacatcgccggcgcttttcgccgtgtacttagatacatgcaggggaaagtgatttcgtgtacacaatttagcttgatagactaatataaaatataccactccacaaatatacaaattgaattttttttatttacaagttgtaaaaaaacaaatatagatgcggatgtacgataaatattttaagtttaatttgttttttttctaatttgtaaaagtcgaatttagtcttgtttgtcttgaaatgatatattttatattaatctatattattaatttttttataactatttagatgatatgaaaaaacaacgagatattttctcgacagtggtaatttagtttcgccttttgctttcactagtttatctcttctccgatctcaattaaataaactatatatatccggcttcctagagaaaacaaatgagctcgagaggtcggcagctagtgcatgctaactgcagatcacttcgatttgtcgcttttctgaaactcttgtttcgtgctaaccagtgagcaactaagcaacttggtgagtggtatatacgtacccaacttttcacattggggatgtgtatgtgtagtgcatcagcagcagtaaacgaactagctagtgtgccatgcatgcatggatacaccagataagtcacaagtatatatcgtggcttgcatttcaggagtttggaaattttcaaaaatcagtcatcactctcttcttgtccatatattggatgatattttcaatggttctcatctcccctgtattactaatttaaacaaagttaatcccttctttagataaaatgataaaaggttgaacaataaattattctaactgataaaaataatacaaaattacattttcttttactgtaatgcaaaattacatttataattcaatataacaccgagattccagataaattaaactaaaattgcacatcgcataacaatgcaattttaggctttagcaatgtgtaattgcaagcgacaaattttaacgcccctgaaatctaacaaatatgtaaggtgcttaaagttttaaa

SEQ ID NO: 65355 - DNA, 1947 bp, Oryza sativa
caaattttaacgcccctgaaatctaacaaatatgtaaggtgcttaaagttttaaaatttcagccacctttttcatctcttaaatgataatcctcatcactcctaagtcactactccttaaaagaggtttaatactcctacttctttgaacttttttaaaatgatgtaaactatttttttctttttcgaaatggcttgtgggttcatgacttcattctactccatatatatggtgaaatttaactgctagtgctaaaaagagaggtatttagaggttctatgcatacacacgcatgtataagacattagcatgcattccgatcttaattaatactgatcatgtaatcaattttcatgtacatatatgcaggccgcactgcctcaatcgattgcttccttcgttttcgcaaaggagtatgggcttcatgccgatgtactcagcacggcgtaagttaattaattttcattaatttagtatcaacctgatgattaattatgccgtacgagttttccttaactgcgttggattatagattaattacagtatcagtctgccgttgaagtactaataacttgattaatcactaacgaaaatctaattttgaatgcagggttatattcggaacattgatctctctgccgattctgattgcatattacgcggttctgggctttgtctaacatgcatttacagcacggcatgcttacttatattagatttgcttcggtccaacaaaaattatctcgagataccgatacctcacggtaccgataactcatctgctcagctagatccaacgatcgaaaataatttggtaccgtgaggtaccggtatttcgagatactttttgttggacgataacaaacctctaattacatgatgctgagatctaaaccaatgtggagcgcaatgacgcaacagaaggatgttaattaatcagagtacttcagcaatagagagtttcagtgttgcaagctctgattaatgatctaatattccaattagtcgatattgtatttcgagcaaagtaaataataaagttttcaacagttttgctacctaatattactgtacgtggagcaccagggaaattaccatacacgtcgagatcgctttgtgagcatgtgtgcaaaattcgtgtgtttaaggtctccccaatttaaaatgaaagaatttcatgggatttcattggaaacgaactaaaatcctgtattcagaaagccttatttttctattataggaaattcggtatttgcttcaaaagaagctgtttacaaagtcaccagctcatcaaatgactacaaataacagtacacgtgatgacaaaagaaaaaaaaaggttaattatgtctctagccttttttttatttttgaagaaaaattctctagctttcattaggaagaaggacgatggaaaaagctcaatttattggtacaaagttcccattgcctccaaagcagaggcggattacgtagacaactagccatgcacactctttttttttagggaaagtcattcagcgagctttattcattagacaaaatggttacattgttcactaacaaattcaggataaagctaggtgattcatcaacccaaatatcagaatactagctatgcacacttggtttaacactatcaagctacatttggtaaaacaggtttttagctctatccaacaaaccggtttcatggttgcctatcgaccactccatcaaagattacacagttacactccttttttccaaaataaataattttttatatacaaatctagacatatactccatattcagattcaatacaaaagttaacttattttaaaacagaggagtgagtcattccacaacgcaagttcaccatttccccgtcaagaggaaaaataaatgcagtcacatcaatcgctccaccaaaaatcaagctcaaaattagtctgtacataaaag

SEQ ID NO: 65356 - DNA, 806 bp, Oryza sativa
gatccatgtgtataagctgggcctggaagtttgagacatgaaggccttactctggttgcggctcgtcgttttgaatttgtcatgccaaataccggtcatgaatatttgacatttagaacaatattcaatcaaacctttaaaaatccggccatcaatgttatattaaaataagtttataaaaaccaataagtttcaaagtatttgaggcaaatctaggcataccttttttttattaaaaaaactaagcattagagaaattataatcaaagtttttaattttgaccaaatctaacaccgaacatcaaatgtttgtgataaaagagagtaataaacaagtactgtgagccttgttttctccaagaagattcaagcctcatttggttgaaaggattttttttaaagtacataaatatgcaatcctttggaattgacactataccacagtgaatccaaaggaatccaccaaaaggaaaactacagtaaaacttgctatcccttcaccaaaacagaggaaaaaagaatccactcaattacaatcttttcgatcctttggcttggctcacgcaggaacgacataaaagattcctatgtttcacagtgcttattgtaatttgtaacaactctatctaaatctcattacatgaggctcctcttcgtcgccggccctgcgaaaaaacaagcaaaataaaatctcttaggcctattcggttcacgggatttcccaatcacaagaataggaaaaacatagaaataatgtaggaatgcacgtgcaaaaaaaatgattggaacatattaattttttctac

SEQ ID NO: 65357 - DNA, 8132 bp, Oryza sativa
  unsure (1)..(8132): unsure at all n locations
accatcatattgttaacctcaattcacaccatttccatttattcatgggcataaccattatacttgtaacaaaaataatgtgtgcctcaagctaataggttttacaggtgtcataaagggcacactgaaaagacagaaaatgagcattagcaagcactgttgtcttattacaaatggggatttaatttacagttcatatcgaccatagggcctcagacagagcagagcttttcaagaatcatgttctcgtcgccgtcgacaatcttcagagcactcctcacgatgtcttcagggaagcccatttaaagttttaaaccaacttatgcacatgtggtcacagtcacagataagttgtactccgtatatccaatggaataacaaatactccgtataactcggtaacaatacattttcttccataccgacggaggtactctgcaaaggcctctatccagtagcagaaaatatggaatagtcacgcaggtactgcaaaaatggattaaaacaaacattaagagcagaacacaacctcaacactgattccttaaaacttgttaattagttttgaccatgtctcgaggttaggaatttctgattctgaatttatgactggaatttctgaattttttattctgaatttcttatactctgcatcgctttagtcacggtacagaactcaacgatttactcaccggggcccattaattatacagccaagataaggtgtagttcagattccgaactctggacctagattgaataaccaagtgactttaccaatataaaggtacactaaaacctaagttggctctctctgacccaataccttcaagaagaaatgaaaaaagaaaaggaaaaaaaaggcaatggaaatataaaacatgtagagtatagcatgcgcaaacacatctctaaattctagtatcatcaatggtccttacccagctccaagtgccatcattggtccacactgtagctctagccatcatgttttcatctctaccttttcccagcaatttgagaagctatgaaacaaacagctagagctgcaaaatttctccattacaaagcttaccagagccctgaccaattttatatcttcaatctcacctgcaagagcaccaaccagttttcagtcttcagtctccattcactgagcatgaaggaaagcatggagataatgactacatgaatacaccatgatggatcctctatcatgcaacaaatgaccagatccagtgtggtcatcagaagaatggaacaacgtcgataagacttcttgaaccagatacactgctagccattgcagccacaaaccgtaagaggcagggtaaagaaaaaagtgcattcttctgagaccaaactgcctcttactcccttcttttccccttcctcttacaagtcaaattaaatgttcacatgatagaaaagaaaaaaaaaaggagtactttgccagcacaaagtgcattcttttaggccttagccaaaagtcaagtgagcagccagctatatatgcaaagtagcaaattagtgacaaatcaacggaaacaaatcttaaaccaaagaaacaaatgtaactgcatccaccaacatatcctccattgtcattcatcgtgctgaaaagaatttcattaggatcaaaatctattcgaatcttgttggttggtttgtgctctcatcaattgggtttgttaagtagctaaacaatgttgttttcttccttttgcaagttatcagtaaataaaaaactattaaatagaaggctctggttctcattcaaaatatcaatagattagatttcatagtctacctaattgctacacagaagtagggaatacttacttattagtgccataacctgattagaaatagcatgtgagcacttgagtagagtagcagtagcagaccaggacgcgaccatgcgcccgtgcactgggctgttgctagctgctgctgcgcccgcacgctgcgcgtcgacgctgcctccgcgcgtccgcaccggcgacctgctgccttgcgcatgctgcgactgcgccagctgctgcaccgccgctgcgcacccgcgtccggcctgctgcaagccaccactccaagccaaaccctagccaccgccagatctgaaggtggtgcatcctcgggtcggggcagcgacgctgcgacggagtgggagaggggcgatgagacagcaggaagcagaggatggcgtgttgtggtgtgggagagatcatcgccgacgaggagaagcaagccaggtggagggaaagaccgggcggcggctgtcgcccgtcgcaaggaaagaggagagagcgagagaaggagaggggaaaggtagggaacagtggcagctagggcttcgggtggggtggggtgggtagggattttctttttttcagaaaaacccctcacttttcgtttatcagagcgcagccctattttcccattttttccttcttcgtataagatatagtaggttgtggagggcttttacataagaatacagaacatagaaacatatagtgagggacctattataaattatatataaaaccaaggtcttttttgaaaattgccagctcgaaaaacccctccgccttccagcgcgcggggcgacgtggatagcacggcgatcgaacacgcgactccaaaatcgttgtgggaggtacaattgggggcaggttgcaaaattataatggcatggttttaaattaccctttaatataaccgatgtggtgcttaaatcttcttatgttttttttattttagaaatggatccttggtttgctatccatctgtacattttttttgttttaaaattaaatgatataattttcatgtgttgatacaacaaatctacttctacatgttataaaacagagattagatcttttacttagaacttgtatttcttaggaaggttatagcccaaccatccgtttcagatactatcggattgggtcgtcacctccctactcaacgtgtatggcatgacccagctgcctcttgcaagagggaaccaaatttgtgaatcccatgtgccggggttaaccattcgacaattggcccggagctctcaaatcacaggagctttctaagagagattctggtagatatcttattgacacgacataattgacacgtgaaaaatatttggagttgttcagctaaattatcaggttgccacgtggcccaataacatgctagaattataatcctgaaatcggtataaagatttaggtcatgcttagttcccacgcaaaaacttttcatcctatcacatcaaatatttggatacatacatggagtattaaatatagataaaaaaactaattacacagattatatgtaaattgcgagacgaattttttaagcctaattgtgccatgatttgataatgtggtgctaagtaaacatttactaatgatggattaattatacttaataaattcgtataacagtttacatacggaatctataatttattttgttattagtctacgtttaatactttaaatgtgtatacctgtatccaatgtcagaaaacacctcgtttttcgcatgcacgcttcccaaactactaaacggtacgttttttgtaaaaaataatttttataggaaagttgctttaaaaaatcatattaatccatttttaaaatagttagtactcaattaatcatacgctaatggttaatctcgttttacgtatcttctcaatcacctcttcaaactcaccgtgtagtccacggtgtgtaacgtgctcccctgacatgcacatatgttgaggggggacgtgtgacactgacgtgcgggtccacaggagtgggccccacctgtgctgcttcctacagtgcgtgtataagatgatcactccggccatggccatggcgaatcatccatccattcctgcttcttggggacgcaggcgaggtggttagattgcattagctagctgtagaaagctagcccatgggtagtaggaagagaggaggaggagccgtggcaatggcggtgcgatgctcttgcgccggcggcggcggcggcgagcgcgtcncancngttgtcgttggaagggttcagccgcttgtcgaagatcgccgtccacaaggccaccgtcgacctccacggctccgcgttcgtcagcgccacgccggcgttgctcggcgaccaggtacacgcccgccaccgccgccgccgccatggtcggtttcagagagagatcatgaaaaaatacttgttttaattggagacctgaagatccggggagcaaagaatctggcgaaattcttgcactcacagcacacagactatattaagctgattaatccaaatcaactaactgaagtactaccaagaagtgaaaataatatctgaattgtgcgactgttggttgattcgccttcgccaggtagacgacgaatgaccaccgaacattttttagcggagcagaatgcataacagcatagatttcgtcgtggtatgttaattcacgcgatggggcacgtcgtttcgcattttaaatgcaacaaattaaacccttaccgttcaaatagtatttattatcctagtagtgcacaaaaaatagtttctttttttttcttaagaaaaaaagttattgtcagcatgtacggcagattgtatgctgtatatgtagtacagatcagctaaccgtatctctcatcatttaacaacgacaagagctagcaagaagcataaagcagtacgccctccctccaaataagtactacagttttgcactattcaattcatatccaacatttaactattcgttttatttaaaaaaaattatgattaatatttttattagataaaaaagcatgaacaatattttatgtgtgactgatttttttaattttatcatacttttattaaataagacggatagtgaaacgttggacacagatactcacgactgcacttattttcggacggaggcaggcctgatttagttcccaaatttttttcccaaatacatcacatcgaatctttcgacacatgcatggagcattaaatatagattaaaaaaactaattgcacagttagggaggaaatcacgagacgaatcttttgagcctaattagtccatgattagccacaagtgctacagtaacccacatgtgctaatgacagattacttagactcaaaagattcgtctcgcagttttcaggcaagttatgaaattagttttttattcgtatccgaaaactccttccgacatccgatcaaacattgatgcgacacttaaaaaaattttatttcgcgaactaaataggcctgtactaccaacaaaggcaggcgtgatctgtaccttcgattaattaaactacacaaaaaagagcgcccaaacctccgtttttttgacaaattggtccttatagaaaacttatttcgaaactagtccataccaaaaactatatctagaaataggccgtcggctcagcgccaacctctttggcgctgaggttgttcatatcagcgccaatgggactggcgctgacatcgcgccagcgtggcgggcgagacgcgacgtggcagggcctcagcgccaatgtatttggcgctgaccccttgtacaggctaattaaaaggatgcgcggccattaataagcaatgcacttgtggtacaatggtatgaccatttgcttgtgtaccctagcaccatggttcgactccctatcacggcagccttgtttgttctttttttttcttcaaatcttcaatctacgtgcgtacattagtacatataaatgattaatgatgctctctgttttttaaatatatataaatataaatatcagaatatatgttctacagcggcgctggcctttatactggctaaataaaagcaaaagcaaaagcaacaattaggtttggcttagctcagtggtaggtatttgaacggtggcgttacagtgaccagggttcgaaccctctcctttatgtttttactaaactttttttttacttagttctcaacttgcggttttaactttttcaaagctcaggtatttttaagtccattcttttatttttaaatatgtactaaatgtgttattccttttaaatattttttaaaaaagtgatatttcttttacaagctcaagtgttgttttaattttaaaaaaacacgtgacattttagaataaaacttacccttagttctcaacttgttgtttattttttaaaaaaaaaactcaagtttttttaaatccattcttctaatttcttttttataaaaaagtgatatttcttttaaaagttgtctctaaactttttttaatccattcttctactttttaaatttgtactaaatgtgatatttctttttaataaaaattaatttaaacaaaaaaagtacattgaagatttgaagacaaaaacgaaaatggagatcatcattaatatgtacgcacgtagattgatgattttaaaaaaaaacaaaaatggctgacctgggattcgaaccctagtcctcagatatagcaagaaagaaacttaccgttgcaccacgagcgacaccgttaattcattgtcgcacatcggtctatttagggtgtgcaaggtgtcagcgccaagtgcattggcgctgaggccctgccacatcgcgcctcgcccgccacgctggcgcgatgtcagcgccagtcccgttggcgcagataagaacaacctcagcgccaaccgctttggcgctgatccgacggcctatttctggatatagtttttggtagggactagtttcgaaataagttttctgcaaggaccaatttgtcaaaaaaaacgccccaaacctgaagtgacccaaatcagtcgtatttgctgcaataattgaggagttcagcacataaggataatatatataaagtataataattaagagaatcaaactattttatacctacgcacgaggaacgacttgataatcttctctctcacctacttcctcttctcaacccctctgcaaaaggataatcgaaagatcgtttacaattttttgagtggtttcggtgtttagtggggcgtttgcgacctccttttagatctagcgacaatcgatcacgcttagcgatggttgggttggtgttgtgtagttccggtgtttgcccgggcgtttgtgacctccttgtaggtctaggttgtgtgagctaggagctatcaactcgtggtggtggcgtgtttggtttttttaagttactattataatcttataatttatttcctgctatatcagtataaaacttcgcactatcttgtgtgggttattttaaaaaatatttagtaccactaaactataggagtaacaaagaagtcaaagttgtttctccttgttttcttccttttcatttatagttcagatatcaacccggattaacttgttaatacagatattttatcattatatgttattaatcacaaatgtatataaactagtgaattttctcacacaattttgtgtgaagctaaattttaaaaacatgattagatttatattaaactcttgggacaattcttacttattttcccataattatgattatattccatatacaaccataccaatcaaatctaaatattataatttagactccccgcaaaaaaaaataatttagactcaccagaagcaaatggtgcgaacctttttttttctaagattaatgtggtaacacgtttctagtcgttcaaaccaattaatatcatttatacaattatacatgtaaaacattaatatcttgcacatactagtgatgtaagcttttgagatatattatttgatgacttatatattactgtctgcatccacaaatataaacatgcatttagacacggtttccaacatactacttggactaataataagaatttagcgtgattcacgagtttattattaggtacgactcctaagtgtatggtaaagtgtcccactcgtgatgatgtgagtgctttttattgtttctgtgagtgtgcatcatgtaattaaaaaacaactacacatgatgtataataaaataataactactccttccgtttcaaaatgtttgacaccgttgactttttantncatgtttgaccattcnttttattcaaaaaaaaattaattaattatttattctttttatat

SEQ ID NO: 65358 - DNA, 9504 bp, Oryza sativa
  unsure (1)..(9504): unsure at all n locations
ctgcaagagttaaatatcattcctattcccccactttagatcctgcctatgccatatttggatctgcgtttgttcagcagccttaaacaaattgacaagttgagacgattgaagagaccccaaatacaaataatcccaaaagaggtgacgatcaatgtccaaattaagcaggtaacgtgctccacgccgacgattaataagtactacatccgtattttaatgcacgacacctttgactttttgataaacgtttgacctttcgtcttattcaaaaaatttatgtaattataatttattttattatgacttgatttatcatcaaatattctttaagtatgatataagtaattttatatttgcataaaaaaattaaataagatgagtggtcaaacgttaattaaaaaatcaacggcttagtataatttagtgtagtccactgtgtgtaacgggctcctctgacatgcacacatgtcaagggggaacgtgtgtcactgacgtgcaggtccatacgagtgggccccacctgtcactgaagctgcttcctgccgtgcgtgtataagatgatcaccacacggtcatggccatggcgaatcatccatccattccagcttctggggaagcaggagaggtagttagattgcattagctagctgtagaaagctagccatggttagtaggaagagaggaggaggaggaggcgtggcaatggcggtggcgatgctgctggcggcggcgagcgcgtcgcggccgtcgtcgtcgctggaagggttccagccgctgtcgaagatcgccgtccacaaggccaccgtcgacctccacggctccgcgttcgtcagcgccacgccggcgttgctcggcgaccaggtacacgcccgccaccgccgccgccgccatggtcggttagagagagagagagagagagagatcattaatgttttaatttgagacctgaattgaaatatatagatccggggagcagagaatctggcgaaattcttgcactcagatcacgcagattatgttaagctgattaatccaaatcgatctactcctatatattatatccccatttcatatgcatgcgtggtgtgtttagctaactgaagtagctgaccaagaagtgaaaatatctgagttgtgcgactgttggtggattcgccatcgccaggtagacgacacgagtgaccaccggagcagaaatgcagaacagcatagatttcgtcgtggtgtgttaattcacgcgatgggggaacggtcgggtgcacgttgttttttgcattttaaatgcaaacccctaccgttcaaatagtatttattatcctagtagggcacaaaaaaaagtttatttttttcttaagaaaaaaagttattgtcagcatgtacagctaacggcagattgtatgttgtatactgtagtacagatcacggctaaccgtatctctcatcatttaatttgttgttggtttataggccacaaccaaaatttaaatcttaaaacttaaagttgagttgaagaagttttcattaattttttattccgtaaaatagagttttttttttctcaatcgtagtttatttttcagtattgatttttaaaccagtaaaaatataaagatatggaaattttactataaattttttttggtacttctgtttattttctctgtgatttatcttagcacttagcaaaaaataaattaaggcatcttagcatgaagcatcaaggtcagcgtgtgcaagtaggagacacttaatttgatcattttaatttgatgctgtcacgcaagaactaaccagaggtggcgcaccttgactttgtttctttaattaacgagcatttagcatggaacttttttttacctactgtaacctgttgcttagtgagaaaagagtatagagcatgaattcttcgagttgggcccttcggagtttttgtctgctgtacagactgtcaccggcgacggagtcaaaaaattatagaagactaaaaatatagaactcgactaatgaagtattaatttttcaaaaaaaaatactatatggtgaattaacaaaatttaagcaagtttttggaggcagttcaagggcttaagccttagctaccctaggcctgcctccgcccctagccaccggtgataatattctactccgtaacagctagcttacttgaaaaaaagaagacgatgaacaataaataagtttaaataagaagtggtaattaaacatgtgaaattttgataaaagtataggagtttcaaatttgcatcaacatcaatcaatttggcatactgaatgcactacatgttcttcagggagaagacacagagtgggtcacggtgaaatacggctgggcaaacccttccgctgacgactggattgctgtcttctctccggccgatttcatgtactactaattacaacaaaatcctttcaaatttccacattttgatcgtgaaagtagttccttttactcatcagtggacacatttgatcgtgaaattagtttccttcactcatcagtggacacattttgatcgtgaaattagtttaaactgttaaatctgtgtcacttgtgcagctcgggttcttgccctaatccttccagatacccggatgagccgctgctctgcactgcaccaataaaggtggattaactgcaatttctctgaacctgaatcttaacaagtggttgctgcacatatgaactgatgatgaacatgtttatggatgattaacgaatcaattgatttgcgcatgcagtatcaattcgcaaactactcggcgaactacgtgtactggggcaagggcagcatccggttccagctcatcaaccagcgctacgacttctccttcgccctgttcaccggcggcctggaaaacgtacgtgatattatgatcgattaacccaattaagaaagaaactaattaaaactgcaactaattaatcaatcttgatgcaattaatcgcaatatatgtaatgaagaactctgatgaaatgagatgaaatcgacggcgttgttgttgatgtgcagcctaagctggtggcggtgtcggaggcgatatcgttcaagaaccccaaggcgccggtgtaccctcggctggcgcagggcaagtcgtacgacgagatgaccgtcacatggaccagcggctacgacatcagcgaggcgtacccgttcgtcgagtggggcatggtcgtcgccggcgccgccgctccaacccgcaccgccgccggcacgctcaccttcaaccgcggcagcatgtgcggtacgcacgcacgcatatttagattttctctctctctctctctctctctgaaactttttaatttttctaagaaaaactctctcaaaacttatttccaaactaaaatcttttagccacgccaactagattagcgtgatgaaacaatactgtcatgccggtctagctaacatgatatcgttatttcgccatatcggttcggctggtgtggtaatattatttcatcatgctaccatggacaataacattataaagctgtcatgtctgctacgagtggcatgccagacgagatgacatggtaaaaattatttagattttagaaataagtattatgatagttatttttaaaatttaaaactaaaaatttcaataaataataaaaataatcacattatgtaccacaccgctccatttctttctacgaattattggttaagccgtacaaaaataaacgatcaacaaaaagaaatttgtaaaggtgagtgagcttgtatgcttttcaggtgagccggcacgcactgttgggtggagagaccccgggttcatccacacagctttcctgagagacctgtggcccaacaaagagtaagtggcatgttcgatctttaggactgaatagtatggaatgctgaaatagatgaatgatttaagtatacaaatgaatgaatttactattataaaattggaaaatgatttacaataatacttttaaaaaattatatgtagaaagtatatgaaaaatcacattactatttaggagctaggaaagcgtgcatattttttatgcttttatattctattctatccagggaaaagaaacctttgtatgtactattataaaataatctttgatcattgcaaggtgattagtgcagcagcaagagttaattaattatgtgaaatcatgatgaacaattgtatattcagaactgtggtatgtatgtacgtatgatgtgatttcaggtactactacaagattgggcatgaactttctgacggatcaattgtctggggcaagcaatacactttccgggcgccacccttccctggccagaactcgctgcaacgcatcatcgtcttcggcgacatgggcaaggtgaaaattttcgtttctgacgaaggagcaaagcctgcaagaatgttcagaaaccgttcatcaacatttgcctctagatcaatcagaaattactactcctccatataaaacggaataaattcttatgtgacatgcattttgacaaattgcacagctgttatatatatagtgtaataataccgtaattgattgatctgaatatatgcaatttcaggcggagagagacggatcaaacgagttcgccaactaccagccaggatctctgaacacgacggacaggctggtcgaggatctggacaactacgacattgtcttccacatcggtgatcttccgtacgccaatggctacatctcccagtgggaccagttcaccgcccaggtcgcccccatcaccgccaagaagccctacatgattgcaaggttagtatctgttattgtgcaatgttcagacaaactcaacaaatgttcaggcatttgttcatattcatttggcattttcgtgtcgattgatgcagcggtaaccatgagagggactggcccaacaccggagggttcttcgacgtcaaggactccggcggcgagtgcggcgttccggcagagaccatgtactactacccggccgagaatcgagccaacttctggtacgtttcgtagcccacttctatatatttcatttcacgtttgaggaggccacaaaagcctgtgaataagtcaaatggtatatttacaaaagaaaattaatttgtgaatataacttttatatacgtgttcttagcgatctaaaagtaaaaactgaaaaataaactccaatgaaaaaaaccctaaaatcaacttcaaatttaaagttggaaatttaaattttggctaataagtataagcataagtgaaaagatgaggctgataaattgtttatccaatcccgcttcattagtttaagcttttgtgtaaactgattgcgattttacgtatgatgagtagaccacaaaattctcgacatatgtaaattgtatattgatcatcgctccatcggcttaaactttttttggttgaactggctggtgtaaattgtttatcgatcatgctttatcagtttaaacttttttttctatcatatgctctatcggattaagctttttgggtcgaactggtcggtgcatacacgaacacgacacaggtacaaggtggactacgggatgttccggttctgcatcgcggactcggagcacgactggagggagggtaccgaccagtacaagttcatcgagcagtgcctgtcgacggtggaccggaagcaccagccgtggctcatcttcgcggcgcaccgcgtgctgggctactcctccaactggtggtacgccgaccagggctccttcgaggagcccgaagggagggagagcctgcagcggctgtggcagcgccaccgcgtcgacgtcgccttcttcggccacgtccacaactacgagcggacgtgcccgatgtaccagagccagtgcgtctccggcgagaggcgccgctactccggcaccatgaacggcaccatcttcgtcgtcgccggcggcggcgggagccacctctcggactacacctcggcgatccccaagtggagcgttttcagggaccgggacttcgggttcgtcaagctcaccgcgttcaaccactcgtcgctgctgttcgagtacaagaagagcagcgatgggaaggtgtatgactccttcaccgtggagagggattaccgcgacgtgctcagctgcgtgcacgacagctgcctccccaccacgctcgcctcctgatgaatgaaacaagggaaaggatcattattaggatgcatgagttgatgcctcatcgtcaaaatgctggcagctgagaaagagtgatcggtcggtcgatcgagttgggttttattttttttcttcttcttcaaccatttcgatcaggtgtggtagtggtcgatcgcttggctcgatcgtgtttctcttcctcatggatggtgatgttgtgcaataaaattgcttagctgctcgggcacaaatgtctaataagattggcaatctgaatttctgagtccacacaatgcccataaatgaataaattatagaaacaactatttacgccggacaccctccgaatcacttaaaaccaaggtgattttggttgaaatgacaataatatgaagtccatatgtgcaagcacaccccctatgtccagatttaaatttagaagtttttttttaatgaaacagagagagtaagcacctaggcattgacagatacgtggaactatagatggccatatggcccgaggcttgacggcccggcccacatagcccaaagagatgagggagaaaaaaatccttatttaatagagaagcacgatgggctatcgtgcctttgggccagcccggcatagcccgagtcttgttgggccaggggtgcagcccatgggcagtcccagcctggcctgggtgttggtcaggccatactggcccgactagcctcaacccaggcctagtcgtgcatgggccatgccgggccaggcagcctatttggccatctatatgtggaaccaaacagtcaactataagggagaaaaaaaaagactaacctacaaattgaatccaaaacttatgtccaaaaaccaatccaatccaacccacatccatccctcacccaagccgatccaatccattagctatctcaacccgtttacacccataccaagtgaagccaaattgaaaaccaatccattagacccattcccatccaacccattagcaggcttagctgcacaggagatggagatgggaagggaggaggaatgtagcaggatgatatggtgttctcacaaacttttttgtttagggcaattgtattcttgcccctacttttatttgcaattgtgattttacccttactttttaaactttgtgattttgccctcactttttgatgttgaatggtctgtttgcccctgtttaacgtctgttaggtggactcagattaaatgagtttaagaaaataagaaattgacttgcaaaatgtaaaaagacatctctatcccaaaaatttcaacctaagccactgctgactcctcccgatccccgtaccccattccgacctccgtccccgattcctaaccctcgcgagcggtggcggcacacgcgggctagcgagagcgaggagcgcgcggtcgtcgcggaggagcgcggggtgaagcaggctgggccggcgcgaaatggcgatgtcaagctgagctagcccgtcgccgtccgccgtggtggtcactgggctcgtcggcatcggcctcggctatagtgcccgaaccgctgcacagcagatgatcgagtacatacgtactgctgcatatgcgtagctagctaggctgccttgcctccattagcatggccgcgaggagctcgcctgaggcatgatggtgacaaggaggagaagaacagcaaggagaggaggagaggaacatttgagttttattgtcttttactttttcttctttgtcactccccctttagtttttatttttcttactgccttggactattggttggttcctaaactggacaggaccaacaaagctattctgttgttgaaagaaagagatgagagtagtgtttcttgtttgcatattcataaatcccttgattgttaaaatgattaaacatgcagggcaagttcatacgtcaggcattgaggcattgaattcatacctcggtccatagtgtttcttaattaataaatcccttgattttttttaaacatatgctggagaatcgcatttcttgtgtagttacaaagttggatttcgttgttaaaataattaagcatgcagggcaagttcatacctccgttttctactgtaatcgtgaaacacagccaaaacacaaagtcctcacaagccaaatctgcaagggcatagatgtccttttacctgtcagttaacaccattaagccctgctaacggaacaggagcatacttgagcttcagttcaaaatagtgagggtaaaatcacaaagttaaaaatacaagggtaaaatcacaattgcagttgtaaatagggacaagaacacaattacccctttttgtttttatttgttaagttcgctaccatgtcaacattatgtagcaaaaaccactaccatttcagcaccaaaacatgtgctggttaaaggtagcaaaagttcatcttaagagcttgctaaaggtaatcataaaacaaattatactggcgcaaattcttttcgcgatcttggggtgtccaatctcaactgcccaacttgcaaaccctgaaatagccggggcagcccacaactgacatattattctcatgatttatgctatttcaccttaatgctatttgacgatatgatgataagacattgttatacatcttatattaattagtcccataatgcgatgtgacagaccaacacgagaatgaaagccacgccattagacttagcgaatgcacaagacgccgaattgctcctaactgaaattcccgtaaacaacttaagctgatatcctgtggctataaataataactggcacatgcagacgagaattaccttcttatttcttaacctgcagttaattgcctaccagtaagcaattgatctgttaccttaagcggtcacgaagtagggtttcgttctcagtacaatccacacgtccaataaagtagcacccatttgtctgcaggcttcagttgcaagctctagcacagatggacgtctccagaattcaatttgctgaagatgaagagcagccatcacaatgacttagaaccctcatctttttgtttaacatttccattacattatactatatgacaatgcgtgaaaagaccatacctgctcaacttcttgaaactataggggctaataatgaaaagataaagaagcaacaaagcaaagcaactgtcaagactcttcttcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 65359 - DNA, 842 bp, Oryza sativa
gtgagtttttttaaatgattccttatacgactatttttgtatttccaaaagcgtcccaagttggcatgcgagttttttttaaagagatttcacgtcttttttatttcctaaagcaaacgaatctgcaaaccgactcaaacacatatatgtattttcaaaagcgaatgagcattaaaaaccaagtcaaacacgaatgacctatcaaattatcggtaaaaatatcttcaatttttataatagtagagatttagatggtaaggatgatccactcgagcgattaaaatagtttaccatacattctcaaataaaaaaatcacataaagaaactgaatttgctcaaagtgattcacatttgttccgaccgatctgcaggaggcacacagctcaccgatagatatatgatcctattggctactatctgaaaatgcggcagattaaagtaggcatgttcttcagtggtgcgatgcgtacagcttagtacgtaccaactcgatcgatcgatcagcttcagaccggccattggtgccactcccgtcgacggtgactcactcattatccatccatccatatctcgtcgatcggtcgaccatcttgatccgtagcgtacttgtgtttctactgggaaatcatcacggcgcgcactacacgtacttcctctatctcacttaaaacaaatctagaactgagcttatctcatgttcgttgtaatatatcatacctaatcatagatttttttttatgacgaaggggtacgtatcagtagtatcacacgacggcaaactgaagaggtggatacgttctaagagttttgtggttggttacttgctcgattttcatcatca

SEQ ID NO: 65360 - DNA, 1223 bp, Oryza sativa
ctattcaagctgtttgggccacaatgttttttctcagtgccatgttctgtgcaataatacaatcatgatgttaacctaaatccatgtatccttctcagcttgaggtccttgtagttggagctaaattttgtgggcgatgcccttttatcgttccagcatttctttagctcttttttcttctaatccatactgtcaattgtttcttttgtagcctgaaaccaccatcgccccgaggaggcagtgacttatccgcccagagtcgcaactttagttcattttctagtactttgttatggcattgtgtgctatttatgtttctggtaccattgtttagtcggaacttgttaagtttgatgctatcctttcgtttgtgtatgttcaaatggtaacaattacttgccaacttatctgccaaaattttactgccttacaaaagcgtcatcatcaaactgccttgattgcttacagtgattcaaattaaatcttattttcgtctatgtaaaacggtcggtcgttcccggcacacgatggttggattgctgatgctacaggccatctagattcacaacaattcgattacatctatattattgtgagcttggcataatcatattcagggcctgtttagttaacaaaacacaaattttcatgctgccacatcaaatgtttagacacatgcatggagtattaaatgtaggaaaaaaaatcaattatatagattgcgttagattgcgtgtaaattacgagatgaatcttttaagcctaattgcgcattgttaatgacggattaattaggtttaattaattcatctcacagtttcttgacagaatattataatttattttgttattagattacgtttaatacttcaaatttaaatgtgtgtctatatatctgatgtgataactacatccaaaaattttctctaactaaacaaggcctcagtcattcatcattttttgtttggtggtaacacgtaagaaatgtttcttacaaatttcttacaaatgatacattgacgtggcacacaaattcagccattcataagcggccatgtttcaaaatttcttggagctaagtattttcagctctagaaatctatgaatctgagctgtgattacaccaataacatttggattaatcattttgcgtcagttttagggtaaatttaaagggatttgctatacaatagcctgctttttttttttgtttttatcagctg

SEQ ID NO: 65361 - DNA, 3527 bp, Oryza sativa
accgtcgctaagcgtgattgattgccgctagatctaaaaggatatcgcaaacgccccgccaaaacaccgaaaccgctcagaaatcgttggcgaactttcgattatccttttgcataggggttgagaagaggaagctggcaagagagaagattatcaagtcgttcctcgcgcataggtacaaaatagtttgattctctcgattattgtactttttatatattatccttatgtactgaactcctcaattattgcagcaagttgagttttgtatgactcctattatctatctattactcctattatactggagtggagtatagtttagtgctatagactgatttggatcactgcaggtttgggcgctcctttttgtgtagtttaattaatcgatggtgcagatcacgcctgccttagtttaggctttttgctagctcctgtcgtcgttaatcattcatctgtcaattacaaatcacctggatttggaggagtctggaagcccctctctaaaaaaaatataattccctctgagttttgtccctcctttccaaacaccatcttggttgtcttgccggccctgactcgatagtatagtacgttgtgtgtgttgtgaaaaatgtgaagtgcatgatgcatgattacgtgcatatgtttttctggataattcggatccggccgagtcgatcgtttaccgtgctgatccatgtcccacttgtattatgaaaacttttacctttttgtgaggatatgaaactatttgtttatttgcggaacacattaagaaaatttgactctcattacacgcgtaaacactcacccctacgaatgaacaccttataagtatattacatatcttaaaattaacgaagtcattacgaacaacacgtcgacggatatatcacctaccacagaagaaatataaagttataaataccagcatcttttgagagactggactgacatattttaagatttaatgtgtttgtactgtatttatatatgtgagaatttagtgaaaaaatatggagcggtagtccctttggtttaagtatagggtgtgtgtgagtattcacaccacataggacgaaaaccaaaacaacacgtggcgtggatgctctggtttggttttaacagttgaggatgcccaataagcggttttgtagtattgggatgtgaatggaactcagccgctacatggggatgctaagtggactttgcttagtcttcaataatctgctgatagaccgtgggcttagctactccctctctcgggccgaatttacgagcccacaacaaacggcccatatttgcttgcggcccaccaactaaaacgccctcttatcctcctcctcccccaggcgtcgccggcggctagattccggccggtgatggaggcgtcggcgtcggcggcggcggcggcggcgctgtgggggcacaagcacctcccgctcctggcgcgcgcgtcctccaagagtcggtggagtacatcctgcaggcgctctggcgcacccgccgcaccggcctcgacgccgccgaccgcgccgtcgtccgcgacatgctccacctcgcctccgacgccgacctcgaccccgtccgtatccgccgccggctactcatcatctccaccacctctcctccgtccccgcgctcgcttgtagctgatcccatctctctctcgcagttgctggtttgcctcagggtactgattcgcagatgcgtccatgggaacatcgggaaggacgaagtcgccaagcttttccccgaggaggtgtcgcccgagctgcagaggctgctcaccttgcttcttcagaagtttcagccggagtggcaagaggatgttgccaaggatcaggtaaaatcaggcaaagttctagctcactggtcatttcattttgcttatgtgattagctcaagagataattgtcccaagctaatgtttctgtggttggcatgttcatagtttgtgcattggtgtcaagataaaatgtggtcactggtcactattgatacatggattttggttcttgttttgaccttcggagataattcaagataaaaaccagcaagttctagctcactgatcattttgcttctgggattaattcaagagatatttgtttcatcttctgttctaagagtacctggtgtgcagtgttgaatcggagcctaagctccaattaggcaatggttgacatgttcatagtttgtgagttagtgtgatgataagaatgtgcttgttggtcaccattgacataaggatttgcttcttttttttttaacgcaattagttgtttcgtaggcatctgcatcacggccagaaacaaccgaatgcccttcaaatcaaaaccaagatacaacagagcagccagctgctggtgctacagaggtatgcttgaaacacttgttgtccaagatatatatttgtgtcattatcttgtaatctatatatatttgtcattatcttgtaattttgcttaaaacttcatggtagagtctcactgactacgctcctaacatttctacaatcagattactcgtttatcagaagttcaatcagattacttggatggatgacctgatactgtaaataattgtcttttctgcagattcagaatggtgggaaatcatcagttgtggaaaaagaactgaagcttcagttaaccaaggatactttagacaaaatgctcgaggatatgtactcaaccaagggccaagcgtccaacactgtgagttggccaatcccttctgcaataacaaattttcactacattcttgcatctgaatgttactttcatacttttgcagggcaataccaatggacatgaagagactgcaggatgcacttaggaaaatggaaaatgctgtttttgtcattttagctttagctccagggacattttgcagcagaaaaactgtaccagataacatcccgtgtctctctgcgtcttgtgatagatatttttccccttgggcagtttgatctaggctttggtcactgcatccatttaccctaaggagcaaatgtaggtttagaagctttccttgtagaagaagttagtaggtgattcatctgtaaattgaaatccattggaagtatcagtgtcaacgcatgctgaaatccttacatttccacatatgcggggaatgttaatgtcttgtcacatctttgcaactgaatttactgagttttttcttttatcatatggagcacaagaactgcaaattttccattagaagacaacataaatactggagtacgtattaatcatcttcttaacatcactcccaaaaattgtgtttcgtctcatataagcccaggccagcaacacgattccaacatagtactatagtacaggagcacagtctgcgagaatcatcgaatgctgcaataacttattattccgggcactataaactcttgacttctgattccaagcagtttacttatttcacattttggatcttcccacgcacgaagaattctgtattttgatccgatgccaagatgtgttgaggattcctctcaggtt

SEQ ID NO: 65362 - DNA, 1618 bp, Oryza sativa
agtactttgttcttttgattctctgaaactctgaatctctacaagtcaagcagagctcctctgctctgaaatatctgaaactctgaatctgtgaaattctgaaactctcagaaaattctgcgaaactctgaatttgtgatcacctgacgaacttctgaacgccttcgaagaaatcgagcatgtagtcctcgagatcctcgaggctgtacttgatgtgcttcgccgccgacgaggagtggcggccgctgctgctgccggactccagcagctgcctcgaccggccgacgaacgagcggtacgccgggatgagccgctccgacacggcgatccggagctcctcccggagctgcgggtcggtcaccttccacgccgtctggctccggtacagctcctcgaacgccgcgttgaagctcctcgccttctccttcagcgccgccctgccgccgtgcccgtgcgccgccgccggcgaggcgtcgtcgcggagcgaggccagcacggacatccacgacgcccggaggtagcctgtctcgtactgcctgatctggccgcggtggcggcgcacccagtcgtcgccgaggagctcgcgcagcgccgggaactccaccatcatcttctgcacgatgtagtagatgttgttcatgaggaagatgttcttcagcccggcgtcgtcgtagagcctcgatttctcgtcgaggttgcggaggaggtgggtgaggatctccctcatgcaccgccccgacggcgtcgacgaggcgccaccgccgccgccgccgtcgtggtcgtcgtcgttggtgtcgtggttgctggtgttgttgtcggcgaggaccatgtcgagcgtgacgcggcactcggcgaggaggccgcagtagttgagcacgtagcgtgtcatggggtggatctcgccgccgaggactggtcgccgcgacgactcgccgtggatgacgttgacgaactggtcgatcgtgtggcggatggtgctgcccagctgcgccgcgacgccggcgacctcggaggagaagaagtcgcgggcgtctccggtgaagagggattcaatgtccggctcgacggcggtgagcgcctcgtacatgccgagcatgcggtagagcttctccgtcgccggggtggacatggcgacggcgtccgcgaagccgatgagctgcaggaggcagcccctggcgacgtcggcgaagcactcgtggccgagctcctcgtcggaggcgaacacctcgtcgcagaggcggcgctcgccggcgaggagggtcttgaccacggctctgacggcgtggctccaccgccgtatcctctggttgagcaccccccactccatcctgagcacctcctcgatggcgacggcctcgacgccgaggtgcgccgcggactccgcgagcgcgtcgcggcggacggcgacgtacacctgcgcgagctccgggccgtacccggcgcgcagcatgcggtccgcgacgccgctggcggaggcggccgcctccggcgagagcgcgtcgcggcgcggcggcgacccgtcgggggtcgtcgccgcgcccgcgtcgtctaggtcctcgaacgagtcgagcgagaggcgccgcgcggaggagcccagcagcgcgcgcacctcctcctc

SEQ ID NO: 65363 - DNA, 2239 bp, Oryza sativa
cccgccgccgcgaacacctcctcctcctccgcctgatccacctccggatgtgacaaggggaacatgggcgcctcaccttcgtacctggacagaacgcgcatcatgtcatcggccgcgttcttggacaccgcgaggctcttccccatgtgcttcgcgacctccaccacggcgtcccgcgcgccgtccgccatggccgtcgtcgacgcagcaatcgcctagaggagaagcaaaggagagagagagagagagagcttcttggtggtggtgttcgtcgtcgtcgcgggcgcgcgcgcgcgccgggtggtagctttcaaagaccgggtgctgtgcagcgcgacgcgaccaaccaaacgcgccgctcgtgctgctttgctttgctcggcgtcctcggacaatttccacgtatcaaaacactgcagcgccacacctttctaatactcggggatgattatctcgtgtcgagtttatggaaaaggctatcttttttttattgaaaaacacagttcagacgcagttgttttatccaattaacacctctaatcatgtcagtgtatcttaaaatcgacgaagtacgggtatgtcgtgagaaaaagaaaactaactgtcgttgattgttgatagaaaacacgaggtctgagagatctgcttaattccagtgcaggttcaaagctcgcctttgaatatatgagcgtaccagttgatttgatcctgtaatcaacaagaaatagaaacaaaaaattcgtggttaaatctataaatgatagccgatcggctaggtgccgatgacatatcatttatctttgagtcgatgtcatatatgaatcgatcggcgcttataaatagatagtaaggaactaaatctattcgatcggctgtagatattaacgatatatagttcttatattaatatatacttaaattaagtgattgggatagatcggtcaccatgccgagacagtataaaccacttagatcgaaatatatattaataacaggattatatatgtttatagcatagctgatcagatagatctagcatgtatcagctaatactccgatactactttatataaagatatcaaaacaaatataatattccaaacaaaagcttaatatacttaaatgcaataagatcttgacataaatggcggatttaatatgtcattgaagcatatagatcgaatatggttaaatcagataagatcggctgaaactccgatactaccctaatcggcaaccagagggcaggctagagattgatattctaagcacgacttaatagatcaaactcaactgatgcagcattaagtatgaaaagaagaacaatatctagacaatcaagccgctaggtgtttcataaagtggtagatatcttatataatctaggacaacgtcgttatttaacctaatcgggctgccttctattaacatatgtcagccgattgtaggttagatgacgatattgccaaagattatgtaagatatatgataacttgacgaattatatagacaagattagagtgtcataaagatgaaagcactaatctcgagaacacaagtcatcataacaagttttacctcttgttgaagatcgaaaccgatgcagctcaatccgaaagcaagaactcgtcgaaacaaaactaaagtaaaaagttggtgatgcgccgaaattgtattgaacatgtgtgttaaaaattacatagggctcggggtctatttatacccgagaattacaagatatgtccataccggacacgaccactatctctaacaaactctaagataccataagtctttgcggcagacttttgcccaaacatatctctaaggaagttacataaaacatcataattaatagatacaatcgccttctcaggactctatccatgtgcggcaatcatcttgaagcacctcaattcaacccaatgtcatacaccaaattatactgttagaatcggctgcatcggctcacctagttcgactcagacccagccgatcctaatcgtagccaatctggacttcagccgattctttgctctgttcttggatcaatctccgccttcgactacaccttgatctaatctccttttccgatgctgatattaccaaatttggtcattaacactaactaactgataaatcatgctcacttcgtgaaaaatgtcgtttttaatggaaaaaaaatgtttttttgatggagaaggttgtgcttttgatgggaaagtcatgttttttttcc

SEQ ID NO: 65364 - DNA, 2379 bp, Oryza sativa
  unsure (1)..(2379): unsure at all n locations
atattttgcaggataactaacgaattgaagtttggaacaatgggttccatcgcatatcagaaaggtcattaattattgttttcttcatattttagagaagtcgacggtcaaattactcggtctgggacaggcagttagcctatgtgggcccacaggccgagaggccgggcccaccaagtgccaattgggcaagtggcctagaaggtcaagtataaagattcttgtagctgttctgtagacggagtccaaatcgtagaaagttcagacttggtactaacaaatcgacaaaactgtatcagtagtgacgtctcatcccaaaattacacactgttcattgaaccttgcttaatcacctccagtttcccccacttaatccaaccgaaatatcagagtgcccattgcacaagggaaaacatcgaacctgtgccgattcgatcgaagtccatcagagaaatccttctgaacatttgttgtcagctcttcagtaaacctgaacgattctactccagctgatattaaccgtcaagtctgggattgcataaatgtccctttatcgtcactatcttctcattagtgtcccttatcgtcaagtctgggcttgcatcacagctgacggtaattacaatgctgcttccgtttacgagctcttcttgctggctcgattgcgatcgcaatgcgcacagcttatttggcaaaaaagagcaccgtcgcggattaaattcttcatgtggttggcaacaaaaggccgttgcatgacagcggacaatcatcaaaagagtggctgtccgcatgacgcctcttgtggcctgtccaatgctgagatgaagagctgcaatcacctcttaatggaatgccccctaaccaatcgagtctggcgcatgctcatggtttgctggttcatatggaaagagcgcaatgcgcgtattttcgagcatgtctctaaatcggcaacacagctcttttgggccatnagggaggagattattatttggagagaagcgggcatcttcaagcaagtagaataatcccctagtttccagagtctgtagaggcaccgtgttcttcacggtcgttatcccgggggtgttagccacggctagcatccctatcgactgtttaatgtcgatgatgtaaaagttgtatcaccctctctcttaataaattttgggcggccaaccttcggccgtcccggcaaaaaaaagtctgggcttgcatatagtatgtatctgattctgacaacccattgaaaaagatcaaagatgtcacataggatgaattatcatggttaatcttgtgcattgattctctctgatggacaccatgcctcttgtctgccggtcctatatgcatagtattaatcattttcttcgcagtttttgtatatgctgaattaagtgatcacacaggtgagaaaaacattgaaactacgcatcacttcatattcgttcaaacggccagtgtattagagatggcaaagcatgattcaggtgacgagtaatttcgtaataatttactagctagagcagttcctattcgatcggagtggttgggaacacatgaaagcatgcccaccttgatggatgtcatgactttgaaatgaaggccgcttctgaattcatcagttcacattcaaattttctactttgcccgaccaaaatactactcaacaggattgtaatctcttatgtattgtttaatactactctgtaatctaccctgttttggaaacaaagaaaaacgaatactcgtatcgaatttaggaattacaaaactcactgaaagttatgtgcagtcaacgtccaaggttcattaccacagtacgaatctgagcaacatctattgaaaagatccctttgggccaagtgagccaaacaaatgtgtatgctgtttctatcaaaaagattactgtatcacgaattcgagcctctgatttcatccgagttggacagtggatacaaagttttgacttttatcttgctggattgctactcaattagtctttcctgatcaatttctgatctgatggcttcagccaacttcatcaacctgatgctgtggtcttagaagaaatgaacttttgttgctcacagtacagactccagaacccattgtcttcaaggggatttttttttttttgtcttcaaggaaaaaaaaagttcagaacccattgtatttataagtgttgctgtgcttatgttcaatcttaatgtccttcggttaaatattatgttatgggcatgcagtcacaatcaaattacatgactttggtcgccgaccttcactatactatattcacacaatcgttagaatattcatgaggcagatttgctcatatcatcttggatgttcggccatcctgattataatacgccgcacgct

SEQ ID NO: 65365 - DNA, 12202 bp, Oryza sativa
  unsure (1)..(12202): unsure at all n locations
catttgcagagatgcagtcccttcttccaggtcttgttcgcttcatttccgttttgctgtcgtccgaagattgaagcaacaatcaagcctcctaaacaaagttgggcttttttgtagcagaatatatatgctctctcttttacgactcattgtttttctaagctttttttaagaggactgatcattccaactggtggcagagggggataatggggctaagcccgtgtatttccagcaaatgggcagttcgttcaaatttctcaaacagactagtttggggtattggtggattgtgtgtttttaagtcagcttgttttttgggcaatttttactggacaaaacacaaacgagcttgatgccaatctgatccacaagactgggcaagagaagcgcgcgtgaggtcagcatgcgcgacacgatgctgacacgtgttttatctgatggccccaaattcggctgaagacacacaagaattcagctggatgatggctagacagtccctagctattatttaacttatataaacttttaaattcaatacatgtgtttagtatttcaagctgtgcacctgttccaagcagggcctaattaaattgtatttaggggaaaagtacatgtacaaaaggtttctatgtttctataatactcttacaaacgacgatgtggaacacaagggtgttgattttctataactccgagcaaactaaaaatcaaacggttataactatgtattttttcatcatgcattgcacagctgattcaattatgttcatagcaaaaggggggaaaaaggtgaatttgtattatatgttatgataaaaagaacacttttacaatgctcctgatatcaatcagtcccacttagatcccaacaagagggaaacaagaaaatgtacacacgcactgactactcttgaccagtacgtaaaacaatcacagtaataactactttatctgttttatatcataaaactttctagcattgtctacatttatatagatattaatgaatctagatatatgtgcatagattcattaacatctatataaatatgaacaatgctataaaattttataatctgaaacggaggtagtaataaacagtggtagcagcagctagctagctaggctaaaagcttaaaattaagctagtagcaagcagctgctggaggtgtcagcggatgcacttgcccggcgtggtccatccgaagcctccccggcgcctcgccgccggcggtgccgccgtgtagttcctccagtcgcggaggacggcggcgaggtcgtgcaccttgttggcgaggccggtgcagcagttggcgtggagcgtgcagaccctggccatgtcgcggctgagctggcagaagccgccgcagtgcgccgtgtcgaggaactgcatccggacgtcggcgcggcggctgagctccgcctgcgcccgctccaggacgtgctgctcgttggtccccggcgggaagcgccgccgcgcgtcgcgccaccgccggtagaagtccaccgtccgcctcgccgcgcgcacgtacaggaagccgccgttgggcctgttccggaggctctccgggtcgccgttgtagtagtcgttggccaccgcgatgtccgacgtgatcgcgatgtgccgcagcgggttccggaaccacatgatgtcaatgtcctgaataattaatgcactactattaatactactttcgagttacatgcatcggccagttcgccgtaaaatttggaatattatgtactatcttttgtagtaaatatttaacgtttaggataatatttgatcaaacttttaaaatttaaaccatcaatattttaccaaatgcttagtttagtttcgagaaatggtatacatcgaaaactactatcataattccacaaattacttttttcttagataatgagaaaatctttataaacttactacttcttccgtttcatattataaatctttctaggattgctcaaattcatatatatgttaataaatctagacagacagacatacatacatacatacgtacgtacgtacgtatacatatatatatgtatgtgtatacatatatatatgtatgtgtatacatatatatatgtatgtgtatacatatatatatatatatatatatatatatatatatatatatatatatatatatattcattagcatctgtatgaatgtggataatgctagaaagtcttataacataaaacggaggaagtagattttataaacgtattctaatatataaaattgattgttgaaaatataaaattttatccgaatctttgtcctaaacatcaaatgtgtttacgaccgaacgatgatttgagttgcatgcgatcgacaaccagtttatgctgtgaagtttgtccaggtaaggtgatcatgattattcataccgtgaagaggaagttgaagccgagctggaggatggtctgctggaagaggttgcgcccccacatcatgtcgaggtagtccttgctcatgaagcgcttctcgtcgctgtagtccacggcgccctccggccgccggaggaggtagcagtgcgggtgcacctggcggcaccgggcgagcgccgcggggtccatggccacgatgaggacgtgcttcagcagcggctccgtgccctcgccgagccggaagctctccaggaagaggtccagcagcgaccccggcgccgcgtacgcccggttgatcgacgtcatgatcaccgtcctgtcgtccatcgacgcgttcctcagcacctcggtcaattctgacaatgctttcatctgcaatcattattattatcttttttcagcctttttccattagatgtttcaaatttgaagatcgatcttgttgttttaagaatctgaactgaaagttagtagcaaatctttccattggatgttgcaaatgtgaagatcttgttgttttgtctaagaatctgaactgaaagttagtagcaagtctttccattggatgttgcaaatgtgaagatctatctcgttgttttgtttaagaatctgaactgaaagttagtagcaagtcgagctgtaaaatttcatagaaagttcactcgaatcatttggctgagttgtaaatgatgtaatatatcctatccccacaaggctgcttggacaacaggttagcatattcgttacctcatcagtagtcagtttcagctttaagcttttgggctctgtggatgtgacaaagctacaggaagcttatctcaggctaatgttggaaaagtagaattggcactttggcttgttgatgattggcttttaaaaaaaaaggaaattctagacttggctaatgctgtggaagatatctgcagcattatattggatatggatttgcttgtcgttgcgtcttagagacttatcagctcactgaatgaagatgtagatagaggaataatctaggacgatagaaagggagaccagtagactacctgaccactaatacccgtctattatgcatagttgcaacttccaactatttgcaacgaaatgaaacagtcccaattaattgcacggccattatctattagaattttgaagcatcttgcaagacaataagaacaagaaaattgaaatgaaaaaaaaggtataaaaaccctttttttattatgtaaaagtataattcggcattactcaaggaaactgcactgaagatgttctcatctcatgttcagaacttcagattgttaagcagaaaacgcagaaagcagcatcggtagatcactgacctcgtcggtgacggccggtggagaatcattgttgttccaggaggccagggcggagagcctccagttgatatccatagtagcaatgacgaacgccgccgtcagcgccgcgccgaggaagaaggagatcaccgggatgagcttgcccatgtcccctctcaccttgcaagccatgttcttggcttcttgctgctgctccctgaacaaggtgatcagaaacaagatggatcatcagagaagagttgtgtggtatgatttatatatgcatgcaacatgtagcttttaccactagtttgttggctcgtttgttacaagacctccaaggaagcccacaggttgagccttttctaaagaagagaattttttagccttaatgttgatgattagggggccttgaattggaatctagtacaaaagaattgttctgaaatgttgatattatgcatgataacaaaaaatcaggcatacaacttgcgagagtagtggaacgggaaagaatatgctgcccaaatgtccaagcaaatgagtttgtgcaatgccaatggatgaatcaaatttgcgaagctattctgacgttggaactcaaaaatgaaagatgatgcgtcaatttgaacaaaatctgtattaactgaatgtaatagctaggtagcgaagccattggaaagtcaaaaggagtttttccttgttgtcgctttgcttcgttggtatttgaaaaaaatgaaacgatattaaaaatcttttgcgtactccgtaaaagtgagttgtttgcaagaatttgaagggacataccaattggagaaataaaaagtcagagtcaatgcaattcaaaagaacaaaaaatgatgccttcaattcgaaataaaaaccatatgggtttaacatcctattgaaatcctcaatagagaaattcaactccagattcctatgggtgattcgcaaaactgatattgaaacccaaaaggcacagttgatctctgaaaaactgaattcagaaatttaccgtgaagcagttcatccataacctatttatgttaaattctgttggaaacattgtcatgcaagtgtgatattattagtgtgaacaagtttgtatgtacggaatcatgtacgacatgcatgtaggagatgtattacttggtcagctatgatgcatgtgcttgcatgagttagttgagttggttaattagtggctgagccatgtgttcgatgcatggccagcagagttagtgcatgcagagtacgttgtggtcaaggtaattactactaatttagcatttgtatttaaggaggggttcaggaagcttctacagttgaggttgagtcttgaaataaacaggacaaaaaaaatatggtgtttggaaccacagaaaatcagtgtctattcatatttgcgttcatcatgtgtatacatttgaagttgagcgatcaaatcccaacaaaattcagagatttcagtcaaaaataaataaattcagaaatgtcactacacttgtgtaatgtactacttaccggccccaaaaccgtcgttttgtactttgtctgaaactgatgtaaaaacgataaattaaaacgccttccctgaattaattaatcacgacgatcaaacgacctcgtatcataacaaaaataataataaataatcatacggaattgtatgcgattgtgagcaataacatcctaatgatggtgattgaagatctcgaagtcaagagagggaggactcgcggttgatttacctaccgagacgggagttaaccgctcgcggcgggcggcggcggcggcctgcgacggcgagggagtggaggcgacgagagaggtgtgggcgagcagccaccgcggcggcgatgaggagggggtgcggcggcggcggcctgccggcgtgggagtgcgtgtgttggcgagagacgaccacgccgcggcgccctcttttcgccctctcccccgcgtgcgcggttgggcttgggctggctcccatgtctctggcgaaaacggccgtaattgggccgcgtatcgaacggagttggcccgaattgacgtaaaccgagtacggctccgggccgaaactaccgcgttgctgggattttattgcgaacaaacattattattacttgaaaaatatacatgcataccaatataccatgctccctccaaatctaaaatataaattggacaatatctttctattataatatactctctcggttccaaaatataagtgccaaaataaacatttttaactttgaccgctaatagcaaaaaaataaaaataaaaaaaataaatcatgtaacattgatattactagattttttattaaacaaactttcataatatgcaactctttttatttaaaacataatattgttggtcaaagtatattttggaacagagggagcatccaataaacaaaaaatatatttctatttttattgcagtatttgtaagacaaatctatatatgttgttctagcgcctttaaactaaatatttttaaagttgttataatagttaaagttataaaagtttgatcttaatcttatccaaaacgttaagaattataaaaccgggagattacgtgcataccaatatatcaatttgaaatatatacatgcataccattttcaaccctcctaaattttaacgttatcgatggtttatttagtttaaaggcctaatttttaccatatcaaaattaattttggcaacttcaatagtatcaattgaatgtttggttggctaccaattttccacactagtttaaattctatattgtctcaaaaaaaagtttaattctattctatgctaaaacttgttaagattttgaaactaataaaattttggtttggcaaaaatttggctccaaacaaaacaagctcaaaatgcacaggcatcaccatgtttgcacatcacatgctaaaacacaactttatgtgcataattatgagcactagaatttacaatattatgtgtctacggactcatatcctctgcagcagcaacgtgcatatgggctcaaagaagagtggagtaggacctaaatgtcagtggctttcatatctcctagagaatttttgttcggcaccccttttctcagcccctctcactcgttttccgcacgtacacttttcaaactactaaacggtatgttttttgcaaaaagtttacatacagaagttgcttaaaaaaccatattgatccatttttgaaaagaaaataacaaatacttaattaatcacgtgctaatatattgcttcattttccgtgcttagtgcacgttgggagccggctgtagcgaacacacccagccaacaatgctgcttccacgatgcgcaaacaattgtcaggaccatatgcatggactttgcagtacatacatatgtaagtttcattagcatgcagttcaatcacaactgaaagtgaaaccacacggcatctgccgcattcaggcccgagaagtgggctctacatgtcacaaatttttcccttttttcacacgccgctgtaactagcgacaggggccttcaaaattcaacacccgaagtttttatcacagcagcaaacactaacacacgaaatcgcacgatttcggtacctccaatggtataccacaaacaaccaaacaccagtatatatctctctcacggtaatgttagctctaatgtgatcttttcacatcgccaaagaagccagtatcaatccctgattagtctgtaccgaagtagcgatcaccatactctcctaaccctgggatcacccggtactcctcgttcaacccagtttcgatctctgaggttacaatcttcagacgagggaatcgcttgcagacacaatggaccccttcaggagcctgttcatcgaaatgccattaccaagtttgcacaaaatgaatcatgtactatatcagtattaaccatgtcaaagagctggagtattttaccgagatgagattgagaaacatgatccgctcctcaggaactccactacttataagaagttctatagcttgatttgccgagttacctgtacagttgaatagttatgataagaaactttagctgtgacttcagtagttctcattccgacaagcaagcaaacatcactatgaaaggagcattggataaattcaacactacctgtaccaagcacaggatccatgagtagaacatgtcgttcagcaatatccaagggaaacttgtggtatatgagctggacaaggggaaaaacaaggtccgttcaaaatttcgcagaaagtgaactatttccatggtattttcaagaaaactacaaagcatttcacctgttgtccattgtccccatcccgatgtattagaattttgcctattttaatccccttacaacaagcacgtaatgcattctccatgctttctccactgcaaaacaacatatataccaagttatttcatgcagtaagtacataaggataaaaataatcaaagaaatgggtcgtaagtctaactaaactacactgctggtcagcatgggctgagttatgagtaccaaatacatacccctccgtcccaaaaaacagaccaatcctacctacgaacgtggacacatgtgtatccaggttcgtagctaggaattcgtttttttttgggacagagtagtattgaataaagattttcatcactgaacactaaatcaatgtatacacaataatctgcaaaagaacttatatggtatagaaattcactcaggttttattaaccattaaaggaaggttcaacactagaagctgcagataatccaactttttttttgcatttgaagctattagttttcaggaaagcaatggcttaccttgaataattgacacaccacagagcttcttacaaaagcaactcccatgtaagtagaccctggacaaaagaacagaatgagtatgacgtcataaatgtgcaaccttccaacatttgtttacattaacataaatggacagtgctacgtgcgtgaaactgtagacaaccagtaattgcagcgctttgctttctctttattaatacaatgccagtgaagctggacctttataaaaaagaataattcatgaagtaattgggtgatcagacaacaatcttttagaagccccagattcaagatttctcttggcaatgaatattgaaccaagatggttagattcatttgattcacagctgttacattccatatttttccactttgaatggagaagctcctttatcgccataaaattaaaatcagtagtaaaattgtaaaggggttattggagctcttgttgctccttgttatttttcaggacaaaagataataggtaagtgtttgttgaaatttagatgcacaactttatcattttagacctattttattggagcggtgcaaaaacatatttcccattgcttgttgcaaagacacaaaaatggttcttagtaaaaccaccatggattcaaatggctctgggcaaaaccataaacatgcaattggaaatgtcaaatcccacactttcataatggtatatatagcagatccagttntgccaaaactgtccttccatttctacagttcacaaacactattcttagataccatagaaacattgttaagaaaacctccagagcatatactaagttgctaccactaagagataattccaaacatacttaaggtgttactttttctttttctggctggcatatgctaatggatttatatagggcaaattccaagaacaaaaataaataggcgcaaagtataatggaaccagcaagcacctgttggtgtaacaatctgcttctctgtgaaaggcaaatgccccagtccatgctcaactacctagcaatatatttattttccacatgaataacacatcaataaaccgtcagacacattcagtagctatgtagaactagagaagggtacagaggccaaaaagaatgagtgctaccagacgaatcagacgatctgaataaaagacgaaatctggagttgcaatgtcccggtcgcgaataagagtatgcattccacgtatctgttaatcgagtgtttataaccatgggttgggaataaaataacattatgaaacttaggatcgagagaaactattgattgtacctggaaagttgtattaaccacataaacatttgggtagattttgcataagtcatgctgaccaagttttgtacgaatatgttgcacaattaaatctatggcaacatggttatctccccctcgcggtatgatcacatcagcatattttttggaaggaagaacaaaatcatcgaacgcagctcacaaacctcccatactacaattcaataaggttcatcaaaagtgtcattacatatgtattacaaacatcagggcatgcagattttgtgacatatttaaatagaaaaagactaaaataacatagacgggtgtttaaattacctgctccagcactgagatgacatctctacctctttcaactgtatcacgccttatacgccgggcaagtctaatatcggcatctaaattgatgcataaaatacaaagggataaaggtgaatgatcacaaacgatattgttaccataatatctattatattatacctaacaaagaggagcaacaaacctgtgtcaacaaaaattttcatatccatcaaatcacgaaccctttgatcatgaaaaactaaaatgccctccaaaatgatgacatctgatgcattaacctaagaaaacaaaatagtcaaaaggtttttaagcctaattaacaatcataattcattaggtttcactaccattaaagaaatccagaaaatagaccaacaacgacactgaacagaaaaagaaataccacccataaattattgccatggcgaaactagggctgggttggttatgaaaaaatttcatgaatcataactgctacataggttgagcaaggtccacagtagcttcttagacatatgatgtactctttatattgcatatccttatatcctttccccgcccacaaaaaaggtcactttatagtatactcttttagcatgtgtagctcatttattaatggagacttcatagtacactacttaactatgtgcctatagattcaatattttggcaccaaatttctagaacagaatgtgaaataaggcacaccagatgccatcaatctacataagacctttgcatacaaagttatcaaccagtaattaatcatagataaaaggtgtaataacaatagataaacaggaattatctttttcacaccaaaggtcaacaacgacattactacctttctaaaactttcagagcatcgacggtggttcttaaaatcatatataggaatatttacagatagcccacttttaagctgtcccatgcactctaaaagttgctctgtatcaaatgcatctgcaaaaaagaaagaacgaaaatatcttagtctcttcccaacgtaaagcagattgaaacctcgagaactcaaaaggcaatcaatttttatcaaatcaagcacctgggtgatcaaagttgtaatcttgcacacggtcagattcttcctcagttaaaccacggtagaatgaatcctgcaaaattgaaactttagctgaagtatatagaataattgcagaaatgatctatcagacatagtcaacaactagtctttgctcttttgatgaagctcttattcaaatgacagcaacttgcaagtacccagatcagcattcacccaactgagcaagaaaccacagccaaccatacaagacacacaactgaatacagatgcgaatatgaaagcaatttcatgcttctagcttgccaatacgcaggcaatgatttaatcaaatgcacattttgttcaagctgctccgaaagaagttcttttcacaacgcatttccccttttgacaacttgcacaaatagcaattctgcctgcttgccttaaagaaaagaaacaagctatgaatggtacagagaagaaaaaatataatactgcacgaaaggccctacatgtttaggcattaggatgcatacaaactgcacatacaagaaagtggagtaccatactcatcctcgaccttgactgttcaaatcatgtcatttttggacctaccgcatcacaatatgttccactccgtaagttattttgtactaacaacaaaccatacactgatcactgcaacaacggattggctgattgaacaaaacgctcgaaacacgaaatctcactactaggcaagcatatgcatatagcaaccaaccaagcagacatgatatgcatcctgacgatgcaacgaggcacaccacacctggttgacgagcacgacgcggtggtcgtgcagctgctggatgatcatgtcgcagaccgtcgtcttccccgacgccgtccctcccgacacaccttcgccaaccacaaccaccaaaattcaaaacaaacaccaccaaggattacgattacgagagagagagagagcgggcggaggag

SEQ ID NO: 65366 - DNA, 2303 bp, Oryza sativa
agcagctactgatatagactaccaaattttcaaaaaagcaaaacaaaacaaatgggctctgtttctttttcgtcaggcctaaattgggccggagcaatgcatgatgtttattatctgggccgtaatttgtaatggacttcaaattgggccggagtaactgaggctggttgatttgggccataattcgtaaaggactcaaattaggccgaaaataggacttcaaattgggccgtagcaatggacgaggttgattactttgggccgtaattcgtaaaaggcttctaattgggccgaaaagagcccaaatcgccatagattggcctcccttctccgtcagactgaagtactgaagcagctggcctgcagccctgcacgcacaagttcagagttcagattttcagagaagtgttcgtgtggacactggacagtattagcactgaactgctgctgctgctccaatgtcaaaagggaggagaccagctagcgatgctctcatctcaattctcacctcatcttctccaagaatctcgcctttattctcgcttctgttgctgccttgcttgcttcatcagttcatctcatcgccatcgcaggataagtcaaacataggaccattctttctttcttccttttctttccttgtgctagctcgcttagaacagaactgatgggcttgatcaataattgagtgatatatgcagcaaatgcgtgcgtgcactcatcaactgcttggagggatcgatctctgctagatagatacatgatgtggatctgatcgatgatgcaaatgcttgcatgatcctaggctcatagcacacgcgtggacatctagggttcgaggctgagattaatggattcgatccatatccatgtcagataagcgaaaacttcagttcttctgacggtggtctgaatttttgcccgaagaatgaaacggaatgaagagttcagtgaggttcagaaggagaaaatgcattgattttttgcaaatgcaaattggaaggttacagaaaacaattactaggtgaagtagtggattgattagtgccaactagagattgccaactgttggcagaccactaatcctttttgtaatggaaaaaccaccaatccttttataggctactctgttgatgtgtttctcctaattgttttctttttgtgggaggatatctaatgatggctggctagctagctaatctgaaaaaaagaatgaagaatgcacaatgcactaaccattgcaattacacgttttgcactctttaaacgataatgcacccaagcagtagtgccgcagaaacccaaaatcaatacactgatttcttttctgaataaaaggcaacaaacactgagatatgtgtcacctaggcactgaagaggattgagtgactggaccactatcttctgcactaaggaagacaggaaggtgtgaacatttgagcgcatatgttcacttctcctttttccaaggacaaagatcgagaaatgttcagttgttcactagtgcagagttcttgagtaaactgtactagcgcccatgctgcgttgcatgagttttcaataccgataggccatatacggtactcgtcgtatatatctatcttgttattgggtaggggagcttgctagctaatgttctacaccgctctgtacgtgccatattcatgtcatgatctgtataaaaggacaagaagtttggattggtaggacatgcatttttcttggctctttgtatggatcaggacgagaatgtagtattacagagcggtgcagatcacatagcttgttttctctgcaactgcatgatactatagtacttaggccgtaggccgtgtttagttccatgccaaaattaaaagtttgattaaaattaaaagtttgaagaaaaaagttaaaaatttatgtgtgttggaaagctttgatgggatggaaaagttggaagtttgaagaaaaagttaggaactaaacaagcacttatagagttggggtactcgatcgacgtgtatctgctggcctacttttgagtcaccattccccacctgatgaaatgggtgtaagatgagatgcacttgatagtgcaatgacaaaaaagttaacccgaaagtcttatgttcaatttctaacacgctatcttcttaaaaaaaatatttggagaacgtctccctctaaatcttgttttttttatatattatgggtgcaatatgtagcagttctcgattctatttgatagagcttcggatctagtttttcaagttacataaatttttaaggctagaaatattcaacttattcttaggtaaatt

SEQ ID NO: 65367 - DNA, 3612 bp, Oryza sativa
ttggcttattccacaaataagcgaaacaatgaggctttatctgatttctctacaaaagattaagtcttagctctgggtttcaggaagtgctgctaatggtgaagagttgttactcttataaaagcataagcatatatactcttaaaaacaagagtattgcttagtatttaaattaattgaatttcacatagttaaaactagaattaaaccaccacagaaacagatcgagttactactaacagtaattaaatagcatttgaccgtgtgtcattgttctgaaccctgaacaatgcgtgtcacactctcacaggccacagacagcacgcatatgcatcaggaacattatggcggttataattaattaattactcagaattaatttaccaagtcaaattctttacacacgcagtaatgcagttaattacagtgttatgccgaatgaattttgttagaactaatgaaccgtatcgcccatgcatgtacacccattcccagatcagaactgagctgagctgctagctagcaaggtagccaggccaaggtgtcacgctgaagaaagcaaaggccaagaatatatctcacgcactgggggtcgccgcgttcacacggcgcagctcaccgcaacaacatcactagctgagcagtgaccacttttaaatacgcatgcgcccactcctcgatcgctcgcagcactgagctcgatcgtgcgcgcgcgcgcacgacgcagcagcggctagtggcactcagagcgcgccacggcgggcgccagcatgagcaccgcgtgtcacggcgttcgcggcttcttctcgatctcggcggcggcgatgacgatcgtcgtcaccaccgccgtcgtcctcctgtccggcccgcagctcgccgccggggcgcgcgtcctgatcaaccacgctgaactccggcggcgcgacattgccaccgccggcggcggcggcggcggcggcgacggcgcgtgcgcgacggccgtggcgccgttcggctacccctgcgaagagcacgaggttaatcaatctcgtcgaacacctttaaacgcgcgcacgcagaacgttcgcacgcacgaatcaaaaccgtcaaatctcttttgttttcttcttcttctcatggacaggtgacgacgcaggatggctacatcctgggcttgcaaaggatcccgaggggacgcatcggcggcgtcaccggcggcggcgcggcggcggcgcggcagccggtgctactgcagcacggtgtactcgtggtacgcatcacgcacgcatggcacctaacattctctctaatccgtggtcgttttcttgccaatctcacatactttcatgtgcttagcaccacgccatgccggtgcacacgtattcgtctcatcatgtcgcccctgtttcattgcacctttcgagcttttcttagctttacagacaactttgtctaaatttaacccaagttcgtacgctttttcgtagtttgggttagtagaatagaatctgtgtccaagaaacctgatttttggggggtcggtgaagaattctccgaactccgtttgggttcacaatatccgttcgatggagaacgtacggacaggatagtccaggatttttagcatctttgaattaaagtttgaatggaattaaacaagcttgaggaattaatatatatgcatggatgcttcttttcatgatatcccagtgttagtctcgatcaatatggaatttgcagatatgcatggcacatggttcggtgctcctgtctccttctagcttctgctgcggactagttgcagcactcatggactttagctagcccatcacttgcatggggtctcaaatccgtacaccgttgtagctagctagaaacatgagacatgctacgagcagtaatacggagtatatcccaaaatataatccctccgtcacaaaaatataacaatctagcactaaatttcctacatccgaatacttatatgtccagatttgttatactaggatacgcctcatccattaccatactgttatattttgatatggatagagtaaaatctttcagaccagttagatatggtattaaaaaataggtaaaattaaatagaaaatattgtgattggttgagaagagaaagcagatggagaaattaaattgtaaaaatttatgattagttgagaaaaaattggtggagaagttgttatattttaggatattttaattttgggatgaagagagtagtccttaaatatgtacagcacggcacgcatcacagttttatattgtcaatttgtgttatctcttgatgcatcatttaaaaaatatcaggagtattaacatttacattagatggtgcaataactctcgagaccttcctaaagattctaaaaaaaaaatctcaaattatatagagtatatatatgttatatcgaacttgcagattatatatgcacaattggtgggtaatttgttgtttgcgaatctaattcttgctacaagttttttttctgctgattgagatttttttttaaaaaaaccgaagccagactaagctggtgttatattaagaaggagagaaaatatttacaaggtcaccagataggtgagagaaacaggggagggggggggagaaaacatagaaaaaatacacacactctaaatgagagctaagcggatattcttgtgatgttttttcgctccacacatgctccatatcttgatttcatcttgtattttgacgagtagttgtgacatggttttctcttaattttgaaatattcttctgtttcgttcacaccatatttccgaaatatgccaccaacaagtggattgacttgagtgctttagctttgctttttcgtctgattgagaattaagtggagtcagagagccgttaggacaatttacaatgatgtttactagtagtaatgatgtaaatgtatggtcagatatatagtacgtatgacaaactaatgaatatacattcatgcaagaatttactcctagtatctcacaatcaaacatggataatagcaagatgcatggttcaacaagaagcaatgataacagttccgtactacactattttgcaatcaaaacatactctccatctgtggtgtggtacgattattgattagtatggctatcaacatcactactctctctattccaaaatcccaaatttcattgtactacattatatctcatcccaatagattgatttattttgaaacggaggaagtctctcttatccggtgtcttcatgcatgaacaatgggcacataaatttcaaaattgtcaaaatacgcatcacctaaaacactactatatttggtcataaatatttaatatttaagataatatttggttgaactttaaaactttgaccatctatttatgttaaaataaatttataaaatctaataagtttatgatattagtatagtacttttcaggataaatatacacatacttctttatcctaattttaaattaaacatttgagaaattaattatagaagatcaagatttcaaaatgttgaccaaaccctgtactaaacaccaaatatcagggaatataataaattgttcgtgacaaaacattaatgctaaaaccgtcccacgttaatta

SEQ ID NO: 65368 - DNA, 5002 bp, Oryza sativa
cgctgaaatatctttgtgagtggcaggatggcatgacatggctgctggggtcgccggaggagtcgctgccgtgacatcttggccgaccagggcttcgacgtctggatcgccaacaacagggggacccgctggagcagccgcccgtctcactcgatcccaaaagccgggtaattacttaccattaatcacactctgaatctctttactgcttgctaatcagaaaagatatgttctaacttgtactacaaagtaatcttatatcatatcctagatagcaacaattttttttttgggaataaagatagcagcattttaaaccggatgtagtgatattaactgcaaccctgcattgcaacacggtcatgtacactgaagactgaagtaactgatgaccatctcttctcatgtcagagctactggaactggtcatgggacgacatcgtggtcaacgacatgcctgcaatcgttgactacgtttgcagccacaccggccagaagccacactacgttggccattcaatggtatatactaagctggcaaattaaaggagaattcatcatcatcatcatcatcatcatcatcttactgtaatctgttgggttgaaaacgtagtactctgtttttgttgttgttgttgcaggggacgctggtggcgcttgcagctttctccgaaggcaggatggttgacaagctgaaatcagctgcgctgctcagccctgtcgcgtatctgtctcacattaccactcccattggcgttgtgttagctaaagcattcgctggagaggtaaaaatccatactgaacaaacaatgttcttcatgcagatgctgcaattgcaatgttcttacagacatattttattttctacactgaactctgctctgatcaactatatgttccaaaactgcagctcatctctgatctccttggcatcgccgagttcaacccagcatcgtatggccggcattctcgtgcctttcagacaaataaaaatcatttttacagcttggaatcgtctccggttgctatggagctgacatattggtaattcacttctgtctaatgcaggcctcaagtgtccaacttggttagaacgttctgtcgtaagcccgggatgaactgctacgatctcctcacatctttcactggtaattaatcaaggattagtattttacctacctgagttaatttgctctacattacatttcactccatgctaactcccatgcaaacatgtcaggaaaaaactattgtctgaacaattcagcagccgacatcttcctcaagtacgagccccagccaacgtccacaaaaaccttgatccatctcgctcaaagtaaaccaatcaaattctagtctcatcagtcatcttataccctctaattaaccaaaccaaaatcatgttaatttgatgataatttgatattaattatctggatgcagcggtgagagacggggttctgaccaagtacgactacgtgatgccggacgcgaacgtggccaggtacgggcaggccgacccgccggcgtacgacatggcggcgatcccggcgtggttccccatcttcctcagctacggcggccgggactcgctgtccgaccccgccgacgtcgccctcctcctcgacgacctccgccgcggcggccacgccggcgaccggctcaccgtgcagtaccttccccagctcgcccacgccgacttcgtcatcggcgtctgcgccaaggaccttgtctacaacgacgtcatctccttcttccgtcgatttcactaaaaaaagggaaagaactgaataaatcaaaacaaaatatagctggcatatattcactagtagtgattaagtagctaattaatttggaggtctgagaaaattatatatactagtatagttgatatacagttacatgaaagatgataaatggaaatgggaccaaaattttacaatagaataagatatagagagatggcatttgggccatatcgattttttttaattttttctaagatacttatatgtggcaatgcgggtcctgcctattttaattttattttttttttccaaactatgaatgccatgtaaacgttacataggcgctgcgatacataaacgaccaggtctaagtgctaagcaagcgcctcgtagcatgaaacaataattaaaactaccgaaacctaaattgatcaggttttaataatagctgagtgaatatttatagttggttttgttgttgaaggtcgtaaatttatagtatagggagctgcaatggattttttttcctatagtattgtcatgggaagtttggcccaagaatgaccacccacagtgacggatctagaaaaatgattcaccacccatccccgttgcaaccggagccgccatcaggttaggttgttgccgacgcctccatccaatccaatagaggaacgtcggcattccaactgccatagcagcaacaacaccaccgcgagacaccatccggaacgggaacaccatcagcgtatccctttccctcacgcacccacgtgtcactcctccctcttcgtccacagttgagaaacacctagggattttctgggccttccggctagcttcacaaagtggtgggctaaacgatctgggttcgaagtctcacctcttataattatttgatattaggtcattccctaatattcaatcttttttttttcttcgtccacagttccgacatgaacctcaccatgggccacaaggtcgtctacacgacgaacaagctctatgagttcatccgtaattatgttttagacttagttggcgcttacaacctcaacaagcattcaccgagaatacaatcgtcatctcatagcttactaactactccctccgtttcacaatgtaagtcattttagtatttttcacattcatattgatactaatgaatttagatatatatatatatatatatatatttatttatttatttattagtatcattatgaatatgacaaatgctagaataacttacattgtgaaacggaggaagtagtaagatttgaccgaaaagacagtattaatttagtgtttatgcgtgaattattgaagcaatttattgtgtgaattatgtaaggttaatttatgtgtaatgtatttgaatagttaataccattatctattctatcctattgtatgtctctattatagacacaactaggtgattctctgcactttgttgcgggaatttctaagcaattttcaatatattttttcgataatcgagctaggagttaaaaaaaacaaacgctagagtttatcagtaattatcatgaatcaaacaaatgatacccacgctttaatgtggaacatactaattaatataagttaaatattataaaaaagatatatttattaaaatattgtggaaatgatgtgagagatgacgattgaatatgtttgcatgttgatttatagaattaaatagattatatatatgatgttgcatacttgcatgagattaaatatgcaattattattgtgagtgggtgatgatgtggtatggttgtatgttgaactttagtcttagtgggttgtaactttataaaatgtatagatgactgaaagacaggaaaaccaaccatgcatacattgaaatgatcatcaacaataattgtcacctttgagtattgccgtgtggccgcgcggttaaaaagggtacctataaaaacctagaggtaccgatttttcacaataggcacatttatgttgttataggtgccagttgtaaaatgccacatcagtgtcgtcttacgggtactggttatgaatctaacaccgaattgaaagccggttttcaacccgcaccaaagtggttttatgtagtactgaatcatgatttagaaaccatgcatcaattaacatgacacaacaaactaaaaattaacggagatttcgttttcgtcaactatatataaacaactccctacgtaaaaatgacctcatgctttcctacctagacattattcatgataagctcccaaccataatgtaatctccaagcagcaaagattatcacaaatgcaaatgattggttatggtagtcaatgtgaaactatggtatccttgcaagaatcatgatttagaaaccagcaacatgacagaaagaaattaagctagcacatacgtctatatatcatcaagtgacagtagtggtgaggagaaataaaggggaataaggaagctaaaccttggacagacaaaacctaggttaactcctcataggtcttaattttaaaacctacaaatggcaggttgtcctagctacgtacaatgtactcctttcgtcccaaaatataaacatttttagcatagcatcaagtcaaacatttttaactttgaccattaataaaaaaaatagaaaagatcaataatataaaattgatgttactaggtttatcattaaacaaactattataatatgcaactcttttaaatttaaaacaccttacttttatagatattgttgctcaaagtagcatctcgaagactatgacaaagtataaaggtgcttatattttaggaccgatggagtggtcgacaaagtttgccgtggtaaaaaaacattggctcatagtattacactgcacgtaaactaattaagacctatgtaaagtatgctatatatgacaaatcttaattttcagctcatctaatctaactactcagcacggatgagcattagtgttagaatcatgtgtgatacgtcacgatattatacatatgagttgcgtctgtcccttgagaaataagctttcatattctcaaaaccctatttataatgcacatgaacggtgagaaataagctattcatcttctcgaaaaccctgtttataatgcataaaagtccatttgataagagaaactgcacatctatattatcttaaaaaatgctaagatgatagtagtggtgttgactgtgttcgctggtggggagtttagaactaaactctccgcacgaaaaacggagcggtcca

SEQ ID NO: 65369 - DNA, 2659 bp, Oryza sativa
gccagacttgccagtcttgtctagaatgttttaagtatgttgtttgcttataattaagttgttgttccatgccatatgtatgatttgctggggggatatggaaaaggttgttgtacactatgtttggtgattgaatataggggacgcgatggatgtgtatgagttgattggtgcaccttttgtctcagcaaaatgtaactttgtcattcaatccgtataagtttgttaccaggagcattcgattttttttttaactggagtattcgttgttggttatatatatcttatacaaaacaaaagaagcaacgctagccatgaagtggtatagaatactgtgaaaccaatttgtgtggtttttgtttttgatggaaaattggtatttatctgagcttagattggttttgaaatatcggaggagtcagcagggtttacaaattcaaagaatggatcatgagtgcatttgcttaagaatccaaaaatacaaattctgaagaatttttaaaagccaagagtttgtcagatttaataaaaattgaaaacaaagtgatcttgagctacaaacactagacaagataaatttaactagtcaggaagctactgtagtatttgctcaaattaataacgtctttgcttgttcaatttttttaaggtaaagagagttttattgattttaaacaattacatcgagttgatacaattaaaaaattaaaaataagtactccatatagttcctcttgttttctcttccgcttcttcatatgtctctctttacttcaatccaacaagtagcagacaaaggagtgaaaccatcgaccagcacatctccctcgccaccccatgagtaagcatatactccctccctccgtccctaaatatttgacgccgttaactttttaaacatgtttgaccgttcgtcttattaaaaaaatttatgaaatatgtaaaagtatatgtatatataaaaatatatttaacaatgaatcaaatgatataaaaataattaataattacttaaaatttttaaataagacgaacaatcaaatatgttttaaaaaattaacggcgtcaaatatttagtgacgtagagagtatatccatccaccttccaagcttccacaatatggaagccatggctttgcccgagctcgccatgcatgaagtggagagctccacgatctttctctctccctccctttgtttcagaacagttaataactatgtcatcctcccctcttggcctcttctcaacccttcttcaccggaaaaaacaaaaagagagaacatattctataccactgaatttatcataggttaataacttaccattgactttctctctttctatattatactggcgactttatcaattgttctacaatacactattaggctgggcttatttttcaataatagcaaaaatacccttatggacatacaagtataacaattgatttatatcattagaagttttaaggaaaaaataaaacttttatgtggcctccttaggtataaaagtttgtctataagtttcaatttttttcatttctattttttaaatataacttatttgttatatgctatataaaatatttttgtgttgttggttttaatttaaattatctttcaatgcaacataagatattttttgctattttcttttgtgtaagctatttctctctgatataccacacaaaaatatttttttctaaaaattaaaaataccaaaaacaaattgaaactgatgtacatacttctctgttatgtaaggatgccatataaaatattttatatttttttgaaactttctaatgagataaataattgttaaccatgtatatctctaagggtattttgggtattttttgaaaagaggcttatcccaatggtgtatgtagaacaattaataaagccgtcggtatattttagaaagagacaatgtcaatggcaaatcgttgaactgtaataaactcagtagcatagaatagattcttaaaataaaatactgccttcaccaacgcagagccgtatctagcatattgcgagattgttgcctcaaggaatgatgaggattaacttgtaagcatgtttgcaggcagacgtgtacaatcatttctctctctttttttttcagcctttggctacgtaactaaacctcttctattaatactagtaatgtgcccatgctaacgctacggcgatatttagtaatgacaatatatgtgtgagcatgataatcaatttttggcagattggcacggaaggttcgccaccatgtggagctattttatcaaacgaccacaagtgatgaagataataataaatgcacatataaaaagatatgatgatgacaaagttcattttatcacggatttttctgcttaaatagtcttaataatatcttgaaatgttcccatttgctaaaaaggggagataaccaatagaaaataaattaaaaatatatctaaagagttttaacaaacacatggccagtgggttgttaatattacatcgagaccaagcattttacctaaaatatggtttgtcattttaattaaaggtaacttgcatcgatgcatgcacaacgcagattaaatcatactcccttcgtctcaagaaaaggcaaaccgtgtgtttccgtgccaacagcaaaccgtgtgtt

SEQ ID NO: 65370 - DNA, 3432 bp, Oryza sativa
gcacataagatttaataggcactactgaaagctgtagcaaaaaggaattagtttgacagttccttatctttttaaatgcacaaaagcaatctgtcaaagacaaaggaaattccttttttttcttgtttttcctcttgatttatgtaattatgtcaggtcattactaatttgtatctgcaataatgtagttcccatattttggagatatacagatagggtcctacaaatagaacaaatcttcaaatagagcaatcatattgtatacacctaatagatttgtcgtcgatattatttacataaatatcattcagtttcagggaaatgtcaagtacagagaatcattaagagcttgtttttcagttgtaaattcagatttcagatacattcaaaatgatttaattttattcttttacttaaaaaaatgatccatcttataatgctatcacaactattttatacgctctacaagggtccatatgttacttcaatataaggatgcaatcatgaattcatcatatacaatacctctaagtgattcaccagtgatcccaaccctacaaggatcaacatcctcccattcactgagatgatctccaagctttatcaagtcccacacctgaagatgtccaaatttggcactgcagcttatactatacctgtgtatcaagttcaaactatgatatatcagatcataacatcagaaacaattgtttgagggaggcaaaacaaaatagcaaatccaggattcaacggaaaatcctaatacagtagagcgcaatgatgctatttcgtctgggctaacaccagcatccatgacttttaacccatgaacagaggcagaccagctcaaatttacagcatattgtagagtctgattaaatattttggatacataaactcctgcttatatcccattcctccaagctgattttagtgcctgtgtttaaaaccatgaaaataagaatcaagtcaaataataaccatgaatatgattttcaaacaatcatgaaaggattttgagtataatacatctatgtaagtgctgttcttgctagctggccctttcaccgtgatagcaagaattgatggcaacatagattttttttaaaagcaacaactaagagtttttttacctcaagcagtggaggcagctattcgttaagtttcagaagaagcacaggtacacgcccttgttgaactaagtattggggggaacaatatctaattctgtaacttaggaaatgagctgatgaatgaagccaaggaagtgtgcattgtctcccaggttatataatgtaggtacagaatagtgcatgtgagcctggatatcacaatagaacataatataagcatcaaactgtacacaggtggccttttcaggaagagtcatggctagaatagcgatgcattattcactccatgagtgaaattcatgaatttcatatatctttatccaacaaagttggtaatgaaaggtacatattaagacaataaccacattaattatttgtctaaaattttaagcaagaaaaatcacaaccaaactgttatgatccattttactttggttcttctacaatctctcagggtggctcaaatcaaactcaccacaaagaagaaaataaagtgcttgtagcatccccttcactaatagtgatcgacatagcaatgtatggctatgtacctcagtaataaggtagaaattttcttcaaccagcttctcgtggaagttcctcacctccttcctcgatcatgattgcatggcctgaaattttgcacacataactaagagccagtgccaacaaccctgctcttacgaaaaatccttttctccaatggaggatccggacctcgctctgccccatcaacggcatccccggtataacgaattaatggatccttcaccggagccccttgttccaccgtgagaggcactggcatgaacaaatccaaagccaaacccagccattgatcaggacactcaaaatcgtaatcccagttgctaattaagcggccactctgtagattgctcacactactccacatggcagagggaaaggaggagaccttggatgttacagcggcggctgaggaggacgtcgaggaagttcgcccagagatcggcgccagcgccagcggcctccgtttttctctctccgccgccgtggcggtggcggtgaagtgggagtcacaggtgttgaatgtgccgtttggcttggagcagcggcggtggacttgccactcaaccactaactccacagaggtagcgctggccgcacgacagcgacggtgggttgcccgaggaggagatcttcgcgtctacgatgccggtgaggaggatgcgatattcctggcgccggcagggatgacccatggcgatgcgcagcatggagggctgcccacagcgatggggacgacggacagagggttggcgttccgatctggacagcgtcaccggtgagttggctgaggaggagatcttcgtgtcccgtcggcgcctcggcaatggcgatgcttctgttcgagtcggatcgaggggcgcggtgatgacggcgatggtgaccggcgtaggggcggcggactggacgacagagatcgcgatcggtgtacgggcggcgtggaggcggcgaaccagcgaggacgggaagatccaaaggggagagggaaagtgggaggtgcgtgaaggaagcgccggtcgggatcgcgtgacgaggacagccggcagccggcggcggtgaagggagggggtgcgggaagaatggactgggtgggggaggacggcgatggcggcgctgggtcggcgacgtggtggggggacggcgatggcggggaggatggaaggcgacggcggtggatacgatggatgcggtggatgcgggcgctgagatttaattggacgcagcgatgagagatggcgtacgacatggcggcgatcccggcttggttccctctcttcctcatctacggccggcggccccgccgaggcgccgacgtacgtcgccctcctcctcgacgaggccgcagccacggccacgatggcaaccggctcaccgtgacctcgtctacaacaacgtcatctccttcttcggtcgctttcactaatggccggtttggttgaggggagtttctaataagggattggaagtttgcagggatgaggctattaactgttttgtttggttaggagatatgaaaattttggtgggatagggatggggaattaataaatgaactctctcctttttaatacctgggtaggggctagtaattgggacttgggagggaatttctcgtttactttgcctaaacaaatctcaaccactcgttttcattaatgacctaatctccaactaaactccctatcaattttcaccacctctaccaaagaagatatcgggattaaaaattaaattctcatcttaatctcaccat

SEQ ID NO: 65371 - DNA, 1652 bp, Oryza sativa
attaagtagctaattatattttttaaaattacacagtaaaacgtagacactcacaacacacgcacactcacccttatgaaggcacgcacgcataccctacccctatgagcatcttcgaagactgggccggcaaatactagagattaacgaagtcaccatagccacctcggtgtcgacggatacgccgtctaccactgaaagcacaatgttgttaaatcctggaaaattcgcacctatggagagtcgaatctataatctaaggtgttacagaggctgaggctcttgtaatcattagactacaatcaatttgagagggtgagaaaattatactattagttggtgtatacagttgcatgaaagatgataaatggaaatgttaccagttatcacttggacgatcgtcctactgtgaataattttttacgaggaaaatgtccatcatggctccatcaactattggccaattttagtttgtatattatttaaccataaaatcgggtataccatctcccttaaatattaaaactgcaaaacacaatttgcacaggtatgcccaaaatagtcgaggaaatcattttgcgctatttttatatgtttgttggagatgatatacccaattttacggttaaagtatatatatcaaattcgatcaatagattttttttattacacggtaggcgtacacgcgtaaacatcactacatacataacaccacactcacacccccactctaagaggcagaaccagtagtatatccctgatttcactaaacctcttgaaacttgaaaacacaccagcatgttcgtattatttttaggcaccagaattcgttgaagaagttaaaatggaacttttggcttttacaatagattacactaattgtgccttgcgttaattgaattagcacgggaagctcggcccaagaatgtaactgggccacccattcccgctgctaccagcgccgccatcaggttaggtcgccgtcgcctccatccaatccaatggaggaaccccggcggcgtcccgattggatcctcttggacaccaccgccgtcgccggccgccacagcggcagcagcaccaccaccaccgcgcgtgagagacagccggaggcatggattgctgctgttgatatgaagaatggctgagtgcaagctgtggagaagttttgtgatttttttttgccggtatgaccaaaggaggtaattcaatgtaattaagataggaagaaaaagttacaagaaaagttttacatcgacaactggttgtcgagtaaggatgtgcaccataacacacgccccgaaccatgtgccaactgcccaaacacacgatacagagagggaaaccaagcaccgaacaggccatcgttatgcgagaccgatcgccaccagaccaacaacaccaccacgacaagaagactctaaaacgacgccctcataagggtcacgacgccgaaagacgccatcgtcatctgtccaaagaactggacaaggtttttacctagagctccttgcccaggggtacctcaacaatgccctcaggagggttaccacgtgtcacgccctgaagttctcctttttagctttaaaatttgttaaataaatcgcctaaataaattgttgaattaacctagagttgaatccttaattaat

SEQ ID NO: 65372 - DNA, 995 bp, Oryza sativa
cagatggattagatacttgtggttctgagattctgaactcttcctgcaataattcccaaagcacactttctattaccgaagccccaaaactgaaagaaaaggaacatgctgttcaattggaaaatttaaccaagaactttgcgcatacaaccaatttggctgtaacctaatcttgaaaatgcaggtatgctgttacaaaaatcttgaaaacccctgctttacaattgagatgcattatacttttcatagccagtctacaaattctacctggtttatctgatccatgttggtagttggtccttttattaattgatttgaacatggaagaagtgtgcataattgttttaccattgccttgtaggaactgacatcaatctgatgaagtaggacagatgagctgaagtgtctttctgagctgatgagctttttctcaaagtatcacgattaaaccacaacaagatcaaacaaaaccggtggagaagaattccagaattgaagctttgtactgagtacagaaggtccaccaatcattctcccatctcttctaaccaaggtgtacaaaagatgagcgacactctgtagaagaatacattgctcgctgcactttgtgaatttacagttagaaaattcagattgtagaagccacaggtgtgtacaaaacaacaacgaaaaaaaattatagtgttagaacgtcattatagctgaataagagtattcctcattggattgtcagatttattttgtcttgtgctttccctttgtcgcgaaacagccagggtctgctctgtgtaacaataataaaacccgtttttgcaaaatcattgccagagatagtcaagaaaccattttgacagcagctcaggtttcgtttgttggttgttgacaattccttaaattctttagcatcttctgtactcgctgaagctctgttagaacaacgttgcagaggctaatcatatgcttgtgttcgttcttacttgatgctagttgtatga

SEQ ID NO: 65373 - DNA, 4223 bp, Oryza sativa
atgaaaaagttgaaagtttgaagaaaaattttggaactaaactcggccgaagttttttgtttagagcatcaccaatgtatatggcaaagtgatctatatagatgggacccacataaatagtttatccctatgataatgtccacaatgtatagatacaaggtatcattaggagaaggagaagagagaggagtagagatagataatataatttatttcatatgggtagtccatatgtatatgggtattttttgctattttttttatatggactagttgcacaatgataataggtggctgaatggaatattctattgtttatagactacttttatattgtggatgcccttaggaaaagctaaacccctatcggcgcctttctatgcctctctatcaccttttggtcattcggttcatcgcggatcgacgagaaaccaggttggcccgaatcaatcggcgccggcggcctccgcggtttccgccttcgggtaggcgcctgcggcatcaacaaagcacacagccgaaaccgaagccttttctttcttccgccccaagaagctgtgccacgtgtttcctccttcccctcctcgatttaaccgccccatctcgagtccccccatcacagcttccactccacgaaaaccctctgcctccttcgctcgctgcaccctcgtctcggcgatccatccatggctgccaggaagttcttcgtcggcggcaactggaaatgcgtaagtattccccccagcactagtcgtctcacaatccagattccggatgagccggagacgctgctgatgagtgatgaggcttgggttttatcgatgcgctgcgctgttgctgcgtgcagaatgggacaggggaggacgtgaagaagatcgtcaccgtcctcaacgaggccgaggtgccctccgaggacgtcgtcggtgagccgtcgtcccctcccgagggcgttgtttggagttggatcgattcatgaatcgatctggtgctgatctgtgggtttgtttatttattttaattttttttgggtgcagaggtggtggtgagcccgccgttcgtgttcctgccgcaggtgaagggtttgctccggccggacttctccgtcgccgcgcagaattgctgggtgcgcaagggcggcgccttcactggcgagatcaggtgagcgtcctcccccactcccctgctctgtttcccttccccttttgttttgagagagatgattagtgatttatttggcattgggtgaacaactcggccttacagcgcaatctgagtgtttatcacgagagcgtcgattttagtacggattgttcgaaccgcgagtattgttagtcgattataagcagctctagttccacgaaatctgacttgattataggcatgaatggatttgtgggacagctgaataatgaggcatgagtatgctgctgctgctctattgtggttatcggtgatgttctgcagactgcagtgctattatattaaggggtgaatgacagcagaatgtggaatgctttaagagcaatcctttgccaattcactgacgtatgcttcatatttgcagtgccgagatgttggtgaacctgcaggtgccttgggtgattctgggacactctgagcggagagcgctgatgggcgaatcaagtgatgtgagttctttctacattgtctagaaacataggattttttttcatgtcagctttatagcaactagaatgcgggcagctactggtttagcaaggccaggaacttgccaagaatatctagacaatggtcctattttaaggtcaatctgcaccgtccctaagctagcataaaagactgttgagttactctgttgagttttagccaagttagacctataaattgggttatttcatcaagctgctggaaattctgtttgaagctcatgggattttgatttactatgttgttactaacagttcttttcaccattcatgacagtttgttgctgacaaaattgcgtacgcactttcccaaggtatcaaggtaattgcttgcattggtgagacccttgaacagagagaagcaggaacaacgatggaagttgttgcagcgcaaactaaagctattgcaggtaatttcacttgctattcttcaagttaatttcttataaagttggaacttcacccctaatgttggaacaactgaataagtgcttccttccttccttatgaagtaccttgtgctgttgataaatccagttcttccaccttgaaagctgttaaacaggaatgctagtttatatttgcagaatagaatactgtgattgcttttaccctgctaaatatccaaaaggtatctgtagcttgtgtacaggtttatgatgataacggtgtggtcaaattattaaatgatctatcatttgaactaggaattatgtcatacaagaaacacatactttactactatgagccttttagttattgaagaaaacacatcctgttttgattagtcacatccattttcgtttcatttgttctttatggcttttgtggtccattgtactgtgctgacatagaagtcttctcatttctccacccctaactttttgtcttttttactcgtcatatttttcagagaagatatccgattggaccaatgttgttttggcatatgaaccagtttgggccattggaaccggcaaggttgcaacccctgctcaggctcaggaggtattccttctaacatagagcaattacatcacgattagcatgttcccttcacatttatctgcctcataaaccaatatgggttttttcctatatctaatgtctttcttgaccgatgcctggtacctgattctgcaattctgttcattcgaattatttgaaatatgcatgacattaggttcatgatggtctgagaaagtggcttgtgactaatgttagtcctgcagttgctgaatcaaccaggattatttacagaggtatacctttataactataggactatgaattgaaatgtaaccaagattttgtttagtagtgatgccaattgctaatgtacaaaactctccccacttccctacgattaacctgatcccttgtcttcgcatatttgtcttctacaggctccgtaaatggagcaaactgcaaagaacttgctgctaaacctgatgttgatggattccttgttggaggagcttcattgaaggtcatattcctattcctttattatcctctccatgatattgatagtagcatgtagaacataagcctagttaaacaaaacaccatttgaccagtacaatccttgtgcggttgtgcctagtagcatgccaaatatttgaatttaactctatacattctcacataacatttcaggctttaccgttgtgtatattactgatgattactttttttttctgcagcctgaatttgtggacatcatcaagtctgctaccgtcaagtcttctgcttagtgttctgggttgcaaccagatgatcgtaggagttaatgctgccaattttaagttatgacatgtttgaccagcttgctttgttatatctcgaagtcagtgaactccatatcgttccatagagcatgcagccacctgtggttgctttttttctttttgactttttctcccgagaggatcagatgaactgaaagtgccgttaatgtctgtattatcagaagtttgttgatggcttgatgctataatagttgaacctgatacttcctgagtgaagtactgtcctttgcatgtttgattgatgattacttgttttcgtagtcaaacgggctatcatgaaggatatactacatgtttgttaagtttgttacttcgtgatttaagcaattgttgattaatgcagaataataaccgggtcattcgcttgttactctattacattgtcatgtaaactagttagtgactgaatccatctgtgacgtactgtcctccctcttcctttcttgaatgtacactcccttaaaagcgttttctgggaagtagttatctagtgcacattatcatccagaagaccaattttaaacatataattacatattgcaacagttgcagttataacagattttttttctctatataattgtcaacaaccatagccagacgaagtgtacattacagattttgtactcaccagataaaataaacggtatactagtacttataaaatatcatttcaaagttacaataaaatgtaatatgcgaacatccatactgattcctgcag

SEQ ID NO: 65374 - DNA, 5684 bp, Oryza sativa
tttctcacatatatattgatgttaatatatatatagattcattaacatcataatgttagaatgacttatattgtgaaacggagggagtagaaggcaacatgtcaagaaggcaggaaggcaatcgagggcggcgcggaggacatcgctgaggcagaggcgcagaagagcacgccgtccggggatgctcgtcggtgaggtcaggggctcagggcggccatcattggcagcgatccaagcagggtcctttttacaaaatgtcagggcctattcgaaaatgtgttgggcacggatgcgtcaaacgtgggtggtccctggccgttggatccctgtcaacgccggctcacccttcgtcctcgccgttgcaggggacgaccgacgacggtgatcgcatggatgtcggtgccgggagctcatcagcaacgaggtcgtgcgcgagataatcctcgctaggatttcccgtcgctgagcgtgagaagcatcgtggactaatccgcaggtgcagggcgagcaaaaccaataagaattttctttctagttgtcctcgattaagccaaattaggaaccaatcttctcgtcacgctacagagttcaactaattcaccttgaaaagttgatggtcacaaactcactagatcttctgctcacaaactcactaggtattgctgtccaattaattcagttgctctatgttttcggcaattagaatttcggaatctatgctagatttgtcgagctcagttcctcaggatcttgacatgtgaatctctgtctgctttcatttttctctgtctgaggatttcaacttttggattactgcgacactgatccatgctttgttctttaattagttatgtgttgcgcgagctatcgacttcaaaataatatgctttttttttgtgatcgactgatcgccatatacctgtacgtaatgtgagacgaaaccactattcaattttgcagctgacgttgtgatgtcatgcctgatggtgctctactgctctgtttcctgcgttcccgaaaaatactgctctgttaatctgtttccagcgtaaattaaaacaaacggccaatgataatcgtttttaattttttggccgagtcatcacagactcacagtatgtcaacaactgatgtcagtacacccgttctttgttattatgacacatcactgtcatgaaaaccacctgataggttaacaatcagaaccaagcagtttctgattctgagacccattcttcagaaatctggaaattctaccgatatctatctgcctgactatctctatctcgatctcgtccaggattgttcttgcgaactaatggttgtacgcaaattcgtctccctactgcagtctcagtccaagtttcctctttgatgattcttcgaacttatcgcgtagattgggactcgcgcatttagccgaggaaacacgcttagcagcaagactcgatcagctccgatcctcacgttgaagcgatgaaaaaaaatcacctcgaattcgatccaggcggcgagacgtgaccaaatcacgtacaagtcgtcgtcgaacagacctggttgtttaaactactaattctaaactgcagagggtcagagagaaagatcgtacgaaacttgtactgctaatcatgcaataagcatgtgttaatgccaggacgattcactggggaaggaatcacaccgtgggcatgctgttgactagcggaataataccactgatttaagtagggtcatatattgatatatagcataactgctaactgccagttgctagtgcctcttcggctcttccagctgggagtcgaaacaaacaaaagagccgtcgttaagcacgtccaagtaattaaattagtacgtagtagtaatccctaagctaaaaatatggccagttgtagctgacagctaggagtaagagatgggcaagtagagagtatagagaggaaggagagaggaagcaatatgggagaacagtagtgaagcctcgaaccggctcggttcagtccaactcaaccacgtagaaacgtgcgggtttacacggtggcgaccgcttcaaatgtgcgggagctttgactggtccccagccagctcgcctataaacgcgcgcacgctcgagccagctaccacggcatctgcttgagttggagcaacacaccaagaaggccagagagattcagagaactacaccgagaaggcgagattgtttgcgtggttggtaatttggccggccttgatcgatcgagcggagaagagaagagaaagatggcggggagcggtgtcctggaggtgcatctcgtcgacgccaagggcctcaccggcaacgacttcctaggtgagataggtgcgtcctacctcgatccgcggccgagcgccgttagaagaagacgaggccgatcgagctcgatctcatccgcgttcttgtcctgtgcaggcaagatagacccgtacgtggtggtgcagtaccggagccaggagcgcaagagcagcgtcgccagaggtcagctaatactgctccgtgcagattactgcaaacttcttggtttttcgtttcagaattcggattattgttagacgaggcattgacgaacgttctgggctctgacctgaaaatgcagatcaagggaagaacccgagctggaacgaggtgttcaagttccagatcaactccacggcggcgaccgggcagcacaagctctttctgcggctcatggaccacgacaccttctcacgggacgacttcctcggcgaagcaacgtgagtgccattatatgctctcaccaaaacaaaaagccaacaaccatggcagctagcttagtcatagcaaacgctaaacactaaagtaattttccagttcttaaaggagatattaaggaggtaccaaatttacactaaaatttttggaatttctcgaggactataaaatttctctgaacactactataatctcaacgtgctgaccacatagttaggcaaatgaaaacaagcagaaaactttatataccttttgaacatcctgcacaaatctgaatcttgatttttgttgtaatgcaggatcaacgtgactgacctgatcagcttaggcatggagcacggcacatgggagatgagcgaatccaagcaccgggtcgtcctcgcggacaaaacataccacggcgagatcagagtcagcctcacgttcacggcttctgcaaaggtaaacaaatcaccagacgcacgactgaattattgattattcatgttacgccccgttgacctccattggtctctcctgattggctgggatctgaatgtgattcgatgttgatgtccaatgacaggctcaagaccacgcagaacaggttggaggatgggcgcacagctttcgtcagtagaaagattgtgaacttcaagtctataatcagttggggcctgtgggaggtttagataagtatactatagtactagcaaggtaggattttgtgagtaacaacggcatctaatgcccaagattgatgtggttcgaagtgtatgtatgctgccttttttttttctatactagatgtatattcagaacattgtagagtcatgaacctgttaatggatgtgaattatgatactacttcaacctctttttcgcctttgtgtagcgatacatacggtcagactttaccatctctaacctccaatatattaattagaatgtatgtataattcaagtgtgatgataacgagttgatttttcatcaaaaccacttatgtatcgttatattctttacaattttttattaccacattattaggacgtctgtgtgtataagaaatcatctatttagaaacctagggagcaggcttacaccgggaagtatctactgagaagtaccaattaggtcaaaccgtgaaaaccatcacatatcagagtatcgagaggaatgtctgcatttatccactccataattcatgagaacaaatgcaatcaagtttcttgtgtccttggaaaatccattcttagtgatgtcctccgaaaagaagactagttcagaaataaatcaaaggaaccactattctttcatcgtgtcatcatatacaacgaccaaatataaacataagcaaaaaatctattatattattaaaggaatagaaaaaaggagtctccacgttcgctctcatggcctaaaaattctcacattaatcggagaaaaagaaaaatcagagtccatatagaaatacaatttagaaatagctgaaattcggaattaaaaaataagaaatattagaagaggagactagagtccatatagaaatacaatttagaaatagttaaaattcgaaattaaaaaataaggaatattagaagaggagattagagtccatatagaaatacaattaggaaataactgaaatttggaattaaaaataaggaatattagaagtagagtatagagtccatatagaaatacaattaggaaataatagaaattcggaattaaaaataaggaatattagaagtagagtatagagtccatatagaattataattaaggaaataatagaaattcggaattaaaaataaggaatattagaagtagagtatagagtccatataggaatttaaaactaactaaaattcggaataaacataataaaattaaaggtagagttttgagtctgtataaaaatacaatttacaaataactaaaattcgaaattaagaaaaacacgtgaagaagagtttaaagtcaacatagaaatacaatttagaagtaactgaaattcgaaattaaaaattaaagaatattgaaagatgagtttagagtccacataaaaatacaatttgaaataataaaaattcagaaataaaaataaataatattggaagaagagcctagagtctatatagaaatacaatttacagaaaattcggaatataatttacaaataactaaaatttgatattaaaaataattaataactaacacatatataaaatacaatatgaatatttcacatttgtagtttcgtaaagttattgcaaaatttaaaattatgatgttattttaatatatttgaataatataatgagaaaacatatatgctattatatgagagaaaatataatgatgctagccgtataatctgcgcgggccaccatgctagttaacataacagtagaaaatgcatccaactatacagttatccccaaaagtccgcgtttgaacctgaacatagcaaaggtcctacttaactcaaatgaccagatctgttccttcacctgattgtctcggactcaaaatggatgtacaagttagactactggtacctgttaaaagattcaaaatgtgaccatacccctgaactgtactcgtttggtccaagcaatatggacttcgtagttgtaaactgaagaagatggtctcgaagtggagatcgttgcctcaggtgcataggtaacaagtcacctcttgcatttacatcagaatcaatttcttcataccttcactatagaggaaacgacaggtgcaattctgctccttggcaagaccaaatagcaaagctatgtttcctaggtgcacaaagttgctgcagtagtactgtagtattgtccaaggttctaagttcagatcgtgaggcagtttgcataaacaagggattgcatttttactcatcttaaacttctgtaatctctgtgactgataagatgggctgcagga

SEQ ID NO: 65375 - DNA, 1834 bp, Oryza sativa
tcaacatatagattaatgtttggttcaggatcatcaggatttgccaccttgatacgtggttctatcatagcagtatcaatcgaaccctgtgaacttcagagtgtcaattttgtcaaataacaaatgcatcgtagtactgatgtaatacttcagaaagtctttgaaaatacaggcttgagctaattggtaagtggcaccagtagtccagtactaatggtgaaatgaacagccgtggcattcattttgtagaccttggtctaggaaaggaatctggaagggagttcccttgtccatagaaaaccatgtgtatctcgctttataagaaaattacagttgcatttcattctgctttcatttgctaatcacagatgactcataaaaagacaatgtattgataacttttgaatgtttatcactcccagctaggcaagggaatactaggctctttgaatggttcacatggctcctataaataaagtccaagatatttgaactacacttgagaacatgctggatggtgacattgacaaggaggcaacttccgcttatgcttgtaagtcctgctgatggaggagcacaagtcatttggctctcctggtgcataatagattttctagtcaacacaggctagagtgtttaacattctcttctctacaaatgacccattctgaatcaaatgtgctcacagactgaaaataacaaaggcatgtttagtacttacctgactacgacgccactgtgcacgaagggaagcagcttcttgaagaattctcagttcttcctcttcttccaggttcatatacagtagttcagttgcactctcatatgttaacatgtaggtaggttttatgattgaattctctatactatattctgcaatactatgaacaacacaaatatagttctcaacaattttgctataacaagcaagagaaaagcaatattaagatagtaggataccttccatctggctgcaaaatcacagatacagtaacagatttacaacccctgccttgttgcaggctcatagcattcatagcaagcctctctgggaacattggaaaggtagcagttggtaaaaagatcgaggttcctctgtgcattgcttccctgtaggaaaaaaagtaatgttctcttatacataccaatactgatagaaacactagaagaaggagaagaacaagaacctgtcaatgatgctccggggttgaaccaagcttgttgggtcagcaacatgtatccagacctttatcctaccatcaggtaatctagcagcacttagtgcatcatcaagctgagtcaccaaaaaaaagtgtttaatggatctgtcagtaggcacagctgctaaattataaccagtctcttgggatagatgcaatggcagaaggaacagaaacatgcctcatcagcttcatccacatcaatagcatacactttcaaagttgagagatccttcctgatatcctggaaagatgaattgaatgagattttgaattagtatacatcttttaagggaagacagtgagggagaggcttgctgtcagtacaaatcaacttaggctgtgcactatacttgtaaaaaaacaaaaaacaatacaaagggcatcagtatttggtagtagactaatagctgacatattaatttatagttgtacagctaaacttacataaagggaaaaacacaatatgaagaacatcaatatttggtagtaattaaaactaccttgtctgagtcaggacagtctaccagaagttcctctgcagctgacaaaacttcctcagtgtacctgatgcgaacatcatacctgtaaagatcaagattgacatgcacagg

SEQ ID NO: 65376 - DNA, 2020 bp, Oryza sativa
ggctcggaaccctagatgagggtataaaatagcaagcttttcccctctctctccttctacggcttccgttgggtgtcgggggtagtcgatgggggaggagagagagaggatgatgctttcaaaaaacctcgcccgttgaagcgatggggaaggggaagacgagcgagaggaataaattattaacccatctcttttttccgaataggtccctcagatttgtccttattagataaggaggcgagaaaaaaatttctaatattgcgggtgtgtttagttcaagctaaaattgaaaatttggttgaaattgtaattatgtgatgaaaaagttgaaagtttatgtgtgtaagaaagttttgatgtgatgaaaaaattggaagttgaaaaaaaagtttggaactaaactcggcctacattgttgtattcagtgttgtatacggtacagtgctatacaaaagaaaagcacccaaaaaaaaggaaaaggattcttgcaaaaaaatcaaagttgaattttacatttttcatgtgtttagggcaggcttcacaatccctttatcggactgaaaactttctctagcacgagcagtatatccagttttcacgaaaactaccggtaaactaacaaaaaagacaaaaatgagaaaaatgttatcaaaataattaaattttagtttgattgtttgaaaagcttaaccatgaaatcgaatggtttttgttatggaaccaaccccaaatattctatttccatgaaaatcggtctattttcatgaaaatcgtgatttccattaggaatatgaaccctggacatgttcagcacgaactctcacaattgtgctgttagtacaatgcaaaatgcatgaaaaaaacgagatttcccctaccgtatagtagtacagtaacacatgggatagtatgatttacggaaatagaggggtggaatacaaaaaaaaagaggagcaatacgagttggagacgaaaggaaacgtgtagcggacgcgacggtcgtgccatggttagttgacggcgccgtcgggttgcgagtgccccggttcgggttctagatgccagaaggggccgcggtcgcaaacgtcgacagttaccgttgtgggccggaagtttgaacccctaacggctcgcggtgcgtgcgtgcgaccgtgcggtgcgaaggggaatacacttccgcatccggccgcgtccggtctcctccaggtcatctgcgccgttggtaatcgatcctgtgtacgggtgattctgctgggccgatgcttcacggcttcacatttgccatggcccatggcgagcggtcagcgtgcagaagcgtacgcggcgtaccacgagtccacgacattacgacgagtaatgaacaggtaaatagtcctatagtcgtcgttatgctgtactgcttcagcgctagtacttgctgtagtgaacattccaagaacattgacatcaattcgtaacggaaaattggaaccatgtcattataattttacaaaatttgagatatgtcatcctgacccacatgtcattgactcatgtgggtcctacgtgtcattgagataccgatagatctcaaactttacaaaattataatggcatgattccaatttacccattcgtaaaagataaatgtttgttactccctccgtcctataatataagggattttgagtttttattagtactgtttgaccactcgttttattaaaaaaaaattggaattattatttactttttttgcccttattatttaaagtactttaagcacaactttttgttttttatatttgcataaattttttgaataagacgagtggtcaaagagtataagtaaaaactcaaaataccttatattatgggacggaaggagtacatgaaaatagcatcaagagacttgtcgtcagaagtacttcaattatttactccctccgtctcagaaagaagcgatttctgggggtgaggatttgtcccaaaaaaatcaactcctgcgcaacacccgagaaatattcaatgatccttatcc

SEQ ID NO: 65377 - DNA, 4949 bp, Oryza sativa
ttgtttgcagaccagcacggaccatgtcatcgagcagagcctcagcttcctgacatttatcatcattgcaaagaaaacaaatcgtcatcatcaaggcataccttacggaatttggaaccaaacccttctgcctcatttccatgatcaacttcagagccttgtatcaactcccttctcttccatagccataaatcatcatgtcatagatcacattgcccggttcaacacctttctggtccattgactgaaacagcttcctggcatccttcatatgcccttccatgaagagtgcatgaaccagaacaccataagtgcgcacatccacctctagacctgccttctcccatgcaagcatctaaaaagccttattcatgtcattttctctggcaaatgaatcaaataatcaattagtattgtgtatgtcactttggtcggttccaagcctcgttccttcatgtcagataaagccctatttgcccctagcacgacagaaaccggcaataagcatattgtatgtcattgcactggttggaaactggccgccttcatcaggctgaagaaatgcaaagcattggacatcttcccagctttgccgtagccatcaacaaggaggctataggtaatgatgtttatctcagacgagtactgtccctccgcatcatttccaatagcttggcggtaccccacagcttgccatgcctgcgtaggcggcaatgagagctaataatattgcgtactatgacccttgcaggcatttcgtcgaactagttacgagcgcgctcgaattcccttgtgcaccactctgcgatcaagcagttttaggtgtagaggcttggctcgactccagccctcctcaattctcatctcctcgaacaaggacaaaccattctccctctggccatggatgaagtagccgtgcatcaaagcggtgtaggtgacctcattaggcgccacccccaagagcggcattagatcgaacaccctccgggcttccgccacatcgccgcccttgcagaacccgtggtccggacaagcgcggcgcacgcggtcatgtccagcgccgtgtcccccgccttcgccctgcaggcgagcatcgcgagcaccgagcggacgtcgccggccgcgcagagacggcgcgctgctgcggctgttgttccccccatcggagttccccctccccctcgtgtatacacgatgatggtgtaaatacggggtactcgtgtaatatatacgtccaagtgccggcatggaatgacctccgggcggtggccgcgcgcagccggcgctcaactgaccatctctaggaccttgaataatcccactcgtgctaattttttcagatcaacgtgaccaaccgaccatctctaccgtttcatgtacttggtgaaatggagctatgaagaaactagacgtgttcaaccggcagctcattcagtctagttggaaaaatagctcctgtttaatgtcaggaatcaggatatgtggttgaatgttgtcacctaccaccataccttaaatcaatcattgttaacactagagactatatagcgcgccttagcatgtactccttccgtcccaaaaaaaaaaagacaaactctgttttccgtgtccaacatttgaccgtccatcttatttaaaaaacttatgaaaaaaattaaaaagataagtcacttaaagtattaatcatattttatcatccaacaacaatgaaaatactaattataaaaaaaaatttatataagacggacagtcaaacgttggcatggaaatttaagtttgcctttttttttaaggacagagggagttctctatattcgtcccataaaaaataaaatacgaaatatgtcgcatcttgtttattgtggtagtactagtcatttcgggtctgcatatatttaggtcacttccacctgtttttttttttcaagcaagacgctacacttaccccgttacatatgaactaccaatagttttgcctactccctcttttttaaaaagataatgagggctcatttggtttggtgccctaccaaatcattggtagtgtcaaattatgggcaagatttggcattgccaatatttttagtagagttgaattataggagttatattgcctttggtaaattttggcatcaatccaaacatctacaaggtactattttaagtgccaactatttgttagaggaaatttttgcagcaaaccaaaacagtcctaaattctagttatatatttcgacatagggtgcgtttagatcccaaaaatttttggccaaaaatgtcacattaaatatttggacacacgcatgtagcattaaatgtggacgaaaaaaacaatttcacagtttgcatgtaaattgcgagatgaaactttttgagcctaattgtgccatgatttgacaatgtgatgctacaacaaacatttgctaatgacggattaattaggcttaataaattcgtctcgcagtttatagacggaatctgtaatttattttgttattagtttacgttcaatacttcaaatacgcattcgtataataaaaaaaattggcaaagaagccatatctagaaggtttcttttcttaataacggaggttgtatcctcactcaatcggtcgttaagtatcagcatgaactgctcgctagtgcgctgtgttttcgacgacattgcaggtgcaggctgtgctaaaagaggtaactgaattaaggttgtgccactgacatgtgggtcctatttttgatatggcccacatgtcaatggcaaaactacaaaccacagaaagtcgggagtctcatccatgaattaaatatccaatgatataaggaaccaaccacacagggaactagaatggcttgtctaagtgggattcttgagttgtcagttgtcacctgatgaatattgatgagatgatcggcgatttgctaccgcattcatcagcttctccatcttcggcaaaaaaaaaaatcctgtatctagagtgccagaaagcattagctgggtgtcatgtgctggatcacaggaaaggactttaacaggaaaaaaatgaaatgcgcccaccgtggggctcgaacccacgaccacaaggttaagagccttgcgctctaccgactgagctagacgggctttgttggtacagttctcaaaacttccaaatttaacataataaacctatccattcagaaaaaaagatgggaatgatttagtttcttttactttcttcgacacaagctaatgtattttccagcataacttgatgcaaagttagattcttttaaaacaaattgtatttgagattcaaccctttcttccattttcataaacacaactatatcagtacacctacatcgttaaagcctatattcaacgtggtcaaattatgcatatcttctagtttttttttctgtcaatatagtaattgttatggttcttgagtaagctaggtgcctcttatccaagcagtcacccactcgccattcccatagaccatagtcccacacctagccactcacacgccacatctcgcgcgtatactgtccacccaacgcccatactgctgagataaagccacattcctcctaattgtctctgatggctgcgtatcctcgtccacttcgacgaatggtgaccacgtcgagggtctccttctcaacttcgagtctcttatggtcgttgcttcctccactctggtctctccattgttatatagatcgctggttgtagatggcaatgtggctggctgatgtagcgcttggcttcctcctctttcttcctcctagtcctctgttgcttttgtgattttcttcatcccttggaactgttatttcttttgtcatgaccgcatgccaaaataacaacactctttttttctagaaaaaaatcaatgcactttggtctttgtttttgtatgatcggaactatttaaggcaaaaaaaaaactaaatttatcagtcggatcgtaatgctccccaccattaatggtaggtaatgatatagctgcaccatcttaactgtatctggccttaaataattcttactactagttattctttttcttcttttctgaaaccatatcaacctactttaattaagctttggatgatcaatccgtaatcaacatgtcatagatcacacaatcttaattctttatagccttttgataggattgatcaaagatgcaattactttggtgcaaactgtagcatatacagtcatgctataacaaatacattatgtttaaaatcaggtgatggagcttccagaaaataaatacaggacatctgaaaaatgtttataaatggggatgtctacatattttgggcttgtttagattgatgccatttcaaacctttttttttgcaaagttgtgaaatacgtgcatccatttagttacttatcaaactctagtaaataaataaaaaatcctgccaaaacttggtaatattattaaattgccaaatttttggtattgtaaggtttattttggctacaatctgaacaggtcctttgtgacagaaaatcccacatcatattattcgaattttggaccattggatatgcttcaagatttgtgcggagctcttaaccctaacttctgttggaattaatagatgggctaaggcctattcgaagattaattctttggaaaatcacaaaagcccacctcatgggatggcatgcatgtggagtttagtaccaccttgcttattctaggagagggggacatccttaaaggggaggatgccctcctagccacttgaagcatgtgtggtggagagaagagggggaacacacgcgcgcgctcgctggcctggtctggcagacgtacgcgtcgaatgattcacaaaattggctcctcacccttcgcagatgcaatggagtcggataagttacgcgcgacttatgccttcgacgtcctgcaccgggagaaggcgacaataaggtttttgggaag

SEQ ID NO: 65378 - DNA, 1548 bp, Oryza sativa
cccaactccaaatcctaacccgtatgctccctaccgaagttggggggtgtcgccagcgccggagaagaaggggagcccgccggagttagaggagagaagccgatgtacgaatcttggcatagatccaatagtctaaaatctataagatttcatctctaaatttcattcgaataacatatagcaattccatttataataacccgtgggaaatgtaccgcattatttggcatagtatttaagtggcataaataccacaccaaaccaaaaccacttgaaagatggtgttatggcccaatataagttctgtccgtgtgaaaaagggggagcttgagacgaaaataatatccatcgccaactatgcacggctaccagagtttgacagatcggagaagagcagaaaaacaattttgtgctactacttggcttcacactggcatatgcagtatcttctggaagaaattcggttgtcatgcacaaaacttgcgtagtactactagtactagctgtggaagcttaggaaacgaggaaagagatcaatgctgagtacagcttgcagttttctttgaaagatccggaatagaaggaagcgtgtcttcggtttgtctctctacatgctccgcgtgtcacatactcacatggcctaaaccgatgacgtggtaataaaccggtagtaataatactggtagcatttctgtctgtctgtacactcccaacttgcatcctatcctcgtgttaaaagtcacagtcaccatgcggtactacaggaagcacagcctgatgactctgatcaatagccgtcactactcactacaaccacaatatggttgaaaagtaggtaataagacataaatacatctctattatcgggtaataaacattgtggcaaggggtaacaactgctatccggttttagtactactaccggtagcaagaaaataaaaaaataatagatgtgcaacattttcatggggtaagcaattatgttatatagaaaatgtatagttttttcagtggccccaccttactacctctggcagacaaaatatacatagtgaactctctatgtcactgctacctcctgttacatgggcctatgctaatgcccacttgagccagatacatttggcatgccctaacgaataaaaagggtcattaccgagcccattcctggcctcctgatgctgtcaacctcacttccccatcacgatcatgaggcaaagatcggatcgcattacgaatctctccccaaacccaaatgtccaccaccacccacgcgaggatagaaagataatccgactagttccatactcccaatcttgaacattagaccttccattccgttcattcccacatcaatcaatctatcccgactcccgtgctggattggcgtgccgcgcgcccaccggccgcaccacatcagagagaccagaaaaatccgaatccccggtcagcgacggccaaagccaaagccaaaccataatccgcgccgcgccgcgcctgaaacgcgcacgaaaaaacttctgggaatccgagcgcgacggattaggg

SEQ ID NO: 65379 - DNA, 3520 bp, Oryza sativa
tcgacagcgtgccccgcatcatctcgcgcccggcgcctggttcgctgtaccgcagcccgcagctctacgcccgcctgcgcgccgacatggacgccgacaacgccactgacgcggtgagtgtctcccacctgctcatccgcagcctgggtctgttgcactagaaatttatatttgcgatgaaaatatttggtcgttttttgtgatgaccgctgagcgagtttacttggtgcttgagatgtcttaggtctggcggtggtacttggattactgggtgattgtgtactaagtttagcgcatctgtagcaacagtgaactgtgtctgtggctagcggccaataaacgattagattatttagtttattctgactgggttggatttgggttaggtattcttacagttgttggggaattgcaataaaattatagaaatgcgtgtgatgtatcagttaatgtttttggtgtacttgctgcatgtgcggggtggattagagggcagactagtggtgtttcaccggttgaaacctacttcatatttgtggatttgtgggtgtcctataatattagccagttgggcattagcagacaatggggttgcttggtcagaactagagtgttggaatgtgagaatttatcagttcaactgctgcaagcaataagccaataagcctgttgggtttgtacattgggtcaaaaagctatcatgtttgtgtttattgtgactgcctgctgggagtttaagaaatacacctcatttgatctttttgtccacaatgattatgaatgtggcacattaagtaaatgccttagttggttcttccttaatgaattattgcactcgatatggatgatgactgcaaaaaagaatttcattttagatgattacaggtaattttttttaattcaaattaatgaaacttctgtgtatccgatggcctttcaagttttatgggcctgtttcctggtgtgatagctcgcattgtccttttgatcagtgaaaatgaccttgcttggtagcaaacaataagatgtactgtacaactgttgccacctgcttgctatagcactgtggggcattcttttgcactgaatttatcaaagatggaatatgtgctattttcatatatagatctttgtgtgctcataacataatggaggattgatttatcaataccattttccttctattgtgtccattagctttaatgtagttatatgacataatttttagtgttgcctagtaccatttcatgttatatgttacagatccatattgttctgtggtttgagggtttattatttccctcatgctatcaccctttatcttgtccttctaagttcacttatgcatgttttcgatgtatgtttataatctcatattactacatttttgtagctagcaactgtatggagacatgcttacaagggtggcatttggcgaccttgcataaacaatattacatatggtatgccattcctacctttccttttttactaatgagtttcaaacagttcttatatttgtttatatattcatttcaaaggccagaactgttcctattaatatgatatgacttggatgaattccaatgcagcctagtttcttcctttgtccacgtgtaatatttgaagttccattttgtgaaagaaaatatcaaaactttacaagtgatttaggtgaaactataccactacatatgcatgttggtcagggttacatttattggtagaatcaggcacatgtggacatgcccataaaggatttttatgaacaatgcttattatttcttcacagtttccaaatatgacatctctgatggttaattgtgtatctctgaacaaacagacatttaattccttccattggcttgctgcttcctggtacatcctttttgcacaaaaatctaaaggaaagataaatcacatttacatgcaaatgattccacttgtcatttgcatatgagtgatatgtggtgcactttctacattgcacttttgttgtgatgtatttgtaaaggccgggaaatttgtaatattattggaagtatgttttaagataaatctaccgatatatttgtgggacatggcataaggcacctttgtgccaatataactaccatgaagctattattggtcaaagtaaaataatagtttgactgtacatcctaggcctagggcactttgttttttttactggaagtcgtttacttatgtgcatttgccatacttgtttatgctatatgcatactcctttttcagttacttagtaaaacagcaataccattttgcatgatgcgcctatgtcttgatggaattatctaataaagttaaatatttatgttagatttgcctgaattaaatggctacatatacgtggaggcgaatggtggtttgaatcagcaaagggcatcggttgttacctaccttcaatgaaccctttttgtttttgtatttttatcatttctgtccacaaacacatcatgagtttctacaattttttttgttcccgcccccccccccttttttttttgcagatatgcaatgctgttgcggttgctggttttctaaatgcaactcttgtgatcccaaacttccactatcacagcatttggagggatcctaggtctctctctctctctctccccctctctctctgacgaagttgaatttcttttgaaacaaccagaagtttgtttgcattaactctacttatgccattttttatgaaatatgtgtatgagttaatgagaaatgattttgttcaaaggtgtcacataaaaaagataccaaatggtagtagtgaagtatgaaaatgttcctttttttgcatgctgcaacactgtactatgttaactgccatactgacaaggttctatgtttgtgtttggatgagagaggcttctttgaggatttattacaacataaaaaaatcaagttattaacatttctttttcttgatacagcaaatttagtgatatttatgatgaggaacacttcgtccaacgattgaaaaatgatgtccgagtagttgacaaggtgcctgagtttattatggagaggtttggtcacaatttgagtaatgtgtttaatttcaagataaaggcttggtcttctatccgatactacaaagaagctgttcttcctaagttgatcgaagaaaggtaggttaaagccaattttgttattgtagttctgaagaatgtaagaatgttgacttgtgatatatgatagagtaaatttcacaaaccgactgtgatatatgatattttattgcttttatctgtacattataggcttataaggatatcaccttttgcaaaccgactgtcctttgatgctccatcagctgttcaacggttgagatgtctggctaattttgaagccttaaagttttctaagccgatcacaactttatctgacattttagtatctcgaatgagagaaaaaagtgccgaaaacaatgggaaatatgtagcggtgcatctccgttttgaagaggttagtctttcttctgttaacaaat

SEQ ID NO: 65380 - DNA, 8115 bp, Oryza sativa
  unsure (1)..(8115): unsure at all n locations
tctgcaaaagtttctttgcttttcaagtatgatctgacataatgcaatatctgccagaatttctcttcaaggatggcagctatcgattacacagtatgtgttcatagtgaagttttcgtgactacccaaggtggaaattttcctcatttccttcttggtcataggagatacatttatggtggtcattcgaagacaattaagcctgataaaagaagattagccatactcttcgatagtccacgtatcgggtatgctattactgtggctcatgaactcagtattaaattaccttctggctctggaaatcttggacgttcttgcattattcgttgttaaaactagcaaattttcgttttgttaaaattttagttgcatttgtgcagatggaagtcactgaaacgtcagttggtgaatatgagaacacacagcgatgccaagggtattgaaatgaaaagagcaaatgaatctatatacacctttccatgccccgactgcatgtgccgctcaaacaaatcagaacactctaaatccatccaggctagatagcatctactagtcttgacttgattgactgaccttgattctttttggtaccatagcatgtgctcattctttgcttgccgtctggtggtgtgatgtctgtccggtctccaagcaccctactgcagcattgctcatctattacactccccaggtggattttgcggatatattagattcatattagctaagctaatcctggggctaacaatacaccgatctgagtctcaatagatgtgtctaaccgtttctaggtctaataccctgacaatgtagtgccagtccgcttgatgtaatagtagttcccttgtacatttctcagctaggaagaaatttgtcatacaaattttgagaagaggaacaatgcttattctgatataatttattgatcctttcatctgaaagctagctctttgtctaactattcttttgattattgtatcaagggagggaggttttccttcttctttcatttgtacaatttgccaatttcagtttgagtcagaaacaggcaaacagctaaaagttggaaattctattcccagttctggttcttcatgttgccatctgagaagcaggatatttctgaaattgcagttggcaatctttcaaaaccaaagtgtccagtatgagagattatcagtccgatgaagaatgtgatggtaaaggaaaaccggtacgttttccacggccgtcttgctttcagcttatcgagtacaagcattcaccggcgtcagttgcaggtcgtcaatgggggctcgaggcgggtcacatgccccatttgtagcttatgtacgccgctcgcatcatccccgttaaacgacaataacttgtgaaaggaagctggtgagtcgagcatctcgtgaaatctctctgacggatttagattcgcctttttgcccgttcattgtttcagttacccatttttggccaggtgccttttggtactgaatgaatcaaggcttctcaaacaggcgtcacaacataccgtgctatcgtagtggtccggaagacgatacctcacctgaggaaagttcggccatatcttgctgttctggtcaggttgagtgtaatacacacactannnnnnnnnnnnnnnnnnnnnnnnnnnnnnnnnttcactacgcccttcacgtgccccattttcacacaacagagtaaacaccgcccaggaccaaaacaatgtcgaatcttaagaccattagtttcgaaatatttttgatcctgaattgagggtacagtaatggactagttttttttttttgaaatttacagtaatggactagttcatatagttaatcctttgattcgaagtattttaagagcaaagtccgtatttaattgtttggttggtagaatgacgcctcaatccgcaccattctgtcgaataggaccaaggcacacgtgatgcgacgtgcatcatggtacaaagttggcaaaagcgcctggtagcggagagtgggaaagagctggctggcgtagtagactagcaggagtccacatcgtcccatcaacgctgcgacgccaccatttaattccacacccaaaacaagtccaccgtttaaagaaaggcgtaaactatcgcatttcgacagcaaaaaaatccccgtaatctaaaaccaaaatcacgcgcaaaatatttttcttccccgtctccttcctcctcgggcacctcttctcctcgcttactcctcagtcccccacccaccaccccagttgctccccccgctggcgagatgcggggcggagcgggagcccttccggtgccaggcggcctcgcgctcggggtggtgctgcttctagttctcgccgtgctgccgtcccgggcggccggggtgaacgtgacggccgcgctcgcggctttccccagcttcgccgacttcgcgcggcttctggagtcgagcccggtggccggggagctggcggcgcggtcgtcgctgacgctgctggccgtgccgaacaacaacctgccgcgctcgccctcggcgttcgcggcggcctccggcgccgacatcgccgatgtgctgcggtaccacgtcctgcttgagtacctctccccttctgacctcgcgcgcctccccgcctccgggaagctcgtgacgacgctgttccagaccaccgggcgcgcgccctccgatctcggcgccgtcaacctcaccgtcgggggaaactccaccgtcgtggtccggtcgccggcgcctttcccggggtcgagcgccactgtcctcggcgccgtcaccgctgtgccttacaacctcagcgtgctcgcggtgggtggcctcatcgtcccctccgggctcgacgtcgcggcctccgacagccgcccggccggtggcgtcaacatcacccacgtcctcgcggacgcgcgggggttcaacgttgctgcctccatgctggaggcatcgggcgtcgcggacgagttcacggcagacgagcgcggcgccggcatcaccgtcttcgtgcccaccgacgacgccttcgccgacctccccgccaccgaccgcctccagtccctccccgcagatcgcaaggccaccgtgcttcgcttccacgtgctgcactcgtactatccgctcggctccctcgagtccatcgtgaaccccgtgcagcccacgctcgccaccgagcgcttcgaggccggccagttcacgctaaacatcacacgcgtcaatggctccgtcgccatcgacaccggcatcgtgcaggcttcgatcacccgcacggtgttcgaccaaaatcccgttgcggtgtttgccgtctcgaaggttctactgcccaaggaaatgttcggtcggggcggtgctgatagcgacgtcatggcgccgccgccggacgcgatggcgccagatgctgccgagaacgtgcggacgccgccgacgagactgtcgtcacctccagcactgcggggtggcgctgatagtgagtcgtcatcagcattgtcaacggcaagggctgtcaattggtggtgtatacggttggtgctcctaaatctgcatctcttactactacctctggtatgagatccggatgttacccattgctcgcttcattttgctcaatttttgttcttctgttactattttccccattttagaatgtgtactacgggaatgtgatgggtagagaattttataggggcaaaagcagtagcaatttgtctagtttctttattagttttaacgaaataatatcatgtgtagagagacctatgaaacctacttgttccaaaacgaacagcagcatgttcatagttgttctaatcaggtcagtttgtgtttgaactgaagtccaattggggctagcattactggggaattggtgtgaggaactgaggattactggggaatcgatttgtgtgtcttttgtattaaggtaaggtgcagaagaatttgaagacatgcatttgcctggtattttgtttatcaaggacctgaagtcttggagtcagggttctggagattgatagataggtggtaagcgtgaggaatgagctggccagcttggaggtggcctggttgtctacccctgtttttgattctcactcctctttcctgctaatgacgcggactctagttgcgcttgctgttactattccctgaagacaaattgaacacatgtccaccctttagctgattggtcaggattttccaccgttaaatttctgttgaggacataaaccaaccatttagggtggcatatgctcaattatccctttttttatctaaccatatagggtggcctaccacgtactccttgctgatcatttggctagtttcgtagcgtgtgaactgaaatctgataagttggtttgcagttaaattaaatagcttatgccccagctccaaaagcttcctatatgaactttagcagccctaagatctgaagagaagaagtttagcagcattgtataccaggttgcgaatttactgataggtaggtgttctgattcttgtgactacctatcaggtattgctcatttcatgcaagttaggtagttgtatattgttgtgtttggtagagatttgagggaatttaaaccatcccaataaagagtttgaaattctaggtgctattgtcatgcattgctagtctaacgtctaaacatatccaaatagtctgtcagttatccaaacatgtcgaccaaaaacatgagttgttgtaacttgtatatgcctctggtagctaccgtttatatgtgcggctattcctaacattctgtggtgtttcatgttcataatggctggtgggtttttggggagggaccactgtgcatgaaacttttgtatgtagtttcactagagtccatgaaagtggacctattgaggttgcccatctttattcgattagtttctggacccgtttggtcatgtgccagctcatgcgtactttacatgagccatgggacccatcaagttcttttctgaataatatccatgagatgagccatggttgaaatgtcaaactttctaaataatgacgtgcacattttctgctttctttgtaaactagcgtcttggaaattcagcattaatactggatgcgatgtgtttgtcatagacttgtaactattcattaaacttgtaactacttcagtaaaagtgtatcctctgtaccactgaagagtgaagaaatgaatgcagaatagaaaaccctgcctatctgaaatatactgttcagattgcggagaatatttatactaaaaaaagttcaatatttatcatatgtctcgagtgtcttcatgtcatgaaaacaaatgaggtgatatttatgaaagatcaaagtaatgagtcgtttgaacacctaggttcttgggcaagataagatttagcaataatgcatataggtatgttggattagtggcaaattactggtttagtttattgttgcggacttgtccatctatagcctacagtgaaatcaagaggcatttgtatctatgttttcaatttcacattctgaagtcttgtcagaaaaataccggcatatgctgtagaaaacagtgtaacaccaatatcttgttctttgttgtgcgctgcagcatgcacttgtcacctattgtgctacagtttttttttttttggggggggggggatgggtacagtcttgagactgaatttcagcaataatgaataaatggaaggtgcccatctattttaatattttttaccttttgatttttgttctcatgctccttgtctgaagcttcatcttttctgtaagatcatttaacctatctctgtaacttaaatcctagagtaggaatatgcaatgttcttttctgtaagttcttgtaacctattcctgcaaatgagcttaatggagttctgaacttcttatacatactccatcaaaggattgtgcatctaaaattcctgattacctgtacttttatcaacaaaaagaaaaaaaaaggaagaagatatgcatagttattatgaggttctttcaatctgcaaattttgatcaataatacaagggtagctgacataagtgttcttagtggatatagtagcctcctccccctctctttttacatgccctaaatgtcgaaatgaagatcaggtgactgtagtgtaacatgctatctagccattaattccaatcttcttaggtcaagaatgtgctgattcagtagtctagaactctatgttcatagagaaaactgaaagttgcttctgttttcttgttggattagcagttacagtttttgtgagatttgttgtactgtgaatttgattgacttgaaaagatgtgaaagtagatgtcttagacatgccacatgttaaaattcttaggtaaagcaaaagcatggagcaacttcagatgatccaaattggtaggacatgtttgatgtcagaggctcttcattgatacaacagtggaatttagttcgtggtcacatggttgcaggcatattattgtactgtctatttttgtatgatggttacaaagtgaaaatgtacaagtagaatggccttgccatgctgcagcaagatctgtacatgaggtgacctgcttccggtgatctttatattaggggttattttttgtgggagggttcaaagaactgatatttctgcttgatttattttttcctatttctttcttagcccttgttaatgatataaatgggaccagccgaggaaaatccatttactggagtagctgtttcggaaggaagtagaagtttgcctggttccttcaataggtgagttaccaatgaatccttgtggcacgttcatttcatttcttttaaacaattgtgtggatattgaacacttgtgaggattgacgatattaaccaatagggtcggtgttttacatagccggttttcacagcactattgtgatgtcggaggtaaaatgctaagctccagtacgttccatcgcgtgctattgtggcgctgtagagttttggtgaccatgacatgaaaagtctgttattgaaccttaggtttgaattctgtacttgtgagggaaatctagtactcccatggtaggatcttgtacagaacatcgcataattcaggcatacactctctacgccattttccagtaattagggctctttgattcaaaggatcggtaatcaaaggatcagtataggattttgatttttgtaggattcacaatcctatggattatttcctatggatgcctctgattcataggaaatgaaaggaaacattcaaggattacatacctttagttcattttcacaggaaaaaaaagaaaaaggtctgacctctttggaagagaaatcatgtgttttttcctatagcactatcaaagggcacatttcatcttttcctgtgttttttattccaacgggattgaagaatcatattacttcaattcctacgtttttactattattatatttttcctatcctgccggtcgaagggcccctgtggggtaggataagatatgataacagattaaacagtgcatgatagcagagtcaaaaagggatgtacagtagttgggaatgatgcacgcactggaggaatctattcatgtcatcttgctacgcgttacctatagaccgcagctgccttctgccgcgagcttttgtgccctcctttctatttgcaagtagctggagtactccctccgtctcataaaaaaccaacctagtatcagatgtgatatattttagtactatgaatctggatatacatctgtccagattcatcgtactagaatatgtcacatgtaatactagattcgtttttttatgggacataggaagtaataactagagtgctctgtagtgtttttttttccagatagagtgctagtatgtagcgttgaatacactgataattgttggaatatttgatggtatggtaaagtcaactagtcaagtggtaatgacgaacagtttacatgtaaaagtgacagagaaaaggtaagctgtagatatgtgtttagtgaagagtttaagtatttgcatgatgttactaggttagaataaaattaagagtgggacttgggccaaagaaaatgcaatggaacacgaacgccgaactgtccggcacgaaccagagttttctgatactcgtatgtcacag

SEQ ID NO: 65381 - DNA, 2367 bp, Oryza sativa
ctaaaattgtgtaggatcgaaacaaagtaactaagccaaccagagggggtgaatggttggtatacccaaaaacccaaacttttagcggaaataaaagttacccttaaattcgatgtagatcggtctaaccgaagttgatccgccggtctgaccgcgctcgcgctgtcggtctgaccgatgttgatcactcggttcaaccgcctgaagattgcctgccgcgtgtgaagtcgccgccggtctgaccgcctcgccctagccggtctgaccgccgccttgccgccggtgagtcgccggttagactgccaaaacccggtgaaacacaaatcgaagcacaactttattgcttctctctgtgtttacaaagtataccaacagcactccttaaaaaaatttcgactaaactcgaaaccctaactaaactagcaactcaattgctctcaaaagcgataccgggaagcctcacgctccccctctatttatacatgaggtaggcagcctaaagccacgaaccaaactcatactaagagtcctaaacaccttaggaaaccctctagtataagaaagaaactttacataaccaatcgtaccaaatttggactccttccaaattcgactccgcatcccatacgcacataatacctccattgtatgccatatggaatcttcaccaatcatgtgcatcaactctagccttagtatcccgcatgatatctgaccaccacggacatcgtcttaccaccaagccgactcccggtccatcaccgcaaatactctctcgaggcatcgagtcacctacacatgaaacaaacaaagaaaccatatttcgagaccaagctatccccaacttgactcattagtagcaaacaacagtattacatacgtataatatccatctagaagccataactatgaaacaatcacggatatccaaagaaacaactcgaaaccgaaaccgacacagcgtcggccggtcagaccgcgggccggccggtctaaccgctcgatcaccaccggtctgaccggcatacaccgcccggtcggaccggtcacatgaaataacagtgaatccgatcatcacctgaaaattgattatctccaaaaccacttcgacgataatctccaaatatcaaaaccaataatcacatatgccaattgtttatcacagaataagaatcaaaacacacattgattttacaaattgaaagtttggttaaaaatgaaacgatgtgacggaaaagttggaagtttgtgtgagtagaaaagttttgatgtgatgaaaaagttagaagtttgaagaaaaagttgggaacttaggctgtgtttagttccttccaaagttagaagtttgggttgaaattggtacgatgtgactgaaaatttgtgtgtgtatgacaggttgatgtgatataaaaagttggaagtttgaatccaaagttaggatctaaacacagcctaaggacaccaaacttccctccaaatcccaactttccattacatcacatcacatccaaaactttcctacgcacatataactcctaactttttttttccaaactatcaacttcttcccaaacttttcccaaacacgacctaaaccaggcctaggtctgattctgatcagttcagcatatcacattctggactctggagtatagcagagagaatttcactgcatcggttcatccattcgcatgtcttttcacgatccttgtacctgtccggattcatgtcaggtgtatttgcctgcaattgccagcttgaagcttccaacttctcaaaatttcctttcttcgtgtgtttatgagctcagggaatcaggcatttttagagtttcagaaatcagaactgaaattaaggacgacgattacaaaagggtcatcacaaagaggatgccagcaagccactgactttacaggattttttctcacgcatcacaaaccaacgaacgatgcgatcgacgaagaaccatccacccaaacgatcactactggctcaggagcagcatcgcctccggccgctgctgcccgaagccgtagaacgggtggtggtagtggtgcggctcctccgccgccgcctcggccttcgcctcggccatcgacaccaccagcaggttctccttgtcgccgtcgtccacgcaggcctccctcctccacctgccctcgtaccgcgagttgctccggccgtagcactggtgctccatcgcccccgcgcggagggctgccgccgccgaccccgacgcatgcgcgctgctgaggttgaagctgccgaatcccttgatctcgtgcgctatcttgcgcgcacgctcacgctcatcctccaggaaggggccccgctccagcagcctcagcacgcgctccgacttgctct

SEQ ID NO: 65382 - DNA, 6400 bp, Oryza sativa
gagaccatctgctcgatgacctcccgatccctctggaactccaacgcgacgctacgggggccgtgcgtcaggaggtgctcgaggaggaggagggccttgtacgcctcacgccactgccgcctgtcgaacctcgcgaacctgtaagatttcccgcccccgaatcaatcgatcagccaacaaacgagcagatcacaaacgcagcgtgcgtgtgggtggcttcgttaagagaggcaagctaggcacgtccatcgctcacctcttgtggaggatgtcggagatcctgacgtactcgtcgatctcgaacgcctgccgcgcgatgaggctcatcgtcttcacgttcggcggcgatgcgtccccgctcgtcgcctcctccgtcatcctggaccataccaacaaaaacctcagcatcaagaacacgatggaacaacggatcggtgacatctatccgaacaacaagacgggggaaggatcgatcgaggaaggagccactcacagctgcgtcggggtaacatcggtgagcgcgagccgcgcggagcggatcttgtcggtgaggtaggacgaggcctgccgcctgagctcgtggaagctgaagggcgaggacgcgtccatggccgccgcgtactgcgcgcagaatcccgcacatccgccaagaggcgacggatatagcaagtgcccctgcttcgtcacccgcacgcagctactgccacgcgcatcgacgcgtccgtccgcccgcctcgccggccagcaaccactccgcaccggagcgcgcggtacgaacagagctcgctcgcagggggcgcaaccactccacaaatccgctagtgatgcatgggatgggatgggagacagcgacggcgagcggtggaatggcttgtgtgcttggactggacgagcttatttggaggggaaagaagtgcgcgccccggtcgatctctttgtcatcacccctttgaagcgttcaaaagtggacgggacgacgctacgctgtgctagtggcctagtgcagcgaggcgacaagattgtcaactggtgtttggtactattagacgggtgggcgagttttgaattttgaaacccgcatcccgtggcgcagccagggcagcgcaggcgctagtactagctagaggggtggccgccgtggtgcgtcgcggctgaggtcacgtggtccggcctacgtacgcgtggcgtgcgcgccgtggcgaggacggcccagatggggggcaggtggtggccgtgctggaattctctgtgcgacgcacattcgcgctgtgcgcctgtgccccgaagcgtataggagtacactccatatcgcacgatcgatcgcccagcgacgtcagggacaagcggtgtggtggtggtagtggtagtggtagtggtagtggcagtagtagtcgctttcgagaacgatgactttgatttcttttctcggtttttctacggaagtgttctggagccatactcctacgacgtttggcaggtggaggttggaagggatttgacccgcttttgttagacttacttaaaaaaaaaaagactaaccctaaatttgtgtgcaacgtttaactatccgtcttttacgaaatttttttataattagtatttttattgttgctagatgattaaaacatgattaatactttatacatgacttgtctttttaatttttttcatattttttttaaataagacggacagttaaatattggacactaacccaggatttatcttttttttttggaacggagggagtacagtgcaagattgttcctagcgtcccaaggtgagtcgacgggcgtcaccggtgaaagcgtggaagaagtaggagaaccagaaaagaaaggatttcatctacattttttaactttttcattgagacgatgtctgtgttaaaatgtgtcacggtccacgggcttttctacgtgccaccttgtccagtcgtaagctacgttcgttcggaccagagagagaataaattctcgtcatatatgctttttctgagttgttaaacaatgtatttttgaaaataattttatagaaaagttactttaaattcgttacaagttttaaaaaatattacccaattgattacgggttaatggttcagttcatcgcgtgtatctgtcagggttacggataaggataacctctgtcctatgacttatggaatatatcaataaggtatactctcacgtatacgtatacggttggtttccgtatacgccgttagaaattcacctcaaattatgggagatatctctacgagttaagggattaccgaagtactactcgaaaagggtaaaatctctagtatatcatgtcggtttacataatctccaagtcttacttgagagtcaaggtatcccacgatataaaagggacccctagggagaggctaagggcatcgcatctcatcgccaacacacccaccaaagtttacgaagccggagtacacggagccaactcgccgggagatctcgtcaaatccctcgactacgatcttgtcggtatcacctgttcggttactctctctgtaatggacgtaactacacagctaatggtagctggtttgtctcatatatgatagacactatccacctatatttcaaatacaattttctctaaaactgctcatccgatctacaatccgattacaccgttgtgttcgtaacaattaaatctttataacaagaactcacacgattatattttgatgaaaaaaaatataaattacttttataatatatctaaattacttttagatttcactaagttacttcttagacatataaaagtaattcaataaagcctaaaagtaatttacatatactatagaagtaacttataaaaaaagaaagtaacttctataatatatgttaattactttaaaactttattgaatttacttttatatatttaacttagtgaaatctaaaagtaatttagatatattataaaagtaatttatgattttttatcaaaatataatcatgtgagatcttgttgtaaagatttaattgttatgaacacaacagtgtaatcggatcgtagatcggatgaatagtttaagagaaaattatatttgaagcataaatggtaggaatattttttctacttgcttgatcaattagtactatagtaaagtaagattcttcaagacacatatctggacaatggctaatcgtatctggacaatggctagcgtcgctcgttatgactaaatcaagagcgctctcgatttagattttgcgctttgtaatctgttctcatcatcagcaatcccatataaactggactagggctattacctgataaagggcctgaaacagtacaatccttgtcttttgtctgttttaatgtcgtactacgtagatccctattccgacgtaacccaatactctattcttccgatacatgagtatcactcgtcgacagtatcttctctattttttttcctcatcctcttaatcgcagccttcactttcgtcgtgacgagtcacgtatcgctacttgcaaactgcgtgctcagcgtcgacaagtgatggagcagccgccccaacaggatgcacgacagtcaggtcgagagagcctcaccatcgacagcgtgagcatgacactgacaccggggtgaaaacggtaacgaccttatcaatgtcgtttacttaacgtctttacgaattacgaccgtaccgatatgtccatcggcacgcggcaactccctcatggtagcctgccagaattttcacgggccatatgctcaccgtcgaaaaggaaaaagtacaccgaaggtcccttaacttgtcatcgggatataaaatcgtccccaaccgcaaaaccagataccgatgatctcttaactatacaaaaccggtcacaatagtgcctcggtgattttgatcccgattttgtcctatgtggctgctgactcagcgtgggacccacgtgggccccaccaggatgccacgtcatctctctcccttcctcctcctcttctcttctcttctcttcctttctcttcgcaaatcgcaagccggccggcggctggggattggggtggaggccgacggggcgaggcgggagaggacgagggcggcgccgcgattgcggccgactgaagcgggcgcagtggggaagcacggcggtagcccggtgaagctctgcggcggccaaagatgggtgagggggctcatgccagcgacggtggcgcacgcgcacgagcaaagtaagggtgtgggcgcgctcggcggcggcggcgtcgatgatggaggcgcgactgccgacggtccacttcggcgggctcggcgagcttaccaccaccaacaccgcagagccaagcgccgctgtccctctcgcttcacaggccggaggcggcgatgtcgctgctgatgtagcagcacaaccaccaccaccagccgtcgccggcggcgggcgcggcgtcgacatggcagctgcagcaaggcgcgtggcatctccgcggctaaaggttcctcctcccgacgcagcagctcttgcaggagttctgcagcctccccatgaagagcaccaccagcccatcgtcggcaagcaaggcacccaagcaggcgcaagaagacgccgtcggtggcggaggctcgtcgtcgtggaccgcgccgacgcagatccagtccatggacgggggcgagctgcagcggctcaagggcaagatttacatttaccccatgctcgaagaggttagcttgctcagccagctaattaaccacatcaccaccatggcaaggcctaatttaagcaaagctagcatgagagtgtactctctccttggaaatctgtagtcagtagccgagcctggccacttcgccttgctcgccagtggcagccgcgagcgcgccaaacgcgcggtaggcggcgggggcgcggcgaggcgcacgccgcggagcgcgtgtgtacggcgtgtgcgcgcagcaaggcgaggatagcgcggctccccagcgaccgccctcgcgcccagctcctcccctgccgccgccgccggccgcgccgtgcccagcctctccgtcccgcgcaagcgcgcacgccggtcgcccgtggaaaggagagtggaaagggcaagagagagaaatattaagaggctgacatgtggggcccacgtgggtcccacgctgagacagcagtcacgtaggataaaaccgggataaaaaccgccgagagacatattgtgactggttttgtatagttaagggatgtcggatatctggttttacagttgggggacgattttgtatcccgatgacaagttgagggaccttcggtgtactttttccccgtcgaaaacgatctgggccagacattaggcccgtgacggagtagagaatttcgccggaagcccaaccaacaatgcagtcagcccggaaagtgatcccaattaactctactgaagtcccccggtaactgaaaaactcgagggaccgagggagaacggaggatgcgcgggatgcgctgcaggcgtgcagcggcggagctagcgagctttccgcggtctcgggcgcacatttgtccgcatacaccgccaacgattcgcaccgtctttcaaggcttttcctccattatcttactgtaagcagcctcctcccgatctgtgctttggccacaatgggcttgtaaaatgcgcgcacaagagctcacgcagcagcagcagcactgacgacatctcatgagctcgtgatggtgatgctaaccaaggctgaatctaatccatgtagtagtgttggcaattaggcactttgtttatccgcctgcaactttccaaccctcgaggcaaaacaagcaggtttgtcagataattttactgacaaatgcttggctttttcacgtgttgcccgctttcgactccaccatataagccttcacgcctgtccactcctcatcagtcagttacccctgctttctagactctggtagtgctcttgtcccccgtgggatcggcaagctcggctctgagagatcatggcccatgaggtgcgccaatcttaatttcgcctaattgtagctctaatctcacatgctttttctcagtctgttttagcgcaccaattgatcatggcaagcttgtggtttgtttggggagatggtgcaggatgggtggcctcttggactgggcgccatgaatgcaagagctggagtgacgagaagcgtggatctttctggctcggcctccttcagcacggccttcacttcgtctcactgcgcttcgtcttccttcacttcttgtgatttcgacacagaggtcagttcgaacataatctgtatcgcaaattcgcaatgcggcaatggaacagtagtgcaggcagattacatctggatctgatcgtaacgtacgtttatatataagtatgttttttgtcgcagtcggcatggtcattgtccc

SEQ ID NO: 65383 - DNA, 3111 bp, Oryza sativa
tttaaaatcaagggatagatgttttgcttttttcttagaatttctaggattttctctattttattagagcgccacgtggtggcttgagaacgtctgtaggaagttttatggacttttagtatataatagatagatagataatagatagatagatagatagatagatgacgacgtttatggtgactttcgttcgcctcaaaatatacaccaatttttaaacgtatccatagaggataaggtgttcggattcgcctttacaaaggctaaagggtgaatgtacctatgtataagggcttgcatctctaaaaagaaaaaaacgctcttctttgacatacagggcatgtgccactttaccgctactttcaacataaccaaattttagtgttaccaaattttaattgggaaaaaaactaaacactaccttaacaacaccatcctaccaacatttggtagttccgaagattccctcataaaaatgctactaaattttggaaaaacatcaaactaaaccaacgctatcaaaatttggtacaaaagcctatagcgattggtgaaggttataggaaaaagaatatttcgacaaaaaacaaggggagtactaatcttctttgctgctacatgatggcattaagtgaaaagcgagcagacgaaagatttcatgtacaagaattttacatttcaaggcttacagcctctcgagataacaacgaaacgcgagctaaaaagcgaaatggataagtgaagcaagcccatagtcattgcccaggaaggcaaactaggccggcccattaattcctcctacgaatcgatctgggctgtgaccctagtacccgacgtgtatataacaacatcctctccatcgcttagggtttctcctcggacgcagccggcggcttagggttttgtagctgtcgccgatccaaggtacgcagcctccgagcgccgcctctctctcacacacacgagcgcttccttactcgagatctctcgcgcccctctccgcttcgattctctgtttgttgatcgattttggtttgttccgtcgccttcgccgcaggtccgaggagcgaggaggagatccgccatggcgccgccgcagcccaagtcggggctcttcgtcggcatcaacaagggccacgtcgtcaccaagcgcgagctgccacctcgcccgtccgaccgcaagggggtaatttgtttcctcccttctctatccttgctcatctcgtatcgtagcaacatgggcatgtcatctgtttgattagatctatatggtacagttactgtatttgctagctaatttcgtttcgtcgtactagacatcggagcagcgactgctgtttttttgttaaattatatattatgtcggcataaaattatatggttgtctaaattaccattggacatgagtaagtgcgtggtggcttgtgcttgcttaatcaccttcctggcaatttgattataatggactaagaatggtgtgtttaatttattaatttatttgcctgaaatggtggcgtgttaatggcaagtatcagcaatgggttatcgttttctgtacatcaaaattgcatttgaatggcttagatgtgtatgcacactgatgtctttgtgcctcgtctcacctttggcaatttggagaaaacacaactccaaaattgctagtcctggaggcatatatttatttggtgagtctaacgtggaagcttaatcacctcatgattttgtttctaaaatatctcactaaatttacctctgttttgtcttgttctaaatattttaatgttttttgttttttattatccagtaatgtagattcggtttctgtgcaatgtaaacaaaaattgaatgttttttgcttgtgcagttgtgtggatctttggtttacctttctgagcaaagctataaaagcaaataaaaatgatgttctgttaaaatctattttttaacttccacagcttcaatattttgaaatgacaaatgaacgatgaagtgatgctttgtcacctcatgtcaaatagaaaattctgaattaccattagttgatcttgtgatctcttgagcctatgacgtgaaaaaaaaattcactttactgaggagaactacaatctccaccatagctgcttctcgagtctatgaccagagatttcttttgctgtcttcctgatgaatacggccatacaccatagctgcttcctatttatattctttcattaatatgttttcttgtcttattgcagaaaagtaccaagagagtgaattttgtcaggggcttgattagggaggttgtgggatttgctccatatgagaaacgaatcactgagcttctgaaggttggaaaggacaagcgtgcactgaaggtcgctaagagaaagctcggtacccacaagagagcaaagaagaagagagaggagatggcgggtgtcatcaggaagatgaggtgtgtgtctttactactgcattctgcaatttcattgttgatgttctctgttttttagttgctattttttttccgtgcgtattgtagaatgggttctactccctctggtttcataatttttgactttttgaacaatgacacggtattcaaaatatatctttgaccttgtttttctattataatatacaaaataaataaatgcatgtttacttttattatagaactttgaaagatgaatccatatatgctattctaattcttttaaactaaatacttttaaagttgatagttaaagttataaaagtttgactacactctgtccaaaacgtcaagaattatggaaccggagggagtagcactttatcggtaacattgttgtgagatttatttgtgtaagtactcccaagtatataagaggcattctgcaaatattggacttgtctctaaattaacttggtcctttttctgtagctatgtaggggtgcaagtggacaataccactatttgcataaataccttcttgctagttcatttcccacatggtagcacaaattttggaagaaaaagtgaactataagtgggataaccgggaaaaataaaataatcccgcttgtccgcccaacttgtgtccctatacttctgttctgttatttattatagctttataattcaaa

SEQ ID NO: 65384 - DNA, 4641 bp, Oryza sativa
ataaaactatagaatttattaacttatttaaggaatagaaaaaagcctccacgttcgctctatggtctgaaaattctcatattaataaaaaaaagtctatatataaatgcaattcaaaaatatatgaaatttgaaattaaaaataatgaatatagaaaaggaagactgaagtttatacgggtatacaatataactaatggaaatttggaattaaaaaaataagaaaaattaaaagtagaggttagagtccatataaaaatacaatttagaaataatgaaaatttgaaattaaaaaataataaatattggaagaagaatatagagtccatatagaaatacaatttaaaaataattgaaattcggaattactccccccatccataaaagttagacatattttacatttgagtttttccaaataagttttgtagtctttttgcattcaatacttaatgaggagcgaaaatgcctgtagcctatagtagttacaagagtctcagtagcatctgaggtcctgggttcgactctccatggaagcgaattttctacgatttaacagtgttgtgctttaagtggtagcgaggcgcctgtgatgatttcgtcaatcttaaggatttgccggcctagtcttcgaggatgctcataggggtagggtttgcgtgcgtgcgttcataggtgtgaatgagcgtgcgtttgacttcatcaatctcaaggatttgccggcttagtcttcgaagatgctcataggggtagggtttgcgtgcgtgccttcataaggctgtgtgcgcgtgcgttgtgagtgtatgcgttgtactgtgtaattataaaaaaaaagacttaaatgaggagataaattaaatgtttgattacaatccaaggagtcatctacatactcattggttgcatgcttgcattcactccttaattttgtaacattcaagatgattgaggagataaattaaatgtttgattactccctctggttttattttgattgacgctttggataatgatacgctctacaagatatatctttgaccttatttctctattataatatataaaataaataaatgcatgtttacttttattatagtgttttgaaagacaaatctatatatgtttttctagtttctttaaacttaatatttttaaagttatagatggtcaaagttataaaagtttacctcaaccttgtccaaaacgtcaattaatatagaaccagagggagtacaatccaaggagtcatctaaatactcattagttgcatgcttgcattcactcattgattttgtaacattcaagatgattcaatttttccttggtcttggcgacaaaagtaataggtgtaacttttgtggatggaaggagtataaaaaaagaaatattgaaaggtaagtttatagcctatttagacttaatagaaattaggaattaaaataatgaatattagaataagagtatatagtccatataggaatctagaattaattaaaattcaaaataaaaacaataaaattaaaagttgagtttagagtaaatatagaaatacaatttacaaataactaaaattagaaattatgaaaattattggaacaatagtctagagtccataaaaatacaatttagaagtaactgtaattcataaattaaaaataaataatatcgaatgatgagtttagagtgcatatagaaatacaattagaaataatgaaaattcacaaattaaaaaaaataagcaatattaaaagaagtgtctagagttcatataggagtataatttagaaataactgaagttttgaatttaaaataagaaatataggagtaaaacttataaataatgaaaattcataattaaaaaataaagaacattggaagtggagtatagagtttgtatagaaatataatttagaaataactaaaatttgatagccccctaaaccctatcctgaactttccataccggacaaattaaccccctagaccaaattaagattggttttgtccaacgtggcgcacgcgtggcaatccagtcatcatactccacttcccctcttcctctctctcgcacatgctgcgtgcatggcgaggacgggcggtgggcgtgggtggacagcacagaatgcggcgcgcacgacgacatgcaggcattcggagggtgtctgttgacagaaaacacgaggcctgggagatctgcttaactccagtgcaggtccaaagctcgccttcgggtgtgctagcgtgccagttgatttgatcctgtaaccaacaagaagtagaagcaaagaaatcgcggttaaatctataaatgatagccgatcggctaggtgccgatgacatatcatttatctttgagccgatgtcatatatacatcaatcggcaaccattaataaataagaagggactaaatatactcgatcggctgcatatattaccactatataatctttatatcgatatatacttaaatcaagtgattgggatagatcggtcgccatgccgagacagtataaatcacttagatcgaaatatatattaataatgaaactatatacgtttatagcatatacgttctttgcggcagacttttgccctaagcatatctctaaggaaattacgtaaaacatcctaattaatagatacaattgccttctcagaactctatccatgtgcggcaatcatcttgaagcatatcgactcaacccgatgttgtacaccaagtcgtattgccggaattggttgtatcacgtaacccagtctgattcagatttagccgattctagtcgtagctgatctggactccagccgattcttactctgttcccgcaacaatccttatctccaactccgcttcgatcccatcttcacctccgacgctgatattaccaaattcggttgttaacacatgccccccaagtccgggatatttggtaatgttccggatttgccgtgtactgacttcgagcaagtttcgcactttgctgttttccgaccgttattgccgtgcttgaaatactaaccgtcaccctcgagaaatctcacaccgtgacttctgttttcaccgctcaagcgaaactttatcctctctctctctccggcgattcctccgacgcaaaagcgactcccgggtgacttcatctccagcgagacctccgcctgcagcgatgtcgtcttccaccaatccatctgatgtgccatcggccgagtatgctgaggtaagtctccactggctagatcccctttcttagcagcagatcgattttctcctatcttatatcgctctctttctctcggttgtcttggatttgtagcatctctctaactgaatcgcgattccaagcttatcacacgaaaactactactttctcggcccagtcggcaatcctgatcccactgagtttatcattggtgaaaccaataggattcccttcagactaaccaacccagatctaggtcattggaataacacctttaaatcttggccatctctagagaaagttccacccgagaaaagttggaccacatggttcaaacgtgtgtcagcaagcaaaagggttcactgggacgaaattggaatcggccaagcacttgacctcactatagcaaactcggccaaagatgaacccctgatggcagctgcttcttacttctggtcaaacaccatcaatgccttttcgtttaatcaagggccgatgatcccaactctcatagatatcagcatgatcacgggtctggatgtcacctcatcggccaaccctatgagtttgaatacaaagaaccaatatgactcaagaccaagagcataggcggctggtcaggctatgtagcagcatatataggccagggtccagttacccctcgagaacatgtggctttcctattaatgtggttagaaaagtttctcttttgtgggtctagctgcggtcctacaaccaattggcagttcgtagccgaagccttggagacaaaaagacaatttcctttaggcaaaatcctcctcggctacttgtaccaaatgctaaataatgcatcggctaagctaattgtcggctcagtagtcggagcgggtggaccatggtggctgctgcaatcctggctaaacttggtagtcatgaggttcgtcgatcggccatctgtaacagaaactgaattcccaagattagagccgactgttaacgatgacggagaggaactcactcatcggagatgcacatcatatggagagtacgcctctaccccaactgatgcaggagcaaagctatcggccgagctgctcaaagattggttttgtagcttttatgaggggttccaaaaggatgctcgagtttggtttctctatggagactcaacacttctagaaaatccatgggacttcaaattcgaagacatcaacaatgacagatatcagaagcccagagaaatcttcttatctgcaatcaccccatgcatccttccagtcggcattcatcaagggagaaccatccaagtttcctacgagttttatcatccaatgagttctgccagacaatttggaatgggccaactcccaattggcttattctttgccgataagatccaatgccgaggagaaatctcatcatctttaatgatggatcggctgctcaatctccaaggacct

SEQ ID NO: 65385 - DNA, 2885 bp, Oryza sativa
aggacctcctctaggcagcattgacaccataaagctggcaacctttaggagcaaattatttgacagatggtggggtgaatggaagctacacttattccatcaatcggcttccaagtatatgatagatctctttccagataatgtccctcaagtaagtcctaactcacttgattttatttgaataactacttggttgattagcccttagctaactttcctcctgatttacagacaacagaatcttctccccatcaccaaagcaacagcggcagggattcgagtatgccccaggactgatccccaacggaggtgggccatctccccccgtcatcggctataatgcccccaagtcttcagctcttctccaagggcttatcagagaaccagctgatgcccgcaagaaaagaaagaccagatcatcggctataaatatttcagccccagctccaaagaagaagactaagacaaagaagaccacaccagctgatgatctatctgctctagatccatccattgaacaagctctggatgaagaaattattgaagatgacattgacgaggccgcagccgaagtaagcgatacagaacgaacaccatcggcttcacccaaacaaacccctccaactccttctgctccagtccacttttcaagagtaaatagctccctttaatcccttttataatcattgtatcttatgaccgattacttaaagatttaataattgcagaaaaagaagactgctgtgaaaaagaaattgcgctgcgacaacatctaaaccagctccaccagtaagataacctcaattttccattaattaactctcagccgattttgcctaacacttgtttctttttaagcctcctcctcctccttctccttctgtacagcaatcaacaagtgaccagactccatcagctgtaggaagtcaccatatagaagaagaaattcaaccaactgttcctactatcccagtaggttttcttttgacaaaaaacattcagatcggctatgcctatttgacccctaactctctttaaatcgtcgctgcaggtcttagccgatcttttttcttttgacatcaaagattatcttgatgaaggagaagaagacaccataagcaaagccttagcccctttatccgatgacgtgaagaaaactctggaaaatatttctcatcggctagaggcatcatcactagatagcttggtagttgattgcgcctcaattaggactcagctacatgaaattcaagctctgatcccagatgagttagtcgatatccttactccagccgtttatcttgagcaacatcaattcaaattggagaaagccaagttaagactgaccgaacggcgagaacgtaaagacattgaagctacaatccaagctaatcggcaacttgtgcatgaggaaaaaatccaaacttgatcagctttcagaaggtccgatcaaatccaacattgatcggctcgaggctcgcaagattgagctcctggcacaacttcaggaatgcaatgccgaattagatctggagcacaagaaactagccgatctcccgcggtctgtcgaagaacaaaaagcaagacttaaatcggctatcaagaatgttgctgatctgactaagtctttgaagatcattcctggaactgatgctcaaggtgcccaagctattgaggaagttgaacaaattaggcaaaaagctatttcggctatccagcaatacttgtctcaataacttttatgtaataggacttagaaatctttgtaatcggctaagatgctctagtactttactgtcttgacaatcctttgtgccgattaatatgacttcgaaatttgctcaaaaaaatttcattttgatacatatgtgccccctaattttacaatgtcaaaagcattgataaaattatagaaaccacaatcgattataccatgaaaaaacaactaagggcgatataaccatatcggccattgtacatcggcaaaccacaaccgattacaccaggaaaaaaaaacaactaagggtgatataaccatatcggccatctcaaggcgatggaaacacatcggctgtcatgcatcggcaatactagccgattatgcgttaacccaaacacttgggtaatatttcttcaaatacttgccattgagcgctcgctcatagacttcaccatcaagcccttgcaacatatacgctcctttagatacaaccttataatttgaaacggtccttcccaattcggcgaccacttgtcaaatttaccatcacgagtaccaatcggcaaaatcaacttccatacaagttctccttccgaaaaatctttaggtaccactttcttattacagtgccgagcaacacgttccttatccttggtaacctttgcaagggcacgcaatcgtgactgaaccagatcctccctctcatcggccataaggttgtaatactcatcggccgttaaatcgttttgtaattctgttcttcgagagctgattctaacctcccatggcaaaacagcctcatgtccataaacaattttgtaaggagggacttggatcgatccatgacaagccatactataagaccacaacgcttcggccaaccgagtgtgccattgccgcggataatcagaaattttccgcttaatcaatttgatcaaacttttattagatgcctcggcttgcccgttagcttgtgcataataaggtgaagaattcaacaacttgatacccatgctatcggcaaactgaacaaactcatcagacacgaagattgaaccctgatcagtagtaatagtttgaggaataccaaatcggtagattatatattcctgaacgaattgaatggcatccccagaatcaactttcttcaaaggaatcgcctcca

SEQ ID NO: 65386 - DNA, 816 bp, Oryza sativa
accagccgaagctctttcattagttcttggcacttctcattataaaccatcaatgtatcattcttgcattcatattctcctgccaattgactgattactaacagagaatcccccatgatttcaatggtatcggcttcaacttccttgagtagttgcaaccctttgagcactgcctcatactcagcttgattattagtcgcatatggtttaatagtataagcaaactcgaaacatgcccccctaggggagattatgactaagccgataccacagccatgagtacacaccgatccatcaaagaataaagtccacggtactatttcaaccgagccgattgaatcatcacgatgttccacaataaaatcggctatagattgtcccttaatcgccttcggtgactcataccgaagatcaaactcggttaaggaaaatatccacttttcaaccattcctttcaatattggagccgatagcatgtatttgactacgtcggctttacatataacagtacactcgttagatagtagataatgcctcaaccttgtacacgaaaaatacagacacaagcataacttctccataggggagtaccgagtttcagcatccaagagccgacgactaagataaaatacgactcgttcctttccttccaactcctgaatcaaaactgagccgattgacttctcaccggccgataaatataacctaaacggtattcctttctgtggaggaatcaaaacaggaggagagctaagatactccttaatatcatccaaagccttttgctgctctgcctcccaagtaaattactgatca

SEQ ID NO: 65387 - DNA, 705 bp, Oryza sativa
caaattcttccatctccttctcagctgcctctttagcaagtttccgtcgtaagagttcctccacctactaccagatgagaaatttaagtccaccagccaatacaacaacacaagttcatacagaaaattaagagataagtgcaacctgaggtaattgggcatgtgattaatacagtttttaaccaagaaaccatatgacagtagcaatgtaaagcttaatataggaaaaaatacttcccactcagacactagatactaatagaaaaatgacgagaatatgtgaagtcaagcattctttagttgaccatcaagatatttaataaaatatctagattgatcacatcaatttgatattattgtatatgctactcacaatacaatagacttagcagtaactgtggcaccttggagactacatcgattagcaaaacgacctatattttgtgaaagaaagagtgaaaggcaggtaatttagagtgtgtatcgtgagatgaaaatcatgggtatatttaggaaatatacctgagcaggtgggcgaggttggtacacagaagaatcccggctttcgaccttgacaaaatagactatgtcccttgataacaagaagtgtgcacagtagctttccagagactccttgctaccataaactatctgagaaaacaaaagattagagttacatctgaatatggaaatacaagatagaaa

SEQ ID NO: 65388 - DNA, 1037 bp, Oryza sativa
  unsure (1)..(1037): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnactctagttgagtcctgcagagccaacggagattggtcgaggtcatccttagcagcaactatcagacaaggaacttcatagccagtgttttttccccgtgtggccacttgtacaagcaattctcttgctctttgccaagaaacttcatcaccactgccatttcaacagcatcacattttgtgtgcagaaaattaggtacaactgaatagataatatagagagaggtacatctgaataaacaatatttatgtgtcgaacttctgaattactacattgttcaatcctgaatctgtgaactgtcagcaggagggctcgcatagaacaacgaatatttaaaccaattgacaggataaaggattaaagtcagtcacttcaacgagccaattgacagtatcgtgtagtcggttattctatttaagtggtgtactgctaattcatattccttgtggagatgaacatcccataccagtacccaggcagttagctgttggtttcaagtctatatttagattaccatcagcatatgttatttgccagtcctaccaaactgtggacctccagttactgctagtttgtttagatcccttgatagctaccacaagatgttgacgtgtctctaaaacaagagaaatttctgttttttattttttgggggactgaaatttctctttttgttggcagttggtttctgtttttgtcactggggttaatacaaatgcatcacaacaacaaaattgatttcatctaaagcaaaaataaagttctctcatagtatgccaggtttataaacaaatcatactgctatagctaatgggaaaggagtgctgctactgaaaactgtgtattgaggatttttgtcatgaataaaaaggaagaattcagtgaccatgaaagaaaaatgcaactgacaaaacttatggccatgaataaagagggggataattcagtgga

SEQ ID NO: 65389 - DNA, 3875 bp, Oryza sativa
ccaaagcagacctgcttgagcatataccctgtgccctacatgcagtgaggagtgagaagcccccacatatcccatgattatagctcaagctagccattgccggtaggtaggctccctgacctgagttagcgctagagctcaagatcaaactctaacagagctgaccccgtacgtatttcatctaaatcttcctgtttgcgctacgccatcccaagctcatgtggcagtatgtctaggacaatttgaggtagcttgtcgtgatgggcaatgaggaacgtaggtggtggaggcatgcaaacctgttgggagtaaggaattgcaggttgagatgcaattgcaaagatctggagctcaagctttagctttaatggtggtgtggtggtagctcgttgccgatggtagccaagaaaggatcaacctagtccattgtgaaacatattgtaagaatacctggtctcaagtgaaagcatgaggtagaccctggttcatagtgcaagttgggtaaaataaccttgcccaaagtgtaattcactctattttaaaacgaatggagtatatatgttgtttaaggataagacagtaatatcgttatttctccattttatatttgacagccttctttgtttattttacaacctttgtagattattttaaagatatattccctctatcctaaaaattattcaatccgatgtgtgtgtgtgtctatacacacatacatgctatctagatacatcttcacgattgatttttttcttttttgcaagaggagtagtccctccatccaaaataataacatcgcttttttacccatttcacacataccaatataaattaaaaaatatctttcactttatcaaatcctaatataatttcactttattaaatcctaatataattgttcctcactttatctagttcgaatgtatttttctcacttttataaactctaatgtaatgattacttaaaagatacaaattattttcaggacaaataagatggtgaaagataggttagtttttatgagggagtaagtctagacttggggaagcaactttaaatggtctacgtggttacgagtgtatatacgattccaatttaaaatagaacgtttccatgctgatgtttatgtatttaattaaattcagtgcgtgagaattttgtgagcttctcgcggatttacactgccagagagtgtggtgtcacgatgaaacgacacgcatgggtgtattagtacatatatgagtggtgcttgatgctacgtcgtgtaacgtacgtgtagtaggttgctaattgagcatgtccatgctgtcatttcgttattagtagttgtaacaagctttcttcagccataatgcacctagcacacctttgtttacagatgaagcaatcgtaactgctactgtactagtactatacgtacgattaatgcatactgtacgtgatgatgaatgacacgattgtttatgtccgattgtccatgatcacacataaaaagatcaacttgctatatataaacaccaaaagaagattgccccatgaattaaaaaaaccttaaaaacaaaagaaaagcctgaagcccctccaaaatatagtactaacatcctcatgttgatccgaaaagattcccacctgtcagtgttgttggtcttgtggctcaggtccaatgtaccaagaccttctagaaggaatctatgggggctcgctccacttgcatctgcatgcatgtgacgcagctcgcatggagtatataggagtaaactaacgagtctcaagaaaactaatcatcgccatataccgagattttgagaaaactaatgaacaaccaggtttatttggttatgggatataatcgcttcttaatttgctcaaagcctgcaatctaaccaaactgcgagaaggtctttgccacacctgggacccgtttggttgacaatcataagttgctatcaaactgtcaaactcaaattaagattatgtgctcaaaatctaattagcacaccttagcaagattaagataatcttgtcatcttttcggagtcattagtaatagtatgtactgtctaattcgctagaaggaataaaaatcatgatatttaaacttgattaatcttaggtgtgacaaaatcatgagaaattgcgtccggcaatcaaacagacccttgaccacatcagcctcttgaataaaagtatttcttcttatttattggatttattagactttatcttcttatttgttgaaattgtttagttgcttgtaataaatgatgggagaatggcaaatataccactacttaattttacctcctaacttggaatagccattaaaaaaactgcaaatttaccactagaatagcttccatttaccattgttgtttgatgtgtgcaattaagaggctaaaaataattcataaaacaaatgtgaaaaatcaagggaataataagaccgattccctatctgcctctcttcaaaccctggcagcactcatttgttccctttgcccatcccctcctctcttccttgaggaaacctagatcccaaatccccttattacctgttcttttaaatcgagagcaaattatcggatagatcggtcataataaggtacaagatggcgatggaagagttacaggatatgtattttagccggtagcaaatcgagcaggcggcggtggcggcttgggtgacggactgcggaggcacgcgcaacagcggtcgggtttgcagcggcttgggcagtagcagcagcaggcgactgcagcttgggcctaggtaggcgctgaggcggtcaattatggaggtagctacaaataaaaacgacgatggcggaggcgggtgttgcggcggtcgattatgcagtctattgcggctgagaagccgcaggcgcagcagctaactatggtgatagcagatgagcagcatggactacatcaacaacaacaacaacaacaacaacaacaacaacaacaacaacaacaacaacaacaacatgaggatggctgttaatcttgcaaagttgtggcagctgttactgtggcttttataattttcataaaaccaagatttctaatgatgtttgttcaatctgtcaatccgatggcagatagtctaggttcatactgtattttaatggcaatgcaatcacatttttcttaatggcagattcacaataacaattcaaaccaataacaaatatgcaattggcccataaaaaacgaacctagtaccgaatgtaacacatcatagtacttgtccatagtactaggatgtgtcacatccagtactattggttttttatgggatagaggaagtaagggggtgtttgggaaggagagactaaacttcagtgattgagcaaataccacccaagtaattgagcaaataacagaactcgtttcattgtaaaaaaaaaatgcggcggtatgtggtggtaaccactggcactgttccccgggcctcgctcgtggtagacgacggatgccgctcagctgggtgcacgacgtactccacggtgtaattcatgtgccgtttcagatgcgtgagtgcgtgacgccgtgaccccgctcatcctggacgcgtcctgtctgtccttcgtgcgtaataaagtgcgtgtgtccacatgccgacgtggaggaagggccccgcagccccgctgcgacgcaccacgccgtctgctgatgtgtcgctcgcgctgcctcgggccagcgtgcggccggcgtgcgggagcggcgtgtctggctcgggaccaccacgtggggccgtgggggaacttggtggccaaggcaattctgtgtccgtggccttcggtgaacccggcccatgcgccgtatagtataatccacacatgacacagcgcaccgcgccaatcacagt

SEQ ID NO: 65390 - DNA, 3784 bp, Oryza sativa
cgtcgtcggcggcggcgcagcatgacgactccgaggctttctcggatatcgtcctggggtacatcaaccgcatgctcatggccgaggacatcgacgagaagttcgagcactacccggtgaacgccgatgatctgctcgccgccgagaagccgttcctcgagatcctcgccgaccagtcgccgtactcgggcggcagctcggtcgagagtcccgacggcagcagcgccgccaactcctgtaacagcctcagtccctgcaactgtagctcgtcctccgacgggcttggcgccgtgccgcagacgccggtcctcgagttccccacggccgccttctcgcagacgccccagctgtacggggatctgatccccacggggggcatggtggaatcgggcggcgcctggccgtacgacccgacggaattctatcagctccagaccaagccggttcgtgagaacctcccgtcgcaatcttcgtcgttcgcgtcttcgaacggcagcagtgttactttctcagaaggattcgagtcgttgctgagcccggctggtgtcttgcctgatgttagcctgaatgattttgttgtgcagaaccaacaggctttgcagttccgccgcgggtttcaagaggcaagcaagtttcttcctgatgagagcaagcttgtgattgatgtggataagctctacagtggagatgaggggagtaggttccttggtgaggttagacaagagaagaagcttgtgaaggtgaagacagaaacctctgatgttgaatcagcaggtcaccgaggaaagaagcatttctatggtgatgacctggatgcggaggaagggaggtgcagcaagcattccgcgcaagggattgacactgaccaccttgtgagggatttgatggacaaggtcttgctatgcaatggtgagacatgctcaaaaggtgttaaggagttgcgtgaagctctgcagcatgatgtggcgaaacattcatgcggaggccatggcaaaaggtccacccatggcaagggtcgtggaaaagaaacaacccaagaagggggtggttgacctggagacccttctcatccattgtgctcagtctgtggccactgatgacaggcgcagtgcaactgagctcatgaaacagatcaggcagcatgctcatgccaatggtgatggtgatcagcgtttggcacactgcttcgccaacggcctcgaggcgaggctggcaggtactggtagtcaaatttacaagaactacacgataactcggcttccatgcactgatgtgctgaaagcgtaccagctttatttggcagcttgcccatttaagaagatctctcattactttgccaatcaaacaattttgaatgctgtggagaaggccaagaaagttcacattgtcgattatggcatatactatggatttcagtggccgtgtcttattcagcggctatctaacaggcctggaggcccaccaaagcttaggatcactggaattgacacacctcagcctggtttccgcccagcagaacgcacagaggagacggggagatatctaagtgattatgctcagaccttcaatgttccttttgaattccaagctattgcgtctcgatttgaggctgtccggatggaggatctccacattgaggaggatgaggttctgattgtcaactgcatgttcaaattcaagaatttgatggatgagagtgtggtggctgagagtccaaggaacatggcattgaagacaattaggaagatgaacccacatgtgttcattcatggggtggtgaatggatcttacaatgcaccattttttgtgacacgcttccgggaggccttgttccactattctgctatcttcgacatgttggagactaacattcccaaggataatgagcagaggttgctcattgagtctgctctatttagccgggaggcaatcaatgtgatctcttgtgagggactggagaggatggagaggccagagacatacaagcaatggcaggtacggaaccagagggttgggttcaagcagttgccattgaaccaggatatgatgaagcgtgcgcgggagaaggtcaggtgctaccacaaggacttcatcatcgatgaggacaacaggtggttactacaaggatggaaagggcgcattttgttcgcactgtcgacatggaagccagataatcgatcatcttcatagcttgttcagctctaattattgcatgatattgtaaatgtagacctgttcatatttttttggggggcatttggaccgattgttcctggtaggcaatatattgctaggtatgttatttgaacaaccaagtaatgggaaacttctgcttaggaattgtcttatatgatgatctggttcatctctgtccgtacataagatgaacccgcctgttcctagaatctctgcacatttgttgtgatcattattgttgcttccgacgggaacagttggttcaattttggtggagctgctagatatgttgaagttgtagaccttgggttgtcttatgtatggatgagccttgtacagtatttcttccaaacattcagtacttgtcactaagttctggttctggataatctatcatgcacgtgcattctctattcgtacttgttgaattgttcgacctgtttgttgaattggctggcatctgttctgttacattacatctggggttgggaaaggcaagtatgccaccatggcaacttgatactgcattagcgccgtgtcgcatataggcaatgtgtttatccatagaaggatagtcggcaacgtgtgaactgttgcgtttgccatatcacacgaatgatctggcgcctactagctactgctggaatggaagaaatagcccgccacgcgcatcactctctcctgaaaatcacggcgcatcttctaaaatgccaaaattagagcagccatttttttgccgtatgcgtcgtgctgatctgtctcgtcacgaatagcaggaaaaataagatcagtccaactttgcaatgaatctagacgcgcctgcattgcaaggaagaactaccgctcaaaagtgcaacagcgatggatgctgcctgcagggagagtccagccgtggtagtaacacacacacacaaaaacctgtggctacagtaaacgcaacaaagacacatccacacaacacgtccacgtataagaagcaaacatagcacagcaactcagcaagaagcatcggtcacggcagaaagttaccgcccagctcggcgataaacaattacagacaagccaggtcgtcgtcactcgtcacacacattggcggcttggcgcgaacaaatcggcaaatctgtcgtgcgcggccaagacgctaaaccaagatgataaaagccgcggacacccagccgctacggacgaggagtacacgtggccgtgctcccctccaaaaaaagaaaaatataccgttcacactaggtcaccactcaccacaagtgcaggttcagctcaatacaggttcactgaacacgactagcagcagtacatgttggcaggaagaaatgaacaatgcgatcaagcagaaagatatactactccctccgtcccataatataagtgattttaagtttttgtttataacgtttgaccactcgttttatttaatttttttttcaaaaataaaaaacgaaaagttgtgcttaaaacactgtagataataaagtaagtcacaaataaaataaataataatttaaattttttttgaataagacgagtggtcaaatgttgcaagaaaaaactcaaaatcacttatattatggga

SEQ ID NO: 65391 - DNA, 5259 bp, Oryza sativa
agcctttcaaagttaatttctactacctgtaaagactgtcgtcaggaaaaaaattcaggtttaaaaaaataggaaaaagattcagagaaatacagattaaatgtaaccatgttctgatgttctgtttcctgcgtctaaagaaacaacaattcccagagcaatgaactatgttcaaaaccaattcgcgcccgcatttggttgatattgtgttcagctgtgtatcaatgttatcgcctcatctcacctagtagtaaaaaggcaattaatccagagagggaaaaggtttagttacgatgtgcgtctcgcagtcgcaggcgtataagagatagctgagcggcgaagcacggcggccgtcatcgtcatacggcgtcttctctggagacttgattcgtgaactcgaagaactacaggagcaattttctggatttttccctccgtaatcatgtgtaacatccaaatctggatagggtgaattggtgaaatccattagatgaaaaattggtggccaagcagacattttttttggataccgttagatctaaactgcacggtccacgtcgctcactaggactggatggtgtattttcttcaaaaaccccctttagtttccgagtattatatcgctcttacatcgatcgtctctgcacctcgtccccttcctcgccagcgccgagcacaaccaacctctgacagtgtggtcattgcgcaaagtgtaagctattcacttcgcgtgaaggataaagcttacctcctccttcaaggcgaaaatgacgtgttatgttggatgccagattctccagttttgcaagcagcgccatcgcaattttggactagctaatgtgcagctttcccagcctctgttccaaaactgtgtggtagctggagtctctgctttgtcagcaaggccagatgaacacacctaacccgtctctctgcgttgtgctgctgaactgcggctatctgtacagaatcagatataatagcccatctaccttaacagtcactagttttagaactataaagcttgttatatggatttccaggttattagtactatttgatagtaccttttcttctagttggagtacttgattagtttttgtgccatgatccgtgcaccggacttgttttggttggtcttgttgctgtctcaggatctgtgagctgatccatgtacctgtctgtaatagtatttttaattgccccttttattcttatgtaaatacagcatcacctttctttaggagttaaaaccatcgtttactctttaacttatcagctgtagccaaactttaaattttacaactcaatttttgagttgatttttccatcatagtttatttgttttattgacttctctgagaatacatatataaaaactttacgaccaaatcattttttattggtaataagtgttacgcttataaataattaactgtaggtgaaatgatggaagtaatatattttctcttgattttagatagtttgaattcaagttgtgggaaacaaatccacagatttgtttaattgggaaagaaaatggatactcatgaaagaaaaatataggcaaaaaggacaacgtacaaggagtgttctggaacagtttcatgcaattaatgcccatttttttattcaaagaagcatcaaaacagtgtcattgtatagttgtacacaaataaaagaaaaaagaacaaaataatgtcacaaaagttagctaagaacgggctaacacactaaaatctccttcaggagaaagcaatcgcaaattggcgaacaaatgaaatgaggaaagaagaatcaacggcatctgtggtaaggtcccgactagcatttgggcagatcggacggcggaggaagcagcttctggttcggatggctcccatccaacactagccatgccatcctcaggccccacgtcgtgtgcgcctccaaatgacagtgcatgaaccatacacctgcacgcacataattgcacaacaaaaattattagcagggtagtactatatctaagacgaatttcacgtacactaattgcagagataactaactaactaactcacctgggttgtcagcgaggaaacggatggccacccatccgccggccggcacgccgacggtgttgcgctcgacggggtcgacgaggttgaacttggccgggtcgttcacggcgtcgtagttgccgaacccttggccgatcacgaagaagttgaagccgtgcaggtgcagcgggtggctctcgatgcccaggatgctggtgtcctgcatcaccagctccaccgacgtgttgtaccgcagcaccagcagcttggtcccggtcttcacgttggtgttgttcggcggcgtccccgtgtagttgaacggcgacagcggcgcgacggggaagtccggcgcgtacacgccgctggagagtccggtgaagtgggactgcagcagcgccctcgccgggagcacgaaggagacgttgttcatggacgccgccatctgcgtgttgttggggccctggcaggtcatgttcgccgggcacggcagcgtgcccagcccgaccgtgaagaagaatcgcttgtcaaccgactgcggcacggccgccgggtactccggcgtcgcgaggctacggagcttgtcggtgaagttggtgacgaagtcggtgtcgttgagctgcggcagcgtcggcttgaacagcggcaagcccttgacgaagctcgccgcggagggcgacatggcggggttctcgtactcgaggatgccggcgacggtcgtgttgccgaaggtcccaggcctggcggtggagtagggcgcggcggacatgtagaagttggcgccggggtagtacggcttggcggtgaggagcacgttggtggtctgccccggcgagatcaccagggtgtcgacggtgaacggcttgacgtagacggcgtcgacctcgacgacggtgagcgtgtggttggcgacggcgaagaagagctcctcgttgagcgcggcgttgatgaggcgcagcatgtacgttttcccgggtttcaccttcagcttgaacgtgtctgcatccacgcgcacgcacgcatgccaacggtaaccagagtcagcacgtttcaatattcactaatcaccagcaaattcttcgacggcgacgtgcatgaatggaaagcgcacctagctcccctagctatgtcgcaactaagattttgtttacgtgacaccagccggacccaataacagagtttgcttttccaatggaccaaaaatgttaggtcgagtaccacgctcagatcccacgacagtgacacaccgcattaattcggagcaacaaatgcacaatcccatgcatctccgttacgagaaaggaacacggaatcttctccgtccccctttggtgatttgatctgttaccaacctccggaccagtattctctcacgcgccaacaaagatgcaggagtaagctcagtactcgtgcacggtaacgtttgtctctgttttttttctagaaaacaaaaaaaaaaggttattaatttgtggttaaccgggcgaaatgcacgttccttgggcagagcagttgtagagagggccggggaggccgttgatggtgaaggcgtcggagacgttcgggcctccgccggtctggaccgcctggttgaccacctcctccgtgtccgcgttccaccactcgcctacgcgacaaacgcaacaatcaaattaaaaggtagcgagcccctgatcatgcaatgatcagtaagtatgcatatatgtcgcgacgttgcgtgcaaaccgacgcgatgcgcgacgtcgtacgacgacgtaatgcgtgcagcgtgcgtacgtacgtaccgaagatgacggggacctccttgtgcggggcggggaaggggtaggggacgccgagcttggggaggatgacgagggcgccgtagacggtggcgcggagccaggagatgtgggcgtgccaccacagggtgccgcgctgcccggccaccgtgaagttgtacacgtagctctgccccgtctggatcgggcatgcgtgatgtacgccggcccgtccgcccacccggtccgcacctgccggacgccgtgcctgcacgtacgcacgaatgcaccatcgatcggatcaaaaaactaaagcgtgaggaatcgtatcgatcggtacggtggatgagcagtgcaatgagatattgtgcgcgacgttgttggtcacacgtatgaatattcggtagccttccctcgccaccagatccggcccggggcactgtccgttcaccgtcaccatgctcttggtgttgcacagcctcgtagcgttcaccatttgcaccacatgcagatcgatcgatcgatcaatcaatcaatcaatcaattaagtttttcatcaagtcgagatcactctgcatagactatgtgtgtgcaggcatacattgaattcgtagtgcctagtgatgccatgagcttgtacgatgagaagcagtagggaagccgccaagagtagagggctaggaagagcagaggagatagccatggtcatcttaatttgtgtagcctaagctttgagccacaatctgtaatggctcttgatcagctagctctgtgagactttgagtgggagatggcctggcaaggatggaatgaatgttgggaaaaagcactcgagtcgtctacatatatataggacatgccaagtgtgtcgcaaccaccaccgccatttctttgagggttttttttttctacacgcgcggccgtaggcgaggagatacgcagcttaggcgacacctcttgtttggtgattcggtagatgaacgatcaagggaggagcttgagcttgagctagctagctagtgctctgtttttggagtgtagccaaagccagcggcaaccatgcatctgtttttcagtcttttgaccatgcatgcgtgttttgttgtatgtaccatccatgcaatggatcgatcgcctgaactgtgttgattaatttgcatgcatagtggcacgtactgtttctgatatgatgcaaaagcttgctgaaactgaaagttaaaactatgcaaactaataaaataaagaagttggtttactgcgaattggttacaatgcaagaatcgaccttttgagattcaaaacatagcactgatatcgggatgtagattttaaaggatgtactcttgttttagcgccatatcgtctagaaaatcatcaaaaacatttagagagaatgacaaaatatataaatatgtggtatattatgtattccactaacatatgtaagtttaaatatgacttgc

SEQ ID NO: 65392 - DNA, 1517 bp, Oryza sativa
tataaaattgcaaacttagtatatacttcatccgtcccacaatataagagattttgagtatatgtaacatatcctgaagtactacgaatctggacaacctaaagtcttttacattttagatggaggaagtaatatagtatataggaagtggattttgatccctcgagaggatatcctctcgttgtttgcaatgccattcaaatggttatgaaaaatttgaaaaaatttgagatgatgtattaacatgtgatatatcactccacaaacatgcaagtaaaaattcaacttctatatcttgcaacgaaattaacaaatttaactctaaatatacgttaactagctacggtttaatttgatttttttcgttacttataaaattaaatactactagtaaaacaaattgaacaaaaaccagtcattggttggtaggttccttatggtataacccattcaactaatttcaagccctagttacggctctaatgtttatcacatgacaacgctatattgttgtatctatcgtatattattaagataggaagaaaagtaaccaccacacttttactctaggtccagaaattaacgcttagtagaaggaaaagaagaaaaatatgcactatttgataatgatagatctagattataacggctaatcaatatagttggatactactactgtatttgtgaaaatataagcaatatttgcatgtcaaatccagttgtattttgaatataaaatctatagctacataaaaaattgcccgggaaattctactagttaatatatgtagaataaaaataagttatatagttcttaaccaaagaatacgaatatataatagctcatctgaaacgacatgctttattcagaagcaaaatgtgatatattatttgttattttgttagtagcatcgtggaaatccatacccattacttttgaatatgaattgcataaaagtagtgagatatagggaaaaaggcaatcaagattttccattcgagtatcatctttcttcaacatgtgtgtcagagttatggataccatatacctaatagtagttgactaaatctcggcaggacccaccacataccatgtcttctacggaaacaaccttcggatataggaggagttccgcataaggaaggatgaatagagttctacatggaaacgacaaggactactcggattgtatccatatggtttccttagttctactagcttggacaaggggacacctatgggtataaatacaagaccctctaggaggagaggggagacggaatgtagcgcccgttccatcgtggcgcctagcgggaaaactatctcttaaaaaaaaccctaattgcgaaatctgtttctttgcttgttgtctagtgtctgtgccatctcagatctcaaatccccgatctatcgtcaagttcaatcccgaatccaaatccttcccaaatcaaatccctccgcaaaagtctatttcgcctccctcaggttcgatgggccgaattcctctcggcccatc

SEQ ID NO: 65393 - DNA, 9499 bp, Oryza sativa
  unsure (1)..(9499): unsure at all n locations
caccgctgggaatcggcccctcgtgacctcgtcgccgtttcccccttttctctccgccggttgccgccgccgcaatccgccgccgacggactccctccggcgaatccaagccgttggctcgctccctctcgttctccctcatctcccggtgtacgtcccgtcgcccctcgtcgtcgcacgacgtcccggagaaaccgccgccgcccgccgtccattcgcggccggcgccttcgtcttcctccagccgcccgcgtcgcagccacgtaggcgccacgtcggagccacctcggcacgaccggatcggctgacccggccagccgctccctccgttccccccccccgtgcgcatggtccgcggtgagccatgaggctgcgcgtgggcccgccgcaccgcgtcctccgcgaaccgcgcgcatgcgtcgcggctccctccctaaaccctagcacgccccgcgtgcacctcgctcacggtgagccgagtcgccgacaagcgggtcccacccgagaccacgcgggatggacccggcccaccggctctctctctctcccctccccgcccccgcgcgcgctttgggccgccttcttgggccggccggcccattaagctcggtcgagccgcccctttctctcgggccgcgccctagccgcccgaggaaagtctaatttccctccctccttcctttcctttcttttctttttcaaaaaggatttaaataaatccttttcctttagactaaaaatccaataatcttagaaattcaatatcttcccaaccgtaagtccgtttgactccgttcaacttccaaaatttctcaaatctcgagatctatctaatggcacgcttagaggtcaataatagggctttattttcgccgtttgctgagttgtcccgtttcgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgtattgataggattgcacttaatctgcttgtcccgtctgcaaggcagattggcggacgtacctaacttgttgcatctgatccttccattgttaattgttataccatgtcccccttaaccccttagttgcgcctcggtaatcgtgcactctgtacgagtatcgacggtcgccttcaaacttaaaatctgagaaacatcctgggtaaaacttgggttttacaaaagactcggaaaaacccgacacctgggtcggtgcttgcgaactaaatgaatttccaaaattgcggaccggggaatgtaccgggtgtacagtttcccgctcttgcacttaaggaccgtttccttggaatttcatccgaacataagacaagtacgaccacatgggtggaatgggacacccctggctgagtaactagctaatcgggggagccatgatgccaagagacatgtggattcaacggggtggtgtcggggaggacccccgggtttcctggcacaatatggtatgggacctgatctggtgttggtctgggacccctctcgttggcatatggtgaacctgtgtcggctttcgaaatgccttgtcatgaaagccttaaggtctctagtcgtggccgttctgcacgggctggatgatccgggttagtaatgtcgtgtgggtaaagtgtaccccctctgcagaggttattaaactgttcgaacagccgtgcccacggtcatgggcggatgtgaggtgattcctagcgtagttttgttttactactgctttgtgaaatttgctgatgtggtttgggattgatgtttggaaaatctgcggctgatgggatcagccaggcccgggtggccgtttgaaagctgttggccgggtgccaatcttgatcaattcaaaagactgatacattgcacatactccgaccggacgagacgcactgtctcatccgtgtcgtttgagaagcactcacttagttgtttcagaaaagagtttaaataaaatcaattgcaaaaacaacagcctttccttgaagcctgcattaaacacttatttcccatggcttgctgagtactcccatactcacccttgctctacataaataatccccccagttgctgaagaagatgaaacggatcccgctgacgaggagttcttccaggagcaagccggctacgatgagttttagggtttcggcctagttcccaagtcgcgcctgtgatgtttggtcgaagtcttggcttccgcttcccttttgtaatgcagttgtgagctcgggatctgtccgcagcccaacatgactgtactcctactctataataaagagacctctgttgctgtgatattctgccttcctgtgataccagcactgtttcttgggactggtatcgactaacaggttaatttggagcgtcacgggctagttccgctcgggactagttcggggcgtgacacagaacaatagatcaagacaaaagatcaacatacaagccaacatatgccaagacaagctgccggatatcgacatcagagatatgcctggatcaaccctatccggtacctatagagaccggctgtagggatttaacgttgtctctgatctcgccgggcacgaactcgaggaggaaggctaccctgttgtcgactacgagtcagaccttcagaccgccatgtcgataacagttagataggttaccccaaatattgtactggtgcgattatggtgaatatataagagcaataccggcttcggccaacaggatgtagggttattatctgacaattcaggggcccgaacctgtataaaaatccttgtatctatcttttttaccttagtctgagatctatcctagtaccaacgatccccatactatgcaaataccggaatcgcgacatcaaacatcgacaatgtgagttatgtatccacatgtcaataagatcaaacagaggtgcagattgatgtcaaagtgtgaagagcagctagattgtcattaatttattattcccaaatttcatgacagtacaatttattctataatcaagcagtaattaacctcaatgattaactctaaacgggttatgttcaaggcttggaaccagtgtactttaattttaacagtatatggatgtgcatgtttagtgggttgagtaaagattctgccacactccaggagatatttgatgactgaaaaattcctagcatacggtggaagccgcacacacgtgtgtttggtggtttgcgttggtgactgcataggagtctcgttgtaatctcttcaaaaaaaaaatgtgagaaagaagtcgcctcctaatttttcaagtctctgtcccaaatcaaatattttttttcttggaaaaaggtgataacgataccgcccgttattttcattgatatgaaatgttttgtaacctaagcattgtgtgggtcaggttactacctaaatattttgattggctgctttttattgggtcctgcataacagttaacgagtgttattattttttcttagaaaatttaacaaggtagactttggggacttggatacactttgtaggccttttattatttaaacctttgatttgatttcactcctgtgttgctggagctgccaaaaacagacttgccacacaaccacaatatattccttatcagtaaagtgaattggcaattttattgcggtattttttttaaaaaaaagtgaaactttgattaaaaaaaacattctcaagcaaccacaatctattcctgtcatagcaagctaatcccctagtcaatactagttacaccaaaatcaccgaggtaaatgagttactccaaaacaatataacaaacattgattaatatgaaatagtacataaaaaaatcctttgccgtacatcaaatgatggtacaaattattgggatgaacgtggatttatgatccagctccctcatatgttacaaaaggtgacaaataataatgagaagcccaaaattaaaggccttgcgtctgatcaagaaacttgcccatgatcattcgtacatcagctaaccagatgacgacacaacttcggaaaggcacaccactacaagaaaagcattccatagcaccaaccgcgagcaatcaacagaagcaagctagcaaaagcagaggagtatccgagtatcctacagggaagctgatgagcaagacgcaatctctgtctctggtcggccggtgtcgatcggttagcatttggggagatcggacggcggagggaggatcttctggttgggtaggctcccgtcctgcaccacccatgccatcttcaggccccagctgacgtgcacctccaagtggcaatgcatgaaccatacccctgcacacgtccaagcaaaagtagcgaattagttgcaaatttcaactcatgtgtgcgcagccaaatctgttttctcgcttattgatcagaaatgcaatgtaagaataaaaaaaatcaataaaatgttgcaataatgcaatgattctcacctggattgtccacgaggaagcgaatggcaacccagccggccgccggcacgccgacggtgttgcgctcgacggggtcgacgaggttgtacttggccgggtcgttcacggggtcgaagttgccgaacccttggccgacgacgaagaagttgaagccgtgcaggtggaacgggtggctctcggcgccaaggacgctggtgccctgcatcaccagctcgaccgacgcgccgtacgggagcacgaccagcctcgtcccgttggacacgttggtgttgttcggcggcgtcccggtgtagttgaacggcgacagcggcatggccgggaagttggaggcgtacaccccgttggacctgccggtgtagtgcgactgcagcagcgccgtggaggggagcacgaaggagacgttgttcacggccgccgcgaaccggctcccgttgggaccctggcacgtcccgttcacggcgcaggggtgcgtgcccaggccgacggtgaagaagaaccgcgtgtccacctgctgcggcacgttcgccgggtactccgccgtggcgaagctgcggagctttgcggtgtagttggagacgaagctggtgtcgttgatctgcggcagggtgggcctgagcaccgggaggttcttgttgaacgccgcggtggagtgggagctggggtcctcgtactcgaggattcccgcgacggtggtgttgtcgaacgtgccggacatcgccgtggagtatggcgccgccagcatgtagaacgtcgcaccggggtacgacggcttggtggtgaggagcacgttggtggtctggcccggggtgatgaggagggtgtccacggtgaatggcttgacgtagaccgcgtcgacgtcgaccacggtgagcgtgtgcccggcgatggagaagaagagctcgtcattgagcgcagcgttgatgagccgcagcatgtacgtcttcccggcctccaccttcagcttgaacgtatctgcatgccacacaatgcgtatgcgtataatcaaaatgtactagctagctagcttatagctgcaagtgtacagcacagtgcaccacctttggcagagcagttgtagagcggcccagggaggccattgatggtgaacgcgtcggagacgttcgggcctccgccggtctgcgtcgcctggcttatcaccgcctccgtgtccgccttccaccactcgcctaccacccaaacaaaacaaacgcaatttaacccctgatcactgatcagtcgccatgtttgttacgcttacgtacagacccacgccacgcgacagtacgtctgtcgtcgatcattacataccgaagacgacggggacctccttgtccggcgccgggaacgggtaggggacgccggccttggggaggatgatgatggggccgtacacggtggcgcggagccaggagatgtgcgcgtgccaccacagcgtgccgcgctgcccggtgatggtgtacttgtacacgtagctgccgcccggctggatcgggcactgcgtgatgtacgccggcccgtccgcccacccgctccgcagctgccggatgccgtgcctgcatcatcgatcgatcgatcgatcgtcacaatgcgcagtgatgagctcgatcggtaaaattttgcaccggaaaactgatcgatcaaacggtgaagcgtgcgtgcgcgcgggtgtgtgcgtaccagtggatgctcatgttgtagggggagtggttgatgacccggatgacgacgaggtcgccttccctcgcgaacacagtcggccccgggaactgcccgttcaccgtcacgatgctcttgctgctgcacagccgtgtcacgttcgtcgttttcacctgcacacgtacacaccatacgcacaaacacatcgcaattaacgtaccattacactattgccacgcatgcatgcaagttggttctctcgatcatgcatgcatcgaacgtaaagaaaacaaagaagaaacagaggacagcgactcacatcgaattggtattccctaatgtcgcccttggccaggttgacggagaagagcagtagcgcggcgacggcgaggatggaggaacggagaaggtaggagatagccatggatgcctcctcgagctctcgacttacgtacactgagagctctcgtcggctaatgggctatgaatgtgtttgagatcgatgctagatgagtgtctaaggtgtctatatataatagtactagaggacaggaggatgagatcgagaaaatgattaattaatctgtacgcttctggtgattctgaacagaagtttttttttttgagtttttttcaactcggccagcttagtaagctttatttggtgcgttgttggttaatgaactgggcacgaggtcgatcttcccaactcgcaaggcacaaacactgagagcggggcccatgcatgcatatagctgtgtatagcttcggagtgtggctaaagtcaactactcttctgtttgcatgtcaccttgaccaccttttatctttttctcatgtcttaattaacacgcagaatgccgaatatacaatataataattagatcatgctgcaatgcgaatatgcacttgttaatttgtgtgttttggttatctttgtcacgttttcttgttgacttgggtgcacgaatcaatttagctcagctctactttgaaaataggggattttatagccagctgaagtgcgatttactcagaaataaagaacttgtgtggatggtaagaactttcacatttaatttctagtacttgtgtacttatgttgaaaccttttccttctnttcccccccaattaanatctaaagaaccgctgtcaaggttgtcattatttttaaggcgtgaagattggtggttcggctgagattaatttttggcggcacccgaaatgatataatacattagcgcatgtatcaagcgttaactattactccctccgtttctaaacatttcatgtcgtcgacttttttaaatatgtttgactgtttattttattaaaaaaatttaagtaattattaatttttttcctatcatttgattcattgttaaatatacttatatgtatacatatagttttacatatttcacaaaagtttttgaataagacgaacggtcaaatatgtgctaaaaaatcaacggtgtcaaacatttagaaacagagggagtataaatttaaaaatagctttatttgatttcttaaaaaaaacttttacatacaaaatttttacacaaaacacttggagaataaggaagtagccattcggaacagttaattgttacaatacatagtaatagtctgctaatatattgttctatgagtgattttccaggtgttgattaggtaccagaagttaaccatatttcttgtacaatataataatgtcttacttccttaatgaccgtaaaatttcttttgtcatgtactttagccttttttttatgatacataaaagttttgcgcatctttatattgagcattgggagaataccaattcaaaatataagagcaatattgatatggtctccgaattatcctttttaatagagggagtatggtctccctattccgtttgcttgtaatgtaaactcaagaattcctttaaccggtcgatcgggagagatcatcgaggttagttcgagttttctgcacctactattagaaatgtgttaaatcaggggtagttgaattttcgctttaaaactaaaggtcagaggcggcaccaagtggatcagttgcaaatcacatacttttttcgtcaaggcccctaccatattatccttacatgccaagggatgagatcacgagagccagtgaagacaacgaccttggcctggacgagagggttgttccaagcccgttcttcgattggcaacacattcgcgtcggccagaaatggccaggcatggagtacattactaatatatgtcaatttaaaaatgggggattcttgatttgtaagctgtttatctggtaggtcgtcgcccgcggatggtttggtaacggagctgtgcttcgaacagttctcttctttttgcccccccaagtctccaaaggaagagaaggatgcctgacccaaccttacctgttgctatccatggacacagcacacaatgacacaacgcatgctttgcaaggcagacttgatacgtaaggcaagtgggggttgctcaagctcaaaccttctgcaggtatgattcgagtttcggccttgatggcagtttctcattttaagttggggaagtacttcctttgtcttgttctagttttgcagactatttcgttgcagttccccaaagaacgaaaatgcaagataactttctggtacatttcaggaaaaaaaaaaagggacaggagaactagattgcaagatgttatcaaaacgttaacaagtactacaggtaaactctcagggagagggcgagaggctcaggctttccaagctatgagcacgggagactactactcatcatacgctagtgatgggttacaggaacagagaacaaatcgtcaagcagatttcagaaaaaccacgaacacctttatacaacttctcatgccctagtgctaggttacagccttacaggaacagagatcaaatcgtcaagtaaatttctgaaaattcatgaactgaaccactagttatcggcagattcaacagattgaacgcctgcgcgaagtggaaatcgcaatctagcaaaatagccataacttggcatatgaacacctttatacagcttctcatgcctcagaaatattaataatctgttcagcaaacatgcgatatacacctacaattctgtccaagttatgatgccacagcctctccaagggatgatgctccatctgcatttgacaattcagcattcctattgctgtcttcatcttgaaaaccttgtttgaatcgatcataattagttggctcgagtgtcttgaatgggcgttcccctagaacctggacaagatcatcctggtggagaacctctttctcaagcagcag

SEQ ID NO: 65394 - DNA, 21041 bp, Oryza sativa
aagctgctctttagtcatcaaaagattgtcatttggcacatactgagcaaaacctaaagcagctgttccacgaggaacaattgtgaccttcagtagtggctcggcatgctccaaaaaccatccagcaacagcatgaccagattcatggtaagcaacagttcgccgctccaacttgctaatcacctgtggtggacagattgataagtacataaccgctacacatgaatgtccaattgttcatgccccatataatactttacatccaatgcaacagcacttaattatgcaatgatttctgctgtaacaagtaacaaagagaacactgaaatcacttttaaaattgtacaaaccaacctaggctctcaaagcaaatgtgaaggtttcaaagtgcgcctcagtcacatcaagaataaaatatagcaattatttgcaatttaagaaaaaacagttataagcagttctcatatagaattgacaacattgaccaagccgatattgtttaacatatatataataaaatttgctacctcctgaattgataaaacaaaaagtatggcagcccaacaacaaagtatttgcaacaattttgtttatttatgtactcgtagcctagcagcattgtggatactggatagtttggcagccaggttgcaaaattcttatgtaaaatttgataaatcaactagtagaggcaaatgaaaattggcaccgtaaaaaataccttgtttttcttttccaagcctccgataaccctatcaattgcagattcaaaatgttgcattgtaatgagtgtgccctcacttcttgcagcaattaaagctgcctcattacaaacattggcaatgtcagctccagcaaatccaggtgtcaaagcagctaatctttgtgaataaaatgatggttccttgtccagtttcagctttttaaggtagatgcgaaatatttgatcacgaccctttatgtctggtttatcaatacttatctgacgatcaaatcttcctggtcttagcaaagccttatccaggatgtcaggcctattggtaccagcaagaacaacaacaccagatgtagttccaaacccatccatctctacaagtaactggttcaatgtgctttcacgctcatcatgtccaccagaaaaacctccacggcctctagcacggccgattgcatcaatttcatcaatgaatacaatactaggtgaacactgccgagcttcttgaaataagttccgcaccctggatggtccaacaccaacaaacatttccatgaagtctgaaccagaaatagacaagaagggcacaccagactctcctgcagtagctttagcaaggagagtctttcctgtgcctgggggaccaacaagaagagcaccctttggtatttttgctcccagttcttcatatttcttgggatttttcaggaaatgaacaaattccataatttcttgtttggcttcatcacagccagctacatccttaaagaacacctgtagcacacaagaaacaaggttacttcagtagaattatatgaatatgttattgtatgttctttgtcaatggtgaataaagctacagaacaaacatttacaaaaaaggatatgaatttcatgttttgttcaaaatagcaagagatggaaatagcaaataaaaactaaccttatttttggagtttttatccaattttgtcacttgaacttttccaatactgaaaatgctacggcctcctttcccaggaccacccccaacagtaaatccattttgtatccttttcccaagcaaatatattaatccaataattagaacggttgggacatacttcattacttcctcaaaccattttgcttcagtagtgtaagtgattgggacataatagtgtggatctatctccaatgctttctgggcctcttgtaacttctcttcaaaggagtcaacacttccaatattgaagtaatacttgtagctgctaggagactctatcccaggaagatgacttgtagttatatggatatcactatcctgaattcgatcaattgaaggtgaactcctgacgtaaaccttagcaattgacttgtttgaaacaacaatgtggtcaactaaaccaggttccaacaacttattcttgaattcttggaagcttatctgaaaagaattacaattaagtgggtatcacaagttataatggactaggaaatgaatgtatgtgtcgcacagaaaaagaaactggtagggaactgaagtgtggatatatgatatagttatacaggattagatgattaataggatgtagaataccaaccatattgcatttcataccaacatggcactaacaacatacgaagctcatgctaaaatgccctatatcaaactcttaggataggatatgatatgccatcagtaatgaagtactgtagctagggtcacatgctgcaccaaataatcacattaatgctctcgagcaaaagcataccatctccatcagtacaactatgtgatttaaatcttttcagtcaaccataacttcagtcatactccctctgtttacatttgcttgtcaccattaaccggtgctgttacaactttgaccacaacttttttaaaaatatatatatatatcatgttttgatgaatgaaaacagtatgatcatatttagcatgtaatataatttcataatatagtactccctctgtctctaaatttaaggaattctggctataaatatatggatctggacatgcacgtgtccagattcatagctagaatcccttacatctagggatggagggagtatacttttaaatatttacaagtttcttgataaaatatgagaagtcaaacttaggatatgaatagtatagtgaaaattatttaggaatggaggggggcagctaattaattatcatcaattgtgttatgtacaaataaaacataaactaaggactacatgtgaaagcataatttttttttccttaccactttgctaggccagcgaaaccaccaaatatttttttcaagataaaaaaagtaaccttatatataacctcatatcacctctctaattggactgcagcaaaatgaacactgacaaaatttatataccacacagaattggaatgattcttttctgaaatttataaggctgaccaaaggcgaggaccttcagtaaagtaaatggggattttgataacagctatcttctatccacaagtgtgaacaggtaaaatgacaatgaaacacacaagccactactgttgctcatgtttaacagtcggtttttcagtaggaacagacctcctgctctgatgaagatgctgatgcagataacaataataggccaaaaaggaataaaggagcaatcatgtccttgaattgtttaatgctctcctcgaaattccattgatcacctgaactggattgctctgcacaccagaaatgaccacattaagtatgtggtttgcagtataatgctatatacggatgcatcaaactttacaaattgtacgcaaccaacttgctttgggctaaaggctcatgttgtcgtattccacaatactcatgctagtacctctcccttaaaggtgagcgggcagtttatgaggcactaaaactcaaatattagcattttcagctatacatgatacttacatactgttaggggtatttgtgcaataaaataaaacatcaactagccccactctgtttaacatgtattgccacttacaaaagctctgcatatcatcttcttaacattgttttctattatcagtatactaaaactagaaatcacaagttatgatatagcatgattttagggcagcactcggaaggttaagtcgccactggtatgtaaaagtctactctctttcaaaatattttgcaaagctcaacaccttaataaaccatatccaacacaagagcgaggaatgcaggttaaaataagcacttactctttgagtcggacttgtcactctcatcccctttacctttattctcctcctccgaatgcttcccgtggtctgaataaaaaaggcaacgttaaatattaacagagtcaccagatatccccaaaaaccacctaaccagccagaaagcttacttttcttcgacttgtcggagaatagccgccggaactgccggctagcaagcaggaacctccagtccccacccttccctgccccggaggccaccgctgcccgattcccgataactgacgtcacatagctgcgcagaaaacccaactcgccgcagggcagcggcggcgacgaagcacggagcccgccatgccccccgagcagagaaccctacggcaacgacatccgcacacgccgcccgagccattagggcgaggacgcgcaggaagaagccacaccaatcggagaggggaaggggagggggtgcggctcgggcactcacctggcgctgccgggaggagcgcgcggaccgggcgagggcgcgggagagggaggagaggctcatggcggcggcggcggcgagcgcattggacggagatcgaggcgggggcgggccgtattagggttttgatcccgcccgcgctccgcgtgcgtgatcgatcgaaactagccggtaaagtgtactgtgcccccgttttctcgcggagagagcgacgaaccgacgagacgaggtcacgagggacgcggttgatggtggcggcggagagggctcaagggaaatttgttggtgtcgatgaaagggcaggtggacacgcggcaagggattgccaccaatctggagacagttcggagcttccgctgccagtatgggtccatgggccaccctgttggataggccacgatattggaccgctaccaaactggtccatcacgatatataaatgaggaataggttcattttaggtaccttaacttaacagtgagtttgattttcgtcctttcaaaccacaatatttttctacaaatttcatcgaatttttaaaaaattgactataaaaagaatcaaatgatttataatatgaaacagagggagtagtagctagcaacaaccaaattagtttgattggtaatgaaaaatatcaaaccaaatatgcgtttgataccagcaatgtacacatttagcctccaaattaagtggcaaactagtatatttctaatattcatcaggtattagcaattaagttcgttagttgtgcaacctgtttatagctagctcggtggtctttccagcgtcgggcgaaccccacaagttgtattcttttttcgtagctacgttcagatcctttgacctgtccactacttatacgtatccatcagtaactaattacaccttgcaagtagatatccagtactgtactatcgagtcatcttcccaagtcaactccccactcacttcagctacagaaacagtgtttcctgggaccacggccagtccaggcacgaccatatggtcggcggcgagtcagaggacagcgccgtagcggcgtcagcgcgcgccacggacgacgaggccgaggtcgagccgccgccgccgccatcgtcgcacgagcgatccgtcgcgacacgacgcggcgcggcgtgctccgcgtcgccacgtcgtcgtaactcggcgacgtcacacgacgtcccatcgtcttgtggccactctggccgtagccggccggcgccgtcgccgtcgtcctcggacgtcgtcggcgagaaggccgccctgacatagttcttcctcttccttgccgccgccgcgggcgacgacggcggcgggccagcgccggaggcggcggagaagcccactaccgacgtcggcggcggtggctgggcgatgtgcggcgggaagagcggctgcgggccgtgatggtgcgacccctcgtacgtgacgatgagcatctccgggtcatcggtggacttctcgacgtgcttcttggcgctgcatcgggagctggtgcacttgtagtaactcctgcattttcaccggagatgatgttaccattgccgtgatcctgcaaatttcggcttctctgaaaaagactgctcatctgaaaacatcgctgttgtgttcattagccgccgttttaatgcgatgcagatggatgttaattcttgcagttcggcgttcgtgtaattaattacgttttcggtgatgacgtgcacttggagattattcaacagcacagtgattcagactatatatggcatgtgcatgtatatgaaagcatgcgtgtcttcgcaccatcctgtatttctctgaacatgatctggaattaatgtctccggccgcttgcttccgctggtgtgccactacgccagtgaacaacctacctgcggcgcgcgctttcaaccccgcgtgcacagtgacactgattgactctagaactccacgtggtgctactagttgggccctgtttatttctcacccaaaaattttatatcgtatcgcatcgaacattttaacacctacgtaaaatattaaatatacataaaaaaaataactaattacacatattgcgactaatttacgagacgaatcttttgagactaattgctctatgatttgacaatgtgatgttacaagaaacatttgctaataacagattaattaggcaacaaatttgtctcgcgatttactgacggattctgaaattagttttttattagtgtccaaacaccccatccaacccatatataatacccgatgtaatacgctaaaactttacacccatggatttaaacacccccttactgatataatatatatatagctttaatttctctggaatctgaacacacgatctatcaatctatcatggttgttgtgaattaaaggctcctcacttctcaactgaaatgctagatcattcacatccacagagacagggcaatcaggaccgtgtccccccactcccccttaagacaataaggatatttaactctattttttaatatatgacatagttaacttttaataaatatttaatcaatagttttatttaaaaattttgtacaaatataaaaaaaatcattcttaaaaagtatttaacgataaatcaagtcacaataaaataaataataattgtataaacttttttgaatacgataaatagtcaaacgtatctaaaaagttaacgacatcatatattagaaaacgtagatagtaatttctttcgttagaaaaggtaagaaaattgaatggtcgaagcgaatgaactgctaagaccacaacatgctactcatcacatttgtgttagttacatgcaggatctcgtagtgtgcagtaggtacctaattaaagagtctcctaaacaaactccatcagttttaaaatacagaaactttcaacgtttgaatctggtttcaaaatataagaatatctagcacactattctagggagtacatactacttgtcctataaattattatttcccgttcaaatttcttcacatctctcactcccacctacccatacaccctacctatccatcatttatttattgtgggatttctatcttttcttgtctaccttaatatctgtccaataacctagaaatatttatatttacaaataaaggtagtagtaattattgagtactccctctgttttcgaataacatactgtagaaattttcaccaaaacacgtagatcatggtaacaaaatttataaccaaattgtcattggtagttatttggagatgattttaaagaatggataaagtggaggtggagggcaagaaatggatccaaaatagaagcacctagaagtttgctctatggtgaagattgatttatgttcacaagtatagctacggagagtagggtcaaaattaaaattctgctaataaaagtgtggtggtgataaaaatattttgaaacaaacgaattggaggaaaatgtcgttatttaaaaatggataaagtataaataaaaatagtatatcatccttttgttttgagaatgtttatatgctatttgacggaaaaacaccttacaaatcatgcaaatcctaaaccattggatcatattaagaatcgtgcaccatatttctaaccctaacccctcatttcttctattgtcattcccagcgcaaccgctgccactcgcaagcttgcatgcatgcgatgcctctgcctcagccccatgtgccgcagcccggccttgccggttggccgaatgaagtcaactgtgccggcaactcccccttcatcccgggccttctccccctcccacctctcttcccaagtcggcggcgcaagtgtccctgtctcgttgtcttccccgtcttcggcagctcctcgccgttggatccgtcaccactaatcatcgtctcctaaccataagctctggtttgcccccgtcatcaaggccaacccatcatcctcctccatctccgtggcttcgatgtggccgccgatgcctcacctccaactcgtgtctacctcccactgtcgggccgttgcctccgacatctctttaagcatggcgatgtccctcttctttgccctcccctaccaacctccaaccctaccacaatcaaaaactctaaaccctaacttcactaccttcatagaggttgctagagttggtaaagaaggtatcgtcggagctagaggagaaaaactccggtcttctgagcacgaatcacgaattaaatttcaaaatgggtaatatacgtgattataaaaagaatatcgccagccatttaaccatctttttttaatgtaagagtgttgcacggctaagcgttgacttccccgtctagggaattcgtcaatcccttgttctgcaccgtatgacactaatcgatctgtactgtacgattggcacacgtgtatacgtatacccgcgagtccttccaagtcccactcgcggaaacacgacacgtacacacgcgcgccgccgtgggcgatagcaggcggcggcgagccgcgcagctagccatattgttcatgcacggattgcacgcacaggcttgaccgcgcgcgctcctggcggcgtttttctctcgatttcgccatggtacggtgcagctgcaagcggctgcccccagcgctagcgccgtatccggtgtaaatgaacgacgtcgacacgcgcatattgcgccattcttatcaggactaagaatacatcttcgttgtcgtcgtcaactcgtcacaactgtatgtacggctacagtacatctttaccacgtcgtcccgttccgctcccttaattggttaaattttctttttcacaacctaactaagaacgatttttgaacgcttttgagcatgggcgtaagtttaatcagtgcactatggtcaacttgtcactaaaaccgtgccatccatatcgcaaaatctaaaccgagagcgctctcgatttagtgttaaaagagcgacgcactcattcgtgagagaatgtccagtgctactagtacgtgagagaagatcctgtgctgccagtacagctacgtgagaaaaggtccaggtgttactagtgcacataatgcatgtctattttttttctttttatagaattttctctcaaattacttatccgatctacaatctgattacaccattacgttcgttgcaattaaatctttacaacaagatcttacatgattatattgcgatgaaaaatatttatatttataaattacttttattatatacgtaagttacttttatcacgtatataagttacttttaaatttgactaaattacttctatacattcataatgctctaagttgattatttttattattgtttttagttaattctatattttgtggactttataaatcttctctacactttacttgtgaatttactctacataatttcttatttcagctcactcacaatataataatttctactacagagagttactcctcccgttttataatgtaagtcattttagcattacccacattcatatagatgttaatgaatctagatatagttctaaattaaagttactttaattctttttgttgtaattcaattttcttaaccgaatatagcaagaatccgacaattgacgacttgacaaatctcatcgactaatctcaggacttcgaagccgatgctaactctaagccgatgactactccgggcttaccaaatttcactgttaacagtaagttacttctataatatatgtaaattacttttaagctttactgaatttacttttatatgtctaagaagtaacttagtgaaatctagaagtaatttagacatatcataaaagtaatttgttatttttcatcaaaatataatcatgtgagatcttgttgtaaagcttctctaaatcggattaaatcggattttattgttacgaacacaacggtgtaatcggattataaatcggatgagtaatttaagagaaacttctctaagaataaaaaaaatacatagatattgagtatactagtagctttttttttaaaaaaaaaaggtgtctctctttagcactatccagatatcactctcggtgtaaatgtgtccctatgtcgcaaaatctaatgcaagccagtgaaagaagggtagagctggtggaagaataattcggattgaaggagaatgataaagcgagcagagttagattggatcgatgatactgcgcgtggcgcacctgggatgtgggttgttcttgatcgacttctgcccgtacttcctccacttgtacccgtcggccggcatcttgccgccgcagctcctcaccttgctcgtgtacttgctctccgcttccaccctgcggcttaatttccaagcaaaccaacaacataatatcaatctccggtaagaactggagttagtttagctctatgcatgtgtgcacaattgtgcatgcacctacaaatacagagagctgtagcggcggccggaggggtacggcggccggggcgacgccgacgacgacagcgccttctcgatgtcgcggatcgtcgggcctgagtacaccgagcacagatccctgctcaccgccggtgccgccgcggccgccgctcgtgatcagcgctgccgcccccgttgcacggcgcggcggcggcggctgctgatgaccccgcgccgaacgagtagtagagggtggggtgttcggcggccgggacgaacaggccgtcgtcaccgaggagctcgcctatgaggtggtcgtcgagctcgcagggccagacgccgccggccacctcctccgccgacgcggtggcctgagctcgcagcacatctcccatcagatatggtcctggaaaacgccgtcgttgcttgtgaggggattggccatacataccacgggccggtgcaacgtggttagttagacacggcgacgaagtaatggaacagctcggagagtctgatatatacggatcaatgacatggacacatggagcctaaggtcaatgtcaccctgggactagatcggtgtcatgtttcaacggaaagtcaacctgtcattggctttggtgcacgacagcaagctaggataagagccgtatgataaagttactccctccatctcaatctacagggcgcctacttttaaagaaaaattaaactcgatagcttttaattaataatcatactaactatatttatacttaaataaatattatgtatattatatcactattatattttaaaatactttcatatgatgctaattttatatttgttgggatcatataataaaataaaatattggtcaaaatatgttattcaagaccatattaaaaaatataaggcttacaattagggtagagggagtactaattatataccagagttttaaaaaatctatttaacagatactaccttattacaaacatacatattataaggatatatatcaccgttcgaatgtgaggctgggcttaagcttagcgtgggcacacaaaacatgaataactaattaaggctgtgttcggcagcccctcctaccaacccatctccctcgtttttcgcgtgcacgctttttaaactgctaaacggtgtgttttttgcaaaaagtttctatacgaaagttgcttaaaaaatcaaattaatatatttttgaaaaaaatagcaaatacttaattaatcacctgctaatcgctactctgttttccgtgcgagcacttagtgctgggaaccaggggttccgaacataccctaagtattaactctattagctactactacaaatatcaaaaattgtgtaaactagatttttaagtacttctatatgaaacttattttataaaatacgaaccgtttaatgattcggaaaacgttcacacgaaaatcgatgaagtagctcattctataagccttgccaaaaggtgcataataagtaatataagtaaaagaatgtattttcaagaaaacatattcttataaatatatagagcaaatcatccatgttgataatctctaatgaagtactacctttgtgctaaaatgtaagtatttttttggcacgtatattaaaaaaatatgtgtgaatgtttttgaggaagtgtgtgattggttaagaagaaaaagtatatgaaagagaatggttgtgattggttgagaagatgagataggtggagaaataattttattttggaacaaggtattatgctacaaatagctagtacattttaagatggatgtagcggctgataagacaatccaaatcaatacacgtgatgcacaagttcgtaagtaaagtatttacctgctactgtgtacctcacgaaaaacagcgtacagtttcttttgggaaaaaaatagagcatagttgcctccccccctctctttctctctccttcagagagtacatcctttttcaaacgtcgatgaaaagaaaatttttcggtgtcacatcatatgtttgatcggatgtcggaaaatttttttggacacgaataaaaaaactaatttcataactcgcatggaaaccacgagacgaatcttttgagcctaattaatacgtcattagcacgtctgtgttattgtagcacttatggctaatcatggactaattaggctcaaaagattcgtctcgagattttcgtgccaactgtgcaattagtttttttatctatatttaatgttccatttgagtgtccaaagattcgatatgatgtttttgggaaaaaaattttggaaactaaaccaggctatctctcaccaaacaaccaaccttgcagaaagtgagacgacgatcgagcgaacagaatatgaattccctttccactcatcgctttctcaggggcggatccaatgtgggtgtagagcggactcaaatcccccctacacctatcggacccatggatacccccctgagtccccccttcaattttttcgtcctgattgataagataggaggtgctaaatgtattttaatagtattttagcatagtttaatactgagattatatgtttatattgatgtactcggtatgttgaggggctgtttggtttggtgccacacaatgttcatggatccgcccctgcgctttctccttataatttcttgacgacgcgttgagcttcggttgatcccgacgcctgcaacagtgccacggccgcacggcgtcgtcgtcgtcaagcgcgagtatgatcttgtccggcacagcgctacagccacgatcgaatttactttcgaatttcgaaagatctcgttgtgtatacctatggcaccaatcgatcttgctcgctgccactgccacttgctgcacgcactgaaagggagacgtagagctgttcctctgaaaatgaccgataaatccacgaaacgattcggtttcacccgtaacttgacatgatatttgggcgaagcaactgttaaactgtcatttgctcattttttttcaggcagtttggtcgagcctatactcggggcctatttagttcccaaatttttttttcaaaaacatcacattgaatctttggacacatgcatgaagcattaaatatagataaaaagaaaaactaattgcacagttatgggaaaaatcgcgagacgaatcttttaagcctaattagtccgtgattagccataagtgctacagtaatccacatgtgctaatgacggcttaattagtctcaaaagattcatctcgcggtttccaagcgagttctgaaattagttttttcattcgtgtctgaaaatcccttccgacatccggtcaaacgttcgttgtgacacctaaaaattttcttttccccaactaaacacatcctcatttactctgctacagttgaagttgaaccacattgctcccctcgccacaagggtgtcaatccaaacgtcatctcggtcaattctgggatagcagcatggtcgaggacacgaggtagtataggaaatactactccactatgcactgaaaaagtcgtcctgcaatttctcgtaaaaaaaaaagttgtcatgcaattggggtagacccagccggggcaggacatggtctctttcgctaataaaaactccgccatcggctcatccatcacacagcgatggacacataaatatatactctctcggttcctaattaaatacttcatacaattttgactagttaaaaacatactctctttatattttattgtataacgccattgactttttaaccaacgtttagtcattcgtgttattcaaaatttttgtgcaaatataaaaatatttatgttatacttaaagaacatttgatgataaatcaagtcaaaataaaataaatgataattatataaattttttgaataagataaatggtcaaacgttatttaaaaagtcaacagcgtcatacattaaaataaagagggagtattaagcgagaaactaaaaaactgttatgttcttcattaatgcgaagagaaaaaagagaagagattacaattggtaaaatagtaaaaagaaaacaaaaggaagtattaaagtagtctaggggatcagtaaaactatatttatttggggataaatttttaatctaaaacatatttatttagggctaactagagggagtatatttgaagcggaaggagtgatgttgatcgcatatgcgaatttataccagaggggctgatatctttgtatgtgtttagttccttccaaagttggaaggttaggttgaaattggtacgatgtgactgaaaagttgtgtgtgtatgataggttgatgtgatggaaaaagttggaacacagcctttggaaccatggcgttacggactcttaattcttgaacggctcggaagatccagagttgcagagacaatttgcagtctttcagctgtttatccccttcatggacaggttttaaccctgcaggcagacaacaacctcggagcagtttgtgaatgtcttcagttcttgacagtgctcacagtaatctactcctatttgctactgcccctgttccaaaaatcttgacgctttaaggtttctaagccaatttagcttcatattaaaacgatcaaatttctcttaattatcgattcaattgtcacgctttaaggtttctaagccaatttagcttcatattaaaacgatcaaatttctcttaattatcgattcaattgtcatttcattgagtacctgcactcagtatgttactacggagtagtacaaagaatcccttaatgcaattaaataataaattctcttaaagctcattgttagatgatttgatggaatagacaaatggtcccacttttcaatcaaatttactactccaatgacacttttctgggacattgacagaagcttaaaaacgacaccttttttgacggaggaagtaaacatctactctatttgtttcataaaaaactactatctccgtttcaggttataagactttctaacattgtccacattcatatagatgttaatgaatctagacacacgtatatgtctatattcattagtatatatataaatatgagcagtgctagaaagtcttataatataaaatagaggaagtaatctagtactctgtactagatgcattctagtattagatgtgagcatatatatatatatatatatatatatatagagagagagagagagaatttttatggtactatatattgatagtatatattgccattataaatgatctaatggcgtatattgatttgaccttccacttaactagcttgcagtataaaatctgaaagggtagacttgtctttctgtgtggtggtccggatccgatgccgccaagggctctcaccgcgccattagagcaggtacaatagcaggctattagccagttataaacatattttaatgagataaacgatgagagagaagagcagcaggctacagatttataaccagctagctgcaacacggactccaagacataatatatgtatgacaggtgggatcgtatattaatagtatagtaagcaactattgtatgaattggctattagattagctatagatgaattagagatagcagtgggctatactattgaactttgctcttatagcgctatcgggcggcattgcacgcacacggcgtggatgcgcgacgttccgcggcagcgtcgaagacaacttgaatggcacctgaccggctggtgtgcgggtcagcgggtgaactaaaatgtgcttgcatgcacaacaagccatagcaccaccatatgagaatgattaattttggtattgggttgtgttagtagtccaaactataaggtctatttcttatctgggctgcaaaagtgaaatgaaactggatttgtgtttgctactgtctctcacgagcgtaagttaaggggctgtttggatgcccacctcaatttaccatagttttttattaaaggtgtgtcaagatgcaaattgtgtggctcaaatttaatggccacacttgtgacaaactttggctaagaaaagggtctatgactagtaggaccaaaagaatagaaagtgtggcatgctaaagttatagaaacaaaccaaacattagctacatttggacaaactaacatacctcaagtgtggtaaaatgtggcaccaaccaaacaggcccgcactagagcagccgagcggcgacgagtcacaccgccgttgcgcgccgctgtcggggcttgtctctccaagtcgcacgccgctgtcggggctcgtctctccaagtcgttcgcgaggtagtgactcacgacatgacatcacaaacatctagggattaaacctaaataaccaattacatttttttttggcaaattcctattgtacccttgtaaatactggcagcatatactaccagtacaatgtgcggtaaaagttctcttacctcacatttgtgaggaagagaataaatcacaacacacatatagatgaggggatttgatcctacgacctccactagtcaacttcatgaaaatagtatgttattgtgagactttaaaagttacatttaaattttattatagttatatatacgttataatataacactacgatcatactatatttatatttatatttatatgaaataaatttttagaaccctgtaccaaccggtcagtggcgaaagcccgccgggggggctaacctgcagcttggctcgcgtctcctccgcctcgaagcacgtcttctcccaatcatttcaccagctgccatcaactaattggtactgctacttccatctcaaaatatagtaatttttagctatgaatttaaatatataggtgactatattaataactaaaaataattacattttaggatgaagagagtactatttagtttggtgttttaatctgtattacgggagccgcaacttgacttgcagcttcagaaatagtagatacatgtgttcaaagtgataacagcaagacccgtttcagatcctaacagaaaagtacgtacaatattcctgagaactgtatagtctgtattctagatatgcaattttctccgcacatcgacgacagcttttatgagtcgaggtcgcgctcgagcttcacgacagtcacggtgattcactatttcactacgtacaagccgcccatgctcaagatcactgttgactgttgagtacttgagtgcttaccatacgaacatagcgaattggaaaacccaaatcagtatgaacgggctataaaacgtcgggcgcgctaactggcgctctgatttgcactgattttctactctaggattggctccaaccgttttatagcccgtgcatactggttaagaccacttaagcatataaaccagcagaagaaccagggttagtcagaccggataggatgttttttttcttctgaaaaataggctgagaggacacattacacatctatctatctattctattattaaaacagctttgaaaggaggcaccacgttcgcttttgggggctaataattcccacattaatcagagaaaaaaaaagaaaatgagagtccaagtagaaatacaatctaaaaatagttattaaaacagctttgaaaggaggcaccacgttcgctgtgggggcaaaaaattcccacatcaatcggagaaaaagaaaaaaaaagaaaaggagagtccaagtagaaatacaatctaaaaatagctgaaattcggaattaaaactaagcaatattgaaagaagtttccatataacaacctaatacgagattaatcaaaatttgaaataaaaataaaataaaatccaaaattataaaaggaaaggagagtccaagtaggaatacagtttaaaaatagttgaaattcggaattaaaaataagcaatattgaaataagtttccatataagaacccaatacaagattaatcaaaattcaaaataaaaataaaataaaatccaaaattagaaaaggaaatgagagtacaagtaggaatacaatttaaaaatagctgaaattcggtattaaaaataaggaatattaaaagaagagttcatataagaacccaatacaagattaattaaaatttagaataaaaataaataaatccgaaattagcaaaagaaaataaaataagagttcaagtaggaatacaatttaaaattagttcaaattcggaattaaaaataagcaatattgaacgaagaatccatgtaagaatccaatacgagattaattaaaatttagaaaaggaggcaccacgttcgctgtgggggctagaaattcccacattaatcagagaaaaagaaaaaaaaaagaaaaggagagtccaagtagaaatacaatataaaaatagatgaaattcaaaattaaaaataagcaatattgaaagaagtttccatataagaacccaatacgagattaatcaaaattcgaaataaaaataaaataaaatccaaaattagggaaaaaaaaagagagtccaagtagaaatacaatttaaaaataggtgaaattcagaattaaaaataagtaacgttgaaaaagtttccatgtaacaacccaatacgagattaatcaaaattcgaaataaaaataaaataaaatccgaaattagaaaaggaaaggggagtccaagtaggaatacaatttaaaaatagctgaaattcagaattaaaaataagtaatattgaaagaagtttccatataagaacccaatacgagattaatcaaaattcaaaataaaaataaaataaaatctaaaattagaaaaggaaatgagagtccaagtaggaatacaatttaaaaatagatgaaattaggtattaaaaataaggaatattaaaagaagagttcatataagaacccaatacgagattaattaaaatttggaataaaaataaataaatccaaaattagcaaaagaaaataaaataagagttcaagtaggaatacaatttaaattagtttaaattcgaaattaaaaataagcaatattgaacgaagaatccacgtaagaacccaatacgagattaattaaaatttagaataaaaataaaaataatatctaaaattggaaaaactaaaagagagttcaattaggaatataattttgaaacaactgaaatttaaaataaaaaataaaaacattaaaagaacatattggtattaactatttttttaaaaaaaatactgaaattagaaaaagaaaaataagatttcaattaggaatacaatttataaataactaaaatttttgataaaaataaatattattgaaagaaaagaccatctaaaacatatgacgagataaattaagtaagaggcctataaaggagtggagtggtggcggttgatacgacatataaaaattgttaataaaacatcaaatagaatcctaatgacgattaaaaaggagagacgtcaggcaggccgtgaagcaaacgagtaaggcggttgccgagacttcttagacagtaaaaaaacaaaccgcattgataattgtattcgatttttaaaatctcaatgacaataaaaaggagaagcagcgggcggggtgtataagagtatagtttcagagccaccgacggttgacgggacttctagaaaataaaaaataaattccaacgatagttatgttcgatttttagaatcacaataacaataaagaagtaggcggcgaacatgctgtagaggggcatagtggcatcgtttgataggactcctaaaaattataaaaaatgaaactataagtccaacttttaaaggttcagaacttttaaaaagtaaaaaaaaaacaatgataatcatgttcgattttaaaatctcaatgacaataaagaaggtaggcagcgggcgagccgtagaggagtacaatggcaaagctactgacggtttggcaggacttctagaaagtaaaaatgaacccaaacgataattatgttcgatttttaaaatctcaataacaataaagagaagagacagtggacggcccgtagaggagtataatggcaacgtttgacgggacatctagaaattataaaaataaaacacaacgtgacaataaactctaaaaactataaaatccaatttttaaaggttccaagaagaatgaataaaaatagtggtagatcgagcaagcaaataaagaagatgacataaggggtagcaactggtgtgaattttaaaaactatataattagaaacatgaggatgataaggtttggtctctcaaagtcttaagacaatgagatagctatttaataaat

SEQ ID NO: 65395 - DNA, 722 bp, Oryza sativa
aatttgcaaactaaatcccttctcttgttgtgcaggtctgctggtactactgacaagaagaaatagaagtttcaagttgaagatctttttgcaatccttattgtaattcatttatatggacctatagtaagctctagatcgaggtgctgtattgccgttgagaacattgcaatgctattgaggagcattgaaattttggcacatgtttcgatacatcggttttgtcacaatttctcagggttctattgcccttgattctgtggagttttgtccttgaaactgttcttgcctattgtgtcctgacgtgatcgtaacggtctattgggctgtaagattgggagctatttggtttccaatggcgaaatggcccaacgattaaccaaaaatttgtggatgctaatcctctgaaacacaggattatccaaaatgagattaggaaaatgtaagaaatatggtgtcatgtgcattagatttggattatccaaaatgggattgggaaaatgcaagaatatggtgtcaatgtgtcatgtgcattggtttacgttggaaccctggaagattttaaaacagacgttcgcgaggtgtggtctcatgcttttttttttctttaagggtcttgaagggaatataatcggacgacgatactttttgtagaaaatactaagacaaatttctatatggccattcagaacacatgaactggcttccataaatcctacaga

SEQ ID NO: 65396 - DNA, 1510 bp, Oryza sativa
  unsure (1)..(1510): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtcctgaacatcactgcaaggatcgaaagtgtgcatggatcagtgcagaacatggagtggagaattggcatttaagaattgaaatgcaaacacaaactgtagtaaaaatagaatctaataaacgcgcgcattatgatcaaatggatggtcatgctaagaacaacagatcaaacatgccaatgtcaacaacgatactcgaagctggattggatgacacgtgcaccgaccactcatgggacacattttcatgtcccaacattatgagatggaagggcagcatttcttggatgggaaaggaagcagctaaaggatgatgtggaaggttgtgtctggccgttttggccctagctaggaggatggtcatttccttctaccctcggtcatgcacagcatgacagcagcacagtgcacagaagattaatggagctacaaaagggtagcagcagaagctacataggcaggcaggcaacgttaaatcgtgtgaccatgaataggcagtctctctgttccactggcactgtatataggggggcagaggagaaaagacaggtgatacgaaacaatggaagaaatggaagaaaaaacggacggatttacagtaggagacatgaacaaggcatgcacatcgtgacagaatagtgatagctagctaagcaagcgtaatgcgattgcatgcaacgcaacgcgtgcatgcagaggataagtacaaatagacaactagcggcagtactactaccgtgttatacatcatgccgttgtgcaacaaagcggtcaaggtcaactgtgaagaatggatgttctacgccaagtatacttgtcatgccagccatgcatgtacaaaacgatttcgtatagatttattggcccatgcatgaaaaatgcaagaactgaaacgacagcacgagaactttgacctccatacgcatgaataccacgaaaaatgaatggatgccaggtgcatgacacccatgtgtaaagctaattaagcaagacatgccaaagagaagatttaatacgtgacatttaaagcacgagaaaaggtttggcttaccaccaccggcgttgcatgcggccgtcgtcgtcgtcgccggcggcggcggcggcggtggcatcgccgtcggcgccatggcgagagggaagggccgcgcgagtggcctgtggagcacgggcagcggcggcgggcggcggaacagcttgctgaagtagtcgaagctctgctgcttctgcttctgccgctgccgggccttgtggttctggaaccagtagaacacgt

SEQ ID NO: 65397 - DNA, 9546 bp, Oryza sativa
acatcgcattgcatgctttgactactacgcgatcagatcagagtgccttcaggataaacggatcaagcattttttttgttgggaaatgctcgtatcgtggttttgcgcccaaacttcagtctattgtcacagaaaatgttcgccgcggttctaaagacatcaatgcaggagattcatatcgatctcgcgcattccgttctgtgaaagcttaattcagtatacatcggtgtaaagcaattggttgcaggcttgcagcatgctgcatgcagctgaaatttttcgagttactggttgccgcatgcgtgcccgaacaaggatctctgaaatgataaatcaggtttattttgcaataacaaaagatcaaaccagcaagatacttcctccatctaaatataagtgcaactttagtacagatatgatataaggtgtatttaattctttgggtgtaaagtttttgaagtatacggacgcacatttgaaatattaaacgtagactaataacaaaacaaattacagagtccgcctataaactgcgagacgaatttattaagcctaattaatccgtcattagcaaatgtttactgtagcatcacattgtcaaatcatgacataattaggctcaaaagattcgtctcgcaatttacatataaactgtgcaattgttttttccccacatttaatgttccatacatgtatcaaacatttgatgtgacctttttgaccaaatttttttgagatctaaacaaggccatactccaatctaggaatacaaatctgaaaagtaaggcccgtttagttcgcgaaatgaaaatttttgggtgtcacatcgaacgtttgaccagatgtcggaaggggttttcggacacgaatgaaaaaactaatttcataactcgcatagaaaccgcgagacgaatcttttgagcataattaatccgtcattagcacatgtgggttactgtagcacttatggttaatcatagactaattaggctcaaaagattcgtctcgcaatttctcccctaactatgcaattagtttttatttttatctatatttaatgtttcatgcatgtattcaaagattcgatgttatgtttttgaaaaaaactttctggaaactaaacagggtctaagaagtatgctgtgtgcatgcaaacggaaagttttaaagacaactttactgcttgtctacatgttgtgtgcatggtaatcagctatcacgagctcacaaacaatgaagaggagagagaggccgggacctgaatgatcaatattgggacagagggacgccggccatggcttttactccctcaactggagacggcagctaggctgccataggtagggattgaaatggcgaggcacattgggaaatggagatagaggctgaggctgataccaaagcaggctagtgtagggcgatagatgagacgacgaacactgtatgcatgcatgcatgcgttgtgtttgggacatgcatgcaacgcacggcaatgggagagggcagaccggacggttcaggagtcggattttgagattatcgcttcccgtttccccgtaacgtgatgtgagagaagccgagacgctgcacgcctgcgtcgcattactcctcacgagctaagctagagactagagaggcagggacgaagggagaggcagacgagagggggaggaggagagaacggatcggagacgctgcaaattggcgcttgctggtgctgcgcgcattgggaaatgccatgcgtagctagaggctaaccacgcgcgactcgcctcacccaatcgggctccggtgagcagtggcagcgtgagcgtcgtcgtcgtcgggtgtccctgactagataggacatggattgactttgatcggcgacaaatcttcaagagagatccgaatacccggaaaaccgttcgccctgatccgacttaaaaacttcgacggccggccggttgggcaaatcaaaacaccggagcaggttaaccgcgagcgagccaacgctagcgcgaaaccacaaagatccaaagcccgtgctggttagttgccgtggtgcagtgcaggcgcaggtagacgccggtggaaggcgacgcgagacatccgcgtcaaagaaatcctagaattccgggcacgtagcgcaacggtgcgtgtgccatgatcaggagattgtcaaaaaaaaaaaaaaagacaacacttgagagctgttgagcagctgctggaacagacattctgaacggataaaaataataacgggcacgagaagcatgagtacaacgaagttttctgggcccaacatatattttttccttggttgattagcaccgtgaaatagtgcatagaggatcgatcagaaaaaaacaggccagtgcaaatgtgtgcatgttgttggtatgcatgctcaacagggatgcaagtgggtaatccactacccgtataaaaactcgcttgttagtatatttttcgtatgatagtttaaaatttagaagaaaaaattaactaaaagtgagataagcgggaaaaaaagcgcgcttgcccgccccacttgcatccctaatgctcaaggattctagaggtgaaaattagggatgacaattgtgcccgtttgcccgtttatccatgggtaaaaaccctattagggttgggtttgttctccattttatacccatgggtatcttattgggtcaaaagctatgcccgatgggtaaattggcatgggaatgggtaatcactacccatgcccgctttgcccatttacccgcaaaatctaacttacatgtaggctaggagcaaaatccactagaatacataagccacgtttttattttctacggtttcccttttatttcccttattatttctctccctttactctatcgccgctagaagagagacgacaccgaggcggagaatatttgatgttttaagttcaattcgaacttagaagcttgtagactttttgttccactgcttttgttgtggcgggtaaacgggcacgcccgcgggcataagacgcccgcgggcaatgggcaaccatccttacccgtcatgtagtaattgtaggatcaaggaggccgactagaggggggtgaataggcggttttaaaacttaatggcacttaaacaaaactaacctaagttgctaggcaaggtgaggtgcaaggttaactaagcaactaagttaagttttgcaaacctaagtgatatgggctcaaatatgtctctatgaatgtaaatagcacaaatgtaaatgcaacaaataaatgagacaagagacaaggaatttttcaccgaggttcggaaactcgccggtttcctaatccccgttgaggcgagcccaactccaccgctcaaccacgaagccaccgcacgcccccttcgtcaaggggtgggcaaggcgggagccggcccacggagaggactacccaagcctcgatcacttggggtagttcttccttcactccgaaggtggtgaactccaaaccactcacaaacggtgccgggcctcctccacaatctcctcggagaggtcaccgggcaacacctccacaagctgtctaggaggcggcaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaagggttcaagataatgcaatggagtgccaaaaccttacccttgttgctggggagtgggtatatatacccccaaccaccaaaactagccgttggaaccgaaatccccaactttgtgctctgccggtcagaccgccgttatgaggccggtcagaccggactactttgtaacggctagaaaactagccgttacagggcaatcattgagcccactcaacctggccggtctgaccgcagtgtaggggccggtcagaccgccgtcggctcggtctgaccagttgcggctctggcggctctgtatcgccaccaaaaaccagaccagtgcaatagactagtggggccggtcagactggccttaccacgccggtcagaccggctaacagacccggtcagaccggcctaaggcccacggtcagaccgtaggtcacttttcagctcaaccgactgttagtaaaacggtgatatctcttgactcgggtatcggaatttggcgttcttggactctatggaaagcttattcaaagggccatccaacccatgaaaaatccatccaagaaacacaacttaagtcaaggataaagggctcacactccaaaggatatccaccggacatacccacaagatgtcactcactcctattggacatgcccacttctctcttggtttaggacttgagaaaactcatcacacttggttagacaagcccacaaaatgcacctacatgcatatgaactaatatggcataagatcatccacaagctcgcttcatagacccctcttgatagtacggcgcctatctagcaaatccagtctacaccaaacaccaagaccgggaaaagactaagaaaacattcttagctacattatacctttgccttgcgccatccatcttggggtcaagcttgagccgagatcaacacttgtgaccatccggttgaaccatgtttatgccgaggtcttgtccatcctttgtcaagactttattctcattacaagcttgacttcattcttgccaacatgacgatgtccttggcttggtgaccactaacccatggtgtcattcattagcctcatcataatgggacctattccttttcacacctcaaaggagaacattagtctcaacaaatcggttgtcatccttcacttgatgaccaaccggttgcatatgaaagatatagatatgtttgttgagtattcattaacatcacaagtgtcatatactcgtatgcaagctcaagtgcaaagatccgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacatatagagaaggcatatgtagtaatgatgtagactaacataaaacatataccttcatgatctccatgttctcaatgtaaatgagactaaataagataacattcgagtaaacattagtctcacacttatatatcaataacatggaaatcatatatatgaacctatcaaaaagtaggagataagaagtggtacatatcattttatctccatgcatttcatccttgtcatgattaaggtccatcacaaaagaatgcatgtcttccacatctcattatcgggaaataacctagtagacaacttatgcaaaagagaggttaatcccataaacatcggtttatcatctatcaccaaagtaacaattacacaaattgtttaatccaagatctttcaatcttttctctctttggtgatggataataacccgatataaacaatatagagagatgagatgaaaaatgatttcaaatcaagaaagaaatcttataataaacaaaatatagaataagctccccctcaagatgtgcatacatatggatatgaaggaacgcatatgcacataatcaataaagatcaaataggaagctcacactatattttggatccacaagagagaccaagttagaatgtgtgaagtttaatacatacctctcatcatttttactttcatatccaaatgagactagtcaaagaaaggctcataaaaatgttagtctcatataattaaatttgtcattaatcaccgaaacagaattaaggcacttgaacttatagtaatgggtatacccacgggcacaaataatctcacgggcatgggtatgggtaggaactacccgtgcccgtcgcgcccgattgccatccctagtgaaaattctttattttgaaacacttgaaccggtgtaccgtccatcctctcccaccttcgtgtgacctctcgccatgtccacaatggcttcaccgacgaccctatttggcgattaaccctcaaggcctcgaatacgaaggagccatcgtggaggtgctgtatgggacaaatagggtctgtttgggagagcttattctgaaaagtagcaagtgagaatctagagaaattgagaaactcatttctggattctacaactgtagattctcataatctaaatgaaaaactgaactgtatggaggagctcgcagctagagattatagaagaaactgcagttgtcagaaactcccctaacagacccataagctatattgggaacaatgtgggcaaggaggatgtgggggttgagcttaacacgggcatgtagtgacggcgtgatccacgatgggatgaccaggggacggcggctagatctagttgtctcaaagtagattcagtccctccattctgggatccttccgtcatctcttgagttcccaacaccgttagagcaggtacaataacactattgaccttgctcttaggacagctacttcgccacgctcaagggccccgagctcgacactgttaacaacagaatttggtaatatcagcgtcggaggtgaagatgggatcgaagcggagtcggagataaggattgttgcgggaacaaagtaagaatcggctggagtccagatcggctacgactagaatcggctaaatctgaatcagactgggttaggtgatacaaccgattccggcaatacgacttggtgtacaacatcgggttgagtcgatatgcttcaagatgatttccgcacatggatagagtcctgagaaggcaattatatctattaattaggatgttttacgtaatttccttagagatatgcttagggcaaaagtctgccgtaaagacttatggtatcttagagtttgttagagataatagtcgcgtctggtatggacatatcttgtaattcttgggtataaatagaccccgagccctatgtaactttaagaacacacgttcaatacaatctcggcgcatcgccacccttttttgctttagtgttatttcgacgagttcttgctttcgggttgagctgcatcggtttcgatcttcaacaagaggtaaaacttgttatgacgacttgcgttctcgggattagtgcttccatctttatgacactctaatcttgtttatgtaattcgtcgagttatcatatatcctacataatccctggcaatattgatatctaacctacaatcggctaacgtccgtcaatagaaggcagccgattaagttaaataccgatgttgacttagattatataggatatctaccactctatgacacatctaacggcttgattgtctagatattgtccttcttttcatacttatacctacatcagttaagtttgatcttatgagtcgtgattagaatctcaatctctagcctgcttctcggttgctgattagggtagcatcggagtttcagccgatcttacctgatttaactactttttatcttatatgcttgattgacatgttaaatctgccctttacgttaagatcttcctgcatttaagtatattaggctgttgtttagtatattctacttgctttaatatcttaatataaagtggtatcggagtattagccgatacatgctagatctatctgatcggctatgctatgaacgtatatagtctcattattaatatatattttgatctaagtgatttatactgtctcggcatggcgaccgatctatcccaatcacttgatttaagtatatatcgatataaagattatatattagtaatatctgcaaccgatcgagtatatttagtcccttcttatttattaatggctgccgatcgatgcatatatgacatcggctcaaagataaatgatatgtcatcggcactagccgatcggctatcatttttagatttaaccgcgatttctttgcttctacttcttgttggttacaggatcaaatcaactggcatgctagcacacccgaaggcgagctttggacctgcactggagttaagcagatctcacaggcctcgtgttttctgtcaacacgcttttggcacgcctggtgggacaactaagaagtcagccaacaatcctccctcatggccgaaaaaccaccaccaccaccatctagcccaggctctgttaaggaaaagatgctgaagttgggattgactgacgtcaatgaaggaaacgtcgtgccgatcgatccagaaaaattcacacctgagcagaagaaagagtttgaagcaatgttgcggcaagcacgggatcagttcttgaactcattcatgcagacccgcaaggggacacttgttcagaagtcaaaataaaagttgttgctgatgatcctggaaccagttcttctaaggatggagatgggaaacaagctctagacggctccgctcagccgagtatcaaaggtgctgccgatggctctctaggaaatcaaggcaacaattctcaaggggtccatggaggacaaggtgacggggtgcatggagttcaaggtgacggtgctcaggggctgcagggaggaaatcttaatagtgacgtggcacaggactttttcaataacttccaagatcaggttgattacgctgtacatcatgctttgatcaatcagtctggggtgatagtcaataccctgtcaaacatgatgaagtcaatagccgatggttcaatagctgaacatcaggctgcaggcccgatctatttgcaaggaggtgtttttccaaattatcggtctttgattaccgacgttcagtcatctactcaggcagttccctccgttacacccacaactcagccgacggcaccggcaacaactcccctacctgctacatcagctatggcgccaggccagccaatgaatcctcagctgttaatgagagagcatccatagcatagtgggcaggttgcgaatcggccaacccaagatcaggttgctgctatgtttttgccgcctcaacatgcggttgatctaatacagtagcagccgattcagcaacagccgattcagcagacaccccaaattcagcaggttgtgcaaccaatccagcaacaggtcatgcaaccagcacaaccaatccagcaacaggtcatacaaccagttcagcaaacaccaccaaggcagcagtctctgcagccgatttagcaaacgccgttgagacagcagatcgtctagccgatccagcaccaaggtttagtgagcgcatcggccgggtttgcaacgcctggtggtcagcctgtacaacaacttttaaaccaagttgtcccagaacatttggttcaccacgtacagccggatggcatagtaatgcctcaggttgttcctgagcacttgctgtgcaatatccagccggaccctcacaattaccaagggggtaacctaaattatcaatatcaacctccttccccacaagcccaatatcggccagggggattggctcaacctcagtttgcatcgcaatatggtcagttcgag

SEQ ID NO: 65398 - DNA, 13355 bp, Oryza sativa
tagtaattcttcacacccttctaatgcaaagaatcttcattacatcaagtccaatagagaaattaatacaagaaatatttaacaattttggtaacctaactttttgttacaatgaaagtatcaagttattaaacatgaaagggcgttctatcagcttcttacttttcaggtgcggttgaaaaaagatcattgatttcagcaggttgcaaagctccatcctggatattataccaaaaggcattttcaaattatcaatgtaaaatgacagtttttattacaaaaaatgctcagtacaacaaagagttgaatacgattcaggagaataacaatcacatcagtgcatagaacttacattgtctgtgtcaaacatgttgaagatccctctcaagaaatcaatgacttgacttttcaattccaaggtttggaacaaaaaaaatgatttgactttaaattaattatcagcaaaatatataataaaccagaagtatgataaatatcaaacatgaagatgcttagtgaagctaacaccatagattcgcatcaaattgaatgactaacaaattacaagcacatttctagagcagtttaggagttcttaagagtgcggatattttaccacagtagtaatgttagtgatgaaaataccaaagggtgtatatataaactgtaaataaaaagcataacaaacgatcaattaccctaaattctcataaattcacctctaaaatctgaattcagagcaactcaatttatagaatctaaaacaattaactatcagtgttaagatcatgcacatgtacaattactctagtttatacagatagtacacaggatagctggaagcaacaaaagggcaacattacttgatcaggagctcgtttaattgctggaatgaggtcatctctaagcttgagttcattatcatagccaaacttcctcaacacggtccaagtagtttccagctttccgttcccaataataagggtatgaaggaaaagaaacccagtcaaggtaaggccattttcatttacaccttcagtcaatttctcttggatggttctcttcacgcctatgatttcattaggttggagaggagcattgaagcatatgacctgtaaagcagccaaaaggagattcttaacatcaccagaagtattaatagaatgatagtgcaagcattagtttgccttacactaatcaaagaaaccaaggcagctttagtggctacaaacctgaaaatcattgagctccacatcactaaaagctccatccctgtcatggtcacatagaataaatatacgcttcaaagccctcatacagcgtaactttagcatctgtgcctcctgatcaaatagaggagctgttgggtaaagcactgctttctgtgcataatagaagacctcataaacctgcaaacatacgcaattatagttagctagagactagcacaatgtctggacttttaatgcatctgatggttcaaataattcatgcgataattaactaattcattgtacaactgatacaaacagtccaacacctgccaaatttcatcaaccgatttgtggaaacaagtatcgggagactaggcaggtgagggaaacacgccatagcgcgcgcagcgtgctggactcgctacaacagccagtcatggatgagaaaggccatggactcaagcctaacagcatcagacagaattatcatgtactccctccattgataactacaagtcacacatgaatttggaaaattcaaaatttataactattgacttaacaaatatagtatgttactatgtttactgccatacaagatgataccattgcatttctattgcaaagtactttcacatgaatgttaattccctagatgtcaatattatattgtaaaataaattatggcccaaaacataatacgacttttatttatataaacaaagaataatagagttgcctgggtttttctgagaaagaaacccaaattcaaagagaatggtcctgtgtattcagaatatcgggtaaaactttcttggataattcataattttaaaactgctctatattattattggtaatattactctagtcggtccaacttggtgctactggttagctgataaacacagtacataataaaagtattgcccagtaaaagtacaacaagttcatgcctagaatacaataaaattatgatctagctagtgttgtagctattaacttattatgtgcagcaatgtgccaagcatccctatctcagagcaacctatcaacacaaaattatgactgcagacatattaaccaggatctggcgaagcgcagagcactcaatgcaggtctcgatctctcggaatgcaaccatgatgggtgccatcacggcatcaagagttccctgctcctcacccctcaggtccagcttacatcccacgacaatcaccggtgcctccaactgagccaagcagaacaaaacatgagccacagcggacaaaattaatccacaaaattaccaatcaattccggcagtgagtgcagagcctcacctggaggcgccggagttcggggaaccagaatgagctgagccgctccagcgtcgcaggttggtcacaggcgtaggtgagcaccaccacatccgccgactggcactcggcgatcagcttcgacctctgctctgggctgaatcagcaattcagaattgtcaacgaatcaaaatccacaaatcccccaacaaaaaaaaatacacccgcaaatctagcgtgaggggcagtggaggacctggaggaggtgtcgacgatggtgatggggatgcggtcggcgaagtagtcgacggggaggcgggtggggggcagtacgcgggggacgtcgcctcggtggcggcggacacgacgaggctggacttgccggtgccagggtcgccgatgacgacgactcgcaagctctgcttgcccgccagattcgcgggcgccgccgcgagcgccatgcgtgtgctcctctccctcttcctcggcgggttttggctacgggggtgtgggtttttgggcgcgatgagttgatatcttaatctgctttggaccggggcttcgctcttattgcagattgagatgctcccctcgtcttggaggagaagaaaaagagtagtaagtcgctcggtttattacggcttcatcatctccaaatttatactacctccttccctaaatatttgacacctccttccctaaatatttgacaccgttgattttttttaaacatgtttgatcatttgtcttattcaaaaacttttgtgaaatatgtaaaactatatgtatacataaaagtatatttaataataaatcaaatgataggaaagaaattaataattacttaaaatttttgaataagacgaacggtcaaacatatttaaaaaagtcaacggcgtcaaacattttaggatggagagagtatattcctacatatctgcaaatttttaaagtggagctgtatatagattaggatacacgaaaaagtttttttttcgcgcgtaagttctttgttccaaagagagttatagacacaaaccaagaatatacaatatttttttttccaaaagagttagacacaaagcaataatatacaagaagttgaacgtatagctatatatatatatatacaaatatagaatgtaagagttggagactctccctacgcatgtaaaatgaaacaactcattaacaaataattaaataaatacatttcataaaatttaagaataaattaatatatttcataaaatttaagagtaaattaatatatttttaaaacaagttttctatttttttaaaaaaatatcatttaacaatttaaaaaatatgcgcgtgtgaaaaacaagtgagtataacttgggaacatgccttcgccaaacgtacgtacctgtacaaatgttgtgttagaaagttctaactcctgtctcattgggatatacgagaaatacaagtgttggttgagtgaactctatgtgaggggtgtatatctaacaaaattgtattattcatctctaaacttgtttggttgtatcatctagatccctgaactcttaacatatatttcaatttcccgaacttgctaaaatgtggcacccaattctaaaacgtcacagtgccttaggatcctacatgacacttacgaagcatgtaaaaaaattcataatgacattcaagaaaataggggatattctcgagatatcaaaggagtcactaatacgatggtattgtttggtttaagttcttagcaaattttatagtacgatttgtaagtggaaggttatggtcctctttagcacaactttggatctagagcaattttacggttcttgaggaggtaccatgaggtaccactttttctattataaatttggtatctcttggtatctagttattatgaggtaccaaattttacactaaatttttagtaccttatggtacctccttaggtacagtagatttgctcttggatctaagattttacagagcaaggttgttttctaactttggatccgtgattatgttgttaatatcttaataaatcattttgttcatattttgtatgttatttaaaattttaatctactataacttgacatatatgtaactaccaaattattattgtatatttataaatgcatgatgataaaatcctatcttaattatcatcatattaaaattcgctagttttggcaacaaatcaaacagtcaaaacatagtgaccgggaagacccacagccgcaggctcgcagacatcatgtgttgcacacagagcaaaatgccttgttccccaaagccaaaacctcgaattcctcctcctccaccgccgccgccgaggtctgtcgccggccctgcgctcactccggccttacaaccccacaacactacaacgactgagatggccatcgccgcagatggcgaagcagatgccgaggctgtcgacgtccaccttgccgacgccaagaccccgccgaccatcaccagtgacgacaagaccccgtcgacgaccgtcgccggcgacaagatcaccgtcaccggcgcggagacggaggacttggttcggggagaagccatctacgacacctccgatgtggccagcgactcatccttccccgagagcccctccggcgttcgcccgccgccggcgcgcgagcgcgactcggtcgacgacgaccgctcgggcttggcgatgatccggtccggaggccccagagccaccagtctctccgacgaaggcagtgatctgattggagctcgcgtgtgctttatctccatcctgttcctcgcgtgctcgccgccgctgctgcggcgccgccactccggcgagccgctggcccacctgtggacgatcgccctcctcatgtccgcctacctcttcttcttgatctccatcctctcgcgcacaatgcgtcccaccaccgtcttcgtccacatctcctacggcgtcctgctggccatctctgctggcacattcgccggccccatcgccggattcgccgtcatgcacctcgcgacaggctggacggccggcctgctcgggtacgccttcgccgagcacctgcagcacattggcaaggagaaaacggccatgcgcatggctccccccaccttctcgaccgaggaggagaagagttccttcgagatacatcgtagtggcgttgtgaccttcttcgccgtcttctctatgcttgtggctacggccatggctctgctagtgaaggtgcctcctcgtgatctgtccctgctcgtgatcaatctctcggttctggaaggcacagccatctactgctgggcggttttcgttgcaaagtttgcgctgttcgaagccctcgtcacggtcgatcagcttggctacatgatgttctacattggcgcgtatctgttggtgagcttccttgtatgcctcatgagctatcttgttttggctggcgatgccattgtcggggctatgtttttctggttcctgatgatggccatggctggattgattggctacatgctctccgtgcgtgctcagtacaaccagatggtcctgtcaaggtaaacagcaaaactaattgcatgtgtttgcaaacaatctgtttataaaaggacgcttctcgaataaatcggatggccgcgcaagacgtcgctgggtaagactaagatcgaaaggcctctctacgaggaaggagaaactggttgcaataggaattattcgactagtaattttgttacaagagaagcaatacgagaggtgggctgggaacgatagtagtatttttttagaagtactgggaacggctgagaagaagggaaaaaacggaacggagagaggagcgggcctgcaagggaggaaacggaaaaaagggaaaaggggattaattcgggaaactattcttaccccttgaggggatgttccctcgtttgcttaaaaaccatctaaacggttataaaaaattctgaacaaatttgacaacattcatacaacacatatatacaactccacaaaatcttaagtccaaactcaactcacacgtcgagatataaaaaatacaaattcagcgtatgaatagtagcgtactgtttatatctaaatttgtcttttttatttctcgatgtgtagatcgaatttgaacatgaattttggtggactagtaggtatcattatactctacattatcaatttttttcagaatttttcacaactatttgcatcaaatttggaagaaaaagatatacaaggggatatcccctcgagggattagaatccacactcgattaatcctaacgcgcagcgaattagcgttaccgtattttttttcctttactttcctttttcctctttcctgttcctttgcacgcctttcctttttcctttttgggtaatccgaatcctctccttccgccccgctacccgctacgggcagctcctcctccattataaaacccgccaccccgctcgcggttacaaccccataagtccacaaccctagtaccctaccactgagatggccatcgccgcggatggcgaagcagacgccgaggtcgacgccaagaccccgtcgaccatcaccggtgaaaagaccccgtcgatcgtcaccggcgccaagacagaggacttcttgcggggagacgccatcgacgacaccacccatgtggcgagtgactcatcctcccccgacgacaatccctccgacattcggccgccgtcgcgcgactcggacggcgaccactcgggctcggcgacgatctccccggcgagtcgatcgggccgaggccgcagagtcaccactgtctacaatgaaggctccaatcgtattcgagctcgcataatcttgatctcagtcccgttccttttcctcgtatgctctccgccgctgctgcgccgccactccggtgacccgctgggcctcctgtggacgatcgccctcctcatgtgcacccacctcttcttcttgatctccagcctctcacgcacaatgcgtcccctcccagtcttcttccgcgtctcctacggcgtccttgtggccgtcgccgccgacacgttcgctggccccgacgccgggttcgccgtcatgcacctcgccacaggctggacggccggcttgctcgggtacgcctacgccgagcacctgcagcacattggcaaggagacgacggccaagaacatggctcccccaaccttcttgaccgaggaggaggagagctccttcaaggtgcaccgccgtagtgttgctgccttctttaccttgctctctttagccgtggcaacggccggagctcttctggtgaagatgcctcctcctgcactgtccctgctcgtcaccattctctcgattctggaagggattgccatctactgctgggcgattttcactgctaagttcttactgtttgaagccttcgtctcggttcatcagcttggctacatgttgtgctatattggcccgtatctgctgctgagctccatcctatgtgtgccgctgagctgccttgtcttggctggcgatgccatcggggctatgtttttctggtttgtaatgatggccattgctggattgcttggctacatgctctctgtgcgtgttcaatacaacaagatggtgctgccaaggtaaatcaacaaactaaatgcaggtctttgcttctagcataattaagcgatatgtttgtaaaatggttacttgagaagctgcataactatgcaaattaatcttcattaaacttttgatgagcattggcatgatctgtatgcgacggggagttgtttggcacattgtgggttgctaacaggttgtagtttgtctgatagatccgtagtgctgccacataccaattctgtttagtttgatactttaatgcgtttccaaacgattgcaggattactgattctgaggttccaaataacgtttaattgttgtgcatgtttaaaatgttgctatctgaatttgtgacatgtttattggactctcctcaggctgccggtggagcagagcagagatgaagatggcctacaacaggtctggtcttgactctgactgccagcgtctagataaatagtactgcggcagcttattgatctcaacactcaacatccaactacccctgaattggaaaaaaattctctcgtgcggagccccaatcctcagcgcgtgaggcaccatcctagatggatgccacctgtattctcaccaattttaaagcaccggaaaaaagtaaagcaatttggatttttttttcttagcgtataccctccgtattccagtagtgccctacgaacttgtatcgtattctctaccctaatcacgtcattagtgttcctcgttcctcagagccgtaatccagctattcgcccttccgttccggccatcaccgcgcgtgtagttcgccgcccttccgccgtcgccgtcgccgtggccgtcgccgtcgtcatcaccgttgctgtcaatgtagatgaatccccgtggcggcgccttcgtcggtgctgttgcctgcccatccgccggtggtgacgatcctccgaggccgcccaccacaaacaccacgatatcgatgaatgcaactgccagcacaaccttgaccacaaccatatggcatcgatattctcgacgatggcgcattcgtcgatgctcaatgaactggagattagattttgaagaagctgtgattcctaagtagacattgtacttatcatataagtagaaaacaataacattaactattgtttctaatttgtaagctattgcaacctttatttcttcctggaagcaatttgcagtgattcgatatactcaaacacgttatttctttctagtatatttttctttggagcttcgtgtcttgtaaacgggctgccatgcattgttgattggtccatggttgatcaggggcctcggaggatcgtcatcgccggtggatgagcaggatgcggcaccggtgaaggcgccgccgcggggattcatctacattgactacgacggccatggccacggccacggccacggtgacgatggaagggcggcgaactacacgcgcggcgatggccggaacggaagggcgaatagctggattacggctccgacgaacgaggaacgctaacgacgtgattagggcagagaatacgatacaagttcgtagggcaccactggaatacggagcgtatacgctaagaaaaaaaaaatccaaattgctttacttttttccggtgcttcaatattggtgagaatacaggtggcacctatctagaatggtgcctcacgcgctgaggattggggctccgccccagagaatttttttccccctgaattagtagtccactagtccttaacgaatactcctacatgcatgtgtaaagattaggggttatcctcgagcgcattatgctataatacgaatctatgaatgtgtaattcttaacccttatcgatcggcacatatttgaattgagacatctgagctactatgtagtactgtttgtggtagccatccttgatcaaagtatatggaattcatgctttagctgcattttggcccgtgactatatttgccttttagccttgggttaattggatccatatcactgtaaatgtggtaaataaaaaatataccattactattcacgttatctgctagatgtcacttgtaaaattttaaaattagaaccatgccacttccgtcactctttccatcctcccatcaatcttttcgtcttccccatcctctccccgttctcctcctctccactgccccggatgacgccgccgccgacgccgtgctcacccacctcgccgaccgcggatacggccgtgacctgcgcctcgtcgccgagctccgcatcgagcgcacagactccgcggtcgccttcttcgcgccctgcgccgcagccagcggcggcaagaaccggcagtgcctgtcccgccctcatccgccggccaccgctccaccattgctttcctcgcgtgaggggacgtcgtgttcttctggccgttgtcatgtccagtaaaaggtcggcaagcgtatgcctcgattgttctccagatctctcgaaaacacggattggaatctagaaagcttgcatattttgggtttaatatgtttccaatccacactacaagctaccactaggcaaaatcctttgttttgatacgatacgagcaaagaagggaatcaatcacttacagcttcgatgtcgattctgtagacgagcaggcggcgtcgctcgcggcagctggcgcggtaagccatggcgatgtgcgcggcggcgagcgcgagcgacatgaggaacatggcctccacggcgacgagctggcccttgccctgcagccccagcccggccctgtcgggcaccaggtggagcggtggtcatgggagagcatcccctcgccatcgccgccgccgttcgccgccggccgcgaccccatgttcgtcactgcctacgccgtgcacccggacggccgcggcagcgacttcctcgactccctcctcgagctcatggctgccggcaagatggaggagcgggtcaacgtggtgaacatgccggagagaggatgggaatgacggaaagattgacggggaggacgaaaagagtgacggagtggcatggttccaaacgatgaccacttgccaaacgtgagtctcctattctctcttcctcccatctctctcgcttgcaagttgcaactcgctcaaagagaaagatactcatactcgctcaaagagaaaaatactgatacctcctcaaaggggttgtttagaccatagccaaaatacatcttaccaaattttgacaatgataaaattacagtaagttgacaatattaccaagttttggtaggattccttatgtatttattaagttttggtaaaagaactaaatatataaatatatagacatatttaacaactttttatttaaaaaaatggtatggtttaaaataacatcaatctaaacaaccaaaataatttagagagtgtgggatatgaagaagctgttagaatgtatataaaatttgaaaagaaattattttgcttcattgccaaatgaacaaataaagagcaagatttgagatttgaagaaactcttggagatgcttagactagacgcacatttagattgctaaaaaaaaacctgtaaaggcaaagatcgacaaggacaagttttaggctgagtttgtttcttggggttgaactcatctctaacgcacgtaaaacagagagactcattaacatataattaatcaagtattaattattttttaaaaataaaaataaattaatataattttttaaatcaactttcgtataaacatttttttgcaaaacaaatcgttaagtagtttgaaatgcatgcacacaaaaaaaaagaggtggttgagttggaaagaactcagccttagtaacgttaagaatagtaaatgtgctatttacaattagagatcccactaattttggcaacaaatcgatcagtcctaattgactggagcgatacacaccagcagtcaagtcaatttctcctccatcgccgccgcggctgtcgtggtggtctttcgccggccctgctctcgcttcgacttcacaacccccacaaccctacgactggaatggccatcgccgcggcttgcgaagcagatggcgccgaggctgtggtggccggccaccttgtcgacgccaaggctccgtcgaccaccatcaccggtctctcctccggtgaaggcggtccagatcacattatacctcgcgttatcttgatctcatgcatgttcctcgtattctccccgccgctgctgctccgcaactcctgcgagccgctggccctcctgtggacgatcgccttcctcatctccgcctacctcttcttcttgatctccaccctctcgcgcacaatccgtccctccaccgtgttcctccacatctcctatggcgtccttctggccgacgcagccggaacggttgctggccccagcgtcgggttcgccgtcatgcacctcgccacaggctggacggccggcctgctcgggtacgcctacgccgatcacctgcagcgcattggcacggagacggcggccatgcgcgtggatcccccaaccttcttgaccgaggaggaggagacgtccttcaagacagatcgtggtgttagagctgccgggtttggtataatatctctgctgatggttacgcccatagctctgctattgaggccgtttgctgatcctgatcctgatctgctgcctatgttcgtggcctttctttcggttgtggagggggctgccatcttgtcctgggctgctttcgttgctaggtttgtgcttcatgatgccctcctgtccgttgaccagattggccacatcatgttgtgctatattgtcccatatctggtgattagcttctttcttcttctgctgctgactggcgttggctttgctggcgaaaccattggggctacgtttttatggtgcatgatgctgtccatagctggattgcttggctacgagctctctgtgcatgcccaatgcaatcagatgatgctctcaaggtaaacaacagatatgcgattgcttctagcataacattttgtttataaaatgatgtaagatcgaatcataataactaagccaaccaaaggggggtgaatggttgagatacccaaaaaccaaaaacttttagcggaaataaaagttaccctcgaaatcgatggatcgcggtctgaccgaggtagtcatgccggtctgaccgtctgaaagccaccggtttgaccgagattgaaactctggtctgaccgcctgatcagctgtcgcttgctgtcgccgccgccggtctgaccgccgctgagatgccggttagactgccgaaacccggagaaaca

SEQ ID NO: 65399 - DNA, 4532 bp, Oryza sativa
  unsure (1)..(4532): unsure at all n locations
tcttacaccaagccaactcccagtccatcaccgcaaatactctctcgaggcatcgagtcacttacacatgaaacaaacaaagaaaccatatttcgaaaccaagctatctccaacttgactcattagtagcaaacaacagtattacatacgtataatatccatctagaagccataaccataaaacaatcacggatatccaaagaaacaacccgaaaccgaaaccgacacagcgtcggccggtcagaccgcgggctgcgccggtctgaccgcgcaatacacgccggtctgactggcacacccaacccggtctgaccggtcccgacaaaccagtaaatcctgttcatttcctgaaaattgattatctccaaaaccacttcgacgataatctccaaatatcaaaaccgataatcacatatgccaattgttcatcacagaataagaatcaaaacacacgttgatattacaatctcccccttaatgaacaaattggcaaacccattaaaaatgttttggagtttgaaaaattaaaaacaaaaacggtaaaaaaacacactttgtacaaacgtacacatcgtgctcaaaaatccaaaagaaaacttctccccctttttaaaagaaagaaattcccaattgaaaaaacatgctcttctcaaaaactcttctcttctcataaaaactcatctcttcttcccaaaaaacttatctcttctcccccttttgacaatgatttcatcaagcataggaattatgtttttgaaagtataagagcttagcatacatatagcatatcaagtcatgtgttgcaataaaaagaagataaacccatctataacagaacaagcatgcattaaagtacaaccatgaaccaaagattttacaattaagcttgaatcaacaatcaaaattcatgatttcatacgatttataatgcaacatcttaataagcacataggttgaaaaataaacactaaacacatatacctattgcatttatcactctttctcaaataacctttagcacaaaacaaccaagagaatttttttttgaactttctcttttcttaagcctttttgctcatatttttcttttttattccgggtacgtccctgtcgtcaagactgtttccagggattcggcacccattattttgctcacatcgaatacgtccttgtcgtcaagactgtttccaagaattcggtattcatttttttcatattttttattctctttttcacaatgagcaattaaagctatttaaggaataacaattcaataaagcatataaatagagcatttataaatcaaaccagatgctagcttcaacattacatattttcttaattcaagtatagaatttaagtgtcatgcatcatctcccttaaaagcaaaaactaaatctcatgaaaagactagaatacatacaagttatgctagagacaaataaaccttcaaaatattactagcatacacaagaaaataccatatgtataaacaaagctctcttttatcaattttttcattgtcatatttttgcttgataaaaccatgaggtacaaactccccctcaaaacatgccaaaagaaagtcataaaaagcactaactccccctcaaaataacctccaattcttcccgaacaaaaatcaagaaaaaatcaaagattttgaaaaagacatccaattgccaacgatatcaccaaaattctcaagaattgacatacatccaatagtattaacaaaaactactacctcaaacattagcacatgaaaaagctaataaacaagagaatagaccaaaattatgtcnatccaaaagtaaagtgatgttaccttgcttacaatcgtcatctcaaagttaaatgcacatggggagtatgccgccaaaatacctacgaacgagaagatgtcgagacctccgtgttggggttagaaataagaaattttggaatccaacactgagtcacacgaccactagaaccagtaggtacatacacacttacaaaatcagaatcagacttaccaaaaaacttacctttttgcttcacaaaagtctgagttgaatttcgcacaaaattgccccgaggccggtctgaccgccactgtgcctgtggtctgaccgagcctatcaaccggtctgaccgccggtttacctgcggtctgaccgctggccggtctgaccgactggtcagtgtcggtctaaccgtggtcctcgaattaaaacccgatttttgccaatgtcgttttgcaaaagcaatttctctttcctttttctgtttatgggcaagtctaaaacaaaaaccaaccaaatgtccatcttttccacaaaaagaacaagtgtacttctcacaacaagtttgtgaagtagatggttttgcaacaacagaaggttttgcattcacaacatttgatttcgaagaagatgtattcaaagaagacatgatgccaacagatttaaacacagtgttcttaggctctgattcaatcaaaatttcacctctcctagcaacacccaaaacagtaggaggatgtctagaattatgagcataaggatcaaaacctaaaccatgattgtgtgtgctaaccttagattgatcaagaatcatgttgaggttctttttaccatcagaaaatctttgcaaagaacttttcaaataagaaacctcctgagtaagaatagcacaatttttgcaagcatccaaaagacctttttgttttctacaagttgagcaagaaaacacctcatcttgtttaacaatttcctccatgtgtttaacacgccctaaagcatctttcaacttcatctcattcaaaacacactttgaacaatcttcagaaatcaaaacaccattgttttgttttgccttatttgcacatgaagcattcgccaaagaacttgcacaaaaagcaactttgtattttttcaaaacattctttgtcaaaatcaactcatcaacaacacaagcatgtaaagcaaacccaagagcaaaagaagattccaattttttagatttttcaatctcaaattctaattttttgcaattaacagaattgacatctcgcaaagcattaatttcagaaaataaaacttcacaagactgacaattatcatcatcaggaatcgaagattttaatctatcaatttcagcatttaaaatctcaatagtgtgatccttctcatcaagcacaatagaacatgtttaaagtttttttagcaaatttgtaagcagcaagttctaattgatcataactatgcttttcttcattatcatcatcagattcatcaacatgagaactttcattacgagcaataaaagctagatcaacaaattgcttacatttgccctcatcttcatctttagatccataaaaaacttttatgagttcttgaattaaccactgcatgcaatgcttcttcttctccttctccttcatgttcttcttcttgttcacgtcatcctctttaactctaccatcatcttccttcttgcctctcccaagcttaggacaatacgagcgaagatgatcaagtgcaccacacacaaaacaacgattcggttctcctcttttcctgttcctaacattttccatagctcgagaaaatttgttagatagcaaaaccaagtcgtcctcctcgaactgttcgagttgatcatcggacatggcattaaataaagcaagaacaaaagacttcgatgaagaagtaccaacattcaaagaagttgaagacgaaaccaaagcactagacttagaatcacctttacgagaacgaatattcatctcatgagttttcagttttgtgtaaagcgaatccaaagtcaaagtagacatgttcacaaactcctgaataggtgtaactttcatctcccaaatagacatgtcaagaccaatcaaaaagtgacgagaaatctcagattgtggataattagcatcataagaagaatcaaaagatctaagatcactctaaattttattaaacctagaaagatagtcatccaaagcttctccaggtttcatctcaaatttaatgtacttctttttgaaaagatcacgacgaagttctttaatgttatttgtaccttgataaaaattattcaaagcaacccaaatctcatgagcagtttgaagatgagcaacacgatcataatccgaacgagaaatcccactcaaaagaatattgcgagctttgcaatttagttcaaaagcagttttttcagcagcagtattaatagcttcaggaatcacacaaggaagagaaacttttctccaaatatcataattctcagccataatgtaagattgcatcctactacaccaatgagaaaaatccgttccatcgaaaacatgaggcttagttaaaaacttattagaagcagccatggcaaaaactctagatcggttaaaatccaaagaagcaaacaaagctttgataccacttgtaggattgaatcacaagaactaagccaaccaaagggggggggggtgaatggttgagatacccaaaaaccaaaaacttttagcggaaataaaagttacc

SEQ ID NO: 65400 - DNA, 1784 bp, Oryza sativa
ccatcaaccacgtgcatcaactctacccttagtatcccgcatgaaatttgaccaccacggacatcgtcttaccaccaagccgactcccggtccatcaccgcaaatactctcccgaggcatcgagtcacctacacatgaaacaaacaaagaaaccatattccgagactaagctatctccaacttgactcattagtagcaaacaacagtattacatacgtataatatccatctagaagccataaccatgaaacaatcacggatatccaaagaaacaacccgaaaccgaaactgacacagcgtcgaccggtcagaccgcgggctgcgccggtctgactgcgcaatacacgccggtctgaccggcacacccagcccggtctgaccggtcccgacaaactagtaaatcctgttcattttctgaaaattgattatctccaaaaccacttcgacgataatctccaaatatcaaaaccaataatcacatatgccaattgttcatcacaaaataagaatcaaaacacacattgatcttacaaatgattcatcaagaagctacgccatatagcaatgcaacctaattttcattatgcttgtagcatgacatgatttgtaggtgggtggaagttcttttggcgccatttaggttgttacagaatgtattagttaatttgtttgttagataaatacctcaaattcaatatccatgtaagcatgtttagttttactacattgttatgaaacaattttgatatctcgaggagatgtcccctcgttatttgcatgtcactcaaatggttacgaaaaaaatttaaaaaaaaattagagaagatgtattaacatgtgatatatcactcaacaacatgcaaattcaaattcaacttctatatctcgtaacgaaaaaaacaaattaaactatagctagttaacgtatattcacaatcaaatttgtttttcttcgttacgagatgtagaagttgaatttgaacttgcatgtttgtagagttatatataacatgttaatacatcttttttattttttaaaaaaatttcataactatttgagtgatatgcaaacaacgaggggatatccactccagggatcaaaatccactccagtttcaaaccattgcagctagattgctagttccgatgtttcaaataacatttagttgtttcatgtttaatgttgctatctgattttctagccggatggttttgtcatggtaaactagtatcctgatgaagcaaactgaccagctagtttcttttatcctttttatttcatccaacaaatttcatgtgctttggcaaaatggcatgtgtatttgatagatccatagtttgaaactttactgtgtttccaaacaactgtggattactgattctgaggttccaaataacatttaattgtagtccatgtttatcgttgctctcagaattttctgacatgcttattggactccttaggcgggcgctggagctgcaggatggccatagttctgctgctggggagagtccgactgccgccactacttctgatgactagacaaggagtgctgatgactaacctcctgaattagttcttaacgaatgtactccttgctgccgtgatggctttcaatgtaagcggggcctatatatgtaccttttgtctaaaaacccattttacaaaaaaaggagtcttagcaaccaagtggcaacagcttcacaagcctgcccacacaagaaaactctcaacctctcttggcccatacaaacttgtttgcactttgcaacaaggaacttga

SEQ ID NO: 65401 - DNA, 9909 bp, Oryza sativa
attggctttaatgtatcagtttgttaaactccattcttacaatcctgccttctatacaaggaccactagaccaggccttgctccctccgatcacccacaagctcacaacaaagagccctttttaagtagatgtgctgtttgttgtgcatgttaaatttttctgctgtcctaagatgctaagattttgcctttcagtatctatttccaggacttgaagttggacagcaagcaactgaagatgtgtttttatcacttattgcttcatcaggcaaacttcaacttcttcataaggttctttcgagacttcatattggaccttatattgctatcatatcttagcactgcacctgaagtttaaactgctagaaataacactgctcaattgctaaattgcagttgctcccaagattgaaagaaaggggaaatcgtgtactgattttctcgcagatgaccaggatgcttgacattcttgaggattttctttgttccctgggatacaaatatgcacggtatgcttcattcgtctaccttctatcaattctctaaattatatgcttcagactttcgctgctcttttccttgtatatctagtaattgaatgacacttcttttggccatttcatggctgtgttaacacttggcagcatcgatgggcagacatcactctctgctaggcaggagagcatagaagagtacaaaaacattgatagtgaaacatttattttcttgatgtcaactcgtgctggtggcatgggagttgacctggtaatgtattatcatatcaacttagttctttcagttgaaactgttagcctgtagggcaagctcttaaccagcaactgcaatagtatgattatgcctctggactgacaaacatcattataatttgcagcctggtgcagatagggtaattatatacggtaagtggttttaaatgttttcattcactgctaattatataatttgcaagtggatacttgcactgatttggccttcctatttccagatcctgacttcaatccatttatggacttgcaagcacaatctcgggctcatcggatcgggcagacaagaccagtggttgtttaccaactcattacaaagtgttctgtcgaggaaaagatactgcagaagtcaaagcagaagttggccatcgaaaatatgttgatgaactcttccaagaagccaagtgctgatgagttgcagtctatattactccatggagcaaagacaattgtggacaggaagatcagtgcaacatccatccattatgacaatgaagccattgagaatctcctcaagttagacccttccactggtgagaaatgctcgtcggatgataacggttatcttggcagcattgtgagctttgctcatggcgtcgaggatgaagcaccttcttccccaaaggttgaggatctgaaagttctcaagcctgctactcccaaggttgatctcggccgtgggaagaggcaaaggaaagtcgtgaactacgctgacgaggttgagaatgaagacagtgatgatatgtatgccccggaaggttcgtcgacttccgaattcagcagttcgtcctccgatgatgaaactgacagcgctctgcagctgcaaatagttacagtaccggacattgatgcagattaggtgtacaactctgtttcttactttctgtttgcgtctttgccttttgggacccttgctttttagtgaagggatggaaatagaaggaagcttttggataggagcagtatatatttaaaggttgaagttacaagtgagaaggtcgatgtagctattttggggtgttgaactgtaccaccttatgcagaaacctgatgatgcttgatggaaatccattagacagcgtccttgctgcactggtcttggaatggctagcgtataatctgtcttggaatcactttgctgcttgtgatttgtgggattagtatctctgtcggtgtcatatcgtccatttgcaacagagtaatattgtttcctacgaaaccgtaagtttcactgccagaatagcagaaatatttttgtttgacaccccgacgttatataagcccgcgagccgccgccgccgccgccgctgctagggcggacgagcgctcgccatggcggctagccgagcgaggcaactccacgctctctacctgacgagaggatgccgtgacccagacatgtgggccaacctcgccaaggtctacgcctccaactccttcctccgggaggccgctatcatctactcgaaactactgccccatcgtactcaccacctgccccttgtcatcgtcctcctcaaggcaaccgcctcccgcgcggatcccgtcctcggcagggccctccacgcggaggccgtgaaatccgccaacgcccacgaccgcctcgtggggacgacgctggtgtccgtgtactgcaagtgcggcctcctggccgacgcgcgcagggtgttcgacggaatgctggaccggaacgccgtgacgtgcaacgccatgctcgccgggtacgcggcggcgggagacatggtgagcgcggaggcgctgttcgccggcatgggctcacggactcccgtcacgtgggcaacgctgatccgggggttcgcggggaagggcgacatggcggaaacgcggcggtggtttgaggccatgccgctgggcatgcagaacgtcgtcacgtggaccgtggccgtgcaggcctacgttgccgcgggggacatggagaccgcgagggagctgttcaacaagatgcctgcgcggaacgcgtttgtgtggtcgtcgatggtcaccgggaacttcaaggctggcaatgccgacgaagcgcaagcggtgttcgacaaaatccccgtgcgcaacttggtgaactggaacgcactaatagcagggtatgccaaaatgggatgctgcgagaaggcactggaagcatttcactccatgctaaaggacaagatcaagccggacgagttcaccatggcaggtgttctctctgcctgcgcacagctcggttcgctagagcaagcgagaaaggttcacaatttcatcatccagcaccgtatccggaagaaccagttcgttatgaatggcctggttgacatgttcgccaagtgcggtgacctcgctttcgcacgaaatatcttcgacaacatgcaatggaggaacaccgaatgctggaactcgatgatctctgcactttccagccatggacagagcattgaggctattcggttgttctccaagatggagtgttcggagcagaagcctaatgagatcacacttcttgccgtactcggagcttgcacacacggaggatttgtagatgaaggactaagaatcttcagcaaattcgatatttacggggttgctgctgcagtagagcattacggctgcctggttgatctcttgggccgttctggaagattgagggaagcttatgagattgtcaagaacatgcttgttgaacccaatgaggtgatctggggctccctgctcggagcttgcagggtgcatggcgatgcagagatgtctgaactcgtatcaagtgagatccaccaattgcactcccgtcgtgtgtcaaccaacgatgcagagtacatcttgctgtcaaatatcatggcctcgtcggaaaggtgggagcaggctgaacgcatgaggagaaagatggcgctccatggagttgggaagaccccagggtgcagttcagtggagctcgagattactgaacaccaagtatgtgcaggcagtggtacgttatcccagctacactgactgcattttttgcatgtcccaaatgttcttccgaaagtgttttcacaagttgcccagaaaagaaaagcccctcatgtgctggatattctattaactgtacttcttatacatagatgattagacaaggacattagattattagacaagggaattatctgttctgttgcatccctttatcaactggtgctggcatagaaataactacacacttcgtgtcaattttatatgctaatatcagtcaacaggcacaattgaattatgtatttgaacatcaatttttgtggttgaaatgttaaaagaaaaatcttcactaacgatatcagaaaatacatttctgccaaatttccaagatcaaaggcaccaaaacgacttcagggtgcagttcggttgagcttgacatttctgaacaccaagtacacgcaggcagtggtacgttatcccaactacattaactgcaattttgcttgtctcaaatgttctggcgaagcggtttcacaattggcttgaaaagaaaagggattttctatcaactagtatgcttcttgtacatagatgactgtacaagggaaatttataatctgctgcatccgtttatcaactggacacgatgctggcaactgtgcaattccctcaataaaaaaacggtcatgtcaattttatatgcgaataatgtcagtgtgcaggcacaactgaaatgtgaaatgtgaaattctgtatttcaacattaatatttgagggttcaaatcatcaaatgtgaaaagaaaccaaactatcttcactaatgataccagaaaatacatcaacgccaaatttccaagatcaaagcaccattaactattaccaatttactgcattgcaaagagaacacaagaacagagatgataacgaaatggcatgatcatctaggactgggaattcagaattcaaccaagacaagttaaactagacaatcacttccctatcatagatccagctgaacttgaccttcctctgctcatccttcttagccctgtcctcagcccgctccgcggcccgccgcatcctcttcgcgagcccgcacacgaagtcccgggccctccggccctcgccggagagcccagtctccagggtctccagcttccaccgcttgacgaggaactcgacgatgtcggcgtagtcgcgcgcggtgtagacgttgaggcgctgcgccacggcggcgaagtggtcgaacaggttcatgtcgcggccgtcgtgcatgaggtgcgcgggcatggtgatccgcttgtgcatcatgtcggcgatggcgagcatggcgccgtccgggtcgagccgcagcagctgctccacgatgcgcccgtacgccgtctcgtgccgcttctcgtcggcggcgatggtgccgcaggtgcgcgccaggacgtcgtccccgtgcgccctggcgaggcgcgccgtgttcccgtgcgacacggccgtcgcgcgctcctggaagctggtgtacacgaaccccaggtacgggttgttctccgtccccggatcctgccatggattcagcaacaatgctaagcaaaaaaaagattgaaaccaagcagagaaatggcatcaacatttcgagagattcgtaccatgccggagccgatgaggtactggacggtcttctcgaccatgcgcatgtcgacgcggccggagaggtacatgtacttgccgaggatgtcgccgtggcggttctcctcggcggtccaggtgcgcgtccagacggcccaggggcaggcgctggcgccggtctcgtcgcggacgccgtcgagcgtgttgatcatggtctggtacgtcggcagcgcctcctcggtaatcatgtccccgaccagcacgacgaagtactcgtcggggagccccgcggcgcgcgcgcggagctcgtggacctggtgctcgaacatctccgacgacgagtccggcaggaagtccgtcggctgccagcactcctccacgggcttgagcagcggcagcagcgacgacctcgcccacccttccagcgaccggaacacctccgccttctccggcggcatcgagtgcgtcacgcggcgccgcgtcgccgtcgccgtctccgcggccgtcagcaccgccgcggacacgcggcactgccggcgcgagggcgccaccaccgcgccgcagccactgacacgcacggttcccacgacctgcatgactgccactatcactgtcagtcaactacagtagctagttggtggttggtttcttgatttcttctgcctttctgggatcgccgagctgccgcggcgtggtatatgaagggaggggattcgcctccaatggtgggcgaaaccgaaaccggtgggtggtgcagtggttttgtgcgaacgagccgatggtgtgggagagcgaatcctgtgggtgctcgcggccgttttagccacgctcacagctgggtgcacggctagcctccacggtgtctgaggctcatggcttgtctccatttttggccagtgtatcgggtccacagatcgtagtgaacacgtccgttgctttccagtttccaattttccataccggagatctggctgtccctctcgatacgatgtcgccatcacaaaagggaccggggtcaaacggtactttgtccagctgcatgggacaagtaatctggccggcagtgacgtggccatgttgggaaaaacgagctacggcgagaatttttactgtcaactgtggagaacaaggtgaccaactttgttgaaatgggtggttcgtttttgttctgttgtgtgagataagcaggctggttatggtaaacaccgtggtccgcccctggatttcactaccaagcggaacggcacgtgcggcttgtgcatgtgcagcgctggtccatatacaagtggcatgcatttcgcggacgcgctggctgcagagggattccccgagcccaccaggcgccgccaccgcgcgctgctcgcgaggaaacaatcgagaccaggctggcctgcccctggccgtctggcgccgcgacctgcgacagattcaaaccaaaaccgtatgtaaacccactcgctcaccaagcggtttcgtatggccaagcatttaaccggagatccgcctccacgtcccgtgcaagttagcgtccgtgctcagcacgaactcgccattccttggaattaaatttaaaaatatactattgattcgtttttttttcataaatactcgggatgtaaatttgttagcagaaatatactgtcgatctcgcgcaaccgtttcgcataagtgacgtggacgtgacgacgcaaatagcatctataacaggtgtcggccccgtacaatgaaaccgtgacaccaaacgacgaaatcgaggacgtgcgtgcagacggcgtcagaccacacggtctcgcgcggccaaaccgcgagaccgagcagtctctctcaatcagtgagcgattacgacggttgaaaattgttaattagtgattgattaattgttaattaatcactaattaggataattaatcactagttattattcgataattaggataattgatcactaattaagtagaaccgctggacaagacgttcggtctcgcgatactgcgcggtgtgcgtcgtcacgcttctttgcacaacggttgtgcgagattgatggtatatttctgctaaaaattttatgccacgaatatttctaaattttacgccacgaatatttctaaggaaaaacaaatcaacagtatatttttaaatttaattccattctttgtcattgggttgacgagacgttctggaagccgttcttcttcgttatcacgccgactcggtgactccctggttcgcttcaccgaagcgacgaagatactatgttcggaacgagggttgggaaccgtcactccctagcacgtaaaataaaacgtatgattaattaagtattagctaaaataaatataaatatattaatatgatttttttaaaaaataacttttatataaaaaatttttcataaaaaatacaccgtttagcagtatgaaaaacgtacgcgtggaaaacgaaagaggtgagttgggtaagtagagataagaaaggagtgatcgcatcacaactcacaagcacatcaccggaagttttgcacttccaccatgttgtaaggaaaaagtttatattgcctttcctcaactatagtttaagtccgattcattttctcaccgtaacattaagactccttgaactagggttggacgtttggtcaaaccaaaaaatccggtctcgatctttgatcttctacaagtttcggttatctaaaaatagaaaccaattaatttaggaaaataatgaagatcaagaaaatcagtctcgatctcgatcatgactgaaatatcaaaagttctaaaataatcagggcaagtctaagttccagattaaaaaaaccatacacataaacacacacccacaaaacacaaattgactctcttcgctatcacgggccatatatcgaagcatgctagaggccaaaattcgatttaattgggttgctggaccttaatagtcttattgagccaaaatttgatttgtgcagtttatttagttaatcgaaggtactaactgaattgaccgaatgaaattcggtcctttaacacctgatactgatcaaatttctcagctttttcagtcctagttccggtctttttggttcggtttttttctgtctaccctggcttaacaaataaaatgaggagtgaactcctttgatggtttgctcagcggtttcaaccgacgtggcgtattcacctggtccacacgtgatgagtcagtatacacataagcgtcgatattgacgtagttaataataataataataataataataataataataataataataataataataataataataataataataataataataataataataataataataaagcaattagtccatatgtcatcctctctctcctccccactccccactcccctatcttctcacacatcggccatccttcatcttcgtcaagtgcactgatagcctaatccctccttttgccattgagtgtgtcagcggttggatccgctggggcacatgcaattcaaggttgtcagtaccccaaactgtataatattttacgatactaggatagtatgctacgaattcaaaacgatatcgatctcatctaatatcgtaattttcatagttactcgatcttactatttatttccacacgatcctacgaaatcttggatagtatcccgatattacgatctctacgatcctaccaaatattatttaataaggtggattgaaaataatgtgaataaatatgctcaagtttacataaaaaccaattaaatttatcaaaatcaatattatatattttaatttatacaacatattatatatcttatataaaattatgtaatttctaaaatctgatagtcttacgatcctacggtagtatctagatacttattaccttggatcatggttgcaccgatccaacgacgaggccaccacctccaagcactagtgccggagtgctccttcaatcctctcaccaccaccaccatcgttgatactctctgccactactgttgatgatagcacgttattatacgccttgcctctagctggtctctcctcatgcttcaaatccgcaccagtggcggggtggacaagctcgggctcctacttctcaatcgaatgggccacctacacgtgggtcctgatttttttttcttcgttaattgtaatttataaggtgagggtggaaaaattacacgtgatttctacagtatttttttaaaaaaattcatgtaggtgtcatattggtaaaatgaattgatagttgagataggcttaatgtttggtttaacgattgagatagagaaatcagactatgaggtagaatagacctttttcccggtgcgaacagagttggaaaaagtcaccgaaggtccctcaacttgtcatcgagttataaaatcatcccccaaccgcaaaaccagatatccaacgtcccttaactaaccaaaaccagtcacaaatggttctctggtggttttgaccccggttttgtcctacgtagcggctgagtgggccccatatgtcagactgccacatcagcctcctctctctcttttccttccccttttatcgcccttcctt

SEQ ID NO: 65402 - DNA, 5847 bp, Oryza sativa
tgctaatcatggtgttcaacgttgatgtggcagcctgatatatggagtccacatgggtcccacgctgactcagccgccacataggacaaaaccggggtgaaaaccacggaaggaccatttgtgaccggttttggttagttaagggacgttggatatctggttttgcggttaggggacgattttgtaactcgttgacaagttgagggaccttcggtgtactttttccaacatagtttcctacaggaataagttcacttcatgacccttaaagagtgatcgaaatctaatccgtaaccctaaaccacaaaaccggatatctcgaccccccaaactcttaaaaccggtgcaatttgactcccttggtggttttggagagcggttttgctgacgtggcgccacgtggcacctacgtggcaatattgaccaagcctttgatccacgtggcgtttgacgtggcacttacgtggcattaaagttaaaaaatttacgtgggacccgtttgtcattcacacacagaaaaaatgtggggcccactaactgtgggacccacatgtcagtcctccttcctcctccctctctcccttctctctctttttctctccccttcttccccttcggccggcggcagggcatgggctgcggtgtggcgccacccggcgggagctgaagcggtccccgcagtggaggagtcgacgatggcgaggccagctctcggcgagatggggtcgtcgtctgttctccgcactagccggcgacaagggtgctgatcggtgccagcgtcaccgtggccttcttgctcctgctcgccttcttcttcatcatcttgccgcgcggcggcacaccgccggaggtggtatcgtcgtccaaggagggcgggatccgggggcgtcgcgatggcggcggcgtattccaggttgagagctatggggagaggtgcgagcacgtcgccgaggaggatggccatgatcgccggcgattcccgcgtggctacgtcgactacctgtacctgttcgactgcgtgttcggtgtggagcggcgggttcttggctacggcgtgatggcggcttggctcgccgtgctgttctacctgctcggtgacacggcggcggtgtacttctgctccagcctcaagggcctctcgtggctgctccgcctctcccgacgatcgccggcgtgacgctcctgtcgctcgggaacggcgcgctggatgcgctctccaccatcgcgtcgtcgcctacggcgggggagagggggagaccaccaccgtcgtcaggaaacttgcaattcgctcacaactcacacgctcaacctcactgaatctctgaaactctgaagattgtaagactgtgaacagtaaactgaaaaaccgaagaacagagttctgaacagagtggtttttgtgctgcttaagtctcaccagtcaccgcagcttctctgttttcttctctatttattcatctccatcagcagttcgttacatgcataactggaaagaacaagccagacttcagccccagccactatatgcatgcaaaacagaaattaaaaagctcaagattgcacatcagcgcacacggcatcatcgccgacgaaccaccaagatcccgacgcgagccagcttcctcttctctcgtcgccatcgtcccgctcccgttcccactccctccccgccgccgactgcctccagtcgggactatccaagaagagccgcggctgagcggggacgaggagcctcgccctcctcatcggtgctgaacgggcgcgagtggacggagcggcagccggacatgtcccccgacgccgatgcagttgatggagatgtggtccagcgactcgcgagccgtcggagaccgcgccggtaaccgcaagggcgaggatgacgagcagcatattgggccgccgccgccgccgttcccctcgtcctcccactatcgcgagcctccgcggccgagccgccgccgtcctagccgccgactgcgctgcgccccgatgccgccagccgccgccgctcaccccgtcctcccgccgctgctggcaatgaagaaagagagaacgtaggagaggactcactgacaggtgggccccactttatttttttaatttatttgatgactagaatgccacgtaggcaccacgtcagcgaaaccgtcctccaaaaccaccgaattgcacttgttttaagagttgaggggtcgaggtatccggttttgtggtttagggttacggattagatttcgatcacttttgagggtcacaaagtaaacttattcctttcctacgtgcaacagatgtgcccaggccggactttgagaacgtgcggtccgtagctgttgggtcggaaacggcctaacgggatccccacggacgtgtgggctgttgtagttgggcctataaaggattgcccgaagcgttcggcctcttagatcaggccatggaacactaacgcgccgcacatgaaagctggcctagatccggcgttgtgttcgtttagaaggcctcccaatccatcagcccatctccggttctcctcacatttaactctgagctgagaatggcagaaaagttgcagacctcccctaaccttcgtgatgtggacagatcatgggcgagtacggtcgtaccgatgaacacttgaccctccgtatggccgttgatgttaccggtagggtgatactccctcggtcccacgatataacaaattttaaattttttcttagaccactcgtttcacctcacctcaccaccgcgcacgaccagagaaccaccaccctcctctcgacaccgccaaagtcaaaaagcaaagcgtcacgtcacgtagcgcagagcggctgcaactcaatgccaggtgggccaggtcatatactggccccacaggtcagtgagcctagaaacctccttcctcctggtatctggaagctctggtatttaaatcgcacgcgttcctcagccaccgccctcctcctctgcgcggagccgtcgtcttcctcctctactcctcggacttggccctcctcctcctcctcgcgccgcgccagcgctgacgtagccgtaggtcgccgggcgacgcgcccactaagatatcgagcagttccggagcctgctcagggggctgggtgcggccgctccggcgatcgccggagaagaagggtggttggaatctggtgagtagccggccctgatcccggtcgtcgtggaaatccttccttcctcttccgtggtgggcagcaagagattttggtgctccgtgatctggagagctgtgcgcgggactggggttaggtggcccccccaaggttcgatccggcccgatttggcggagggattcgaacgcggcgtattgggataggaagccgcgccggtggatttgttcgagcagatttggctgctgggggtttgtgtgatgggagatcaggcggcggcggatgcggcggcgagatggtgaccgggagctttagcaggagcacgtcggcgcggctcacagcgaggggcggcgtcgggagcccgcgggtgtcggcggcggcggccgcgcaccgcaagtggtggtggtgggcgccctcggggccgtcgttcgagtgcgctgccttggccttcttcctttcctccgtcgcgctcgtgctcgcctgcgcgctgtatctgtatctcttccggtaccagggccgcggccatgcggtcgccgagttcgccggcgacaacctagagtcctgcgacgtgttcgacggaagctgggtgccggacaggaggtaccctttgtacaatagctccgattgcccgtttgtggagaggggattcaattgcctggcaaatgggaggaaggacaccggctacctgaaatggcggtggaagccaaggggatgcgacttgccgcggttcagtgccagggatgtgttggaacggctgagggggaagagggttgtgtttgtgggggactccatgagccggacacagtgggaatctttcatctgcatgctcatggcaggggtggagaatcccaagactgtttatgaggttaatggcaatcagatctcaaagactatccggtttttaggagtgagatttgcgtcattcaacctgaatgtagagttcttccggtcggtgtttcttgtacaacagagccctgcacctcgcagtagcccaaaaagggtccgagcaattctcaagcttgataagatggataatatcagccggaaatgggagaatgctgatgtgcttattttcaactcagggcattggtggactcccagcaaattatttgatatgtgagttttcttattgtacttgtacttagcaacaccaatttgttcttagaattgttgtcatatctactgcagttaacttaaaaatcatgaacctaatatatgtttgctccaatacatttgtttttgcgaaaaatccttggatagatgttctgtgcatgccaatggtttggcatataggtagcacagtgtcgctttgaaagatatctgttatttagtatgtgacttctaagcaacccctagatcaaaggggtgctagacagtattttttttaagagctcaacacaatttatcctgttcaggaatcatgaagtggactgatcaaaagtattgatagtaacaaattgacaaaaacaagtgatgggttgccttgcaatcttagtgaagttacttgaggtcaaagcaacacaagtaccagtgtttttgtttctcctgtcaaaattgcctgatggctgatgttggtgcattccgtccttcaccagaatagtcgtagttaggaaatatacactgtcgataattgcattgtgtttcaattatgctattaagttatgtttgtgcatattcctcagaagtgtttctactaatgtggattcctattattgcaaattgttacaatttacgaacaatctactaaattgtcatttccctgtttcactaatgggtaattattgttttgtgtttttaacaggggctgctattttgaggctggaggtttgcttaaactaggtacatccattaattctgctttcaaaatggcacttgaaacatgggcttcatgggtgaaggaaaaggtggatttaaaacgaacacatgtctttttccgcacgtatgagccatctcattggaggtgtgttttctcacatacatcggatcttttccagtgtattgttcttcttgtattgtgttataaaggcacctaatgaaaacaagactgctactgttgtggtttgaagaaagtgtaaatgatttgcgaaagacatacactcatttgtatttttttccctttttgcatacttacagtggttcaaatcaaaaggtatgtgaagtaacagaatttcctacagctgaggccaaaggagatgacagaagtgaatttggagatatactcgctggggttgtggtgaacatgagcgttcctgcaactatcttgaatgtgactttgatgggggccttcagaagtgatgctcatatcggtatatggagtcatccttcaaccatacttgattgcagtcattggtgccttcctggagtcccagatgcttggaatgaactagtaatttcccaccttttgacaaatggtgagatcctttacattatcattcttttaacatattatttagagtaaagtgtactgatggcccttaaacttataggggtgtgtcatctaggtctctaaactctcaaaatgcatattcaagtcctagaacttgtcatagtgtgtcatttaggtcccaaatcgccataaccccttcagcatcctacgtggcgttgatgtggcatgccacatggacatgatgtggcatcattttgactgacaaatggaacccatttaattttttcttttcctttttcttatctttttttcccgtttcgt

SEQ ID NO: 65403 - DNA, 25222 bp, Oryza sativa
aaaatagtatctatactccttaaaagacctcaatggtggtggtggtgaatctgccaccatacctatgcacttatgtgggttcatgctgtcagtgtaaccacggttgtgcttgaaattcaaatcagtgaatccatcatctaccactctacatcaaaaggtgagccatatgaaccagcataatccattcacatcgaatttcaaagaaaatatgatttttttttcaattaacattgggaaaagtaatgacataatttatttttaatttcgttgcaacgcatgggcatttagctagtatatgcagaattcaatctgttgacgatgatttccactgcatgcgctgctgtctttgaattgatggagataaatggtgatatattgatctgatctttcctcacgtgcaattttgcaggttggcgaaatttggctggctgactgactgctgacattatactttgtttttctttttctttttcttttttgtttttctgctgcttctgcttcgtctgctatcaagtagcggaccatgatttttttttcttagacagcactacagcagcatgtcttcatcttggtttttccttttcctcaagtgctccttatacacgcctccggggttacagattttgtatcattgtctattttgcgttttagacagaacatcacaatcggcaacctgtatgtaaacaccaattcatttgcaagttttggaaagtcatttctcatgcatgaaatctgtttggtctatttttttcttttgtgctagtcgtacatagaatgcaatcaacagttttccataagataatctgtttgctctatttatttttgtgctgcagtggtattgaattcatgctaaatctattgtgaaggatatcgcagcatttccggatttgcatctatgcggctgtgcctaactggcgagtactgtacactctacagtctaagtggacactgatccgccagatgccgacctgtcacctgtgtgcactgtgattcccgtgatcatgtccagggaaccagtaggctacgtggaagaggatgtgaaaaaaccacccatctctattcgacggccgcgacatcatcctgtggggagcgagctgtggtgacaaaatcacagaacgacaatgtcacatggctacattgtgaatatgtgacaaactgacaacaggttgtttagttttccatgattaacgtatgctgatgtacaaaaactgtgcatgtttgcccggcatcgtgatggactgatggcttcgtgttcgctgggaccggcagatggcatggctaaacgaactctttagattcacccggacggggatgcaacccaagagggaagtgtctgccgtgcacggttgggcaatttcaagtatccttagcgtagcttcaaaagatgtctatcatgtcggcttcacgaggcaaaccagggcagagcatgtagaggtgaggaatgctatcaaactccaaatcgtgcgatgatcatgacagtgtttcgtggggaagggaatgcagtggaatgaaattatctgcattatattactttctgccagtaaaaacgaagactgtggtttgcggagagacattgtatcaccggtcttgcactagcggaacttccgcaggtgagatctgattccgttccatcttgggggtgcaatgcttagaaatggaacacacaatccaacaacataaatggttagcaaaaccaacagcagaatttcaactgttaccagcaaatttacacacatcaatgccttatctgcaatggggagtactttccattactgctgcacccatcaaaatccatcctcttcatttctttcctcccttgcccatttgcccaaccaagcctcagctgcccccgcctaataccgtcgccgatataaccaaccagtctaaccaccactacacactccactccatttcccactcgactccatccagacattgtctccaatgtcgccgccgccgcttcgcctcctcctcttcctcctcctgctccacctcccctcctccctctcctcgcgccaccaccaccacgccccgtcgccgtccaagccggcgccggcctcctacgcggcgccgctcgccgtcctcctcgcttgcaacgccacgcggttccagcccgcctgcgtctccacgctctccaacgcctccgccgacgcgtccactccggacctcctcgccgccacgctctccgcgctcagggcccgcatcccgccggccgtctccacggcgcggtccgtcctcgccgcctcctccaacgtcaacctcaccaacgccgccaccaactgcctcacgttcctctccttctccacccaccgcctctcgccgccgccctcgacgtcgtcgccgtcgctcctctccgcctccaccgcgctcctccacctctacgactgctggtccgcctacaagtacgtcaacttctcccgcaccatctccgacgccatggcctacctcgacgacaccatcgccgtcaacagcaactacatctccatgctcgccgcgctgcagcgctacggcgacgacaccttccggtgggccccgccgcagaccgagcgcgacggctactggccgcccgcggcggcggggtccgccgccgacgaggacgcgctcggcgtgcccaaggggctcccccccaacgtgacggtgtgcggcgcggggtgccactacaagacggtgggggaggcggtggcggcggcgccggactacggcgacgagatgttcgtggtgcacgtgaaggagggggtgtacaaggagacggtgaacgtgccgttggagaagacgaacgtggtggtcgtcggggacggcatggggaagacggtcatcaccggcgacctcaacgccgacacgccgggcgtctccacgttcaacacggccaccgtaggtgcgtatacccgtaattttttccccttctttcaacgctatcttgtctttgtacgtatacggtagctggcacagcgtacgttttttctctacggtggtacacgtggtacgtgcatgaatcaatgcggtgtcattagctgctgctcgtgaccagccaatttagcactttgtctgcacctaaaatgcctttctgtgaatttgtgacgtcggccattaattgttggcttttgtgaacattgcgttcggcatgcgtgaggatcctctgacatactaccattacagttattgagagcatccacgatgtgagacactcctagatgtgagacactcatagagtatcttcactaactaaagacactcataaggaaacttagcttgtgagacactcatagagtatcttcactaactaaaaacactcataaggaaacttagcttgcaatagaggacacccctggatgtgctcctcaaaatctgaagaaacttaatagagacactccaacccacaatgggtatcccagcccacaaagtcccatgtttatttttactaccctacccctaatctctctcccgccccctctttttttcgccgccctctctctctcgccagtgtcgccaccgccccctcctcttttttcgccgccgccgccgctcccctctcccttcgctggcggccacgaggacgatgaggagggccgcctctcctgtcgccggcatccaccgccgcccctctctctccctctctcccgtcgccgctcgtcgttgtcttccccggcatcctccgcctcgcgccgtcgccggttgggggcgccagatccggcgccgtagtgggcggatctgggccccccgcggccagatttgggaggcgccggcggtggcaggcacggcgccggtggtggcgagtggcgcgtggatccctcgtcgccgccggaggtcgcgtgatgcgccgtcggatccatttctctctctctctctctctctctctctctcgcgcgtcacggggtcggccggaggccgtgtgccgcgccgccaccccttttcctccgcccgtcgccttcgcggggtcgtcgccggtcgtcacctactcccaacgacgagggcgaggggtggaacggtaaaatgtggggtggtagcggtgtccatgggacactcacctagccacgccctctgcaatgcgtctcccggctcggtgtctcagctaaaagttgctaaggaatgcgacccctagcgaggagccgcgcgcctggcagtggagaaggtccgactgaaaagctaacggagggcagacggccgttcctagggagacgacccagggacacccattgtggatggcctgatatatggatctcacccttctatcgttctacgtgtcaatgtctgtaacaagaatgtcattataatagatgatgtgaaccctacttgactacgtctatattaggaagttatttaaccatgagaatgtgaaaattgtacccccaatatctcttttccactgtccatgataattagtcagacactaccctaccctagtcttacatggagatcaacgcaatccttgatgcattttttatcgctatttatctaactatgtatatttgtaaaaaaaataccatatattaaaatatagtttcttgcagtgtttttcatgaaaatctatcaatatggttttgtgtgaaatctaaatattttttaattaattaagcatgtaaggtttcaaggtttgacttcacgcttttaggacatctgtttagtaggggaacgccatttgtgtgatggtgagtcgtgtatatatgactctacctacgttagttcaaattttgatgtacaaatatatttgtgtgcatgtctggttatgttcagggtttacattaccgtcggtaaccacgcggttaccgcagggtacggtaatagaaaaaccgcggtaacctccttaaattcaaataaatttaaaaaataatttaaatttttgataaattttgcatggtttcgtacgggttttttcacggttactgcgtggtaaccgtgcttaccgccgaggcgcggtagtcccggccccaacggtttggaaaccctggttatgctgtgtttagttggtgttgatattttttttataaaaaaaaaaacttgtggtagtaccgcatgcagttaatggctgctaattgccattgaagtgctagagtaattcattggacaattggacagatatgaaatttctatacactacaaagatgattccaaatctttaggtacatggcccaccaatttcctggtagccctaaattttaggtaagttttggccctaccaatattttgatagagaattctattgatgtagcaagtattacatttaaccccaaacaccacacaggtagtactatttagactacaaaatttagaagggcaagatttggcactgaactaaaacaatctttttcttcagaattaggctctgtctccagacctttggaggagaaagagagtacaaaccatctgggatagtgggatgtgataaatacttgttgtgttttcccccttgcaaatgattaatcaatcggcttatcgcgcaatgaaacattcgttcttttttattcgttcttaggccatccaattagtgtggccggaagcgacaatgcgtcccagcatcacgagcctctctactcataggcaaagtaaaagattgtaccttttcgtgcctttcccttttgttggtccctgccaaacagatagccaaactaggcgtggactgccgactagacctggcatggttcgttcggctagtcacaactctcagttttaactttaccctgagatgtactatctgtcacgagacgtgatcgtactcgtgctcacagtaatcctaatccggctgtaatgtgtttggtgatcttaatctcttatctgtttccaggcgtgctcgcggacggcttcatggcgcgcgacctgacgatctccaacacggccgggcccgacgcgcaccaggcggtggcgttccggtcgacgggcgaccgcacggtgctggacacggtggagctcctgggccaccaggacacgctgtacgcgcacgccatgcggcagttctacacccggtgccgcgtctctggcaccgtcgacttcgtcttcggcaactcggccaccgtcctccgcgacaccgccctcatcgtcctcccgaggcagctccgcccggagaagggcgagaacgacgccgtcaccgcgcaggggcgcaccgacccggcgcagcccacggggatcgtgctccgcggctgcgtcgtcaacggcagcgacgactacatggcgctgtacagggagaagcccgacgtgcaccacgtctacctgggccggccctggaaggagtactcgcgcacggtgtacgtcggctgcacgctctccgagatcgtgcagccgcgcgggtggatggcgtggaacggcgacttcgcgctcaagacgctctactacggcgagtacgagagcgccggccccggcggcgacggcgccagcgggagcaggatcgggtggagcagccaggtgcccagggaccacgtcgacgtgtacagcgtcgccagcttcatacagggtgacaagtggatacccaaaatacattagttagagcagcataaaaagaagtaaatggtggtccattgtgtgatcccctcgaatgagatggtgccaaactgccaacggcgtatagccatttaactgtgcaaacgcattgtgccgtgcataatgtttaatgaaagggtggccaaagccttttccttgatcaatgaggatgtatgatctagtgctagccgaccgtgaacgtgaaggctaaatctatgaaaagaaacagctgaaatttccaattttgagtcggccgagtgcggatgcagacaagcagataggttcggcgtgccgcgtgcgctatccgcaattagcatgactgaggcgtcgccagaacattatcatctcgcctcactcgtagtggtggtccatcaggccatcactcgcagcaaccttttttccgccgtagcgtccaccgaccaccgccctcttcaccgccccatatgcagatgtgcgcaaccggccctacgacccaacgagcagaagtactgaaccaagaccaaccaacttcggagttgtgctctgcgcctccgcctacccacttcggaagtgcactggacaacgaatgcgccgtgacgcaccagtcaatgtcaagtaaacagaagcgccaagatgtttgtggatcgtcgatgctaatccacttcgaacctggcaaacgaccatctattcgactgtaggattgtagtaaggaacatggacaaagggtgttgactgccttttgaatgagattatcaaatgcgacacagaatttacgggcccagcccaacttgttcagagaggccttctttggacccttgagttcgaccttcaagcccaacttaaccaacttatcattttagatagaagcagattagaattttgaaaaggtccccaatataggtccgatcttatttagcaaccactaaacccgtgcaaaaaaactccttgacaatgttgatggtcgtttttactaatgtgacattcatgtgatagcccaatcatcaaagaaatttaaaacatatatatatatatatatatatatatatatatatatatatatatatatcccacatgtaaatgattaaaaaataataagtcaatcaactcgtagggagctgctggaaccaccaccgccttccacgcccttcctgcttctgacgaccatggcaccccaatcctaggagagaggacgaaaggaagaggggaatagtcaccggtgccctcctggctccggttcatcgccacctccacccctctcgggctctctgtctctactgtttgttggaagtgtgatgggaggaagagtgaagagaaggaagaggaaagagagagagggagacgtgatgaagaatatgagacatggacttacatgtgggtccactatttaaaaaaaactagtatggtggcctgcgcagcttgcgcggctagtatcattatattttctctcatataataataatatatatgttttctcaatatattattcaaatatattaaaatgatataattttaaattttgcaataactttacgaaactactaatgggtaatattcatattgtattttatatacgtgttagttattaattatttttaatatcaaattttaattatttgtaaattatatatatatatatattcgtatatgggctctagactcgtcttttaatatttatttttttaattccgaattttctgtaaattgtatttctatatagactctatgctcttattataatattatttttttatttctgcatttttattatttttaattgtatttctatgtgtactctaaactcatctttcagtattctttaatttttaatttcgaatttcagttacttctaaattgcattcctatattgactttaaactcttcttcccatatttttcttaatctcaaattttagttatttgtaaattgtatttttatacggactctaaacactacttttaattttattatgtttgttctgaattttagttagttttaaattcactctatactcttcttctaatattccttattattttaattccgaatttctatttttttcttaattgtatttctatatagactctgtactctacttctaatattccttattttttaattccgaatttctatttttttcttaaattgtatttctatatagactctatactctacttctaatatttcttatttttaatttcgaatttctattattttctaattgtatttctatatggactttatactttacttctaatattccttatttttaatttcgaatttcagttattttctaattgtatttctatatggactctagtctcctattctaatattccttttttttaattccgaatttcagctatttctaaattgtatttctatatgaactctgttttttctttttctccgattaatgtgaaaatttctagaccatgagagcaaacgtaaagactcatttttctattcctttaataatatatataatagatagatgtgccacgtaggataaagactaggttagtgtgccggcacataagacaaaaaccattgtccaaatcacatgtggaggtaaatttgaacctgtattaatagtagagggagtcgttcttaactggttttatggttgtacgaataatatccgatctatattttttaggaactctgattgaactttttcctttgagttcggttcatcctttgtacacgttctccttgtgggcttctttccttctgtaccggatgaccacatgcccactactgagccctcacgaggcccaccatatccactactcgaacacgaacacgagaacctttacgagggccaccatatccactacgcaaaacacgagcaagaaaccaaccgaatagtccaatacgtccggcccgtggcatccgtgccaacccatcgaccatccggctaccgagcagcacgccaaccccaccgggtgcaccggccgggagctgccccgatccgctatttctgagcgaaaacttctccgattcgaagcccccgcagccgaactcggcgaagtccccatgccaatctgactagccgcccccgatccgctgccgctgccaccggcatggcagatggcatccccgcacacgccgtcacgtacgcggtacgtcccagcgtgaggaccggccggccctcctccgcgtcgacggcgacggcttgcacaagactgtagtagggtaatcccttcgccctcccgttttctttagccggtcaaagcacgaaagctggcgtctggcctggcaccaggtacgacgagaggacgcgtgtcgcgggaagggtccctccctgcctagggcagtgggcactggagtggagtcggtccatgccctaccatgcgcgacgaccgctcgctttgcctgacaacgctggtgggtgctgcctgtggcgcagggccgcggaagatgacatactacactcggtggccgcgccacactctcgtgctcgcccggacaagggacacccggactccaacaccaccacgtgtgtactcctaccccgtacgcctctctctctctctctctctctctctctctctctctctggacggctgggttggtaggatttccacgatattcgcgtgaaatgtctcgcagcccactgggaatttgtttatgttcgtgctaagtcgtaacaagtccagcaacctcataaacaacagcttgatgaaaccttagtagctgacccgtttcgtttactacgactcctgtagatttagctagggatgctcacgcaattcacattttcctcatgtttcagcttctggctcactgcatttgcaagttacttctctcacaaaatttgctcatgtactccgttagctgtgtactgcccccaatgccaagctcgtggatgaacagtaccagtatgtagtaaagtaccagtagatgcataaatgcattataccactactagttcttgagaagtaaactagtcaatcacttgtgatgcaatcctccaactactcccatcttgaaggacaagggaagtactactagaaagagagattaggagtatctttggcgaacgacgctgctagaaattgtacagcctaacacttctgctttagtcggtgcgttgccgttggaaaagggcagcagcatgagctacccccgaaaggctgcatctcgaaggaacggaagcatggctaaataattgatactgggaaattatgatgttgttcttctttggcagcatggcattgccaccagatctcttcagaaatctggttgtgcccatgttccacacctgcagtgagcagcagtgcgtttcaatgctgcattgttaggttggcactgcctctctgcctgtgcagctgtgcatcagtgccccacgaatggggctcatcacttgagttttgaatgcatgtttgattgcaagtcccgcaattaattgctatgagaaaaacaaagattcccatctcttaagccttaactaagtatgccaaatataagcaaagcatacatacaacctcgtgtgcttcagggacttccagtgcaaaatggccccagctgctccaacgtccaaccatctgtggatgtcagccgtgaccgtattaatccaactcaattttaaaacaatactgtatttcatgtcaaaatgaggcagtgtttgctggtcagcaatctcatgttgcgtcactccagattttatcaccgaaacagttcaaccaccatacatcgaactaggctattgcagccgagcaacaaccaaccccagactgaccaaacaattcatgaacagaaaatttacctatactgatgaattattggccaaaaaaccaaaaaaattgtgagctatcaaagcagccagagtggagccgaagccatgatagcaaacacaaggtatagttttgtcgagaaacctaagcatagctacctttacaagctgttgctatgtatgtatggagcttagaagtttgtatctggtatagggctatctacacatctcatgaacttgtgaggctcgcggtaggtgtggccggcacagggttttccttcgttgagttcttggattcaccccagtgccataacatgctctcccagaagcagaacttctcaaagcaagttttcagcctaggatcagttatgttcctccgccaatgtccatcggtgaagtttgctttctcagcctgcctccgatcccactccaacccagccttttgccttgatctcaaaagacaatagtgctgaagtttctttggcatcttgtcatgtaccttccaccaacgggcatgtgcaacatcactggcaaactcccgcagtatcgggttattccagttacagtcgtaatcccggaagcacagccatggtttgagacccaaatagtgaaggacatagaggattggtgggtcagcaccaaacaaccgagtcttcttcactttcacttcctcttcatccccctcccagaaatgttttaagaagttcatgtgcttcggaattcgatgccaccatgtgaatatctcattcaggtatccttggtcaccaccattgtaggatgttatctcattgatgtggtccatcaacaactggaatgtgcagtttgaaggctcaataaccattactccagagttgaacagtgtcgcattgttgccggttgcagtgatttctggcattgcgaacagaaaatcgacatttctcagaatgaggagatcagcatcaataaatataatcttgtcgtaatctgtgagctgccatagacggaatttgctgtagttccactcattatatgcatcacgctcagctttcggattccggatcctttggattattctaaccttccacccagcagcttccaagcccttccggtggtggttacttatggtctcgtcaacaagaataacaaaatccctagttgatccggcttggcgaatgctttgggcagctgtgattgcaccacagacatattcacttgctgaatgcagaatagtagcatatgcttccctccgtctgtctaccgagtaaagtcgtgctgtaaaggagatgaaagatgttatctagtggaaatttcaatgccacgcaggaaaataaaactagaaggtgcaaaagtatgttctaacatttccggacaaaatcaccaaaacattactgatacatctgcgataaagcaaccactcttgctcattcccgaaaaagaaatgcaatggtagattctaaaagcttacttacagcaacatcgatattttaactacttcatatttggctctcttgttatatatcatagggattaagtggcatgaaatgggaagccatttaaaaatgaaggcagtaagacataccttttgctttgagtggaacagcaagttcacaggatccaactggaagtctgagcttctcccttagtgccttcaagtcaggcttgtacatccaagcattgccttcatgtttcacaaggttcttgcaagagaagagatttggaatagggaagcaatccgtcacaaacagcacatggataccacgattgcctcttgaagcagtcactgccacttttgcagcagatagttgcaaatgcagacgtgcaacgtctcttgaccatccaccagctcgggtacagggaagtttcacagcaacaacatcaaagtgtgtccctcttggaaaaataggatctggaagcgatggacacgatggtatctctgtttcttcctcctcatcaatccattcagggtaaagagtctgccaggtgatgctttccttggcatgctctagcctaatgatcgaaaaatcactatccgggagcaattgtgtccatgagccaatttcagtgctgttaaaatttaatagtccaactttgagcttccgttcaccatcattcagattttcgacggttttatatacatcctcccactgaacaccaagcgaagatacatatcgtggatcaggaatggtcttgtcccatatccacccactgacaaacctgtaaagcatatgaaaggtatggtcaaaaagggtaatgcgcaatttcttattatatataactccaacataaccactgtgatgcgagcaggaattggtgttctagtttccactggatattctactgctgacagaatattgtaataagtttccttttgataggtctactcaccgagaactagactgcatttgatggtcgtacacagatggagtgtacaatagtgtcagaaatgcagcagacatgatcgcgaagagcagaagttgtaaggaccggaacttgcaaccagagcttttctctaggacaaagacatcaaatttttcgacctctttgaaacttttgcttttctgggtccttctcttagctgtgtcatccctgaaagaaggtatagaagaaacagtcagacagcgacttcttacagtaattatttgggcatcaaataataattggtaaagaacaattcagaaagcaacccctgaatgtaggatagtcagcaagatgaaacaaaactttggaatttgcaccaggtatgaagacacaagggggaattctgtctgaagaagaaattgtatatgaaagaactactgaataaataagtatgatatattttccccaaaaaacagcttacattgttgtactgttttatcgaaagcacatggaagtaataaaaattgctagccaaggtccatatcaattgtaaggccccattgttcccattagttaatcccaaaaagatagcttagaaaacatttttcttggtgatcatgttttgttttcctagaagtttgcactagtcttgtgtgtatttgatctggctggcctatatggacaaacagccctagtaacactaaatctataaaaaaaatatagcacatcttttcaaaggagtacttaatctctcatacggtagtatggaaaagcgatcatagtaaagttgattagctatcaaagaaaaaaggctaaagagaacaaaatagcaaggttctccgcactgagaattaaagaaaaagattagcaaaaagaagtggtgccaaaccattttcctccattcttcctttattagtcacaccacatcttttaggaaagaaaagcatcactaatcacaaagatactccagtacctaaccccatgttattggtctcaaatttaaaagtgcgcttagcgatttaaataacgttaaacatgaaacgaaaagctgcactcatgggtaatcccagctgtgaacaccaaagctttgtcaagaagtttgattcaaaacaacggagccggcccctgactactgaacccactagactagcgtgcatcgaagcatccaactagccaaaacccagcattctatacacaccctaagctcgcccatttggcgctgatgggccacacaggcacaaaacaactgtagcttacgcttcaacgtgcctaaagactggtgaccactgaggactgcacatggaactaatgtgtgtagcaattttaatggcaccggcgatgcaaggtgcagtcattggggtcaaattggcagtgaaaacacatgaccaccgacgcctggctccacatcacagcacatccaatttaaccaaattgcagccgctaaaaaggggatcagatggccacaaaagtaaaaccaactttccgtctggagataaaggaaaatccgcaaaaacagacatccattttctccacacatcagcatcaaaccaactcgcatcaggagcagcagcacactagaaaagagagagtaaaacatgcagagatagcacgtttctgctgttctctgattctctcttagctgtaatcagcagcagcatcaacaagggggaggatggaaaaaaatggaaggatggatgccataaaagctgcacaactaccacccaccacaccacctacaatatgagggaagttaaggaggagagcatgatgaacggagaccaaaaggagaacaacggcatcttgtacagcgtactaaaaaccagtacaccatcaccactaccacctcctgcaagaataccacgacgatatggccggcgccgggcgccacgcatcgaccaagaagtagaagtaattagtttttgagtcaatcgaactcgacatgcaacacatgatagcacatggcaaagcaacgcaccacagtagccgggttagcaagcgagcacatacatcaaagcatgtaaaccagctaaagagagagagagagagagagagagagagagagagagagagagagaagaacagtggaagagaggcacgcaaaggtggagcctttcttcagatcgggacagcgtggtggtagggagatcttacgctgctccggccggccggtaccgcgtgttcgtcgtctccaaagaacccatggggactctctttcgttctctgcgagcccacctgaatcttcccccgagccgtcagctatggctctccggtctcaggcggtggccgaccacactgtcgccgccgcggtggagcagcttctcatctgaaatcggagcaagaaacaagggaggattcgtgtgagcatggagttcaccgaggcaaaagaaaacaatccaatgcggccacagaggacgaaggaagagagagagagagtagcaggcaaagaactgaaattttcccgagaagaacagcatcatagtgagagcaaagcccaggagaacaactacacacacacaccaaaaaaaagagtaaataattgataaaaatgcgaagtagaagggagctgcaaaatccaacatcgccactggctaggagcaaggcaacagaaaaataaatctgctagctgctgccgcgcaaaaaaagagagaacccggacaccgaatcgagcaaatggtggcgccacatcgccatcggaaaaaaaaaacccagaagcaccaagcccggatcgagcaactcccaccggcaacgcatcaaacgcaaaccagatcaagaagagcccaggagcaacacaagaacaggaggcacgcagatgccacacggtgaggaagaaggggaggaggatgctggatgcagcagcacacgcacccgcagagaaggcggacttgggagcaccgacgggcgcgccccggcgtcggcgtcgtcggaaatggccgcagttggtggcggccgagtgggttagctgggtgccaccggctctctcactcctctctctctactctctctctctctctctcgctgtgcagagctcgcggccaagggggtgtgaggcagcaggagcgcgttatatacaggaaacaaacggggagagacgggggagaccggagtggaagcgaagttcttcaccgatttttgcccatttttgccgccccgcggggccaatctcgtgtacgtcaagggcccagatttggggatgggctcacggtgattagcgtagtcggtgagaattgttaggcatatatcaatggtggcaaagaagataatggactggaatagaagaagttaatggagaattatgcatgccaaaattggcgtatattcgtcctagtttgtaaccaaatcaaactgggctttattaaaataaagggacaattgtttttttaccctaattttaagactaactctgttttttcgactttactcatttaaccttcttttttttaaacgaagatgaggtttggccctattccgtgaaggcaacgtgacggtgttaactcaagacaaaaattccaattatacccttgtcaatttaacccagtttctcgtgcaaatttgtgtccaccgaaaaagaaaaacatgtcacatggtgcgctgccaccgtcggtgctccctcctctccgcaccaccaccgccggcggtcccttcccctgtgcactaccgctaatcgcccgtcgccgccgtcctccctgttctagtcaaggaggagcagcgccaccgctcgtcctgttcagatcgaggaggagcaacgccacagtcgtcgtcctctaggcccttgtccgacgccgctcttcgtcgcaccgccgcggccctccacccgcaaccgccaccacggcaaatcccttcacgcctcgacgcagccgtcctccctccctcccttcgtggcccgccgccgccgcccctcgtcgagccacggcagcggcccctcctcgacgcgccgctgcggcccacccaccgccgctacctccacccgcagctggtgtcgccatcctccctccgcgagctggcgccagcgcggattccctccctcggaggcccgccgccgccctccatgagccgccgctcctcgtcgagccgtcgcagcggcccctcctcctcaacgcatcgccgcggcccacccacagacgctacctccacccgcagccggcgtcgccgtcctccctccgcgagccggcgccggcgcggattccctccctcagaggcccgccgccgctacccctccgtgcgtcgctgcccaagcacacaggatagggttagatgtgcataggcttggagggcattttggtcattatggaaaataaatttatttcttttatttttttaaatgaaatcttaacggtgctaaagaaacagggtcaaacggagtattcgtttttaaaaagtaggatcaaataagcaaactaaaaaaaagtagggtcatattgataattaggcttcgaaagagggtcaaataagcaactttccctaaaataaaccggtgcaaatttaatggcttccaatatgatagtataacagactatacagtagaataaatctcctacttttgccagagtgtttgtagcacttcgaagtacgaactgagcttagctcggctagttatgtccgtggtagtaaaacatggccacactcgagtttaaattataaacttaacatgggacttgtatttacattaattatttttcactattagcaatatacccgtcaatagtgaaatggttctgatatgcttaatcaaccttcaaatactcgtagaggtaagatgtacttcctccgtcccaaaatataacaactttagccatcaggatttattctaaatataataatttctccaccaacattctcttcctcaccaatcataaccctccatcattcactttttccacctacctctccactaatcatccaatcacaaccctccaccattcacttctagtaacgtgtttaactctaaaattttttatattttgagacggaggaattgcattgcaaaaaacattcgtagcacaaaaatcgttgataaatcttaaaaaaaatcattggctcacaaatctaagtgtgcttggaaattcccgttagagtactttctttacagtttatttcactaaaatattcgtagattatttgttatacgcttctaaaaatgtgtttcctagaaccttaattttgataacttattctaagttatttctgaaagtttattttagaaattatgtagataattcattacattaattcaacgaataatcttcaaaagttgcatgcaagttttcaatgagttgaaaagaaaagcgaaccatgtctctatcaatatcaaactgcatgtgtaccttaggccttgtttgtgattgtgaaacttctaactgttgtattatctttcaaaatctattgcttccaaacaatttcctcgggcaaattcttagaactcatagtggattttttttatttttaaaaagttttattaatttccaaaaaatatttggcgtggcagcgttgttttgccacgcctgccacggtggtgtggcaagacaacactgccacgccagctacgcgtggcgtgacaaagtgatttggccacgccatgacaaaaggttcagatttagaaataattttcagaaatgtctattaataaaattttaaaaaaataaaattctaaaaaataattaaaaaaatcctcatattgatagaattaaaataaataaattagaaactggaaattgggttcttaataacttttcttaaacactcacggcagggtttacgattccgacatgcacttccattttgggcactggcggaattcagaatttcgtgaaatccggtggaaaaccggtaaattccgaataaatttcacaaaccaaaatttgaatacaaattctctgagtttgccgataaattcttgaaaaccggtcggtttaggcgaaattccgatcgaaatcatcgaaatttcgatcggtaatccggcccatgtaagtgttttcctttttttatttttttattcttttcttctctgatgtaagtttaaatacacataatatatcatttttttcgaaaatttatatcccaataggttctatgaatatcatagtatttataagattttatttgattttttcttttttttatcaattcaaatttaaatttggatgaaacttctcgaaatcttagatgatttctactttcgagactcgtcgaaacgtcgaaattttgcgaaatccgaccggatttcgtcggaatggtaaaccctgctcaccggctagcttggcattagctgccttctcaaatactagtgcctaaagtccacagagagcttcctgtacgagtttccatgagtttataacaaggttatgttctaaaacgagtaaaaaaaccctgcagttacggatctgtcctcaagtcttttggtatttggtttcctagccaaggccatcatgctaatcagcttatatgtagtcaagtttacatgaagcatgccagcatggtgctactgctacggagtagaatctgggcgttcacataaccttgtgtaaaatggcatccaagtcgtctggtttgacccacgttgacgggtagatgagatcagcttgacgcgcttaggcattagattggggcaaagcgtctctctgcgtgaatccacgcctaaagacagagctaaacaacactctactctctctaggttggaaaagcttaacccagtggtcattaggaaacttccccgccatagagttctcatcctacccaagattactttacataagcttttgtcactattaacttctaatcagttcagccgtctttgatcgctatgtagttgaaccatcctctctttttgtcctttgctactctacctatatatgcaaagttgtgaccaatgcgtgttctctcaaacctaattcaacgccatgcgtgcatgaacccattcagagatcaaacaatctgcagaaaattccatggtaaacggttaaaaagaaatttccatgtcacaggtatagggtcaaattaaacatttgaaaaaccaaaatttccatgttgaaattaatggatcgatgttacggtaggattaggaaactgcattattcctgaacttttacgtccgtttttttcttcccttctcgtcagacaaacgctagtgatgctgttccaggccgaatccatgacaccatcaaaggaaacggctgtcaagcctggattgacgggggccaacgggcgctttcacatgtcggagacgcaaaaaagccactttgccggccggcgccaacacattgattggctgcttgagacctgttcacaagctagctcatctcgtctcatgagtcatggaggccattacaggttttcctctccaagacgatgctgctaagcgtcgccatgacaccatggaaaggaagaaaaggaggggaataaaaacggaaggtagctagcttgtgccgctcaggccatgaatgcattacacctcgaaactaactaaattctatcacatcgtcttaactcgattgtgggcttaattaggaaactgtcctcttctggcgtcctcccattcataggcgataggtcgttaatcacctgtttcatgtaaacactattgggtattatcactagggatggcaatttcccccgcggggccgggtcctctgcggggacccgcccctacggaggcaggggcgggtgggatttttcacccgcgggtgcgctggggtcggggccccgcatttggccggggaggggacggggggaacatttcactcgccggccacatctcggcgtcgccactcgccagccaccatctcccctcccctcctctccaatctcccctccggcgtccggcctcacgtctcccatcccctccacggctccagctcagggcggcggcgacacacagggcgcggcggcagcgcatagggcggcagggcgcagtggggaggcgagacaggcaagggcacgcggcgaggttgcggcggccggcgagacatgcaagggcgtggcgaggcgacgggcgcagccggcgaggttgcagcgcacaggcgtggcggcggccggcgattcacgtctccaatactcccaaatactctaggcgattcacatgcgaggtattgctccatctccaatactcaagtctccaactgtgccttgtgaatgaaagtgtgcccaaatgcatgggttggtgagttggtctcttaggagataatccatgtgatgcactgagttgataattgtcttgaattttctatgttgattggatgaagatgctacttgctgcgggtccccggtcgggttgcggggccccgcaggggtcggaggcgggtgggatttttcacccgcatccatggtcggggccggggccgggtggtaagtcggggggtcgggggcggggccgttccagcccaacccggccccgcaacgcttaccatccttaattatcactcaaaaaagagggcgttggtttaagtagggatgggcagaaaaagaccgaaccgacaagaccgagaccgagaccgagaaaactggtcatcaatttggtcctgggcagtgaaagaccaaattttgttcagtcaattctgttagtctcctcggttaaacgaataaaccgaaaagaccaaattaaaaaaaaaaggtctaaatgcaacctacaacccactaagttcaataggattaaactctaattttcacatccctactcttataggcatgcaacctaataagagtctttattcatacttgcttatgaattttttttgtgatttttgtgttgaaaatttctattatttctttacatatatgaaaatgttgctgaatttcggtcaggactgagaccgagactgaatttatcggtcctgatatttttgtgttggaattcggtcttcactcttcaaatactgaaatgaccgaaagaccgaaggccaagacagaaatttttggtcagaccgaatgtccacctttaaggtttgagagactcttttggcatcacacgcttcgttacgaaaccgttgttttctgtcaaaatttgcaatgctacctaccgactattttgatctcaccttttatgttctccccttttcttaccatggacacctgtgatctccaaaacgggtggaaaggagatcgtggaagaaataacattagattactcatgttagtagcaccgttgctctctttgccctccaatttccagaagtgaaaaaccaggcgagtgtaatgattggttatgtgggcaccacaagtagcctacaacatcattacacgaaaatacacgaagcctgttgcttgtgattaactcgcaaatatacttgtggtgctgagcaaataaagggtggtataattgtcctccattgtgggcagtggttggcagagaaggctggcttttgttaaactatcgcacaagaccagtggatgtgagctttagataaggcaaaaaaaaaaggcatcgtggattgctaggctcctcttataccatcacaatttaataacatagcctgataagctcatgtggaattaacaaacacagttgcaaagctactgtaaaaaaagtcccggtgttagtaccaactacatgctttcggttaagaccagtagtcatcagtcatcactgggcgctagaaaaacaattcagttgctcgcagagcccacggattaaactagtgacaccccccatatgatctctagctcaaatccatcatgccaccatatgcgtgatgcatctcaagatacccttgcctcagcagccgtggctggacgatgccttgagatcatttagtttaaagtctccggcaacagtaatcacattcagatggtaacactccccattggcccattgaattcttctagattcgtgccccgtgcccactaaccgtacgtcctttatacactgcgagatgtacaaagcgtactactcctactgtagtaccatgctctgttttcccctgccccacgtggagtgaagaagctgggccagtgcgtgtagcagcagtagcagtagtttagtttaactgccatctcaatatctcatctcatctggtatttattcgtggcgtgtatcgcgtccatcacgagctgcctggtcagtttggcactttgaatggaggcatgtgtgcgtctgaccccgaacgggatatggctgtgtggcctcaccatccatccatccatccatctgtgcaaaagtgcgatgggctgggctcatgcactgcactgggtgggacgtggcggtggtggtcacaggaacgcagctctgactatcgcgattcgaccacatttacaccgggcgctgggtggggtggttggctgcctccgccaccgcgcgcgccggctcgcgtctcacgctcgccttcaatgcgtccgcaccggcgcgcggagaaaccactcatcatcatcatcaacccaaccccgtccacgcccacccgttgcggagaaaaagccgcccgtgccgcacgtcgcagcggccgcggcccctctccacacgagagacgcaccggcgcgcaggcgcgcgcagcaacggccggctattacgaggaggaggacgacgtggtgggacgcctttttggcaggtggtgcgcggcgtgacggtgacggggcgcgcgcgcgctaggaggcaagcaaccaagcaacggagaaccgtagccaggtcgtgtgcgaagggacgccgaacgatcggacgcggtcggggttgggggaccatgcgtccatgcggtgcgtgtccatgtggcctcatgggacaaaactcgcagggataagtactggaaggaagggaaaaaacgggactgggtgtctgggtgggaaagaaaaagggaaaccggagagagccagtcacagctcacggttctgagacacatggaagcgtgtagcctaccaaaagggccaaagaaaaaaaaaagaacttaacgcagggatcccctgaaagcgaagtggtcggggtgctgtccttgtccagcctattggttcgaaccagatctcattaattggtgtgtaccgtgattgaaagggccgtaacaaaattcttcccgtgatgttgatgcggcaatgccctttcctctacgtatttcgttttgtattctgcatttctgcgtgggcgtcgctttacagactagccctctcctcccactgtactgtactgttattgtacaggtatatgcaaatcatgcaccaccaacagtatccttgtatatatcatgaaccttatctcgtttcttccttttcttctgctttttggatggaccagtattttctcctagttgtttacaagcaacggagtgcactgatacgtacactcttggcaacacgccattttgacaaacgaagtccacatgtgacgagcatggacgtgcctatctctgtgttggcatttgtcgagctgaaatggattgctcgctgcatgaattaattgttggccaaatgccaaaacattggagcagagagctccgctcactgattggattgtacaccaaacttaattagattctcgccagtaaccgccaactaatcagtggagctgaaagttggcaggatgctgcgatgtccccagaacgttaattttaacatccatttactatattctactgttgaatctggtcatgaaacaaccattagcgattaatgttagcccaccatctctgtaacagttactcctcagcaaattataggcagatggatgccctcctttagtaagagagagatgatgttctgttacagcttctttgtgtcggcagaaatcgcatggctaaa

SEQ ID NO: 65404 - DNA, 3305 bp, Oryza sativa
  unsure (1)..(3305): unsure at all n locations
tttaaaaagtaactagagaaaaattaaaatgacttatagtataaaacggagagaatatatcccttattattttggactatttattacaaatacggggcaatatttcggggccatcccttcttcagataaacgtacacgttgagtcaaactgatgtgcagaactgcagatgatgttaataccgatagctttcatgcctcgaaattgaggggaagaaaaacaatactcccctcaattggtctttatgatgatatcctctaacagccaccaaactgaattgaaaccatgtaagtcattctatcattttctatatttatattgatgttaatgaatttagatagatatatatatatctagattcatatgaatctagatagatatatcaatatgaatatgggaaatgttgcattgtctcgtgtattctacttcattcgtttcacaatgtaagtcattctagcattttctacatttatattgatgttaatgaatctagatagatattcattagagattcattaacatcaatataaatatggaaaatgttagaatgatttacatcgtgaaacggagggagtattatatacgcgccttacatcttttctccgtttcagtcatttgcgtgcatagctgtgtaggtgtgtagaagatatgtttgcatcttcgaaagcagaaaatggcgtgggcacgatgtgataaggcataactagcttcatcttcgtaggtagaatctagctatatatgtaccaactcataataatgtactctaattttgtagaaggaaacaatcatttttaataagaaaataaagtgtgtctagtagtatcctaaaaagtgaaaagggcggccctagaaaaacatattatctgcgatctgaaatactaccaactaacaataatacaatgttgttaaattattcatgcactgattatttcgtgtgtaagcatgaaatctgaacaattcaaaactacaaccttctttagaactaagcgattctatataatctctacaaaggagtggctaaggataactggtgatgacacgctaaaatacgtccactatgctctcagctacgctccacaaataattggagtagaaatctttctccaaacagaagcgcacgacacggcgaattttatccccttttattttttttaaataatttattttaaaaataaacaccagtaaaacttattttcacaattcaaagttccaaaatttctggtcacacgagccccacctaatatggtaaaataacattgttaccccacccacagcggacgtgataattttgttatgctacagtggcatgacagtactacgctgttacaacgttgttacagtcagatcgatgtgatcaaataatgttatcacgttatttagacgggcgtgaccttgttattttactacgacggtctatttagactagccaaaagtttcatatcttaaaaattaaatagtcgaaatgtttatttttaaaattaaaaaggtaaaaagagaaagagaaacgtctctatcttgcattgcatgcccctagtggccttcgctccaaccatccgccgcgagccgagccaacaagccgcccgctcgcgcaaggttacctttcgcgagcttggacactgtgctatacgtaattgaaatgaaatgaaacgcttgccgctgatacgtttttagggcctgtttggttgatgccctcactaacatgcctgaaaaatttaggtgcctgagagctatctgataggatgataaattttacctgctcaggcagcctgaacacttgtctgtttggttgttcttccgcgcctgtgaaaactaaacgtgattaagcttttaattattacggttgttataaagtgttagcaaaaaaaataaaatatttggataggctatatccctccttgaaagtacaaataaaatatatttatatggtcggctgcttttacaatctacagtacctatactacattattataagcggtaattaggattaatgagcgtagctgcgccgtcctggagaaaacggtcgcctgacttaggctaatgaggctccaaaagagctcagggcagggaaggagaaactaaggtcagggcaccaaccaaacaaggtcccggctaatctcaggcttacatctggtcaggcaaatatccttgagagcaccaaccaaacagtcccttacttcacaggagttagcgagtagctgcaacgtgcgcgcagattaatgaatgcaatgcgagacagacaaggatgcgaatcggaacggaaagcaatggcggagcgactctccggccgtgtgatgctattttttaatccattctatagcatgcaaaatgattcttcctagcaggctagcaaaccggattgctgcgagttgtcatcagatcatcgagcactggctgaagtttccatcacattccacgagttggaatcggtcactgtgacagttcttcagatctgtcgtctcgctttgttgctgctctcgtagttttgcagtgctcatgctgagcagtagatcagcaggggttggtgcatcttgtttgcatatgtagctcttggcagccacgtacaacgagccgaaccacccgcccatctatcgatcgacggcgatggcgaccgcgagacgnagnaagagaattccaactgatcaacgacccttaattacttagctatagcctatagggcggcattgcggcaactttgtcgagtcgcatcgctcaccgaccgtaccacgtacgtccgtaacatgacgacgattcactaggaaacaacaaaaagacagtaaatgttcatatcacacaattggcacgttggcatttaattacccaggaaccaggacgcaagcacgcctaaagtttggcgccctacaagaaaggacacccaatctgacgaactctgtggacttttgttttggagcaagcgatcaagctgtgtttaggctcggtaagatcaatgccaatgcttagctaccttgtcaatgatccaaccatatgctgacgaaaccgttgaggtcagcctgatcaagacgagcgtttggcggccacttggattaaggaatgagtttagttcagtttaggtaagatatgtactcagaggattacataattttacttaacaactaagcgtaagactcttctcaagataactgaaaaatcttgaatatgtatatcctagttgatcgtactaaagtttcctcggaaagaaaagtgtcaactactggtcaaactaataatatgtttttttgagaaatacagtacaaacgcttaaataagctaacatggacatgttatcatcggtttattcgtgccacatttt

SEQ ID NO: 65405 - DNA, 3662 bp, Oryza sativa
ccattaaagagcttatgctattgcaagagggaagtagatgaaccggtcaacctatcttctgattactggagaaaattaggggggaacattatcgtaagagatggtttggcttgcataaacgtagcacatgtctttgaagcaaatggattttctctctttttttcagcacggataaaaagcattttctatacggattttcagtcaacctgttaggctgtcacgacgcagggtagcagagacaacagcgtgtgtgtgttgctggacgggcaggcagtcccagcaggtaggagtgtacgcatgttcacaaatcaaacacggggcagcaggttggaactatcgtaattaggcgcgttgttgaagtttgaacttctaagttctggttcaagtcgcttacagttaggttgatctgagctatccgcgcagaaaaataaatatggcctctggctgagaaccatatgcgacaggcatatcacatttgttacacacacgtaaccaaaaacgtacggcaagctcaaaagaaaatccggagtcgtagttccttcggttcacccaacaaattaggttgaaagaccgaattcaaaattctggtaaaataaaaaaaaataggacttgtttactttgctaccattttcaaaaatactttttttttcaaagttttaaaaaagtggctatatggtttgttgctaaattttagtaagcacatataaaatctccaaaatttaataaccttactaaaattttaacaaccttatcaaaatttgacaatgtcaaaacttattaagattgaaaatagtagcaaaatgaacaagtcttcagtgactaacggtaacgcagcacaatcaccgcgttgttcgtcattttcggcaagcaggagcgcacggcagcgccacctggcaatgcacgagcccgacggctgaccaacacggcggcaacttgccgcactcttccgagctcgatctgatccgttggctcgcttttcggcgtaatgtgcaaccccgttccattcggacaagacgtggcattctcaatttctccaaacacgacaccgcctccgctgtgccaccgtacggcagtaacatctaccgccgccacacgacgaaagcctgacatcgatcgatttcaccggactcacataggatcggccgtactgtaccccatcggccgtcggaggcaaccggaaaccggtcgaccacacgattcaccgacggacgggccagcggcacagcgccgacggcaacgccgcaccaaacgcgcgcgaggagcgagagaccattccgtcctcatcatgccgcgtgccgtcggtgtgagatggcgatctgatcgcgtcctgccggctgccgcccatcgtcgcgcgggggcggggggggggcacacgaagacgggcacacgcggggcggtgcatccgtacgtgcgtggcgcgcggcggcatgggaatcggggataaaaaaatgaccctccaaaacgcgctcggctcccggacttccggctccgcagcgccgcgtgcgttgcctttcgcggaagggtgatcgtgaaccgcgcggcctgaatcggaacgcgatcccagattgacccagcaccaacagtccgggtgcatgcgtgtactcttagcacgcaagtaaccagaggctgatcaacgtagtcacgttcgttcagacaataaaattatcggaacgaatcgagcaggtgaaaattaatccgcgtcgtcaggagtccgggcccgtcaagaccttgcgtggcacagcaagtctagtctagaattcggcacggaacaaggaaattaggaaagcgatagggtctccactgtctctgtcctaagttgacacgggatttatttttgttcgttttgtgattgtaaggcaaacacaatcgtatgaagcacctctgctgccacacagaagtgctcctccaagaatacaagttcatacttgaacccggactcctagtgtaagttaagatctagccagctgccagttcttttctctataccttttgagcatgttctgttcgccccgaatacccatgtttctctacggaacttttgccaaaccatgtacttgctgctcctgcgatcacgtgttgagtcagccaaaaaaaaaaacgcagctgaataaatacgataaggatgtattaaacttggtccctatgacttgcgacaagtactttaaaaccgtattgttaattttgatactgcagatcgcagtgagttttaaatgaagaaaaccagggtggtgccaaatcactttcccaggtacgaatcaggctccatgtgtttccgataagagcgatttgagcgcttggctcgtccctcccccttcaattcgttgtcacattgcacgcaacttgccaggaatctgatccggtttaaacttctctcataggcctagattctagccatgtatgtgtttgctgtccaggcataattgcctgtgagggctccccacgtatcagatattcagatctgcctgtctcgttatctgacaagattaatcattttgcacaaaaatgtacaggttcgtatatagtgctaagctatgattggttttgttctgtttagcctaatagtatcatttgctcgcaccggtcaggaccatgcatccatcttattccatctgcacagaacatgctggggcagatgctgtttgatcgaacggtttcagtacaaaaaccctattctctttaatagaagttaatgatcaatccatcatccggattactaacagatatttgaccgagaatcaaaagattgacggctcggatggcgatgccatgtgataactgacaatactttactcctactactggagtatcagtctctcctgtgttcaggtcacaatatttcgaggtacgagattgatgctgaacaaaaaccatttgggggagtttgtgtacggtggcatcagtatcgtgtcgaccgagaggccatatggttgatcacgagaggtgatagtacactgtgccgatcgatcgtaatattcgtatctctgctccccccgatcaatgaataagcagaccggagcgtcgttttgcggtttgattaaactagtgtggctgtggtggggggcatgaagagcagcatcccgatctgatttactcccatccatgggcttcccatcccgtagattccatctgtgacgcacagacaaacaatgctaggtcaccaccgcgaccgccagcctgtgtgattttgctcatcagtacgatcgacatgtactactgatactacaactagtattaccctctggatacacttggatgctctcccgggcagctggccgtatgccccgtatcgctctctgcgtttcacgcgtccagccagcccgccagctaagccggctgcccatttggcccgtagtgtgcaggccgagatttgttgggaaaacacttagtgcaaatcacattttagataataaaaatatattacatcttcaacttctatcatagacacactgtcataagtttaataaaaaaaagtaaagataaaattaaattaaaatgaagaataaagtgatggaacaaatccacaactcccctttattattgactagcgttaaaccatatagatttttagctaacagtagaggaacaagagacccttggcttccgattctggtagtgtagcactattgcacatagtatcttgctcctcctgtggtaatatcgta

SEQ ID NO: 65406 - DNA, 4850 bp, Oryza sativa
ccatcccgttctttgtttatagcggcagagctcacacgaggtgtggggctgtgggctaaaagtcttataggagtatattactacttgaaaattgaggtttaaactgaacacatcaattcgagattcggtacgtgtaaacctaaagttagttgaatgccagtactcttgtcaaacaagtgaaagcccgagatttgcggaatgtgaaacaagaccgttaaatttagctttccttttgaacttttgatttagtcgtgcaggctgtattatgcatagcattctccgcacggcaggggaccgaacttttgaaccctgccatacgttatggaaggtatacaatcataccactagtcaatggcaaattgatgccgagctatatgaagtacgaatattacgcaacgtacactcgtgcgtgcttatggtcaggccagcctaacattgcaaaccaaaaataaggaccgaaactttaattagagctgggcatcgtgacaaaaattagttagtttaggtactagtgacatctgagagacctaacggaatagaatacaatagccgtgaccgtttcaaacttcaaaccctcgtggattgggttctggagtcgggacgcatgcagattcgtataggtcaaaagtttgtcatcgtacagtagtataactcaactaggaacatgaagacatgagcttaatactaattaagtacgagtagctataaccctccatctggtcttcaactaaaagttctgggcaacttgaaggccttggagtatgagacttggcgagtttatcctatccgctactaggggctactagtactctgtctgactcggcttacgtagtaatttcgatcatcaccatgctaggtgcactttattctagctgaacatgcgtgtatacggcatagtactgtggtagggttctatcggtgatcagccaatctgctgttgacctagcaaaggtcaagttaatatactccgtacagaagattagtacattgtgcaatggaacatggaggttttacacttttactccgtgaaacagaagtacagaagaggcgtcctgtagccgtttacactttaataaagcctattggtattgctgctcttccctgcatgcaggggcgatggaccaaaacgttgtccaagtgtaacagtacatgcttggttatatcgagaagttgtacgcagcaatacgtttcgacggtcgaataaattcccacataatgtttggagtaccacgtttggcagaatagggttattcactgttgaacataaagtgctgtacacttcattacttttacagtgtgtgtggctcttcacgtctcatcaccacgtcggtgctatgtacagtgcctctcccgttcctagccagcttttggttgggactctggtgtacggatacacaattgacaggccattccaggtaggtcgcttttcgttcttttttctttttcgctccgccgagggggcctcgctgccgcgaaagcgacggacatcgcggcgaattaacaagtccccgagagccggaaaaggattgttcttcgaggccgccacatgcgagcagccgatggttccttctcgtagaccaactccaactcaccgccggcgtctcgcgttggtttacaaccaatgagatactactagtaaaatcgcagaatccccactttcgtgcgaaaggcagaggcgagcgcggacttttgtgggggcgaagaacgagaaggctgcgacgcgagggtggggggaaatggtttgaagctttggacttgtcaccccggcgcgcgtgctgcatgcggccgctcgactagagagtagagaacatatgaacgctttgtgtttgtggcctggctcgcttgttgttacgtggaacgcgacagcggttgtagtgatttggacctggggacatacgactagcttgggccggtaagacgacttttaacttgggccgatgtactgtacaagttttctgaaatctgatgtgcgggattatacggtgtacgtctacgtgggaagcagtataagttttctcaatcactcgtagtacgcgtgaaacgtagtgtaacctcagacaacctggtgactctgtgccgcagcccgcaagcctgcatggtgaagagattcccgtgatgaactgatgatgcaatgctctggaggcaagtacttctcgggggcctaccacgcaagagactgttactgacatcaacagggaggtgacgcacaggtgcaacacactggtggtcgtcgtcggtggagctcatttaaagttaggggctgtgctgacacgttgcgctggttggcacgcaggcaggcctcccacacggaacacgcgccagccgcctgccgaccgcgagtccgcgacgcacgacggcgtttgacgccatatcctactccgatcctctccgcaccgcgcgggccagcgcaggtaatcactccggggccatcctacgatggcacgaagctctccggattggcgatagcccacgcattagcaggccgcacggcctgcacgtaatccgcgcccaatctactcgctccacggcccacacagatgggccgcaccgcacgttactcgcgataacgttccaactggatttggatggtcgcgtgggcttgagccaaacgggaaaaagttcatcatttgtccctcaaactagtagtaacttttaggaataagttccccttgtgatcctcaaaagtgattgactccctcagtggttttggagggcgttttcactgacgtgcctacgtggcgatattaatgggtctttgttccacgtggcgttgacgtggcacttacatagcattagaattaaaaaatatatgtgggactcgtttgtcattcacacacataaaaatttgtggggcccactgactcctccctctttcttcttccccctcttccacgcggcgagggctggagcggcgggactcagattctgtgacattgccatggtatggcacggtgtgacattagagcaatctggggcgttgaaaataaatccaagggtcctctgcgccggcccacctgcaggcctcagtttttcaccccgcattgctccgtttcctgcccgagcgtgctgctcgcgaatcccccagaaccaccaccgccgccgcttggaagggggccggtgccgccgctcggaagggggctgtcgtcgcgggactccagtggggccgccgccgtgggccgccgcgcgcgcgtgtcgagatggccgcagtggccctgccggcacgagtagaggcgagcagcggccggccaccaggcctaccctcgtgcggtggcggctgcggatggaggctgccgagccagtccaggcagtcgtggtgatctgcagccgtggcggaccggcctcatttttcttctgtgatctgcagctcagcgcgtggaggaggggacgtcctggaggccgcactgcccttgccggccgcactgcccctgcacaagcatcagcctatggacatcaaacagcttctgtttgttgcatcctgactgagtttgcttttgatttgttcttcagaacaactcgctggctcgcggcgacggccggacccgggcgaggcgaaacgggatgggttggatcggcgggcgccgactcccgcgggacggatggatcggcggctaaatttccgacctgcagacgggcccaaccaaacgagctgttggatgtgtttttgatggcagagatcctcacaatgtcacgttgtgacatgccaacacaaagtcacccaagctgaatccggagcggcggcggcggcggcgaacaaggtcagcattggcgcctctgtgtcggccgacgagcgaggccagtgtgtgggccgccgccttcgacctcagcctccatcgtcggccgtcgatgacgctaaggacaacccccgccggtcgacttcctccacgatgccgaccccatcttgccaagcgctggcctcgccatcgtcgactcctcactccggggaccgtctggccccatccctgcacaagatgctcctcatgtggaacgcggcgaggcccgtgtccacgcctttcttgagtagcatggtggtgacgcacaggatgcgctcacacttgcctgacatgtcccagccatggaacctcagaatggcgatgtcctcctcggcgtccagtgaccttatgtactccaccatctcctcgctgaatggctgcctacactgcggccagcagagccactcgaatgtgcaatcctcaaactgcacatgcgtgatcgatgcatgatcaccaacgaacaaaatggaaatcaattagctagaagaaaatctatcagcgtcagtgcttacactctcaggaagacagtatccattgtcgattgtaaccagggagaggccatggccttgttcgtctctgcaggtgaggatgttgccagcgtgcatgtcggcgttggccagcctgatgtccagcacgcaggtcccatctcgccgagcgctggcctcactatcgtcgactcctccactccggggactgccgccaccgccggaggaggggtggcgaccacctcttcatcacgccgaggtccacggccatcgcctcgaaggacgagctccccccgcagcctcagcctcagccccgtcgcagcaccgactgcccagcctcatccgctcccttgtctccatcatcaccgtcgccatcgaccgggtggacgagctccctgcaccaactccgtccaccacaccggcggtgctgccgctccagaacccatatcacctccagcccaccgccgccgccgccgctccagctagcttgttagcaataatcttgtctttagagtgtatgcatttggtttgtataggttttgcacaaggtagtagtgtgtggcagcaaaggatccgagccagtacgtgtgaaacg

SEQ ID NO: 65407 - DNA, 1598 bp, Oryza sativa
agaaaatggtgtgagttgtgattagccacatcaaccaaaagcctgtgtgttttgttcagttcttgtgtgtttgtgtccaccgagtaaatacaagtgtttatgttagtgctagtgattagtacttaaacattcagagaggagagattctaacaattggtatcagagccaatttatgcccaagatcctgcgcttcaacaagatggccatcgtcgagcactccgcatcgcgatcgatgagggagggcatcgtgtcgctcccatatccagtgctcacctccaccaactactccacctgggcgatcaagatggaggctaacatggaggcgcaaggcatctgggatgccatcgagcccgcggccgatgaggccgtggacattaagaaggacaagcaggcacgtgcgtgtctcttcggggccgtccccgaagacgtgttgcagcagatcgcgaagaagaagactgccaaggaggtctgggaaagcctcaagacgaggttccttggcgttgagcgtgtgaagaaggcgcgagtgcaaaccttgaagagcgatttcaaggcattgcacatgaaggacaccgagtcaatcgacgagtttgccggcaaaatcagtggcctggcaaacaagttgagcgatcttggtgtaaccatggacgatgatgagcaagtcaagaaactactcgattctgtgccagataagtttctgcatgtcatcgctgcaattgagcagttctctgacttggacagcatgccatttgatgaggcaattggtcgcctcaaggcatacgaggaaaggatacgcaagcgtgatgacaagaatggcgagcatctacttttcacgtccggcgacacaagcggtggccgcagccgcgtcaagaagccggacaggtccaagacaatgtgctactactgtcaagaacttggacactttgcgtatgagtgccctgagaaaaagaagaagaaggagatagcgctccttgccgcagcgtcaagtgatgaggagccaactcttctctgaatgaagcatgccaagattaggggggtaaatgttagcaataatcttgtctttagagtgtatgcatttggtttgtataggttttgcacaaggtagtagtgtgtggcagcaaaggatccgagccagtacgtgtgaaacgtgcttgctgtgagctgtgcgatgcggccggacgaacgtgccgatatctacgatgtgtaaaggctgttgcattagcatgtagaactagtgattagcggctgcatgcaagcatttagttggatgtgttaagatgcatgcagagctgcagctcaagctggaaggccacgaagtgattttgtggcggaagaataggtctagctagttaccttgttgcatggcatctgcatgttggagtaaggcgtgagtcaaggccaaattagttggctgatccttatcttttgcatgtacttaagtctatgtaatgaagaaaatggtgtgagttgtgattagccacatcaaccaaaagcctgtgtgttttgttcagttcttgtgtgtttgtgtccaccgagtaaatacaagtgtttatgttagtgctagtgattagtacttaaacattcagagaggagagattcta

SEQ ID NO: 65408 - DNA, 782 bp, Oryza sativa
attaccggctgcatgcaagcatttagtgggattggttcagatgcatccagagctgcagctcaagctgaaagcccacgaagtgatttgtgccggaagaataggtctagctagtcaccttgttgcatggcatctgcatgttggagtaaggcgtgagtcaaggccaaattagttggctgatccttatcttttgcatgtacttaagtctatgtaatgaagaaaatggtgtgagttgtgattagccacatcaaccaaaagcctgtgtgttttgttcagttcttgtgtgtttgtgtccaccgagtaaatacaagtgtttatgttagtgctagtgattagtacttaaacattcagagaggagagattctaacatagctcccgcgtcagctcccgctgccgccgccggttcagctcccgccagccgccaccacaccgcggcccatgccccgccgccggccgaaggggaagaaggggagagaacgaaagagaagggagagacggaggaggaagaaggaaggaaaaagtccactttgactcccttaattatcgacagaatctaattcgtgatcctcaaatcgcgaaaccggataagacgactccccgaactattgaaaccggtgcaatttgactcactcagtggttttggagggcggttttgctgacgtgtcgatgttgacctagtcttcatctcacgtggcgcttacgtggcattcgaattaaaaaaatatatgtgggacccactgacatttggggcccacgtgtcatcctctcttatctaccttcttcaa

SEQ ID NO: 65409 - DNA, 4551 bp, Oryza sativa
gtggctaaaaggagatggtatgattcttatatttctgctttttgttgtgcaacacattaatttggtctttccatctaaatcgcgtcgatgtaacagactttttattttccacaaagatgaactttcgctacccaaggttccgaccaatttctatggccacagtatttaaaagttttcgcttggtattttatatacatataaggagcatatgtaaaagtgagagagtttgctatctatggaaaacagtagttaaatttactagcatttgcaagttgcaatcatgcatggaaggatggaattgcacattccatatatatgagtaaatttcacagaactacatgtactttaaatcaaattatcgtaaaactatatatttaaggtaatgtgtcacacaactataaatttaagaccaagtttaaaaaaactacaaatttaataacaaaattatcacaaaactatagggtatgtagtttacatccttacctctaatattatgtttgagttataattgttcaaattttgtgattaaattggtgtaaaatctgtagttttgtgataactttgttactaaatatgtagttttgcgatattctaccttaaatatgtagttttatgataaatttagtgttaaatttatagttttgtgatatatgttaaatctgtagttttgtgatagtttggctaaaatccatatagttttatgaaatttactccatatatattgaatatattattgaatgttggctcctatcgtgcttttctcttctgagggactcttgtaatgtatatatgtctagattttggagtaagataagtttaaataactctttctttttcgccttgatcaagacattgcatcaattttgtaaaaaagaaaggatataaggaatataattacatccccacgctatatagctataggacacatataaccataatgtttgaataaggtgaatgaagcaaatacattaatgctttccatgaaacacacaaaaaaaaccatgtattttttatcacaataattgaacaatttctgcactatttctttagaaaatcatgcgatccaactagggcctacacgcacatttgcaaacggtgacatctattgccatgtttattctaaacaaataactcttgtttatcaagaatctatgttgcaccgatcatggtttgaaggtgcaaacatcatctactccctttatccaaagataacggattataaggtgtcccccataaccacctctaattcaatgtctactcactattacaacttgtgggccttgcacttcatacatacctgttttttaatgagacgcatcataatgatgaacctttgaccctaatctgtctgctatgactacaacatactgatctcttgcttataaatctccaagatattaaataaaaaatataagtaaggcttcaagttgaataaaactctatatctattattataattctagaagttatttaaaaactaaatttagagtgcataattagtcgacatggtattgttaattaattactaattactatagtaaaacgctggataccacgaagggacatggtagcgatcaagagaggaatgagcgctctaggagtcgaacatgagacgtgcccgcgctccacagcagccccttttgccacctgcactagcacgcagtctcacttcctaaagtatcaactatcaagtaaatacattggaacattaaaataataattgataaaggtactaggatgattctatatacaatttagaattagactacatttgagttttgtatctataaatgcaattatattgtttattatatattaaatggtatttaaatataatccccaataaataagataactgattaacaactaatattgttgttaacgcgaaaaacacgcaatggcctaagagatatgcttaactctagtgcaggtccaaagaaattgccttcaggttctcagcgtgctagctggtttgattgtgcaaccaacaagaaagaaaaaggaaaaagttaaatccaccaacgatagcagatcggctggattgccgatgacgtatcttccggagccatgccgatgtgacttgcatcggaccagcaagggaagataaaacgtagagattattagatctacttgattggctgtagatgtcaatgatacatagcctatccaacgaaacacacttagatcgggtgattgggatagatcggatgttatgccgagacagtataaatcactcaatatctaactgtacctcaaagcagaggttacgtaggttcatagcatagttgatggggcaaacctaacgtgtatcggctagtactccgataccgctttatactaagatatcagcgcagataaaatatacaaaacaaagatcaatatggcaagcagggtgcattaacaaattgatatatagaaagcctaatatgctttaagcgaatgagatcttcatataaagggcagatttagacgatcaagaaccgggtagggaaacaaaacggctaaatcaggtaagatcggctgaaaccccgatactatctctattagtaatcaaagaaagagctagataagacgtctcaagatagcacttaacagatcgaacctaaccgatgcaacattaagcgtgaaaagaaacataagatctaagcaaatcaatgagaactcattcaagatggtagatatactgcacaatctagcttggtgtcgatatctaaatttatcggccgttttcgatgatagaggctagccgatgaagttagatgacgaaatctatctagattatacagcatatatgataactcggtgaatcacataaacaggattagagtgtcataaagatgtaagcactaatccagagaacacaaaccgccatagcaagctttacctctttgtcggagatcgaacccgatgtagcccaactcgaaagcaaaaactcgtcgaaacaatgagaatagaaaagggtggcgatgcgccgaagtattattgaactgtcgttctgtgattacaaggtgtcaggtcatatttatacccgaagtcagggccggcccttgccctatgcagccaaggcgaccgccgggggtgggggggcaacacctaatactagtaatctagtaccttatccgatgttgagatcaatgatttttattcagaattaaaggtattgcaagtgagttttctaaattcttcgatatgatgtccgcgcctgagattctgaaatttgttatgaatgcatatttctatccaaatgtttcagatgcctattgaattctcttaaccgtacctgtgacggtagcttcagctgagaagtttttcaaaattgaagttgttgaagaactatttgagatcaactatgtcacaagaaaggtcaaatggcttggctatgtgctcaattgagaaggatatatcggacactattgatcttaattccgttctggatgattttgcatcaagaaatgcctgaagaagtatctttacataggaagcagtggatacgatggggttctattcttcattaagttaatgaataatgatattagttccaagtttcaaatatattgttattttggtcgactttatttcttaataattaccaggcatgttaaatttaatatatggatgtattacaagaatatgcggatgggccaaaaaaataaatagtttgggccagaaggaaaagaaacagatgtgagaaaaaggaataagttcatctaaggtcccttaactttcaacgaatccgattttcgtccttcaaccacaaaaccagatacaacgggtccctcaactatcaaaaccggtgcagattagatccctcggcggttttgaaggcggttttggctgacatagcacctatgtggctagtttgacttggtcttgatctgacgtggcattgacgtggcgcttacgtggcaattcgatccggaaaaataataaagcccgtgggacccacatgtcagtttcacatagaaattaataaaaaatggtggggcccacgtgggccccacatgtcatcctcacccctcttcttcctcctctctcccaatctcccctctttcctcactgaccggtggagcggggcgatggacggggtggagcggggaggccggcggagcggagcaggttcgcgggcctcactgaccagtggagcgggccgatggacggggcggagcggagcaggttcgcgggcagagcggcggcggcggcatgtcaccctcactcccctcttcttccacctctcaacctttttgtcggtggggagccgacgcggtgactgggcatcggcggcgcgccggaacacaaggcaacgacggcgtggaggagggtggtgccgttggcgcggcaagggaggtgctggtgacgatgggggcggtgggagaggaggagagcgtcggcaacgcgggaaagggcgacgaacggcgcggcaagggaggagttgagcgggcgggtggcgggagagcgagagagggcgacgggcggcaagggaggagctgagcggcggcgcgcagcgggagagaagctgggcggctaccgccgccgccgaggagggcgtcgcaa

SEQ ID NO: 65410 - DNA, 6077 bp, Oryza sativa
tccgctccggccgccccgtccttcgcccgctctagtcgtcgccgccccgctccaccggtcagtgaggaaagagaggggagatggggagagaggaggaagaggggtaaggatgacatgtggggcccacgtggggccacgtaagcgccacgtcaataccacgtcagatcaagaccaagtcaaactagccacgtaggtgccacgtcagccaaaaccgccttcaaaaccaccgagggacctaatctgcaccggttttaatagttgagggacccgttgtatctagttttgcggttgaaggacgaaaatcggattcgttgacaagttaagggaccttagatgaacttattccgtgagaaaaatatttgggccaggagacaagaacatccggatgggccaaaaatacagtttgggccagaagaaaagaaacggatgtcaaaaatattaaaaacaaattggcttcgcccggactcgaaccggagaccttcagtgtgttagactgacgtgataaccaactacaccacgaaaccgatgttgtacttcgttgaaaaatttgtttttaatattattttagtacccctaactttagttgctttcagaaataagttctaaatacaaaaggtgctaatactcataattgaattctttcacccgaaattcctatatgctatgcttgacgatcccaaccggaataacgtacacagttttgtccataggataaccatactcctcaagtcccatttgctaaattcagaggtataaaaacagaggggcttgtactagtagtagtagcttgtaacacgacagccaaattacaccagcaactagtacgagtacagcaacaaaagtagtaggagtagtactacatgcataatctcatcggctgcatgcgtccatccgggttcagagctgcgtttggaagatggtgacgtggcgcaggcgctgcgccatgtcggccaccgagcccaccgccgcgagcagcgacacgacgagcgcgccgacgttgagcgcctgcagcgccacccacttccggctgcctctctgcaccttcgcctgcgccatgtacatggtcaccgggaagtacaccgtgagcggccagaacgcgacggcgccgagcagcccgagcacggcgttgaagaacggcagcaccagcgacaccaccgtcgtcacggccacgaacgccgtgcgcagcaccagcttgcacagcgtgaaccgcaccgcgcgcccgccgcccagcggcaccgcgtactcccggtggaagaacgccgactccggccaacggctcgccagccacttctcgtagcacgcgaacaccggctgcgcgtacacctggtacgctccgaccaggtggatgacgacggcaacgttggcgatgtcgacgagccagaacggctcgaggaagccggtgaggacgttcccgggcgcggcgttgccgaacgccgcgtacccgacgcacccgatcgacacgtagaagacggtcgtgacgccgatgccgtacaggctcgccctcttcatcgtcacgttctccgacggcggcgacttcaccgtgtcctggatctcgatgagcagcatggagtaggtgtacgcgaaggcgatgttcccgagcgcctgcaggaagtgccacgccttggtcgacgcggtgacgcctccggcgccgaccctgacgccgaggagggtgccgtgcgccgcgccgtgcgacgcgaccttagcggcgctgaggaagagcccgacgaaggagtaggtgaacgacatgacggcggcgacgacggagatgagcgtcaccccctccaggctcgggcactgggacaggacgacctccgcgaggccgaacagcaccatgtacatcgtcccggacgagccgcaggtcgcgtccggccccttgtagtggtggcagttcgtgcgcaccactgacctgcattctcacggcccaaatcctagtacatgttactgaacaaaaatttgccaagatttttcagggtggccaagaagctggagctaagcttacatgatgctcgtagcggtcgtgatggtgtaacccaccattgcgccccagagaatcgcgtactgcgcaatgccacacacgaccacgtctcgaggcccttcacacgatcgatcaaagcaacagtcttgtcagaaatcgcagagattttgcaggagaaaatgcaggtaagtctcaaaggttcttagctaccgaggcatgagcggacgacgtccatgtaggtgtagttccgcttgccgtggacggggtccggcgtgcggtagcagtcgcagaggaggacggcggtgtagtaggtgatgtaggcgcagacgacgagggcgatggggccgagcacccaccccatctgggccacgctccacggcagcgccagcacgcctgacccgatcacggcggtgatggcgtgcgtcgtcgccgtccataccgttcctgtgaaaaggaaacaaaattcagtttcgtcagtgccattcttgcgttcttgtgagaaaaaaaaaatcctgtgagaatgtctgacaggtcactgtcatttacattacgtgtgacattcttgccttcttggtctcttggaacacctggctgattaagcatgaacatcaataaagatgcagtgcattgaagagattgccatatcagcgcggctaaaaagagatcgccagatcatagatcaattacagtgggcatgatgcaacattgcacaagtcaacttcccagtagtgtaagaagccatcattttttcaaaaggatctccaggattccatcatgtgtcataaacaaagaatccgtttgatctactgcccatgcgctggataccataacgtaaagcagaccaactaacgagtacaaatagagcaacaggttcatatattacgcatgtgatttaatcaccatgtcctaaagcagtaacacttaaaacaactaaagaaatatttgctgtcttacttgtgttaaactaacgaatcatcgcaaatgtataaacagactcttttgaacaacgtaagcacgcacatgaatgaaaacacttatgtaatgctctggtggcctatgtggagtatgatgtggtatcccaaccaacatcaacatgcaaaggaagtatgatgtgaaatcaggcacttgctccctgatgtaaagtactagcagggctaaagtacagtcaaacttttgtccagtaaaattccttaattacaatagacaattgccccgaaatcctattatttgacatgagtgtacttatacttaactggtcattgtcaagactgcttaatggcccgctcttcatcacagcctatgatagctagtcacaactcacaacagtacacccaagataaccagaaaaaggaagtagtagtacaacagaatatgcactatgttttactttaataccatgaaagctatttgtcgaattaggatgcgtgatgtaagtggagagagcacaagctgcaggttaatttgcagccattcatcgatacctaatccattgctccctcacgcgaagaagaaacgttccaataggctattgccaacaaatagtgttttccattgtttctgggattccaatataacattaggataatgattgcacatattgaaattctgcctataatcctggagtattagtactgctgtaccgtataacactagtaaagccaaggccacttggacttggtagggtatatagtagagtagaggtagtgcctgccaagtcattggcgatttggatcttgcaagaggttgcgtgctgtaactatatggaattaggacccagttcctgcataaatactatgccactaacactgttactatccttcacgttgtcctagtaaaagcagtggtaacagaagcttcacgcaatggatttcgcattttcaggtgttggttttatccaataatgctagcatatacgcaagatgcctctattaaatctatcccgagtttcagggatgttgctgcaatgctgtgacgagtgttgtgtgtaaaacagaagaaagaatatgtgcgtattcgggagtgtagcatctcattagctagacatgcatccaagaaacaagacatgtaaaaggggacaactcttttacatggcatttctttaagataaaacactaaaataggcattgaattcattatatggcagtgttaataagagaagtgtaaattccctgcctctgcatttgcagtgtgtatttgtttggttcttccagtacggcgcggcgtaaacaaaatggaaaagaagggtttgactttcagtgcccatgcatgcgtgtatgctccatcagacggcttggacagcaaaatcatgcattgactaattccaaatcttttttttttttgcatgtacttggagaagcaaaacgagagagtcctacaaggtttcgaaaggatgcaagacaaccgcatgttccatagcgcgctgaagtctgaaagcgtctttccactgggcacacatctggctagctctcacttgaaagagaggcacaagtcaataaccaccctccaacgtacgccagcaatgcacgtttctgtccaaattcagcaatgacagaggctcgcagatctaccacactcaacggtatgtggtgacaatgaacatgcagctaaactacgatgaacaacggaacagagtttcagaggaaacagcagctaaatactctgcatgaagcatgaactgttcaggtgccttcctagcagaagaaagacaggcagggtagccgtaggatagtagtaggattttcggcgacgacgacgactgtgcaaacgcgaactggaaacagagaggatcctgagaattacctgttctgacgcggccatcgtcgtcgacggccacctccttcctctccaccttctccacgtccatactctctctgtgtacgagtttccctctctctcagtctccggcctctcttatctgagcggaaaggattttgagcgaattctgaagcctgtgcgctgcagctatatatagagctggcgagcttttgcacctgacctgtttcccactgtagattcattcttttaatacggtcacgaaaccccacgaatcctactagtacctcagagtcccctgtagaaaatgaaggttttccacgtcatttttttagtagcaataactaccaccagattatatgcctgttacatttagttgaacctaccaaggtgttcacaaaggtgcagaagttctggtgacttttatgaatctgattagtcaatttgggatgaatctggttggtacttgcctactacattcattccataataattatattcttaagattttatttttcctaaaataattaccacgatagagtattaatatcatcaatcacttattcaattttcccatattctattttcaaccattctctcgtttttatatgtacaccatttaatgaagcgagcattataatctttcttttcaaatcttaatacgtagtacctgctaataaattataattataattattttgggacggaggtagtactttgtaaccacatgattgaaaaatctgaactaataccttctgcagttgagttagtgagcatgttatccgtctgattttggtaatttctaaatatccctgaagagaagacagtgatgctgatgatcattcaggtggtagaaaatgaagtgctggacatatctcagcctctcaggggctcagggcttgacccaaaaggaaagccatcttctgcttcatcatgcggccgccacgaagcacacattgctacaaagctgcatgaatcatgagattgctgctcttctcctctcatctatcatcgtgagatcatcgtccatctcttgacgccaccaaaagaatttcaggttcagaaacaacaaattgtttcttgcgattcactggaaaatcaaacacggctcgtaattcacggccggaaaccatcaaagtttgctgcgtggttccaaaaccatcaacattatgtacaccctgtaatctgcctatatatggattatatttatggatatgtgctgtgtgcaactgtgcaacagcgtgtctttgctagctcgtgccaacgcagccaaacagcctcacgtgtcgtcatatccctacacacagtagattcagggctggtttggttt

SEQ ID NO: 65411 - DNA, 4745 bp, Oryza sativa
gtgccacggcccaggcccaggcccaggcccaacccaatcttacaaaaaaaaaaacaagtaaacaaccccaagccacggctccgagaaatacaaacacgaacacggcacacacgtctacgtgagcccacggggattattgttcgagtcaaatatgttacaagcaaacacgtggttgcatgcggcgagccggcgtgcatcgcgtcgaccggttttcagttcttggcggtggtgaagcggtacgaggcgtaggagagcgaggcgttgctccagctgcggtggatcagctccgccttggccccctcaccggcggcgccgagcgcgacgtgcagcgggaggaagtggtcaggcgacgggtgcgccaccctgccgtgcggcgccttctcctcgtaccgcttcacgtcgtcgtgcctcccgccgagcagcgcctcctgcagccacccgtcgaactccgccgcccactgcggcaccggcgtgccctcgggccccatcctgcggaggttgtgtgtcgcgctgccggagccgaggacgaggacgccgtcgtcgcggagcggcgccagcgccctgccgagctcgtagtggtacgcgccgtcgcggccgctctgcagggagagctggcacaccggcacgttcgcctccgggtacatgaacatcagtggcacccacgcaccgtggtcaagcccgcggctgtggttttccttcaccggcccgaacccggcttgctccagaagctccttggtcttcatcgccagatcaggagcgcccggcgcagggtacttcagctgtttgcaacaacattattcggtatggtcagatactgatgcgatcatgcaaatgcaacgtcattattcagaagggtagatactgatgcaatgaaattattcagtactatggtcagagatactgatgtagtgattacgttatacgcatataccttttgcttccaggaaatataacgttttccatgcatgatgcatccttttgagcggaatggatttaagttatagtatgatttagtaattgtttggttgcatataagaaaagagtacaaaatctttctattgaaaagttatcatacgccaacaatgaatctaccttcaaccacacgactacaggagcatatatgatggataaatagtactccattcgtcttaaaatataataacttctagcacttaagatttgtcccaaaatataaaaacttcttcactaacattcttttctcaatcaatcacaattcttcaccattcaattttcctacatacctgcacttctctctcccatttaattctgactactttcttaatacttgtgtccaacactaaaaattcttatattctgggacggaggaagtagcacatacttataataatgcatatatagtacctaactaaatacttatgagtagcaactttccttcgacgaaaaggaccaataagctactagatgagtaatcaaatccttatggtgatgcatatatactacctaactaaatattttgtacggcagctttgatgggtgtggtttctccgataacaggttcacccaaattaccagagtacacacccatttttattcgactggcttaaaaacaattgcgtaaatatttactcttggccatcataacctttactagtaatatccacaactatcttatggtgtatatgctagtccttccgtcccaaaatataagctattttggtgaatgtgacacatactagtattatgagataaaatcccttatattttacaacggagggagtaactcaaatgctgaacagagtaatgaaaatgaaactaaatttaattagccatttagacatagctcacagcaaaatccttgctgactgatcgactgaacgatccggcagatgctagtgacaagcgcactttacccacttgtagtagtttggtatgcccattgcccacaaatattccctaattttgctcacagcctcaaacaaaatacacaatgtcatgtctgcatcagatgggatgctggggttggtaaaagttcagatcagctaaacttttgggcatctcttcctactcccatgtttaagtggtaggacctactcccatgtttaataagcatatctaagatgcaatgggacatgtacttcacaaactagcatgaaagatctagtataatactagcatgttttagtctttgattgcgctccaatcagtcccacgtgatataaaatatacaacacgagatacctaaatactccatgcataataatatatagtagtataacatatatggagaagtaatcttcacctttgaccagtttcccctacatcaggcgcggggttatcacaccccagcggtaagtgaggttaccgtgcgatatttgtgacaaaccatacaaaatttatcgaaatttcatttattattttaatttataagaatttgttggggttattgcagtattaccattaccatatccggaggtaaatgcaataaccgtgcaattacggccgattttgtaaacctgcctaaggctatgagcatgcggagaaatggtatcatgctgccatggtgttgcctacgagtaaattcagaccagttgccaaaccaggtttcagcaaccatgtagtgtggttttccgataaccaaggcagaaagatcgatttcttcccatatattctgcgcgatttggaatcaaaaccatccaaatttgacgtcttccctatagcatgtaggaaatccgaatacccaatccttgaggctgtgttcccaacatcttcaacctcgttttccgcgcgctcatttccgaaagtgtaaaatgcccaaagtagaagatgctcgaacaaagaaacgaacgaccaaggtccaattttggcggaatcgctccacgttgtacggccatttctcaatcaagaaacaagggattcgattcgagggaaggagacggacggacggacggaccttgtacatagccttggggaagccgtagaagtcgtggatggtgtcgttgttgccgcggatgacgttgaccgtcggcgcggccgcctcccagtggcccgacacgacgaggatcgcccgcggcaactccgcgcccgccaccgccgccggcagccacgacttgaagaatccctgcgccgcgatggtgtcgtcgatggacagcgtgggcgcgccgtgcgacaggaagaaggtgtccatggcgccctccgccgcgcgcctggtggtcgtcctcctcctccccctcctctcggcttcgagggcgctcccctgctgctcgtcttcccccggcgtcggcgtcggcgtggtcgtcgcgcgcgcgtgcaccgcggccgccgggctgggctgcttgctttgcctctgacccatcctcttctcctccttatacggggccggcggccgcgcgcgcggtgcggaggatgactgtttattttgcggtgtttggtaagtttagttggtcgacgactcgacggtctggaccgcggactcggcccctcatttggactttgggatgtcgctgccggcgcgcgcacgggcgtgtaagcagtgacgtaagaaagcgtacttcgctggaggcgcgtgacaagtggagaagcggatttctggaatcggccatggtctggatgttgttggtcatgtgaatctgtgagactgtgatcctaccaacttctctctccttttttaaggaagggtctcatgactctcatcgaatggatgtttggattgatgcttttcagccaaaacccatcgaattgcttattaggctgataaccaccagccacaaaaaatccttatcaagttaaataagccaaataagccaatcaatggtttttctttagcttaaggggaaaaagctaactttggctgatcagctaaagctcttggcttactgatgagggccgaaaatatgattggctgttatatcttgttatacttgtgtctcgcccatcctaggggtaactgttgcactgcgaatgatactacataccgtgttgttactgtatacttgtacaatagtacttcttttttaacgattacactatatatacatacgtgcgcacatattactacacatgcaacaccacatttgcactttcacgaacattttcttaaataaagaaccaactgtttatatctgattttattgaatttttgttgaaggtccaattgcacctactaatctagcttggatggcatgatatatgttactattggctacagtgtttgagaccttgcattgcttgtgtgttggcttcactgtcagctcgtccaatgtaccgcagattattatataggagtagctacttcaatgccaaacaaaggcaaaaaggtaggattgccttgtttcattgctagagaaggtaaaacatcaaccacccaaagaaaagtaaacatcagaacgccagcccaacagacagcaccttatgaacacccaaaacttaacaaaaacagactacagagtaccttaaacaccggacaccaaagcatacagcgaactattgacattcagaaattcgacaaccatttctataaattaccatcgacaaacatgtttttttcctacaaaatatcattgtacaagtgtttttgtaaattcccgttaggttttcatttatagacctccgttaagtcttctaaaaggtctattttactctacgatccatagaacactatgtgaggggaaattattttatttgatctcttgaggggatgtcccctcgttgtttgcatgtcactgaaatgattatgaaaaaaattgggatgatgtattaacatgtga

SEQ ID NO: 65412 - DNA, 6393 bp, Oryza sativa
ggtggtgaagcggtacgacgcgtgggagagcgtcgcgttgtaccagctatggtggatcagctccgccttggcatcctccccggcggcgccgagcgcgacgtgcagcgggaggaagtggtccggcgacgggtgcgccatcttaccgttcggcgccttctcctcgtactgcttcacgtcgtcgtgcctcccgcccgcgaggagcgcctcctgcagccacccgtcgaactccgccgcccactggggcaccggcgtgccctcggcgacgggcgccatgcagctaaggttgtgcgtggcgttgccggagccgaggatgaggacgccgtcgtcccggagaggcgccagcgctctgccgagatcgtagtggtacgcgccgtcgcggccggtctgcagggagagctggcacaccggcacgttcgcctccgggtacatgaacatcagtggcacccacgcgccgtggtcaagcccgcggccgtggtcctccttcaccggcccaaatccggcttgctccaagagctctttggccttcttcgccacatcaggggcgcccggcgccgggtattccagctgcatgggatgccatgcatgcattattcagttttttttttaaatttttgaaaggagggaacaagctttgcctcgtgatcagatcacaaggcaacaaacatgatgcatgcatggtagggaaggacgaaacgcgaacagttggacctggaacatggacttggggaagccatagccctcgaagtcgtggatggtgtcattgttgccgcggacgacgttgacggtcggcgtggccgtctcccagtggcccgacacgatgaggatggcacgcggaggctgcgcgcccgccaccgccgccggtagccacgacctgaagaagtgctgcgccggcatcgtgtcgtcgatggagagcgtgggcgtgccgtgcgataggaagaaggtgtccatggcccccgcgccccgtagtcccgtacgttgtgtactcctcgtcctctcggtttcggaggccactccctgctagctgcttatcttatctcgccggccgcgtcggtgtcggtgtggtcgcgtcggcgcgcgcgtcgcgtgtgctgccggccgggttgggcttggctttggctctgcccccatatccttctatttatatacgcgccgcgcgcgcatgggcgcgtggtgcgttgcaacgtcgccggcagccgatgaggcgtgcgttggttgcagatgattgggagtgcgttagttgcagatgattgggtcagccgatgaggcaccatcgtacgtactgtacgtttcacagttgtgcagtagtagttggtcgatatgacttccgatctactactccagtctactagaccgcacacctcacctcaagttgccggcagcaaaagctgcgcttgaacagccagcagctctcgcgttctaaatggatgttaagctttggatatagatagaatatgcatgatggagcaaaattctcacatggttgaattaaattaaatattataaattgctaacaaatagtatagaaaaagtggtctaagcattcaagtagatgtttaaagtggggcctcattcattcgctcaagatcataacatgagctacttcaatgccaaacttaaatgtacgtataatgctagctcaacaacctcactagtagaaaaaaggtcttcccttactgtcaaaatatgcctttcccggtggctagactaaccgctagcgtcgaaaggctagtgaaaatctaaggttttcacaagcaaaactttaacagctagcgataatcgttttcgcttgcggtagtgttataccggccgccagcgataatcgaattccgttagtggcagagataatcgattttggggaaagaaaaagaaaaaacccatgcagctgccctctaaccgccagcgaaaataaatatgcccacatgttgctaccctgcattaaaaaatccatagcgccaaatctcaaatcccaaatccacaacaagcacaacttccaaaaaataccatcacagatcctaaatccacaaattcacacaaaaatttcacatcacaacacaaattccacatcacagatcgagcacaaaaattttacatcacaaagattaagaggtgaggcatcacagatcgagcacaaaaatattacatcacaaagattaagaggtgaggatggattcgttgctcccaagggagggcgtggatggccggcagcggatccgctcgccggcgccggctctgctccccaccgcccctcccacgcgccggtgccgccgagcgccgccactggcccctccccccgtgcctctcccgaggacaggcggcggcggatccactctcccgaggctcgccggcgccagatccgcatctcgttgtcgagaaccaccgccgcttccttccccgcgccactgccgcacctccttccttgcgccgccgcccccttccccactcagcaatggagagtgaagggaggctggcggcggtggagaaagaagggaggctggcggcaatggagagagaagggaggagggatagaggagggaggcagagggaccgtgcgctaccgcgcacttgccttccgtcaccgtcgccgccgcgcgctgccgcttgagaaccgacgtgcgctcgcgttttgtcaccgtcgccgccacaagccgctgctggagccaccgcgcgccgtcgcccgagaaccgtcgtcggagctgccgccgccgcctgtggggagtgagtaggagggtgcatctggagggaggaagaggaacaagaggataaggactaggtggataaggagtggtgggtggtgattttttaatgggcggtgatatttttaagtgtgtgatttttttaagtgcggcgtttaaacgctggcggtaggttaagaagcaatagggttattttttgaaatggacttcttaaccaacctcaagcgaaaacggattttcacttgtggtcctagactcaccgtcggcgaaaatgaattttcactaacggttctaaaccctctattcctcgttagaatttcacaagcggatttcttatatgaccgctagctaaaaaaatagagtaccgtcataaaaaatcgtttcttaagctatggggttgggaacccatctcatctacacgaaaaacagagcggtccgttagtacgttattaattaaatattagctatttttaaaaatagattaattttatttttaagcaacttttgttttttttttaaaaacacaccgtttagcggtacatggttaggaaaagcgagagtacatggttaggaaaagcctcgaacgaacacagtcacctcacgctcacagtgacactgacacaagtgcatagccgtatacacgacgacatcatgcggaagtccaagcagagcaacaccgtccccaggcagagcaatcttagtatacctcgtacgcagccatagggaattcgtttttggtcacgaggctttacagtttacagaggaaatgaagtttatctagatgcataattttgactaattgacttggacggagaccccgctgttgaaggtcaagaacgtgcacagtatctcgatccctcaaattcccgtgcgacacgtctgctgcttccatcgcttgctagttacatagtccatcctggttcagctatataacttgatcaatttagagatagtgagcaccaagaatcaatcaatcgagcagaaatttgatctgtacatctccagtcaccatggctgccgccggcagcagcaaaaccgcgagcttgttgctatgcctggcgatgatctccttcgtgcagctggcacagtcctcaccgagcggcgacaaaggcatcaaagggtttcacggcaagaagctcagcttcaccctgtaccagcaggagaccatcaacaagaccagctacatggtcgtcgccggcgtcgccggcgccggcgtcagcgagaccaccacgcccttcggcaccgtctacgtcttccgcgacgacctgacggtgcgccccgagaggtcgtcccgggtggccggcgtggtggaggggacctccgtgacgaccagcttcgacgggctgaggagcctgtcgctgggcaagatcacgctcgaccaccgcggccgccggggatccatgtccgtcctcgggggcacgcacaacacccggccgtccgactgcccggtggtcggcggcacaggtgacttcgcgtacgccgtcggctacgtccggacgtcgccggtgaacctgcggggatcgtcggtcacgttcaaggtggagtttcacctgtactggccaccgtatgctcattacgctccaacttcaaagcactagacaagtcgctgtcttccaccttgatgagcgcgtctgcgtgtgtactcgtttctggcagtccgatattatatcatgcatctgcctattttttttcagtctctcgctgagtagttaatatagagtttgaattacctctgggaggtatttccgtatttggtgtaataaaattcaagattgataatctgaggaattttcatgaaaaaattaaactactacggatgatgcgcttatcggacgcttgttgttcggtgatagtactacttaaaaaagatcctcggatagtcagactttgcagtatacaattatgccaatgagatatgaatcttgagccaattatatcactaacatatgggtattgggttctactttcgtacggttcacatgtcagaaagtcaggaaagcctcatccatactactttcccaattcaatgtttaagttggagatggagaggttgtggattgggatcacatgcagtggctatagccactgcaacttatgcagtcctaaggacatcattggaatataaattaacgtcctagatctttccttgatactgttcacaaatgaccgtacaaagttagtttctgtagcatgtactgtagcaattactgtttaaaacaactgtagcatttatttcagccgttgattgccttgatccaatgatgaaaaatggttccaactgctaaacttgcagtctgtcctatgactgcaccggatctggattcaactctagtcgggcatgcacaactgaaaccgacaacaaactttgttccatttctcaaaccaaacggaaaagttattagcaatgattaattaagtattgattattacaaattttaaaaattgatatatttgattttctaaaacttatatatagaaagttttacatcaaatacactatttagtcgttcggaaaatatatttaaaaaaaccaaagagtagctagctaaaaaaactcagccttggttttttttaactatcatggcacacacctttaaaattgtcgaatggtgtattttgtagaaaaactttttatatataagtttttcaaaaattcaatacattcatttttaaaatttataatagttaatagtacttaattaatcattaatctttcattccattttacgtgtggccgttaatccaggtcaaaaagctagcgaacactgaaagctcccgtgcgccagaaacacccgagaatagacaaccgcacagtaacatacacacggcagcttcatcggttttccatgggcactttcggtgtttcacgattttgcgcacgggttggcccaacccaaaccataccgtgtgcgattttgctatagatttgtcgtgtgattttttctctcggatttgtccttttttaggctgttcgataagtgccaagattcgtgcacatatagcgatgggaatccgcataggattcagtcggacgggttagagcgctaatttctttttttgcgctttaaaaaattgatatgcacgctgttctctctcgttctctctcaattgaaactaaaataaaaataaaatacaaaattacagtcatatataactaaaattatatttgtaaattcagttgatatgacatgtaggtgcattgtaattttgataaaagtaattatgtaactaaatatgtatttttattttcttttgtagtccgttggatgtaaatttaagggtagaaaaaatctgggtgattttttcttagaaatcacctgacaaataaatagacaatccctaccgtgtgtgcttaaacacacgagaaccttcccgtgcggatctagactcccggtaacattctatgtaacggactctttcagacggcacggtggcttaccgtgtgttcgaacagcaataatcaatcaagcagccatctccatggaaagctagtgagcagcaataatcaatcaaaaggattatttagcagttagcaccacctaagctcaaattcttcttccgtttttctctttctctcggtttcaataggccaacacgggaagctagtgaacagcaataatcaaccaagcagccatcgccatggcagctaccaacacggccatgagcttggtgctgtgcctgctggtaatgatcatctgct

SEQ ID NO: 65413 - DNA, 1181 bp, Oryza sativa
aggcagcccttcggcagcatgtacgtcttccgcgacaacctgacggtgcgcgccgacagctcctcccgtgtcgccggcgtggcggaggggacctccatctcgacgagcttcgactgcgaggacggccggaggagcgtgtcggtggccaagatcacgctccaccaccgcggataccggggctccgtgtccatcctcgggggcacgcccaacatcaccaggccgtccgtgtacccggtggtcggtggcaccggcgacttcctgtacgccgtcggctacgtccggtcgtcgccggtggacacgcgtgggcggactcggacgacgtacaagatggagcttcgcttgtactggccgctgcacgcctatttcgctccaattccgtagtaacacatcgatcaacgttcttccattcgcgtcttattccaactataattccatgcagaagttatttttggagttaatttgatacatgaactaagaaagatttaaatgattttattgccctataaatattattgtacatttcaaatggtgcattgatagatcatttattcatgaggcacaatattgactaagataatgtaaggggaataaaggaggtcatatgtgatgaggtaattaatttgtttccacgtccattactcctggttaatatagtgatactgaaagttgctcaatccattccaaataattgacaccggcactatttaattttaaatttaaccatcttttgcacaaaaaaaaaagaatacatgaaaaatatggtatactagcgaacaatgtgctgtcaaaaatattatcatacaaatttctttcatcataatataattatttaaaagtatttatggttaaagtgaaccgactgtagtcaattatttgaagaacagaggtagcaaattctgagtttaaacatgaatattttggtatttagattttaccataacatttaccacggaaggttaaatggcctcacacctctttgtgcactcttattatatagattctgtttctattttataaatcggcgggatgctctaggatttacttggatggaagttcaaatgtggggcagacacaccaagggtgcgctccacattatatatggggtgtacaaactttatcatttgttgagaaggagtggtatggactcacaagaagtgtgtgcttttataggtctggtaata

SEQ ID NO: 65414 - DNA, 4673 bp, Oryza sativa
acatggatacacaataaagatatggctagtattggactagcgacctaaggtacctttttttttctggataatctgtttggatgctcacctcattttgccacaattttgtgctaaaagtatatcaaggtataaattgtgcggctccaaaattaatggtcatatttgtgtcaaactttggctaagaaaagagcctatgatttgtgggaccaaaagataagaaatcattgcatgctaaaattgtagaaaccaaccaaacactagccatattttaccacattttgccatataatagtcaagagtggtaaaatacaacaccaatgaagcatgctctaaacacttgaatgattttgtaattgttatttaagggtccaaacaaatcaattgactattagaagttaaaatagatttaaaataggcttttaaagaaatttatgtaatcaaatttttatgaaaagttaaacatgaagcatgtcatattaatccatgatacccaatgtgatatttgcccattgtagtggggcctgtctgtaaatatcattgtgctttaagctagtttaataaagtatatactttcttcgtctaaacaatatccaattatagagatataaaaaggtgacaatatcatctgaggcttttggtctcagttagtcttgcaaaaaatataaaaaaaatgcttttgaagtttttcacaaagtttacttttatattgttaaaaacacatatataaaaattttatttataaattattttttatttataaatataccgtttgtgacttaccagaacaaggagagaagagtctgttcatcggtccatcacggccggacaaacctcgccgcttcgcttcgcttcaccctttttcggttcgctctagctcctcatcccgttatgccttccccacctgccgctaccccacgcccccttcctctccaggtctcccccctccccttgtgcgacttgtgtcgaacaccgcagccgccacccgtagacgcgacctcagcaaccccacccacttcctctccgtgggcgcccgccgcgcgtcttgcccccagatccggcgcccaccccaggtaaaagccctcgcccgagctccgttgctcccgatgcgcgcgtgcagggagggatgggatcaggggaatgggattgggggtttggggcgggatggatcagttgaatcggctgcgctagtttggaactcgaacagcttgcagtaggataggtgggttgaatggtcgcaggtgttgcgcttttctgatgcggtttcgtttgctgctgctgctgtgtgaaggtagccggttgttgcttgcacgcgtggatcacttacagaaccatgcggcggtaggaacttgggcaagattccagatggttcgcttgtttggtgagctcttgtagcattgattgtgctccgttcgatttcattttggtgcaatccctagcactctaatttttcttgcttggaataaatggtgtaattattagactttatttcagttattaaacttacaatgatcgatagttatagttcagtacttcggttaccctgtttcactgtgctgttttgacttctgttatagcatgctgaaaactgaacttgccaaacaggcaattgatggggactttccttttttgagccagcaattataaacttataattattgatagcaaagttcagtattccagttactcaatttcatactgttcagaatactggctaaataagtcaattcatgttgttctagtcttgtgaggcttccttttctcctgttccaaactattgtcacggttttcctcccgatgtgcaaacattgctttgttttcacttaaatttatttgactcatcttgtatggttagttacattttaatatggcttaaaaccataacggatcattactgcagctttcttatgaggattaataatgggagaatgaagatgaggaacaaacaacggaaatcatctgctctcaactttgatgcaggatgccgatcttccttgtcttttattgtatggagcttggtgggagttgccctcattgtttgcttcttttctgttgtccgtcaagcagacactaggcagaaccatatttatttcagacatctatctgctaccagagagttagaagagattgaggaggaacatttccgcttgccacctcctcacaaggttaatcctcgtgcagtgaaacggcgggggcctcgcaaggctccaaaggttattgatcaatatctggatgagtcatcagcagtgcatgccttgttcttccctgatgaaagaagtgcagtgaacccaacaaaaggtggaaatgacagtatgtacttctatcctggtagggtgtggctggacactgatggacatgccattcaagcccatgggggtggtattctgtatgatcatatcactgccaaatactactggtatggagaaaacaaagatgggctaacctaccaaactcaccccaagagtacatatcgggttagtataaattctagtataatatcttccttgttttagtgactggttatcttagcaatttgttctgataccaaaaaaaaaaaggtacaacaatggattttgagacaagtctgtggctgattggtccttaagtacgtatgtactgataagtggttgtctttataattttccaggttgacattattggggtaagctgctactcatcaaaggacctatggtcatggactaatgaaggaattgtgcttcctggagaacctactaatttcacccatgaccttcataaatctaaggtgcttgagagacctaaggtgatatataatgatcatactggacaatatgtcatgtggatgcatattgatgatgcaaactacaccaaagcatctgttggtgtagcagtcagcaactctcccactggtcctttcacctacctctatagctttcgcccacatggatttgaaagtagagacatgacaatcttcaaagatgatgatgggtcggcttacctcttctactcttctcgtgacaatactgagcttcatgtcagtccattgacaaaggactatcttaatatcacggtagcaatgaggagaatattaataagacggcatagggaagctccggctgtcttcaagcttcaaggaacctactacatgatcacctctggttgctcgggttgggctcctaatagagcattagcgcatgctgcagaatcgatcatgggcccatgggagacattgggcaacccatgtgttggaggcaacaggtttttccggttgacaacattcttatctcaaagcacatttgtgcttcccctccctggcttgcctggtacattcatcttcatggcagacaggtggaatccttcaaacttgaaagattctcggtatgtttggttacctctgttcattgggggattggcagacgaaccgttggattacagttttggattcccggcatggtcgagggtgtccatttattggcacaggaaatggcgcctacctgaaagttggaagggttatacctgaattttgccctacgcacatgaagtacatacaaaaattacagatgatagatgcaatcatggaacagacatagtttgaagagtttggtgattgttccgaatatttcttgagatatctagtcagtgctttcgtaggcctttttgtaacgcaaaaatagtctgtcaagaaaaattgtataacagtgcagctctcaaaacaaatatttgacttgctgtaacatcctccaaaaagaaagttgaaatagcttgagcgtgtgttcatcccgagattatgctggtaacaactaacaggtagtagtgtttctagttactgtatccgttacatgattgatcccaatgaagcagaactacagttacgcaggcacgcttgaatgtcgaacctgtgatcacacatcttgtttaacatccattttcttcgaaaactcaactgattgaatgcctgaatctgataaactagtctcgctggggattgtttatgttgacaagcagccaacacacatgaactaattcatgaatacttgaagccgatggaaacaatgttccatacttcatagttgcatgtgctactttagtacttaagtcatgtcaaaatattgtcaacctcagaaagaattgacatggaacaacagatcacagcattaacaaaagaacaacaaatgactcggataaattccgttggtgatctaccgcttaagaatctaccagattgggaaaaacaaaaactgcctgttaattgctaaagcaaaattttaagcagtatatgttgagtaccagtgccataatataacatcatttccccaaaatagctagagctgtttcctcttcttggtctttgaccaactagatgcatgtttcttcaatttgtgaagtattgttctctcgctcacccgcagcaccaaagaatgatagagattcctttcgttgacagaagagcatgcttgcagtttttgcctgtcatcttccaaagtgtttgaaccatagaggctctccctcatgtcaacaagggatacaagtgcagaacaaacgctctcattaagcaatagcttcttaacatcaggcaatttttcaagcccgctaatatctggatgttgattggagcttgttactctgacaaccttaagcacactactaatgctgtcgacctcatcatcaccaatcagatcatgagccacgctggccag

SEQ ID NO: 65415 - DNA, 14009 bp, Oryza sativa
ctggctggtgcaacctgaatagcccagattatgccagagggatacccttgctcttgcatatcgacgggagtacttacaagagcaccacttagtaaccagagctaagtcgatgttgacgatgtcatatgagttgtccatctctgtgaagccatatcgatgaagcaaagcagcatttcccatggtaccgtatgtgttaaaaacctacagtggaacaagaggaaacataaagttgcctcaaaacaggaacctaactgatatctaacagtgatacattaagcaatactttggacccaaataaaagatggtaagcacacaattacctcctccccttcattgacatctctcacaacaatcatttccaaatcttcatcgtcatctcctacatagtatgaacaaaacaaccataatgagtgaagctcaaaatcaaccaagtacatgtctaaataaggtctaatgatgttacatgcagatggtcatggatgtaacctgaagggatgtcggcagaattttctatagttgactgttcatcagcagaagcattgtttggatcttcaccatcttcactatctgagtccgaggcttctaacactgaagtgaagtggacatgttccccaccagtcttgtggttaaaactgaaacaaattggatggagggcatttccatattaacgctcagacttaagaccagcacaaatacatcatcacctaagtatgtgcacacctgatgcattgtttccaaataaccaggtaaacgagaaataatctaattacatgagtagattgtaacttacaggtcagccaggggaaccattccagacccatgatagctatctattcggaaggacctcgacgaaagtagactcttagcagagaaataattctccaggctaaaatcatctgggtcaacctcaagttctcctgacaaaatgagtggctcaatacactctttccagtcctcacatatgaactgcctgtcttgcttcactatctgcctagaaattttgccgtttttagagccatcttagtgatcagccaataacgcaatatgaaacatgaaatgtgtgcaacaggaaagtacatcatatgcataattagctcgcattatgctgatttgaaaaggaaaaatggccatagttgtaactccagggagccaaacattgcaagatagatcaatttcactgcctaccatcgaagcatcaaggcagatacaaatcgtggaagcattgcaacttgttactacaatagaagggctcaccttatcgagctcggtgccggccaggaggcgctcggcctcatcggcgggccagacgagcggcacgggctcccgctcggggatcaggcggaggtaggcgtcccacggcgactcggcgccgcgcgcgcgctcatacatgacggcgacggcgagcgcgaggggcccgccgagctccgcggcctcgatggcctcggcggcgccggaggtgcgcggggtcaggcacgcgccccgcgggatggtggccacgaggtccccctcccggagcgcggcgagggcgcgcacgtagacgccgccgccaccgtcctcggcggcgtcgaggcggagcgcgttgctgcagacgacgccgtggtcccgcatccaccgcctgaaggcccgtaggcggctgcgcggtcgcggaagggtcacggatcgtagcgcggcgggggagcgcatacagagaagagcaaagcagaggatcttaccgtgcggtggaggtggaggcggaagcttccatggctggcggcggcggcggcgtcgcgaactcgcgaccaggttttcgttgcggaaatcggtgaggcagcaaccgcgctgcaggcccagcagaggcccaccaaggcctgcaacgcgtgtatgttaacaacccttttctctttttttttttaaacacgtcaatatattagaaggaagcagagttatacttgcacgatgtaatcggccagaggatcattgccacgaaaaataggaaaaacaaaagactgttaagaaaaaacgctactcttatataaagggaaaaataggaaaaaaaaaacaaccctcttcttctaaactatgtaatctcgagaacaacgaaattcgatacaatctcaaaagaaaaaaaaagaaattgaatgagaagaagtagaggaagtttttaaaagtgaaagtgaagaagaacaagcgagagagagagatagagatcgacgaggttgaaccaaagctgccaccgctatgcctcgttaggattggtgtatttgcttaccaaggacttgcttgagaagcttgatcatgggctacatcatgggctgggctaaccaatcaacaggaagcctagtgggttcttaacagtgtagtttcccttttgcctgaacattaaatcgcaggtgagagatcggacgggcaatgatggccataattcaagtttggccgctgatcccaattgatttttgccagcagcgctctgtaatgtgcgtgcacctgctgtaactttctgcctgcaggcggccgcccacgccaaaacacagcacaggttgaggtagtactcgtatttgtttcgctgtctttcgctttgctggttggttcgtactgcaaacttgaactcacaccacaggtggtggctttaactaatgccgtgcatcagttgaacaagcatagagtagttcgcttgctcttcagcttgtcggccgcaattgaaatttaaattttaaatcttaattttaaaattaggtttcgatagtttcatcatatttttttcacgaatacgtaaaaagattgcagtcaatatattagaagaagaatagcagagtttagttatacaacgcaatcggttagaaggccgttgccaatggtcaaagaaaaaagaataaatacagaaaagataagctcatgtaaaaggaaaactacaatcgcaaaggagggtggggtaagggtcccactacactccggcctatcataattttttttcaatcaagacttttaagtcatcaaaaatacagataaaaagttatttacttacaaatatacaattagttgtacgtgaaaatataatcgtaccagcaacaaaagcatcttaatgtagccctttgcatgttctactttcagcagtagccaatgcaagagtactactgcctttagccatctgtgaacaagttttcagatagctaaaaaaaactcagggcccctttgaatcacatgaataaaaaaacggaggaatagaaaaaatatagaattctaacatgaatgtaagtgtaaaacagagaagcaaaacacaggaaaaacgtaggaatgaccgtttgattggaccacaggaaaaactgaggaatttgaggagagataaagactcaaaggatttttccatgaggttctacctcttgttaaaattcctccaaaacttgaaattcatagggttcatttctttgattcaaagggctttgtaggaaaaattcctataggaatgaaatcctctaagggcccctttgaatcaaaggatttatgtaggaatttcataaattcaaattctatagaaaattttcctatttggccctttgattaaaaggattaaagctttccaaatcctatgaaattcctatggaatgacacattgcatgtggattttggagaaaatttactaagagctctaacctcttggaaaatttcctttgagtctatctctctcatccgattcctgcgtttttcctgcgctccaatcaaatgaccgtccctatgtttttcctgtgttttgcaatcctctgttttacacttcaatttctgttagaatcctgtgtttttcctattccttcgttttttctaccctgctatttaaaggggctctaaaattcctataaatttcctttgaatcaaagcggcccttatactttcgcccgtttaaaccagcgctagatctgccaggttgatgctcgcaatgtggaaggtgtaacgcaaacactgtaaatcagtaatgatattacagtagcagtgattaggcgaaagtacagtgctacatgcacgagattaggtatgcatggttaccgaaggtacaacccctgctgcctcctgccagcgaagtaaaggaatcagcaagaataaaggggggagcgcgattagtaatcaccaacttttgcaatctgctgcagcaaatttatacacgctctgtacatgtagctgtggatcagcattaaccatggcgacaagaagacaagcgctagaaaagaagaggaaaggcttagctgttgttgacaatgcgctaattaattgatggatcttcagcaaggcgagctccaaatgcaatgcagccatgttctgatgagatgacgcagtagtagagattgaaggcaaggtcccggatggtagatgaaactgtggcagcagatgtcatatcatttctggattcactcaacaacactgatcaagctataggtgagtgaagcttggaatggatagccaagccagcagctgctcgattttcatgatcttcacacttgcattgcatgctgtgatccatccacgaagcgttatggccgagtgaacacctggacatctagctagctgtacgttagtaggagtagttcgccggcaatctatgcaatgcatctacggtttcattacagcgtcctgcagtactgcttcttgcagcagcgtagctcgatcgaatcgcagtcctgcatgccagggatcgggatggctggctggcgtatcagaagtctagacgctcgagtggcggggaactcgtcgaccgatgcttaggcagagattgtccaggtctccaggaatagctagcttcagaccaggtttctgtggatgagcatttaccggttgtgaaaagactagggccagccggctgtaaactgtataagacgtagactgtatacacctacaagggtatttgcacgggcgtaaaccgactgcctgtatactttggttatacatccttaaaaaaggagtatactctctctccgtataaagaaaacaacctagtactattaaaataagacataacttagtaccacaaatataaaaaagtttgtctagattcgctgctgtattaggttatatccaatctaataatagctttttttaagagagaatctcttatatgccagtgaaaattggtcatatcccttatataccattgaaaattggctcttttttacggcattgtttagttccaaactttttcttcaaacttctaacttttacatcacatcaaaattttcctacacacataaactttcaatttttccatcacatcgttccaatttcaaccaagcttccaattttggcatgaactaaacacacccgtatacgtccaaaaaaaattggctcttttcgtgtatgcaattagtccaaatttacgcaccctctcatatcacttttgtctgttgaccgttaactctcaaataaaaaagatgtatttgctcttatgagtatacgacatgcctaacaactcagaatggcaaatacgtctttttacctttggagttaacggtcaacaaacgaaagtggcatgagacatgggaagagccagtttttcctggcatataaggattcttttttttttaatggagggtgcatgacgaaagcaatttggcatacaagcagaagaatactcgtaaaagacatttgatataaaaggttctctctctgtaccataatataagggattttgagtttttgcttacaatgtttgaccactcgtcttatttaaaaaattttgaaattattatttattttatttgtgacttactttattatctacggtattttaagcacaacttttcgttttttatatttgtaaaaaaaattaattaagacgagtgttcaaacgttacaatcaaagaatcaaaatccacgggagggagtaggatttgcctctgaatattcccagtcaatccaatccccaatgcttacaccaacatagctgtagctatgcttaatcactgctttcactgtccacacatctcatctctgtccagttcaactcacaagtctgtctccatcactatgacatctcccataaattgcagcaaaattttctcccctctcctttcatcactagcgctattaatttccacagaaaagaggtcatgcagctccaagtcacatttatatgtgcatggcagcagcagcagtaccacctatcccagccactagataaatgcgaaagcctccatggctgcattgctcattgatcatctgcccaccattagagacatcaagaacactctgcactagctcactcaggttgcatccaaagatcacaagatctgaagatcacattgatataaccatgagcagttctgaagaaaggatgttcgagatggatgctgacccaacttcatcaccagaagccagccccaagcaccatcacagtacatgccacatactagaggttgatcaatctgtcactctgggctttcttgtgccattgttcatgtaaatgccttgttagcctttgtttcttgcttactgtgtctgcaaaacacacgtagcagggtctcctcgggaggtgcacgcaggtggagatggagatacaagagagggccatgaagcatgtcatggagattggagaggagaggaagagaagcagcttgaagaggaggctgatgatgaggctgaggaaagatggctacgatgcttctctctgcaggtcttcttgggttgccaccgctgagcatccaggaggtgaagtgtttgttttttttttctttacttttgtttaagatattttttttcttctttacttatcttgttgacacaaaatttttaatgctattttgtccttgttctctgatttctctgttaccatttctgtgggtgtatggttcatctgtaaatatctaaaactggactagttggtctgcagaaaatgctgtcggaacagcatgtttcttgttttggtaaggaaatatgaatcacagaatttccatcttctgcgtgaacttccatggtgatttgctcctagtaactggagtaactgatatatctttcaccggctttttaattatactctttccattctatatattttagttttgtcctaagtaaaatttctataaacttagtttacaataacatatgcagcatcaaatttgttttgttaaatctatcactatatcttgatggtgtacttatttattattataaatgttaatatttttctacaaatttagtcaatgttaatagaatttaacataattaaactaaaatgactttactccgtagtatggaacggagggagtaccatttcacaaccccagtagcagtaaaactttcagaatcttggtactcctacggtgacatacaggtaatgaagcattgacattaattattgacttaaatcagtgtaccgcgcatataatcactagtaccattactacccaatcatcgttaatatgctgacattggccacagggtcagcgagtgatcaccgttagcttcctttaatttaagtggccgaaacagtgagctgaaaggttgcagatgcttttgtctcgcaggtgattacgagtacatcgacgtgctcgtggcagtaggccatggtgctgacacgtcgtccacgtccaggctgatcgttgacgtggatttccggtcccagttccagctggcgaggccggccccatggtacgcccacctgtcgagccggctgccgccggtgttcgtgggcccgccggagaagctgcggcaggcggtggcgctgctgtgcatggcggcgcagcggtcgctccgggagagcggcctgcacgtcccgccgtggaggcggcccagctacgtgcaggccaagtggctcccctgccgcggcgtgcaggcatcagcgctgccaccgggcggcgagtccgccgcggcggcgaacggcggcgatggcccgcgggcggtggtccagtggtcggtggggaaggagaggagacgccgtggtggtgggcaccggaggtcaggcctctcggtggagctatccgactccggcgccggtgaggtgagctgagctgagctgtggtgtgcagtgtgccacgatggtggttcgctggtttcattgatcttttttagctcccacggtaaaaactgtgggatcgaggtgtagaaggtacatgtactgcagactccactgtactccagtagtttagaccaggttagattggttgccaaccagtcgggtgcagtcagtgactgttctggtagggccaacgtggtatccagttttgcagttttgctttcgcatcaaccgttgtttagctgcgttgatgttggcatgcatgccgcctgtggcatccggcgccgtgttttgcgttggacattttggaggcttaacgccaagcgaatagctagtgtggtgatcaaagaacacacaatccaaagtcatctatttcaaagtttacaagcatattgtacgtactacaacaactatagtgcaattactgtgatctgtgggtgctggaggtggagtatgcctggtcctgtggaatgacagtgcggagagaggggctagcttgtgggttcttatcgttttactggtggtagtaaatggacgctgtacgccgtatatatgcgcgccggtgttgccaccgtcggcgtcgtatccggcacacggggctccatgcaggaggtgggggggggggggggggttgaacgggagggagtggagctgtgtaaccagccgcagctttgtcaggcttgggtgtgaccggcatgtcatcaccatttcacctcgcctgtacgagtgtacgccagtattgtgtggctgatggaaatgctcttcgtggcgcgagatgattgacctctctactccattgctccccatactgtgcagtcctctactatactatccccatggcccattgcagcttttgcaaggaggaaggagaaaaaggaaggtaaaagaggggaatcctacgcggagaagatagagatatacgtacagtgatctggctaccaataactgaacaacgtgaacacacgtagtacaagtacaaccaggtgttgtgttttccacgcatattttgcctaaccccaacaaacggttgatctactcctccgttttacagttgcaaaacatagtaggagcctcaactgggcctctatggctggaagaaggaaacgctatatctggccgaaagctcaactgggcctctatggataatgagccctaaaagttaggaataagttcactttgtgaccctcaaaagtgacagaaatttaattcgtaaccctaaaccacaaaaccggatatctcaacccctaaactcttaaaaacggtgcaatttgactccctcgacggttttgcagagcggtttcgctgacgtggcgcctacgtggtgatattgaccgagtctttgttccacgtggcggtgacgtggcacttacgtggcattagaattaaaaaatatgtgtgggaccgtttgtcattcacacaaaaagaaatatgcacccactgacatgtagggcccacatgtcagtcatccttccttattggaaaaagtccactttgactcccttaattatcagcagaatctaatccgtaaccctcaaccgcaaaaccggataagatgactccccgaactattgaaaccggtacaatttgactccctcagcggttttggagggcggttttgctgatgtggcgctgacgtgttgatgttgacctagtctccgtctcacgtggcgcttacgtggcattcaaattaagaaaatttatgtgggacccatctgtcattcacacaaagaaatatattatgggacccactgacatgtggagcccacatgtcatcctctctctctcttcttttcaccggtctgcaagggcgagagctggacaagcggcggcggccggcggcaggcaagcgacactaggggtctagggcagcggcagaggcggtcgagggagtggtcggcagcggcggcggtgggaccagatcttcctcctccttctctctcgctcatctctttctcccctctttgtgtggtcggcaggagtggtcggcggcggcgggataacgacgggacggccggcggctgtgtaacgccccgacattcattagccattaacacagctaactcacaccggggtgttatgcattacctgtgatatagtaccagtccaaggatacactagctggtacacacagaataaatatggaatcaaagtaaattactttattacatcactgggtagtagtccttacataagatgccatcatggataggcccatagatgagcaacacaacattacagaaaaccataaaagcgacggcgtagaagcgaacaacgcggagcactaagcgactaagcaactatgcactaggcgaagaacctaggcatctatcttattccacaggcgaggcttggggctaggcacgaaacatctagaaatcttcatactcggcttgctcctacagatactcctcggcggtcgggtcgacgtcttcatcttcatactctatatattattataagggcaagggtgattacttaacgtactcaacaagccaggggaaagaatgacatgtttggtttaaacaataaggctaaggttttatttgcgaaagctgcctttctggcaaagtgatttatttcacaaaactcctagtgagtgagtcaagttttaggtgtcgggaggaggctcacgcctcgacccattccacaagttgctttgcaacaacttgtcacgattaacaacaacaattaatttgtttcctctattagtttcttctcacaacaatacatagtccacacagttatctcagcacaacaacgccatcatcatggccctaacaacatctcggtgtcggacgacaccccaggtcacacagacccgttcctaaccacccaggttagccgtctgccacacaggcggactctggtaacgttacccttcccagtaaccacttcttcacagacatttgtcaaacaaatctacgctatgagaaacaccttatactcgcccttgaccgtgggcacggctgttcgaacagttcattaatctctgcagaggttgcacgctttacccacacgacacgaaactgacattgtttacccgtcagcaacgaaagttcgtgataaggcctttccaaagctaacccatgaaaatcgcatgccacctagttgggctaaaatccatagccgagtatcaggcaatgacaaccgtcatccactcaggaaataccgaggatgccacctactcctaccggtaccacgccacaatagaggcaaaaagacacccatgatgggcaaaaatgtgtaacactccgtctcctcatcctcggcattccacaaccattggcacaccaactcccatgtgaaaacaatttacttagccagaggcatcccataaatatccgtgtggtcgcactgtaacgtgtttggatggatttcccaaaggaatcggtccttaacgataatacgtagccaaaccacaatgactccgcatcatcaccacttttcacaacacattttattttaaacatgtatttggaataacccaagtttcccatacggcaaaacatcgtaagcatggctaagcgaaactacctcggtaatcatataacgataccggtgcaaatatttgtggagttatcaaaggtatggaaacatcaacctatgtaatataaatgcgactattaggttggtccgtcggtcgtataaacgatccgaggcctaaacatgtttttcgtgtatactaagcaatgcatttttcaaacaacatatcattgcaaatataggggcaatgtgatcaaagaggcttgccttgcacagggcgcgggtcttctccctcgaaaacaacgtccggagcttcctcgaactcgggctctaaacgcgaaaaacaaaactaaataagaaaaggcaataaaactagttcaaaacagagaaacaatggttccactgtgtagatctcaattttagaaaaatttaggaacttgaacgggtcaatcggagttacggttgattttctacggattttcaaacgatcaaagcattttctggaaatttatttattggacgacaagggaatattctgttggaatattccgctaagctaacagcaaaaaggggaggcccacctgtcagcggttgttggaggaaaagagacgcgggcccggctgtcagtggcttggagggagtaaaggagcacggggccgggctgtcagcggctcagctcggcctctcttcttcttcctctcgctactgctcggctcggtctgggacgacgacgcaccgcggcggcgagtcccggcacggctaccggcggcggagaactccggtgaggcaccgccggcgacggcggcgctaggaggcgcggcgcagcggctctaggcggcggctcagagagtgatatcgtgagaaagagagagtagagagaaatggagatggtgatggtgtggggaggaggagcttgggttgcttccccttttataggcgagcgacgcggtggcgagctggcgaactaggcgcggcattccgggggtagacggctagcagctagggcgggattccggggcggacgagatggcgacgcgatggcttggcgtcatgcaccggtggcgactcgacggcgaaaacaacggcgacgcgacacgaagtgacgcgcggagagcgggaacggcggcgagacgggggtgacgcacggccgacgacggctatggccgggatttggggcggtagggctagagaggggtgacgcgagcgacggtggcgactcgacgcgagagagagggagagacgcggctcggcggtttcccgggaggagatagacgacaagacgacgaggcgacagcgaagggacgcgcgtccgcgagagctcgggatgggacggcgcggcgtcagcggtggtggcgacgcgacatggcgatggaacggggatgacgaggggtggcgttgcggccgttatccgttggcgtcgacgcgacggcgacgggatggagactcgatggatggagtggacggcgacgggacgggggtgacgcggggcgacgtggctccgtgtctcccggagagggcgcgacggtttttttcgtggagtttggcgcgatgcggctttggcgcggcgtgcggggcggcgctacgtggccctggcacgttgcggggcgcacgggagggtggtatggtgcaacgcggcacgggaacgagggcggaacggtgcggcacttgggcgagacattttgtcgaacacctggcgtgcatgcttgtggctggtctggggaagaagacgatgagcagtgaggggctgggctgggctggcgcaggaagaaggctgtgggccggcctgcttagggggagctgaagagaggagggatggaggggagttgggcctgggagagaaaagagagaaggaggcccaattcgaacagtgagctttcacaattttcaagagatttgtagagtttgaattttgaggagatttcaatggatttgaatttgaatttgacctagggtatcacaggtatttgaaggaaatttctaggagaggatttgagatccatttggcacaaaatcaactaagaaccaaattaactccaatttttaaatgacaaactttttaaataaaagcacataaaatacggatgctacaggctgacgcctccaccctgccgcacagcagccgaccagcctcgtcgcggcgcaccggaaagaaagccctcgccacgcacatcgacgacgccgcaggtgcccatcttgaggtacatgatgggcccgtacttgcgcgctagcgacgccaggtcggcgtgcggggctgggccgacgagcgggagcgcgccgaggacggggacgcccgggggtcccaaggggaggcggcggccgccgccaggggagggcgggcggtaggagcagagggagaggttgaggaggaggcaaaggaaggcggcggagagcacgacggggtcggtgcagagcgcggcgagctccatgcatctggagcgacgaggcagggcgtcaacgacgccgtggggagggatgggcgaggacgtcgacgactcgcggggggagagaaagagaggcggcgagggggactccgctccaggttgggtgaactctggcc

SEQ ID NO: 65416 - DNA, 2414 bp, Oryza sativa
atattatctcaatcgggtctaaactacggcccgtcactgataggtgtcatctgtgacgggcttaagttttatgtccatctaatatgtctgtgcgaccatatcttaatcgggcacttttttagcccgattgagatgactttcttgtgacggcccgctatttccaggcatgttagagcccgtcacacatagaaggatctgtactagtggttgaatataccagttctatttggttacagttagatttggagttgtaataggtgatggaggtggagttagagtcggactctataacccgatcgacaactctcttaaatagagaggaggtgccacaatgtaactatagcgactacaatatagcgtagacacgcaaggagacgatggcggcgtggccatggactcgtaccgggtaggtgttatgttggttggggacgcccataattagagcctcggggatgtaggcttcggctgaacttcgttaacaaatattgtgtattcatgtgtcatcatctggcgtgtcatgggtgatcaatgactgaagcgatcgagaatgctagtcgtcgttccgctatatcgactaacttttataacatataaatcgtttgattattttctagtcaaacttctttaagtttgaccaaatttatagaaaaatatagtagtattttcaacataaaacaaatacaatatcaaaatatattatttaatgaaactaatttgatattttaaatattactatttttttcataaatttggcaaacttaaaaaggtttgactagagaaaaaatcaaaagacttataatatgaaacataggaagcatattttttatgggaatagactcaatttggttaagtcgatactttttgcactctcaactttctacccttgaaactaaccgtaagagtggtgcagcgaatcgaaaaatacacaagacattctcttttaggctttattcggtttgaagagcgttaaaagggattggagagaattgatggggaataattccacaccataataggtgtgaaaaaaaatatccttaatctctctcctatgaggatattaaccgaacatcttagtgggatccgatatgggaagcaaaacacaccctcttattgtctgagataaagtctgtatgccacagtcaaatagaggtattcgagagatcaatttatatgcataaaacaatactctcttgctcaagaatctacacaagttttacaagcatcatgatattctttggaataacatgatattgtaactgtattatacaaaccaacttcctcactggcatttactggtaaatgattcattttagtggagagagaacctcaaactgattgatctctttaaagcaattgcaaagagtgcaactgaataatggagcatctatctttttctggacagatagatggaatgatgatttattctggacagatagatggaatgtggcagtgctcatttattctgtccgtaaaaaaacaaatatcacaatcaagcttcacctccctctatccacataggcctaccaacagtttcaagaacctgacatcttagcatacatatatggaattacatgtcaaaccatccagcgaaccatcacgattcaccagcggcccgtgaccggcactggcgcactgcctttctactattgcaatgtagcaagcagagaaaccgaaactgatcagcgcgacgcattttcctcacaaatcctggaaaaaagctagcatctcggccggcaaccaccggcccggtgtcgggcactcagcctggcatgcgatctcgatcgatctcattctccccacgtggacatatatacgtcgccagcctttagtctcttcagtacttatcactaccctgctgcgagctgacattctgaccgggaaattgtacgtgtgtgtccgcagctgcgcactgcgtcgatcgagcgcgcaccatgataccacacacgcgcacatgtccggcaaacctatcgatcggctatcgcgggcggcatttgttgcaagtttgcgtggtcagttttggatgtaagggccgagggcagtcgtagcagatgacggcgaagcagaaagcaaggtcccaacccaaagttgctgtccgagtggatgtccatgagacggatccatgatccatccatctactctgatacgtctctccaaccgaatgacgatgacgcagctgcgaaaacgtatgtatatgcattgcctttgcctttgcctttttctgttgcgctacactactgcactcatctcatctggtttctgtgtgtgtggttcactggttctgcatgaccctgtgtgtgtgtggatgccggtcaagactttttggtgtcaacaacatgctatttgatctcatatactacatccgtttcataatgtaaatcattctaacatttcccatatacatatagttgttaatg

SEQ ID NO: 65417 - DNA, 15393 bp, Oryza sativa
  unsure (1)..(15393): unsure at all n locations
agattagtgggaattcgaccttttaattccctatcccaaacccactcaaattcccaaatctttcaaccaaactacatacttaaactcccatatatcataaactcacattccccatcgccaactccctccaactaaacaggccatgggagttgggctgggattaagaattgagaattgttttggttggcttgcgccggcggcggttccggttaactgggtttgtttttgcagggacggtatggacggcgacggcgcacattgttacggcggtgatcggctccggcgtgctggcgctggcgtggagcgtggcgcagctgggttgggtggccgggccgctcgccctcgccggcttcgcctgcgtcacctactacacctccactctgctcgccaacgcctaccgcgcgccgcaccccgtcaccggcaccaggaaccgcacatacatggacgccgtcagatcatacctcagtaagtacactcacattttttttctctcatctccatcttgttggttaaactgaacgcaatgccaaaaatattttcaggtcctagagaggtgttcatgtgcggaatcgcgcagtacgtcaacctgtggggcaccatggtcggctacacaatcaccgcaaccataagcatggtgtgagtaaccgaacagatcactccaacttccctccgaactgaacttttcgccatcggtcaggctactaaatttcgtctgtttttctttttctttccgttgtgttgcgaagcgcgatcaggaggtcggattgcatccatcggaacggcgccggcgccgccgcgcggtgcgacaacacgtcggcgacggtgctcatgctggcgttcagcatcgtgcaggtggtgctgtcccagttcccgggcctggagcacatcacctggctgtccgtcgtcgccgccgtcatgtcgttcgcctactccttcatcggcctcggcctgtccgtggcggagtgggtgtcgcacggcggccacctcagcggcaggatccagggcgccaccgcggcgtcctccagcaagaagctctggaacgtactgctcgcactggggaacatcgccttcgcctacacctttgcagaagtgctaattgagatccaggtttgcatgcacgatcgatgatgattcgtcacccacaatattcagatactacctctgaaccaacatacacgaacaggattttctttttgttcgtgccaatatttttttagtgcgagtagcaatgtggtactagtacgttcttaacgctaatgcgcttttttccgtctgttttgcttttgtaggacacactgaaaccgtcaccaccggagaacaagaccatgaagaaggcagcgatgtacgggattggagccaccaccatcttctacatctccgttggctgcgccgggtacgccgcgttcggttcagatgctccgggcaacatcctgacggcgtccggtatggggcccttctggctcgtcgacattgccaacatgtgcctcatcctccatctcatcggagcatatcaggtcagtacatcataagttcgtaactgagccccggtagtaaaatattattagtagagatcaccgtgaaattattcttaaaccgggtgcatttctgaatgcaggtttatgcacagcccatatttgcgacaatggagagatggatctcctcccggtggccggaggccaagttcatcaacagcgagtacaccgtaaacgtgccgctgatccagcgaggatcggtgaccgtggcgccgtacaagctcgtcctccggaccgtcgtagtcatcgcgacgacggtggtggcgatgatgataccgttcttcaacgcggtgctggggctcctcggcgccttcagcttctggccactgactgtttacttccccatcagcatgcacattgcgcaggagaagatcaccaggggagggaggtggtatctcctgcaaggcctgagcatggtgtgcttgatgatctcggtggcagtgggcattggctctgtcactgacattgttgatagcctgaaggttgcaacccctttcaaaactgtcagctaaaagcagtgctgcagtatattgtagaacagtgacaaacagaaaacagctacgagttgtacaacaatgtaggattctggactctgattctgtgtctctgtgtatcaattttctcggatatccggccggttcctgaaagatttggaactctgaactttgctggatcagctatattgacacattaggttgttcctatctgattaaacaggtcggaacttggaacatagcagaaagaggttggaatatgtagtagtattggaataacctgtacaacggcctttgccttttagtatttcctgttcctgtctaaaaaaaaaatcagcacatttccatttttaacggtatggtcatattctactggcattgcagtgtggtactggtacatcataattcttcgcatatcatttttacagaaacttcagagtacatgactgaaatttgtacagggtagcttgtacatatgtgcaagcttttcagaggctgctaaaacctcagtttattaccagcctactagttactattcactagtcaggcattctaattaaggtcctaattggcagcacggcagcacccagactgttgctactgggtgccttttgatctttctggcagcagtttcttacaaagaaacggggcatctgttcttacttcttatcattcttgttctttgccttcccgtttgctgagatagagtcgatgtcgatgagcattttcacgacttctctcatggttggccgttcagaaggcagttgaacagtgcaaaggatggcaatgttcaagacctttgtcatgtcctctgatgcatggctgctaacctttggatcaagaacagctgcaggattctggttggccaaatgggatgaaacccaggagacaatgtccagttcaccgtcaaactgttggtctgaagggctgcgtccagtaagcagctctaacagcacaatgccaaagctgtaaacatcactcttctctgtcaccttgagagaataagcaagctctgcattttgagacgagctgatgttagattgtcaaatctacagaactacgcataatatgcatgtcagaattacaccttttgaagaattatgatggatgccatttgctttcatataaaaatgtatgaatattttttttaataacattgtccatgactagtagcaattctttctctctctttttttccagaatacctagtagcaattctaccctcgttgcttgttagtttattagcccaaccaaaaattgaattctgaaacttaattttaagtttgatttcagtgtttttgtttatcgttgcagtagtatatttttcagcatcggtttaaaaccatgaaaaatatagttaaacgtttattaataaattattttcagttatttctaaagataccatcttcatatgagcctgaccattcccggtgggactcccactcattcaccgcatgtaatcggctaatcgccaagaaattcgtccgcatcggaggcactggaggatggcggcggcggatggcgcggccagtagcggtcgactacgacggccgcggcgggcggtggttgaaggggaggttgctggcggcaggcggggagggaatgggagggaggtgggagctcgagcaccgcggcggtggtagaagggggggggcgcctgtcggggaagaagggggtggagtggccgatgcgcgtcacagccgccgacggcggtcgacctgctcgcaaggtggcgccgcggcggcggcggccgagcaagagagcagcggcatggcgaattcatccgcgagatggttgagaggaatgggtaagggctggaagacgaggtattacgcattttgttttttttcctaaggaattcatgtgcaatactaactactaccataaacatttaacatacaagagcagaattgttcatatcttaccaggagccatgtagccatgggtaccagcgaagcagctgagtggtgaaccttccaccaatttggcgatgccgaaatccgcaagcttcgcttcatactcctcatccagcagtatattggtggattttatgtcacggtggattatggccggggagcaatcatggtgaagatacatgatgccctttgcggttccaaccgcaatccggtaccgcttctcccagtccagctccggctgcccagccttgaactcacggcggattgcatcgtagagattgccatttaccacatactcatacaccagaaagtttgattccccaccggtcaagaatgcatggagtttcaggatgttccggtggcgtattttcccaagtgtgttgatctcagttctcatgacctttgcatcatcacgcttccatagttgcttcacggccacaacacccctccctttgctcaattcaagcctataaactttgccagtgcctccacagccaatcagattgtccacatccaagttgcaaatctcctcaggatcaagctcaggggggtggaaggactcaagaacccactttgagtcactgtcgtcgccgctctcgatgtctcccttgctgtggaactgctcaagcttgtaattttcatatctcaggcatgccaacccagataggagaaccaccagagatgtcactattatcagcacgacaaatagccttctctgcgagaagttctgatggttgtcgttccacgggcagtatcttaaattggtggcattttgcctccaaccttctgaaactccagcaatacaaaggccgtcgttttcagagaatgcatcatctccagctatcatcaggagagctggagggactggtccagataaattgttgtgggagaaatcaacataactaagcttcagatattgcaatccttcagggatttcaccagagatcatgttgtgagataggttgagtgaattcagagtgaatagagatgctagtgtgtctggaatggtgccagtcaaagaattgtctgcaaggttcagatcaactaggctgttgcacataccaatatcaggtggtatcgatccttccagagcattttgttccaggtgcaggaatgacagctgcttcaaacttccaatctgtgcagggatttggccagagaatctattgttgaaagcaacaagcttctgaagcagggaaagcttccccaactccattggaagttcaccagagaagacgttattatgaacatacagttggttcagagaagccgaaatgcctatatcagaggatatgccgccaacaaatttattgttggcaacatcgatgatcacagcattaggcaatccccatatgccactgtgaattctcccagtgaactgattttgacttattctaaacctctgaagtgttttgcaagaagagtaggagctggggaattcacctgagaagttgttgtccaaagccaacaagaactgcaatttgttgttttggcacaggaaccttggaaattcaccagaaaaataattctcagatatgtcaattgcattgagtggtgagaatcggccaaggtttgcagggaactttcctgagaattgattttcataggttgaaaatgactcaagaaactccaagtcccctaatccttcaggaagcacaccagagaagttgtttcggtaaatatgaaagatcttcagcttcttcaggtttgctatctctttgggcagaataccacttagctgattctgggacacatcaaattcagataacaatgtcaaatgtgcaagttcaggaggaatttcaccagtcagattgttttgatagagctcgatcttccataggttacgcaggttggatattgctattggaaacacaccaataatctgattgcgtgagaagtctagggtcccaagtgagaccagatcaaatattgaaactggtaattctcctctaaggttgcattgccccaagaatagccatgtcaggttcttcagctttccaatactttcaggaacatcaccttcattgaagttgttctctcctagacctagttcagttaggcctgataatttgccaacccatgctgggaatggtccagaaaaattgtttgttgacaggtcaagaacttgtagattgataaatgttgaaagatcaggtaattgccctgtcaaactgtttgttgacaggttaagaacctgcagatttgtgcagttagctagtgcagcaggaatagtgcctgagatggagtttgcaccaagctccagcgtacgtagttgggaaagaagagaaaacgacgacgatatagttcctgatagtgaggcgttggagagtgatattccaatgacaccaccagaagtttggtcacatgtaacgccataaaattggcatggtgaatgagactcatcccaattgcctaggtaattttgtggatcctccagatgactctttatgtccaagagagcatctgtttcaagaggtagagatgcagatattccgaacttcagagacagaaggatgaagcacaaatatatctgaagttgctgaggcaacattgtgttgttacttgttagcactgtgtacctgaaaagtatgaatcttacgttagtttggggcatgtcatactggatttgatgatgatatcaatacgttgaaattttcagaaaagtaaacattatttaaacttcagaaaaagaatgaaagctatgtctatgtgtagttagctcccagtgcagtgatagttgaataggattgaaggaaagtgaagtgtgaaaagaccaaaagttgtatcattatactgaaagccagttactgaataatcatggggaccaagtaataaaagagtaattagatacttgttcctttagcaaatatcagcttttttgttctctctttaaaacaaaagtgtattagaaaaattaaagtttgctccaaacttcggatcaggaaagactagtttactgagttaaatgaacacacttttgcctgggcttatggttttggttgttctcttcagcaaaacaaatgcttacactacgaattttctcaagacctctttcatgaaaaaagaaacaaagaatcttgagtagcaataccaaatctcatagtactaatcacttgatactaacgcaataaatcagccagatattttaccagattcattgaatatacccgatacctttttcagcctgtcagttaattaagattaggttatgtctgttcatacttcgtatcagcatttaacccatccaggaagtggatgcactgctgattctattttggtctaaagcaacggtccttattgccgttgtcaatgtcatatatggctgtctagtggtagatcgaggtagtatttcttcatgcttaggttctgaattctgatgcagtttgaacgattgatccttatggaccacatgatcaaacgttggggactgcgcagtaagccggtgacagtatgaagctctactgctgtacatgatttgcaaagggttttatctgcaataagttctacactttctgcatgaacccttctgactcagctaacctgtactattttgtccagtagcaatggacaccaagacatcattatcatttgtcagatatatgaacaatgggaacgcaatgctgattccttcccttactgaccctaccaggaattttccatcctctttgatcacaagagctatgctaaacaacaatatttacatgtggttaccacctcttgtcgagaaaactaagaatcggatcatgcatgaaacacagtggtaaattatatctaggactgacaccagagtagaacgggtatttatttcctactgctgtatttctcagttctcagttctcactgtctaagcggcccttcctgatgaaactacaccgactaactctcgctgtctcacaactcacaacctagagtcaggcatgaagtttagtgattactacatgatatcagtcaaagaaatgcacaagtcgcataacatcaatgacaaaatctgaagaatatactaagagctatatatgcaagctcttactcagagtcaagttattcagttcttagcagagaaagaaagtcaaggctctgcaacaagctaagcactagagcgcaatcttaaccagcgagatcgatggcatggaagagatcgacagactaatccatggatcaagccgagaaatgtaagtggatatatatataggcaaagcgaggaggaaacgcacctgctagaaggtcgcaggtagcagcagcaaccgcagaattaaccgtgtagtgctccgcctccgctagcacacaggagagagaggagaggagtgcgtaggcgcggtactgatatatagccgcgcggccgcggacgcgaggtgcgtacttttattatggatggatatggggggcaagtagtggtgcggcgggaggcggagggaggaagaggccacgcgggcacgagatgccggcgcctcttgttctgtttgacgcgcgcgcccgcctcgaggagcccccacctcccgcgccgtccgatgcgccgggcacaatctcgacccaattcgtcgcgtctcgggatccgcacgcgcgaacgtacgtacgcgggcgtgcgagccccctcggcggaatcttcgcatcctgtggatcgcgcagggcggcgcgccacgccacttgcccgccgcggcgaaagcgaccgcgccgcgaatacgcaatgggacgacgggagtgcgcggcccgcttgctctctcgcggaccggcccgcgcccgcgcccgcgtgcgcgcaccatcacacgcgcgcgcgtgtcctgattctactagaacacaccgagaggagataccgcccgctgccgctaccggcctaccgcccgctgccgctaccggcctaccgttgttgctgcaatcctctcccgttttttctcctatacttttctttagatatcgagaattcgagatactttgcccgcgtacatctgccgatccggtggtgagatatttcgcaactctcgcgcgtcccctcgccgtggaatgtgctaacgtacatgcactaccagctgctgggagtagtagcctccttttcttttcttttttcagaaaaatgggctggagtagtagcctcttgtgcagtgtgtaccatgcatagagtttggaatcctcacctgtaaaacgaaaggagaagaaggctcctgttttctgaacctgtgatgggtagaattccgtctctgtttcgttcaccgctgcccgcaagtaactcaggttcagaaaaaaaaacaccgcagcaatcataacgtctcgacaggcatgcatgcaaggggacaagagcggcatgacaaatattcaaacagaaattggggtcaaagatctgctgattcacccccgtgccctacatggacaacgctacaagttcagatagcaagagcacaaaaccgaaagctgcctggccggtctccgcccctggctcccagccacaggagcaactctctcgccgattcatttgtcatatgtgttcttcctcatgatgtacgcgtggcacgtaaagtattcctatcaactacggagtggctcgaacacgtcggcatactagtatttttgtacaagaagaaataatacagttttgtacacacatgactgattagattgagatgttcttctttttcttggcacaacattagccccgtgaactgatatgcagcataattccagtcacaggagcagactacggcacaagcagggaagtgcgctgtctgattgaaaagtaccagttggctttgtctctgcattgtacagttcaaaaatataggcataggatcactgaagttaactgccattacatcacctttagcccggaatagtgcaacgatttagtgctgatctgttgttaagatcaaaccttaattattgctgcactggatgtccctgctcgagcagatgctgctttttgcatgtgagctttgacctgtccctggtgtgaccgtgtgaggcagacagtaatggaattatttgtttaataattattcaagctgttgatgaacagtggaatctgtccatctccaagtacaaataacctgaagctacattgtcaagggacactcattcttgatctttctgattggccagaatgcgtttattcatacatttggggacctgtcctgcattattacactcacgcagtgacaattctggcttatgatccacttgaatgaccagggaattcggtctcatgttcttgtcaaggacatgataagatactagcgtttagcctcttttggcctgcaacttgaggagacagtgtcttttggtgccagtaggtttggactatcactagtcaatgcagccactacgatcgtgcaactgcatgagtagttgctgaagggctggaacaatgttgctgtttccttgataattgagaactcgtggttaacaattgcctgaatggctaggtatctaggtgtagtagaggtctcaacactcaagattctgcatttctatctgtgagatggacgccccaggatgttactggcaggatgattagttgtagtcagcgcctcaacagcgtataggatatgttcaatgttccattgaggtgcttcttcacaggtcatactcgagatgattcagtgagcactttagtagtaacggataacactttttgagtaatgcgtaatattcaggcatgacgccatgggttatggacgcataatatctttactacgaagcttggttacaagcctacgtaacctgcaaaatccaacggacaacctgcaccaaaacaacaaaacgtgagtagtaaagtaactttcctttgatatactactatcacatatggccgtaacatgatgcaacctgtagctgtttaccactataaattagggggtcaaaacgagctgcggttagaccatatatgcgcttatctgcaagcgtgcttccagacaaaaccgggtgttttggggcggcaagctatcacgaactcgtgattgaaacaagttaacgtctgatctccatctcaagccgcccaatgcataaattattgctcgtggtcatcgatggacggcccaaaattccatgccaaattctttccaaaaacaattccatgtgaatgatttattggcaccaaatgatttgttcttctccaacatgcaccacctacagtactagtgtgccatcagttcgatggcctgaccaaaccttcgagcgcacttaggacagtgtacacaacagttgtagggttatagcccatgccttagccagggagcatgtatgtatagcaaaacgtgtctaattcaacagtcactaccacattatcaggagacacgcggatgtggaaaccgacgacctaccgaagaacaaaggtgcgttagccagcaacgtctctgcttcggaaaaggtataatgggccggcctctgcagtgcacgtcgccgactcatcggccgcccatgccgccggagcgtagtgcatgcgggcctcggtgcgtgataggtgagagaggcgaagaaagcaaatcacggaaaacgccggcgtcccagcggctactccatcagaccaccagtccaccacggatatgcagcatcgcgcgatcgatcgagcaatccgctcggcgatccactggactttttgctgacaatgtccgaacgagctgtccatctccccgcgaaatttcgcccggtgaaggctgcatcgatccggccttcgccatgacaaaacgtaaaatcaggctagctgttagtacggtacaccaaccagattactgtcctgttagccagtagacagaggtggacttctcccgtcgcacgcaggctggcctcttacgtttctttcatgatcctcccgtgttcccaaagtcagattaatgcaacttctcttgtccgtactcgcacgtttggtttcttcgtccgtcactcgtggcacgcagttttaaccctaggagcatgttttatgagacatacagatgttgatttctatggcattgatctttcacaggaatagcatagacgaggacgacgacgatgatggttagtgcctagtggtcaacagtaacatcgtcaggcgctcgtgtttcgcattggcgtaaaacaaaggcgctgagactgacataaaggcgcaggaaaaaacagtaccgccgagtcgggatcggtacgtgaatcggtggtgcgcgcctggcctttggttgaccggtggcgcagggcgcaggccaccgattggatcacgctgtcgcgcggcgcggggctgtacgttttttcctctccatgtcgatcgccaccacgcgtgccacggcggccaagatggatcacgcgacggaagcaaatcctgcggaaacgcacgcctgcgcctgcgttcttccgtccgcttcgcctcggccgcgcgcgtgggttggcgccgtggcagatttgaccggcagaggcaccgcgcacgcgcacggcgaacggagcggagccgcggcatacggtgcaccgtgcgcgtgctagaccggcctaaagtcgtaacagaggccccctccgcttcgcccggtcagtatatgggccgtgaactttgcggcctcctcttggacgatggagtcatgatgggctggcgtgctttgggctgccttagaaaacaagcgcaaaatgtacaccagaggtccctcatcttggcatcgaattacaaaatcatcccccaaccgcaaaaccagatatatgtttctcaacttacgaaaccggatcactttgggtcctcaggcagttttgaccccggttttatccgatgtggcatccgagtcaacgtgggacccacatgggccccacatgtcaatgtgaccacgtcatccccttctttccctttcccctcttctctcctttcctcctctcccaattttatcctcatctggggcaggctagccggtgggtaggaaggaggcttggcgagccgaggcggctaccaacggccggcgaccgacaacgggcgactcagcggcgacgatgacgacacaggagcaagaggacctcctcccatggcgacgggtgacgcggcaacgatagcgtcctcgctctcccgtctcactccccgtccccgctgctcgtcgccgtggcagcgccagcatcctcatcccgaggcctggctcctccggcggcagcggggatgaggtgggggaagagaggagagggcctcctcccatggcgacgggcgacacgacgacggtagcgtcctcgctctccccgtccccgttgctcatcgtcgtggtgccctcgagccacctcgccatcgccatccccatctgaggcttggctcctccggggaggcaacatcaaagtgggaacggcgcgagcaggaagcaaccgtgcgcgggagtcgtgggcggcagctgggtggcgaagctcgaggactgctaagacgagtgcgtgcttgcgtgggtcgtcgacggcgggcgcgatgcggttgaggtcgctcacctcgctgcgactgggatcttcgtcctcgagctcacccgtgtggcaacgtcctccccttctaccgtgtcgccgccgccgccacctcccgggcctctttgatggtccgaccccgaggtcgcacgcgcggtgacgctctcccttctcccgcatcgtcgtcggccgccgccatgagctgcctcccttctccagtgtcgcagccgccaccgccgcatcgccgactgccggatctcctctcccgcctcgccccggtgacctccccacccgtgcgtcgccttgcagagaggagaaaagatgagtgagagagaggggggctgacgtggacacctagcatatggggtctacgtgtattccacgctaactcaaccaccacgttggataaaaccggggtcaaaaagtgaacggttttgtaagttgagagatattacgtcttggttttacggctgagggataattctgtacctcgatgacaagttgagggacctttggtgtacttttttcaaaacgagctgagatctcctatacttgattacgcacggcccagatattccgtataacaaactgacggcccagttcacactgatgttctcgcgtatcctactatttcagcatccgtagttaagaactgcacttctctggaaaaagaaagagatctttttctaaaaaaagaaggaaactattctaatccctcaagatgtttcctcgtttccttaaaaatcatctaaacggttatgaaaaattttgaaaaaaattgacaacattcatacaactcatatatacaactccacaaaatcttaagtccaaactcaactcacaagtcgagatataaaaaaacaaattcagtgtataaatagtagcgtactatttatatctaaatttgtcttttttgtttctcgatgtgtagatcgaatttgaacttgaattttggtggattagtaggtatcattatactctacattgctaattttttttagaatttttcacaactatttacatcgaatttgaaagaaaaagatatacgagaggatattctttcgagggattagaatccactcccaggaagaagtgctctactctccatggacagtgtcactgccacctttgtactttctgtttccctccatcacaaaatgtaagccttttcttttgtaacttttcatactctaccacgagaagatatactgcgaaaagaattgcaagaaaatcaaacgaaattatctccatgcgatcagttcgtatactttaactcacattattgatgcttaaatactcaaaacattggttcaagatttcagctctagcaatcgacaagtatgaggttgctcctttacatttctctgcaaattttcttttcctttactgagattccgatctcgttttatatttccaacatggccttggtgccgatgttcttatctgagccggatcacaccagctcacagcctatttcatctcctttgttcttcttcctctgtgactgtgagccgaggaagaggaggacatgtgagcccctccacaagcatcaagcatgtggtcttcagctcgggaaaaggccttttcctcatttcccctttttaggttgcctagctatcatcatctgctcctccttcgatgtacgctttacaatgatagatctcgccaaatagcgatgcaattatctaacagtatacagcagtacggatcgtccagcattacgattatctttgacgcagtcttgttaacctttcaaggtattccccattctctatttgagctggtttcatccggtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 65418 - DNA, 5133 bp, Oryza sativa
cgcttaaatatttgccttgcagtgtttttttacaatgatcagttaacttactttcagaattatttttaaaacaaaaaaaaagagtcaagggtgacagggttatctcataccatattaaactacaagaaaaatacaaggataagtaatacacctgtgctgactgagcgtgagatttctcagcccatttaaattgatttttttctaactcgtagaatatctttgacaccaccaattctccctcatctttctctgtgctttcgatatgatattgatgtaatctccagtcagtgatctgaggattgttaccatctgtctcgtaggcatacaatacaaatacttccttgcaaccttgaagattcccatccaaagttattgatataggatttccacttttttgccatctgatacatttactgttctcattggcgcactccttgaagtttttgtgaaagaaatatgatgcacatccatcctgcctaatacctaaaatatcaatcaaaatgtagcatgtgacagtaaatcataaaaggaacagacatgagagatatttacattgaataatagtgaactacctggtatatcttgagggtgagtataaccaaatcctatggtttcatcaacagatttaataaactcgttgataaaaggatgacgacgagcctgaccatttccaacttctgcagccagatgccagagtagatcgctatcggtaggattaaactctacacctctgggaagacctggccaaccctgcagcaatacaataagcacaacatttaagtaaagaagcaatttaacatgatgcaagcatttgtacggaagatcttggaattgctcttggcgcatttggagattttttaggagcgcagttttaaaagaaacacatggaagaggtttccatacaaacattaacagaaacagttgataccagcaagatggcaatccacataagactccctcctaaagaattaattttactcgtttcaaaggaaaaagaaatgtcctttgtagctgctattagatgtagataaaagtaatgttcaacaatggtggagggtgagaaaaattgaggagcggtgatgactgattacaaatttacaatagctgttcaattatttctcataaaggtatattccgtcatgttcagctctgaccaaaaccgcacgtccacaaaagcaaaagaacggtaacacaagaaatgcggttttcattcgaatgccggacgacaagagcaggaaaagatttacaactttacaccgtctaaccgtctaataaccacacgcaaaaatcaaaagaaacccacctgctgcgccgctccgccggaatcctccgccgccgccgccgcggcgctagcctcccgcctgcgccggaacaacacaaagatgaggactccaaaaaagaaacatctgcaggacagaacaaggagaaaagggaggcgcggcacctctccggagcgggaggctttgactccgccggcgggcggagcagccgccgccgtcgctcggcgagcgggaggtcctcgtggtcggagtcgacgcaggggggaggaggcgggccgacctccttgtccttggccatcaccgcattagggtttgagcgggaggaagcgggggtacggaggattaaggtgagatttaggcgagatgacggcggatttgatcgccggtgagaacgtgggtttggggatggttcacggtgagaaagtgaggctaatgccgatcaggttctcgggcgagctcgcaattttggcccagagcgcgaacgtccaaaatgtagcgatctggcccatgtatcattgaaaatctgctcggtttcgatggcggatctcggcctttacccaacagttctatgggccttgggatgctcgagtaggtccgagtcgtgttaattgacggcctttttgcacacttgggcagatcatgttcgaatacatgacactgcgcgcgttgttgtggaaactgatgactacaataggataatgaatgttgagttatctggaaattaaatatagatagtagctacatatagttaatatgtattggatggttacgattaagtatgtgaattatctaatggctcttactttgtatgagtggtatggcttaatgtatatttagctcttagttctagctatatataatttttgtagatagcgactacaacatcagaagttgcaacctattatcaccatcagatcaatggagccaatggccaaaattgacactgcaggtctgcagcactgtcccacttcgtatgctacagtacccataccgggatccgctacagtagtcccctgaacagcatctgctggcgatataagctgttgatccggtggcaaaagattgctgatgttgctgtagcaccacggttgctctggagtattggatcttgtttatagacttgcttggaactcattcggattacctgtttggaaactcgagatgcatcagtctctaccttggatatgctcgttcaaggttcgaggttatttcgaggttatgtcttgatcaaacatgaggtacgtcgtctggtctctgctacaaattaaaacatatgctataaatatttatggctaggaactattgttctactaataacaaagcaaatatttacttgcaccgtctcaagaaaaaaacaattcccgactagtacgaactaagacataactatatccaaattcacacctacgaagtagttccttatagaatggtgggttctatgttatacaattgaagttaccaaataattggtaccgacaagttgacctcaatacaaacaagccatcaatcttttttaaacaacttagaagtgcatattttagaaatgcatgttgacgtgcgaaacactatatgcagtgatgttgattgtgttcggatgtttgctaaacttaaccatatcaaaattttggcactgacaaagtttagtcatttgtgagaaattaataaagttgctcatttggtttgttggcaaatctcttgaaatgtgtgtgttgctggttttcggttaccaaaattttagcaataaaccaaatgaggtatcatctcctcgccacaagctaggcattttttattacaaaaccctactctatgtggtatgttgtatcatatcattcatattttgctcctctccttcccttcattgtctccgtccatattcatgcgattccttgatcctgtttgctaagcgtgaattattggtgcgaacttggcccacctccgctctatctactgtcgacaacaaacaagccattgcacctcaatgtagaggcaagtggcctatctcgacaacacaaacattcatgtcaacctaagccagttcaacggtgaagcgcaccggaccggagagaataccgttatcattgtggaaacggttgaaagtccttctgaaaacgccaaacatgagttgaaaggtcaaatgggaggagagaaatgtgaacatgggtgagatgatacaaacatgctccaaaagagcagggttttgggataaatgtttttatcacatggatctgtgatagatgtgttctaaaatatggggtttcgtgatatctactcttatttgtttggtatggttagatcagttagagcaagtttaataactactggctccaaatcatttatagtcaatctaataactcattcatacaataattacttataaacatatactacatcattaacatatggtccacctcttatacacatataacattttggaattcgtattgcagctggatataaatttatagcccgattttcttctctcttctctcctctctcttttacatgtgcttatagctgacttgtagcctgctattgtactcgctcttaggccctatttagttcccaaataaaaacttttcaccccgtcacatcgaacgtttggacatatgcatggaatattaataaaaaaaactaattaaacagattgcgtgcaaattgcgagacgaatcttttaagcctaattgcgccatgatttgacaatgtggtgctacagtaaatgtttgctaatgatgaattaattaggcttaatgaattcctctagtagtttacaaacggaatctgtaacttgttttattattagattacgtttaatacttcaaatgtatgtccgtatattcgatcgtgacatgcaaaaacttctaaacatggccttaggtcttgttcgtttctccaacaagtcggagatgaaattttggatactcgtggcacgcttttcaaactactaaatggtgtatttcgtgcgaaaactttatatatgaaagttgctctaaaatatcatattaatccatttttcaagtttataataattaaaactcaattaatttttatattcatcttaatcttcaggagattcaaacaccacctcggtgattcagtgaatcaaacgagtccgttgtgttggtaaataaaaagcgttggtcgcttcgttggacagtaaaacgaagtcatgcgcagccagccagtccaggccgatcaaatatcatcgttggagtaccatcaagggctgtcgcccaggcagaaagcagagctaaaaatagcgctgcatcccatcccagtagtcgtttgtactcgccgaggccggcctgcgaagacgaccgttggggctgatgccgaaagccgcgcgaagccatcgtgccgtgcgtgcgggcggcgtgcccagtttttgccacgagcgccgcgcccgcgcacggcgcaccacacccaatccaccccgagccacgccctactctcctctccacaacacgaccaaaccattctctcgcctgctcgccgctgcttccgccggtcgcctctggtcgtggtgcccgcgaaatttgaccgttgctgcgccacgtcacgctccgggccccgcatccccctcctcgtttcgcgtgcccactgtccaccagtctgagagccactgtccccatcatcccatggtcccacgcccgacgctgtagctgacaggtgggtccacaccatatcggccccacatgtcggtgggaggagggctcgctttattggagtttgttcgtttctttcccgttgtcctatgcccactgccagccgcggcccaccagagacgctgacatgcgggcccggatttccccgaggtccacgaagcgatccacgtagtactactcgaaacagcacg

SEQ ID NO: 65419 - DNA, 808 bp, Oryza sativa
tacgaagagagcttttacaccgacatgtgggtcgcaccaacgcgttgggcccagctgcagtgggagtagggggcttgggaggagtactcgggcgcgtagctgatgcggttttgacaccgtgatgggcacctccctaccattgggcccttgccccttacttttgtacaaaagcccctccttttctgtattctcatatttatatcccatcaacttgcaactcttcattccagttcgcttcctccctcccacctcttctccacttcttcttcctcctcccctttcacactccacttctttggtctgctcttcttggtatccttctcctacgcatagttaagctccgagctcaggaggtaggttggtaggtttctattgcttcttctcagctgggagagtgaaaataccgaggagaaaaggcacatcaagattgtttctttcggtttcttgggcttctcttgcggcaacatgaagaagctcttcttcttcctcttcctgctgatactggccgcctcggttgttcacggcgaggacggtgagatttcccttctttctttttctcttgtgttgcttgatctcatattgacccttttgacactgactctgctatcccattcttggatgtggttgcatggctcgatctcgccatctttgctattacatcatcgataatatctttgtttattaggctagttttcttgctgcaatcctggagaccttgaatgatagcgactgtgattgggactggtcgagtgagcgatgtccctttctacccggatttctgcttgtcgtattgtggtctctggtgtta

SEQ ID NO: 65420 - DNA, 3465 bp, Oryza sativa
tttattgcgactttcggtttatgttgttgattatacttagttctgtatttaaatggcagctgggagaaggtccaacttaaattgcttgagaattgtatccatccaagtttggaaatgggaatatttctctactcgttgttgatgttttggaagaatgatactgaaggtaagcattatttggttgatgaaacagcacactattctgtggctggactaagaacagatcggtccctgcgttatcttatgtttgatggttctaaattatgtttgggtgtgtctgagattttccttgaagccttatagagtgggattctttggaaaaaggtgggtaaaggaggtaggagtatgcatgactattgtataagctaagtagggagggaggtcattatgaaaactataatagtttaccacagattttttatctgcatttttaccactgacgtcatattccaattttggcatatgaaaactatgaggattgttccagttaccttaattcattatttgtctgctgtcaactggaacttgctgaaatagtgtccattctattttgcagaaggatcctttgttattagatccctcgctgttactgaagggtcattatttgtgtgtatcgagaacatacatcagtttggttccctccctgatgatccggatactccatatttttctctggatgcttgttgttttatcaacgatattcaagaagtggtaagccatggtttacttttgacatttcccttgctagttatttgtcatgatttgctccaacagctccaaaagataattccttcccaccttgatgttaagtaggtcactaacactcacccttagtactctgtttcttccttggctgtaaatatttgtgatgtaaatgaaaaacagaaaaacagaaaaacagggagcagtaagcatacgtacccattttagattttggttgcattttaagatgttaggtaatgccatgtctgaaaggaatagcatacatacagagcttagagcaatagccccttgcttgaccatccatttttcccctattcctgtatcttaactcaatccgtatcctacccctcctattccacaatccaaacaaagcgctgcttgcctattgttgaacacgaacagccatctttaatttaatatcaatcgatcaagtatatgaatcatgattgcatctgactttattcctttagctagtgaagttgtgtcctaccaaaataagctgtgatatcattgtaagtaagcttagctgttctgtcagattgaaagttgatatcactcattcaatattctctcttcatgtattcaggttgtggatcactgtgacaagagatgtttgacattagttttggacaaccatgcacatgaaggaagattttgcagtaacggtagcattacaaattcacagagcaagcaaccagatgaaatttacacagtgcatacatggaaactcaagtggttctctgaagaaacagttgtgaagttcatttctttacttaaagctctttactctgtatcatcatcttcatctttacctgtaaagtgtacatcttgatatgttggttcttgtagttacatagtgatattcgttcattctttggggttgtatttagttcttaatctgtataggttgttactagttgcccgtgtagatatatgcttcttatgccctttgtagttatcagaaaattttcccatctaaaaattgtacataacagaattatagtgagtgtggaggagtggatctgcaattttgtcaacaagttgttttcaacaattagttaaggacttctgggtagcactaatggatttcttcaataaaggtgcagctgtcagcaaggatggaccagaattagatgggaacaaaacgagagaaggtacttgtctgatcctgtttccggaatttaaggaatttacagaacagttgcagtacagtactggctatacatccacacgggaaatatcaactatgctgacattacaactacattttcatatctgacgctgcatcttcacttcagctgtagggtgctcccagattcttttcagttctacatttcttctattgcttctgtttctggtttactaccgctctttgagcagcgctcatcctctggaacacctctgacccattcgttctcaatcgccaggatatgaagccgagaagggatcggcggcaacattacgttggcgatgccttcgagctgctgcacgacgagccccatggtcggccggtcgccttcctcgtcttgaatgcaccagcccgcgaccttgcagagtctctcaacctccttcgggtcggcatccttggccaccctctcgtcgaccagcccggccacgtcgccttcgtttagcttgaccacggcatgaaccgggaagtaaatcccagggccgccctccgacgacgacgacggcgcggtgctgttccgccggcccgagacgagctcgaagagcaggagcccgaagctgtacacgtcggcttttgcggtgaccggcgtgccggctagccactccggcgcgaggtatcccaccgtgccccgcatggtggtcaggacgctgctgaagtcgcggccgacgagcttggccatgccgaagtccgcgagcctcgccgccatctcctgatcgaggaggatgttctccggcttgacgtcgcagtgtatgatgcactccctgcacttctcgtgcaggtaagccaagccccgtgccacaccaaccgcgacgttgtaccgttggctccaagtcagggtcacctgcttggagtcggggccggagctggagccgctcatgacgaacaggtgcgagtccagcgagccattggccatgtagtcgtacacgagcgccctcttgtttccctcgcagcagaagccacggagtcggacgaggttgacgtgctggatcatgccgagcgtcaccacctccgttctgaattgcttctcgccttgccggagaccgtcgagcttcttgacggccacgggcgtcccgtccggcagcgcgcctttgaacaccgtgccgaagctcccgctcccgagcttctccgagaagtccctcgtcgcggtcttcacggcatggtagtcgagcagcagcagcgacccctgcaccgccgtcaccttgcccctcctacgccgcatccgcaacaccgccgccaccgccaccacggtgacgaggctcgccaagagcagcaccaccgccgcaacgacgcttccaaggattaccatcgatttcttccacgagtgctccgtcgacgacgccggaacctccgagtgggcgacacggaggtgaagcaccgctccggcgaggccaggatcgccttggccattctcattagccgcgtaggctttcatgttgacgagctcgccgttccacacgaggcacttcgctccgtcgggaacgtaagccgtgcaggagcagtcgaccaggcaggtgtgcgcgcacgccttgtcgttcccagctccggccggcgccttc

SEQ ID NO: 65421 - DNA, 1917 bp, Oryza sativa
tccggcacgttcgcgaagatctcgccgtcccagaggccggtcgtccagtaccggtgctcgccgccggcgaggaggtcgaacttggccagcccgcgcgcgtcgatcaccatggagaacgcgccgggcgccgggttctcggagtccgtccacgacgtgaggaagctgtggacgccgcggcccctgtcgtagccgagcctggctccggggagccatgtgtcggtcgggtgatcaaagctctgccacgccacgtgcgtcgtcgtagtcgacgacggcgatcgcgaccgcgaccgcgtcgcgttgctgttcaccacgaggttgccgtcgtcctggagcgtggcgacggtggtgcgcgggggcgacggcgaggaagacgcggacgcgttcgacgaccacagcaaggtgttcgacggcgccgtcgagaacagccgcagatcgccgtggacgctcagctcgaggtggcagctcgacggctcaagaatcgggcgctcacggttggcaacccaaacaaccgtcttcttggagatcttcttgtaccagatgccaaggtagtgcttgttggactttcccggcgagaagaggccgagctcgaagttgccgccattggagaccagcgtctggttccacagcagagactggcctagcgtgagggtgtcaatggcggccgtggggagatgtaggttgaagaagagcagcaggaggacgccgacgaggagcatggtggcgagtgccgagtggcaaccacaattcttacttacttagcgaagagtgattaacttgtttgttggcctcctatatagtactcataggtatctgtcatggcattgattgaagggccaagctttgtttggccatcatgaatccacaagttatgtattagccgtcagccggtcatggcatgatgcagcattggcttcttcaacgatgtttacgtgccaatggactacttttttacagtttatttggattttagacgatatacaaaccgcgacttgtatccaatcagtgtgacaataagtttttggtggcagtaagtttcagcgtgacaataatgtctgtttcaagtttttcggaagtgctagtcaacaagatttctcagattttaaagaagacgaacttttatctctatataaagacctgatgctcatttccatcctttctctctcgcgtgttgatgtgaatcaggtctgaaattttctttgatctgcctgcttcagcaggaagccatccgtctttatcatcgctttagctttaggtctatcactagttggtctcatgtcgctgtgaagcccgttcagtagcgatgcagcacccccgatatataggcatatgcatagcccgcatttatgaaagttagtaatttcttggttacgcatcgaggctttatcccttagaaatggatggatatgcccccacgttaattaaccaacgagagcagcaatcaaactgcaagagcgatgttgtattgcaccgcaccatgggtccgggtcaaaatcgaacatttttttaattgctcgcacggttcagaatggaatcaaaagattatatcataaatttctaaatttaaatctaagttttaaatgttttaaataaatttatatctttacgggcaataactagctaaggtcccatctccgaccggtagccgctagttcttggaccatgatcgttattgcaatttcgctggtattggaggtttatgggaccataattagtagggcagtttgccagattttggatgctgtgaactactgaagtgtcatcgcatagattgtccagtactccagttactctgctgctcggccctagtgtcctcggatgaaagcaaccggcggcctgaacagaactcgtcgctggagtacgtaggaaagcagagggagtggccaccccctagttaatgaaggttggtggcagctgcgc

SEQ ID NO: 65422 - DNA, 3159 bp, Oryza sativa
taggaaactgatgtcagggcctgttcagattgtagcttaaataaagcttatcaaattttagtaaagttaccaaatatgtgcatccatttagtttttttatcaaactctaataaatacataaaaaatcctgccaaaatttgataaggtttattttgactacaatctaaacaaaccctcgttataaaaaaacaaattattgccgaaatatacgaaggtgattccgcgtgtgatggacgatgaaaaaaaaactttacccgaagacttacttttttttttgttcttcacgtgggttctatttagttagaaataaattaaaacgcacatgtaaaatttacagcaattttatatcttaaaatgatggttcaaagtgattaatttttttatgtaaacatttaatgatttttgggcgaaaaaataagggccaaaacaacgtgcgccggcccgacccgttaggcaaggaggtcctatagacacattacacgagggagcgaaagtagacttattacaggagaggccggagtgaagattttccacattaaccaagcaagcaaattaccacttgtgttatgtgattacatggaagatacatatactatatcaactgcggttttgcaatacaatgaaaaccgaccgacccgactcggattaaaacagattttagtggcgcgtgggatgacggacgaagaaatatcggaatccttacgtatttttttattaggtatagatatagatttcattgaaaaaaaaatatgttggacctacgagaaaatgcgggaatctattaccagaagctgcatgtccatagatcctcgagtatgatttggcagcccttcagaaacgcaagcttcgaatcagcagcgatcgagttgtaaacgagaagagtgcttcgaaaaaaagagcaaatcacatcgaaacgcaatcagaagacgagaaaacagatctgttcttcgaagcgcaaacgagaaaagaaacagattcagattggatctttgatggaagggaaggaacagggagggagccaaggctgcgggatccggcggcgcgcgaggatatggaggagacgcagaggcgctgggttttataggcctcgattaccacgattagggtggaggccggtatctatgggccgcacatagctgtggcattacaccgttccggcccaaactatatgggcctcttgtaagtggctatccctttcggcccaaccaatgcaagtccgcgcgttcgtcgcgatcgaaggaagcggaaagccgcaaaaatccatgaatcgatcaacgattcagaacaaaggaaacgagtgaaggcagttggctcagaagaagattttgattgtggtgcagcgcacaaacactgacacgttctgcaaatacaacctagtaccaatttccttttccaggcaacgtaccacccaataccaagttcccagacaacatcttagagcaacagatgaacacaggcaacatcatcttgttcgttctcaatgatcaccacccacccataacaccgaggccaatcccactagacaccaaaaaaagaatccccccatgaattcctacggactctgctgccttgcctactaaactaaccactctcgtctcactgcctacaacaggaggacgacgctcaacagcagcgccgcgacgacggcgcggacgaacgacgagacgtccccgatcgcccggtgcgcgccggagtcccccgccgtggagttcgacgacggcgccagcgatgtgccgttcagcaacgacgtcccgttcttcccaccactgcacgtccaaaaataaatgacagatttgagcgaaacgcacttgaattctgtttcaaacatcgcgagaatgtaaagacgttatggggaggggaaaaaaagagcgtaccttccagcgtaaacgcaagacccgtggcctgaagaaaacagagagaacgaaataagctcaaatccaaatgtttggaaagcaggaatctcttatggttttgtgaacttactgggatcggtggtggtgatcacggcgacaccgctgaagtagcacgtcccggagcccatgcccatgccatggtagtaggcgttgaaggcgtaggtggcgtgcgcctcgacgttgtccgggtcgtagcacggctgcccctgcatcagcgcggagcagtccaccttgcccgggccgcaagcccagtcgagcgccgcctgcagcatcttctcgtcagcgccctcccgcgccacgcagtaggtctggttcgtcgtgtcgttggcgagcagcacgccggagcctgtcaggtgcagggtgtacgccgggatgccgttcatgtcgaacaggccccagtacttctccgacgtcgagccggggcgggtgtcctcgtcgtagagctcgtaaatgtacgtcggcacggcgacgccggggtgcttcggcgtgccggtggtgttcatcacgtgccggatgaggttactgttgtaggtgtcggcgttgtctgaggtggcgtctggctcgttggacgggtcgcccttgtgcggccacccggtctccgtcaccatcaccggcacgttggtgacgttgaggtacgccatggcgaagtaggcagcgtccacgaccgcgtcgaacacgttggtgtagtgcagcagggtgttggcgtccaccgcctccttgttcggcggcagcggccggaacagcgcgtagtccagcgggatgacgccgttggagcgcatgtagtcgtagtacgggtacacgttgagcatcagcggcgagcccgtggactgcaagaacttgagcagcggcaccagcaccgggtccagggagcggttgaagaaggcctgcgacggcgggaacgagtcgaggatgatggacgaggagtgcggcgtcgagatcttgatgtaccggtcgagcgccgcggccaccagcgcgttctggaggtagcggatggccggcatgaggagcggcgccgcgttgggcagcgtggagagcacctcggagccgaccgcgatggccgtgatgttcacggaagggtagtgcgcggccacgttgcgcgccacccagttggccgccgtggcgttggagttgccgatggcgaggagctgctcgttcggcacggagacgatgacgcggatgccggtgttggcgagcgccgcgagcatcgccgggtcggcgtcgtacagccgcacgtggcggatgttct

SEQ ID NO: 65423 - DNA, 2303 bp, Oryza sativa
taatatgattttttaaagcaactttcatatagaaaatttttgcaaaaaacatcccatttagtagtttggaaagcgtacgcgcggaaaacgatgtgcattcttactccctatcacccaaacaaacacagccttagaacacatataccaatatatggattaggattactggtgatttgggaacaaccaactagcagtcatcttaaaaaaaaaaagagaagtcagaagatagctacagtgaattcattagtgtccagagagtgcttgtttgacaagcaagtcaaaagtgtcaaacattgataacatcaggacggttggcatgcgatcgtgcaggtttaaatgcagtcaacaaagaagtcagaaacgactcattgtacgtgtacgagtacggtcgctgttttgctttccgtgatgcggttggacgttaaggtctcatcactagcgcgatgtcccacagcgatccagccagcttcatatggttgcatatacagaaatactactactttgcattatcaactatgctccattcagcttcgtgttcagatactctctcgatacttgcgtgaagagagatcagatatggacaacgaagacgtgcaacgtgtgctttcaaaaaaaaaaaaaaaagacgtgcaacgtgttacatgaacagtacggcaaatgcgatcgaggatgttactcgagttattacggcatggccaatcaaagttgacagttaaagtccaccctcagcgaacaggtgattgatcgattagtactcctaacgctgctgtacttctcgaataaacattgggttattcaaaattgttggagtagttataactggaggagtcatacaattattataggactgtgacctcgatcaggatggtttctaactctgttcctatcaggtagccttcaactccaacacaatctacactctgattgtatttacaccctgtatatgtactacttcctccgtactcgtcgttttggtcgggactcgggagtaaaatggagtttaaccgttattattttctactaagcaacttcaaagtgaataggtttaagtgtatgtaagatattggtaaaatattttgtcgacgtttgatgtcgcgattccggtatttgaatagtatggggattgtcggagaatgaactcctccaccagggaaccgtgaggcccccctttgtgagttcggccgggggcagcgggtgagattcgaggatttggtgagcgaaactgtgtggtcttgagggggttaggcccctccaagacgatcagaccaaagaggtttatacaggttcgggccgctatgaagcgtaatatcctactcctgtgcatgattgattgaatgtagaacaccagtgcttggggttgcgagacccaagcgccagttcgctccgaagtccctcccctccaccactaggcctagacctccttttatacctcaaggggttaccacatgggcccaacaacctaacctaactccggtggagaagtattataatctttgcattaaatgcatgtcttgtttcttgacttgggaagccaagcacacgtcgtcttgatgatggggcctgtcaaatcttgccgcctgacacggggggtgcccctgtcaatcaccatttaatgggtgaaaacttctgggctccttttacaccgggaaacgggagccttgctttgaccagagcgggaggaccgactccggctgggataagaggatgagaacctctcaccatcactatttgatgggacatgtcaggctgcacaccgcctgacacacgagcagcgcacaggcgcactagccagtctcatcggtcattcgaccggtcacagaccggttgagtgcactgcacgccacattaaatgcggcgtagcgcgaccgcttgggacgccataaatacgggtaggcggacacctaacccaccgtacgtggtgacctagagatggggtcgggggagcccgacccctagtcacgggagggggcggccgccgcccgacctcgggcctgatcccccctcggggggggggggagccacgtggcgcctggggcggccttctccctctagtctcggccagggagtggccgccgccctacctcgggcctgacccccctctggggagggccacatagcattggagggcagcgtcctccatccaatttctgggaaggagtggccgccgtcctacttcgggcctgactcccctcgggggagggccacgtggcatcagggggcagcctcctccgactagtctttggggaaggagtggccgccaccctacctcgggcctgactccctcgggggagggccacgtggca

SEQ ID NO: 65424 - DNA, 6582 bp, Oryza sativa
ttggccggagccggtgttgctctttattcactataatcacaccagtacaatatttagggtagcctatctaactattgtagacttggcggtctgaaattctaactcgtatcgacaacagggtagtcttcctcctcgaatccgtgcccggcgagatcagagatagcgctttcgtctctcctgacagtatccggagacaccgtaggggactagccgtgcttatccctgaagccgctttcgtctctcctgacagtatccggagacaccgtaggggactagccgtgcttatccctgaagccgctttcgtctctcctgacagtatccggagacaccgtaggggactagccgtgcttatccctgaagtcgatatccggcgtcttgtcttggcttatgttggcttgtatgttgtggcttctgttgttccgtctccactctcctcttaggaggtcttatatttatacccataggtgtccccttgtccaagtagaactagggaaaccaatatggatacaatccgagtagtccttgtcgttttcatgtggaactctattcatccttccttatgcggaactcctcttatatctgaaggttgtttccgtataagagtatgtggtgggtcctgtcgagatttagtcaactactattaggtatgtggtatctataacactgacatattttccatcgcaaaactaataataagtagtacaacattgatgctaaataattagattatttaagtatcaaagctaagcaactcaaagtcaaaaccgatgattaacagatgaagtattaaatatatttttttgcgggaatgaagtattaaattttgacttaggtattattatatatgttaagtttcaagttatcatgcatgtaacatcatgtacgttttcacgaaaatgctcacacccgcacgaccggcggggtggagaaaaatcggacgttgtctaccactacagtatgcaaagaatcttttcttttcttatttattcaaaagatttttttatcgtaaactatttatctaatctacgatctgattgcaccactaaattcgttacaattaaatctttacaataagaccacacatgattatatttcgacaaaatttttattgatttttttaatgttgcatgtggtcacttatgtttcaactagtagttttacaatgtttcagctagtgtactcatgatgtttcactgtgtacggatcaaatgttgcagtggaacgtgccgttgcaataaatcacccacatattttggaaaccctctattaagggaattttgtttattttttgttccacaaaaaatgtttcacctaatgcactcacaatgttctactatgtatagatctaatgttgcagtgaactgaaatatatcattgcaacaaaaaacccacatattttggaaaccttctattaaggaaattcgtttcattttttgtttcaccgaaaaatgttacatctagtgtacttataatgtttcactatgtatagatgtaatattgaagtgaactgaacattcttccgctatttgctgaaacattgtttttatataaggtgaaacaacaccagatttaaacgagtgaaacattttcgagaaacaattccgatatatctggtggaacatcgtgcaacatttaaaaatatttcaataataagctaattttttttcatcggaatatatccatgtgtggtcttgttttgaagatttaattgcaacgaatttaatggtgtaatcgaatcataatttggataagtaatttaaaaaaattagtttaaaagtagttttgtatgtaaatcgaacgctgacgtcagtgtccgattttttcctaaagcatcgaacgtccgacgcgtaccctctccaagttgtcatttgcaaaagggtccaaaatgagtattaattggcacgggtttgagtctcagtgcccatgcatgttccgcttgttttaattcagttattttcgataggcaacaaccaaatgcaacttttatatgcacaagaaaggatacagctgccgaacgcacaccaacaccaacagctcacacggttgggacgtgttgtcacgttgaggcgccgttgggcacgggtggcatcactccacccgtgggtgggcaggtttcacccggatcgagccgtacgcggacacgcatggcgtcgacctcaccactgcaaatgcgtgcggttagtccaccggtggcggcctcacatcacatggctcgctctcggtctcagccaataagccaaacgacaacgaggcaggcggcggctggaaaagcaaagcgcctccctggccgcgccgtacatgattcgagcgcgtgcgcggcgtcgcgaactggctggccggacgtgcccggatgagatagcgcacgcgccaacgtgcatatgcctacacgccgcgcgtgcggtctgggacgagtttcggtgcgtgagatgacggacgatgttcggttgcggactggcggcgatggatgacgccacgcgacgcaccgcgcagcggctggccgtttttcggttaatctatagtagctgagctgggtggtagtacaaaattatatattttttaatataattttacttaaaattaaaatttattaaatagttaccttgttgtcttaagattttgaaagaccaaacatatatattaaccatttcattattaatcttacaattattattctgttttataatccgatcacactattgtattcgttataattaaatcttttcgacaagatgtcatatgactatattctacttaaagaaaaatatatctttcaacagttaaaatttaatgttgcatgcgtgataatgtggctactccctctctctcatattacatgcatgtagtaatttttaaaataaattttcttctaaactatttatccaatctacggtatgatcgcaccattatgtttgttgtaattaaatctttacaacaatatataacatgattatattttgatgaaagtaatacatatgttttaacatatgttttcatttcataaactttttaaataattcatttgctatttttttcagcatgtataacttaatgtttcacccatgatccattaaaaatttaatcaaccatttatttcaaggacaactgtgttattgccgctattttatgttgcaattatgattttacccttcttttttagattggtgtttttacctttactttttgctaagaaagcttcagtttgccccaattctaaatggttgttaggtggcccagatttgtgagataaaataaaagagaaaaatattaacgaagtgcaaaaggactattgtacccccaacacagtattcgttcagccgttcccattcaaatattcctatccaagtcctgtgtagaactcgagcagttagcggctgaggctgggggtaggcgggtagctggcggcggctctggcacagcgccacgggaagacaacagcgggctacggcgagccagcaacagctacggcgcaacacacgggaaggcggcagatcttgcgcatcaccacgggaaggctgcggcgagcggccggcggcagcgctccggcgcagcattacaggcagttgagcagtgagcagcatggcgtggcacgacggcaacaacgacacatatacggcgggcagttcgtccacaaagacgaacgatgccgttgctgcttgattttccttttgttttttcccatctcatagtatttgtgacttgcgaggaatttatgtaaatattagtgctgaagtttcgcaaccattcgaattatgtgaaaatgctatcaaaattctatgaaattttgggatacaaattctaaaatacatgtctttttacagttgaattcacacaccgggcaaattgaattttcgtttgaaaaaagtagggatgaaaacacaaatcctaaaaaaaaaggtaaaatcataattgaaatacagaataaaggtaagaacccgtttgtttcagaattcatgcaacctgctgtaaacttgtgtgtcgggggccttgcaggcttgcagctacggtagatggaatgatgagttcggtcaatatttttttctttcacaaagctaacatgtcagggtaatcagatgttaccgtgtaacacgtctaattaataatctaaaaaagaatatagataatacacctgatcgtgagtgatgttcacccttgcggccttacctagttaccttcattaatgcctaaaatgattccgaaacaagttattctccatgccatccgtaggctacaggttccctttatagtcgactagattcattgcagaacgaacatataaattccttccattgtatatatgttgtacatctaaaataaactcacggcttttatgtacatatttgagggcacaatttcatgtgctggtagcctggtaacgtggtagcatagtacgtaccatgtgaaattgagtacgaggacgtgaaattgagcaagttcactttaggtacctcaatttatctctcagtctgaaattcatccctaaactaaaatgacaggtatagcaggtctttcaatttacaaaaccggatcaaccgagatcctaggtagtattatcaccaattttaactgattgacaagctgggctcacatgtcagtggataacatttcccggcgccatcctccgtgttcatcgtcgcgtcgatctcgtcggccagatgacgacgcacgcagcagctgtggctctgtggtcggtcaccgttagggaaggaggaggtggtggtcacggcagcggccatgccggagccggccacggccacggcggcggacatggcagcagccacggcaggccggacccatcagagcaccacccgggcaagcgcagcgcggcgcccggtgtcgggcagcctcctgcgccgctgtcgctctgcttcccctctgaatgaatcctgacccgaaccgcaccgcacccaatttcaaatcttgaatttaaatcgattgatcttgttgtgtacatagaatgaaatgaatccaaaggaattttttgcgaacgcagaatccaaaggaatcatagagaatccgcccgattcgggatttccggtgagattttcccgcatcttcaatctgcaatctatgtgttctttccaagaaatcaaggttttttcttggatacgttcatagaatcgaataatgcattgctaaacctaaaagggttcaaaaaaaacgtagtcagctttcaagtcgcatttaaatacgtagctacggccaacctgcgaaaccgagacaaattcaagagaaaattcctgtgtacccttaaaaattcacctaatcccttatacgtccttgaattttacttattttcttatatacccatgaattttagtttggatctcttccatgcctttttccgctagttgactattagttaaccgttaaatttttaatgaaaaaaacccattttaccctctgctatgaaaaaacatataaaataatagagtagaaatttgttagatgggactattatatttatgagttagttatgcaccacattatgtgcgataaatatacctttagatataacataaaataatagtccctactgtattagttattaaaagttttctatgtagcacattagtatatttttcttatacgacaaatttgttgtattactgtcacaacacatatgctacataaaaaaaagttttaataactaataaataagtactactccgtttcacaatgtaagtcataaaacttacattgtgaaacggagggagtattaattttttatatgatatctaaaagtaaatttgtcataaataatattgtgcataacaaactcataaatataatagtttcatcaaataaatttctacactccaacaatctactccattagtttattatgtttcttaatagtaaaggataaaatagatattttcataagaatttaatgatcaactaggaaaaatggcataaaaaggatccatgtaagtaaatgagcaaagaatggattaggtgaacttttatggatacatagggagttttctccaaattcaatgatcacgaaaccatggctcctgctcctcatcttcttcctcctagccgtgttcttgcaacgggtgattcttctattaacgggcaagcgattcatttcatcctctccgttgactctctctgctcgtgattagattgatctgatcttagtggtgttcttatcctctcttcctacaaagttataatccattaattactaaagcttaacatgtaaagatgacacatcatcgttcactaacaatcattaaatttaaacatcatgcaaacatgctatattaactataattttataatttattaaattttagatcttttaaaatgcaagcatgttaaattattatcccacataattcacataatatttttatatatatcttgattgtttttttatattatactatgtacatatatagttcatcatcacttagttctctcttctctcattaagtcatatcacatcaattgtttttagtgcttaaataaaatctatggtccaaattagattcgtctcatgaattagtccaagattatgtatgggttttattaatagtctacgtttaatatttataattagaacatccgatgtga

SEQ ID NO: 65425 - DNA, 2958 bp, Oryza sativa
ggaatctatatttttcccaagttatttttaagactgagaattgtccttggtatattgcaacattgctatgtcatcatcaaataatgaggaatcaacccattattttacatttcctgtaccatcttatctatacgatcagcactgctttgcacctttctaactctggacatgtgtgcctatctggtttgttatttggcactaagtgtcgcattacacatgccgtttcaaccacccctgcctatttgggctaaaacatcatttttccaaacactagattactagacagggaatgttcatttgctttcttcttttggtttcatgtagagtctcatgttggggcatggtctcatctgttttattcctgttaatagaggcattttaggtttgtcttatcaatttcatgtaactatgtaaggctctaatctcaatgtcaattacaagttcatacaaataatttagcagatgggtccgccttgttgcattcagctatttgctcaacatgaccaacttttggaagaagtctagaagggtaactatcccataatctaggccactaacatcaaatttattgtcgtaaaactctttggagcgtttttttttttgtttatttcttcttcactaaaaggcttacccaattcaacattgtgaatgtttgatagtctctgccctgctaaatatattgggatcaaattgcctgcgctagccttaacaatccttacagaagtcattagtcagtagcatttctatctgagtttctgccccagtaataatttctccccatttttagatttggtattgttttcctttctactaccattaactatcctacaaaaatactctgtgtagttatcgcctttcctcaacagccaagtcaaatgtgttctttttgatcagatttatagctaaaggtagccatattttgggacagagggagtagtgcttatttttgcagctaaaacctcaacccaatctttgaaagcattctttctttttcctcttatattcgtattttgtcaataatatcttaacctgattggtttgtgccaagttctattaattagtcttgaaaatcagggtgttggagccaatacagctcagatttgagtttgagtgagctgttataactgagatctgctgttcctttttttacatgcatgcttacaatcccataaagaacctgtcaatttacaatttcatttttctatttttatttttactctttacgctgtaatttagggggtattagaatttaaaaggccctgaatcctcttcctaactttctgcaactttaaaattagatttattttcctagagcactatttttgtgaactcacaggaataaacttctctgcaccagagctcgagtgttttaaaaaacttcaataacttgatgaaatctcaccagagttctctcttatctgctaacccatacatctagcttttctcatgcatgtatctctatctgatatagtttgaaaggaatttgaggaatgtttaggagtacgttccaaatttctcctccttatcagtctttcagctttatcttgtcctttgactgggaaggccccctggctctaggtcctcctaggttgcccaaacattgacttgttttttctttccttttgtattccacaaccttgtatacatcatttaaagctccagcatttacttcaggcttacctcaggcttcttaagatcacctttctatgttatgaccataccttcttcattcaacttcttgtcttgcatattgtctgcatatgggttcacatttttgcttgactcagcagttccaatcatcaccaacttcattcttttcatcatatatcttggtttgaatgtaatcaacaaaatcaaacaatttttttctacagtggcagaataatgtttatattttttatatctgatcaatcatacttgtttacttctagatgaagaggcttcattccttctttgagaaaggatccgtttagcatatcgcccatgccatcttgaccatatgaatcgttaggaatttgtccaactttcttggttttgtccctgttgtttgcttcatctatcacacacctttttgacctgatgatgcgcataactcttctgggcatttgtaatgaactttttcacaattgtggctaccagaattgttatgatcaacaagatatgtctcccactctgaccttagcaggagctgatttgaatttggtcagagtaggttttgggttatagcaagtcttttcaccacgtataaattttttaggctttcttctcttgttcgatatttttctcccttttaaccaccatctttatcatttgaattgtttcaatttacaggttggtatattccgcatgtgcaaaggttccacgtgcactataagtctgagattaaatatatcaaatgatgtagaggtgtttgcaagaggtatgcataaatcctttcaactactacaaagcttttatattatagtaaatgcatatggatatgggccttggttctgatactgttatatgattttttttatgtctggatatttacatgtgtatttccctctgttcgtttctatatgagggacataacttgacaatgacattatgctgtccaggcaaatacattttctctgcaagagattgtacctgggtgtttgatgatgtgggcacaggtatttttaactttgttttctctttagttgctaaatattaatttatgaaacaaagattgatacaataatctgctattcttcttttttgttgcacttttaggtctttaatttagatgatgaatttaggccctaatattgcaagatgtgcaaataacttcatttgataatgtattagtacattttatatattttgtgaagatgactatccctttaggaagtattaagttgagttgtcattcccatgtttctaaaaattttgacttttttgtttctggaatttctcttattggccagaatgatc

SEQ ID NO: 65426 - DNA, 5864 bp, Oryza sativa
tgatttcaaacggccgccaaatctccatacaagctccgttttcggcccgtgagtacttgatggaaagctctcggagtcctctttccaacggatccaacctcatcaccaaattccatcccagtcaaccgcagatgaagaaacaaggtgcaacatcacctgtcatgggcctttgggcttgtaacttcgtttgggaccccggcccaagtggggcccatgtgaggtgcgccccaaccaggtggagcacaaccctaggaccctcttggtcgttctcccacccttataagtagctaggtaccctttcagggtttctcgggttttgatagattaaagtttagccattgctacttacttgcagcgcgcgtgtcggctagaccgtccgtcttcttgttcttcagaaccccaacttattatttgtattaaattcctatttgcaatatcagattgcttttatgttgttcttacttgtttcttcgatttgcttgcaggaatagggttgatctgcaccggcaagatcaacaacccacggagaggtgtatcgatcgctaaggcgcaacacaacgtctcgtacagttgtagtcggatcgtcaacgtttctcccaaatcgtagttatcacaactcaccgaaagatcgagccaacaacagccttgagtgtcgagaggaactcagggttcatcagaaagcaacaaagtgatggagtcctcgtacgcaagactactgatagttcctaggtagtttatatatgtactacggagaccagggtactgctattacactggctgtggcctgggctagtggtttcagggctgttggtcgaagttaatttatgtaaactttgttttggctgacccatttgctgctgatatgggcactcgatgaaggtttcagaggctgttgcttaggtaattaaggtaagcttattttggatgaactggtagttgctgacatgaacagttgaacatttccgccgggcatgctttattgaattattgacggtcaaaatagctgttgctagtccgtttgtctttcccttggtcaaaatttgattgtccagatttgctgtattttttaaattgctggcaaagatgcttatattgataagtgtccatcttgtgggtggaattaaacatggtggtattacttagtataaacacgagttagcaaatactccctccatctcgatttgtatgatgccacaagccaatggagtgaacaatctaaaatgagtcaaaatgtatgatgccacatggagtgaacaatgttccaccatctttcccttctccttaaaccatggcctgatggcgtgatgcggagccgtttgcatttgcatgtcgctgccgtgattcctgaggccacctcgaaccgccttatgctcatggctcctcgccaccgtggtggcagtggttgacggcctcattggtatcatgtgatgtagccgccgtcctcgttgtacacgatagagttaagctggtgctatgtttgagagaggccatgctactgttgcacttgcatcgcttgtgccgccgtcgagaaaaaatcgtgcgcgttggcggcggctccccaatgttgtgttgggacttgggacagtgggcttttgaagggaaaaaaagtacgaggatcgtgacaattaggatagtttatactccctccgtcccacaatataagggattttcagtttttgcttgcaacgtttgaccactcgtcttattcaaattttttttgtaaatataaaaaataaaaagttgtgcttaaaatactgtagataataaaataagtcacaaataaaataattaataatttcaaaaatttttgaataagacgaatggtcaaatattacaagcaaaaactcaaaatcccttatattatgggacggagggagtacaattttgaatgtactccaattactatattaaaagttgaggaatcaagccaagcagaagtgtccatattgagtcatttgtccatttgcccaggcagcccagccaaggcaaaccaaccagctgccgctgctgtaaatactcctgcaacagtatttgttgcatcacgtacggataaatcaaacgtcttttttttttcatatctctctctgcttacccatgcgtactcatgccgttgtcttctcgcagttgcgctggtccaaccgtggaaacgaacacagtgaattcgaattcacggttcgttccgtcctcctccctggacgccaacccggtttgcgaccgcacctaccccaggaacaagtccgcgtacgtccgcacccgcccgctgcatgccacctatgtctgcgttattgcttctccgccaaatttaagtcttcctttacctaccttctccttgctccaatcgatctcgccggtatatatactgctccatctcgtcgctcgtctctcgcgttaacccctcgtggcctcagctcgtcgatcgatcgatctcttagtccgatctacttgcgcgcggctagctgctgctgctgctgcgtgttgggggtggtggtgcgaggagtgattggttggttgatagattgatcgatcgagcgatggccgtggcggtggaggagatcgtcaggagggccggcgggtgcgccgtgatcgacggcggattcgccacgcagctggaggcgctcggcgccgacatcaacgacccgctctggagcgccgcctgcctcatcaccaagccgcacctcatcaaggaggtaactaatcttcttttcttctctccccgtagttcaccgaccgggccgtcgcgcgtgtgcctgcatgcgtagtgctcgtcagctcatgccacgcttgcgccacatgctgcatgatgcatcttgctgtctcgtcgttgtcatggcgccatggattgctcacgttgttgcccgccgcgatggaatgtgtatgtgccagctgagctgcgtctctgtttgttgttcggttgaccatgtgaaaagctatatattagctgttgccgtgttggtgttgcgttagagatcgatgcgattattccacaggtgtatgtgtgttcttcgtccctttggtcttggaatacaacgttcggttggtaactgtgttatcagtcaactctcgtttccttttcctccacaaaaaaaaaaagtaaacaaatcttaagatgtgatacaaactgtaagtcttgctgtcttggtcttgacctggacaagaacactgtaccttttccctttctcacctatggacctactaccgaccaaccaagttttttttcagatgtgtctagattgctttttggaaaaaaaaaagaaacaataaaagattacctactctgttgagtgcgagaggaaaaggtaggtaagcacctctgaattctctgaatgtcgaacattctcagagcattcagtttcatccatccttttccctgaagtaatgccatcgtttgactcaatttaatccattgtcaggatgactattctagtgtgtactgtgtacacttgaattgtgtttgttgcaccaacttctgataggcaggaccattcaattgtgtcaaatttacttcggacgtgaatatcacgattcttttcgaaagatcaaatgtcacaattgtttcaacttctttatgcaggttcacatgcaatatcttgaagcaggtgccgatgtcatcatttcctcatcataccaggtatcatcggtctggcgatcttcattccccagctgacataaagagtaatctttcagtttcagcatcagagaaattgatgccttcctttcttgtatctctctgaaggcaactatcccaggattcttagccagaggaatgcttcttgaggaggcagaagggttactgcgaaggagcattgaattggcactggaagcacgagatgaattctggaagtcgacgctgaggaagtccaagcctgtttacaaccgtgctctggtcgccgcatccattgggagctatggagcttaccttgccgatggctcagagtacaggtaacttctaagattcagcactgcaaagccatggattagccatggatcggcacgcattgtaaccttaacctcgtatataatattttgcttgtgtcattgatgcaacattgtatctgacagtggatcgtatggagaagacatcacggcagagaaactgaaggacttccacaggcgccggctgcaggttcttgcgagcgctggccctgacttgatcgcgtttgaggccatcccgaacaaaatggaggcacaggtgaggctagtgaatctgaatctctgaaagaaaaacacagattgtgcaatgtgttccagacattcaatagcactgaaatgctgccacctttgatgtttcttgctgaaattggtgatcatgcatgcaggctttagttgagcttctggaggaagagaacatccaggtcccctcctggatctgcttcagctcagtggacggcaagaacctgtgctcaggagagagctttgcagagtgcctccaattcctcaacgccagcgacaaggtgaccatcgtgggtgtcaactgcacgccgcctcagttcatcgagggcatcatacgcgagctcaagaaggtttgcaccaacttccttcagcaccatcgactccatcttgcacacaccccaacattttctttctgcaccggttctgcaatcgtctgaaactctgaatgtgtttctgacagcaaaccaagaaggcgatcgcggtgtacccgaacagcggcgagatttgggacggcagagcgaagagatggctggtgagcacgacctgttacacttaatctgttctcatcactggcacgccaagaaagattagcacagatctgttctcatcactggcacgccaagaaagattagcacatttccgtgcgaattcttggtcgtcttgatcatcaaactgactggtttttttgatgcgtcgcatgcacagccggcacagtgctttgggcacaagagcttcgacgcgctcgcgaagaggtggcaggaggccggcgcgagcttagtcggcggatgctgccggacgacgccgtcgacgatccgggccgtctccaaggtcctcaagggcaagacgtcctattcagcaactcagatttgagaccgactacttggtagtgcaacttttaattaatagcgagaattataccgattcagtattagtttatgctaaattttgcagcggaaattaccgtctaacgatttgtaatgctgatgtgcaaccatcgaattttatacgagcattagcatggagagtgttgcagaggcctggggatgtgatttatcttctttatccttgtaatataaggaaagtagcagccatgtatcgaatttatgagttatctatatatccaaattgcactgataatgcaaaagaacaagttgcgtgtcctattgtttttgtgaatagttgttgtattggcaatacttaattccaaaatccagaacatctacagtctagagagaagacatgtagtatgaaactacaatatgccaacaatttcaatacctaatgcggaccatgaaccaagtcagcctagtgctagtagatgcgctctgacttgccaactttccaagtgaacagaacctgaattgatgacaccttcaaaatgactgctttatctgatgttagatctgcagtgatccggccaacaatcaagcatttggatgactcaactggtgaatccatatatgaatacccaccatttgccagatgatctaatgtttatcaacagctagcaaaaaaaaatgcctagttcacctgtctatccatccacaacacttattacagtgtaaccccaccatgatttcctacgtacaggtgcagataggctacacatggcacccctgtgttcattctttgtaagccttctgaattataatgatgactacaacaactctacaagcccacatgaagaagggggg

SEQ ID NO: 65427 - DNA, 1916 bp, Oryza sativa
attttcccaactttagttggaaagtgagataggaccaaatgcccctcggaatacccattcatcaggagctttcctatctttgtcttccaatctgtgccagatctctcgttccacctgtcatgaactacccggtcacggtaattgagcattgtgccaagcccagaatttggtacccaaccatattcttccaaaacccgcgcctctccttccgtcaaatcttcaccaatctgtaaaaaatagattagttcaatgtcctacaaactccttttactcatgaaagaactcatgagtaaaaggtactgaggtagcacaaaattataaactcctttcactacggaaggtacatatgagattggaccgttgaagctaatgtcctatgtgaacatatatctggtgctaaaattttctaaaacgagaaatatattcttcggaggtatattatgaacgatatcacaaacttagttacatcagaaagaaatatagaaaaagagtcgagtgcatgaatgtatgattgtatccagcttcaaaactagtaactgcgtattctgatagaggatcctagaaacaattgtcaactggaaaagaaactaagaaaggctataacacagtttattaatggttaatgggtagttgtgtacttgtgttcataagcaaggatagaagacattatgaaaagctatgctggtaacaggtaaactgaccagttactgtaatgtttcaagtctattccagtttaccttttaaaaaaaaaatcttacaatatatttttcctcaaatgtaaccttttacaatcaccagcttcaagattacatacaacacatcaaacttcgtataattttacccttgtactggctttatcatatctattggtcacagacgatataccagtaaccagcatcaatagagctgattttttttcctcctctgatcataagtcgataatagggccttttactttgaccacatttctacgtacgttgacagtcaaaaagtgcagcacaacactgggaaaatgcaggggaaaaaaataccaaagcaagaaatcttaccaataatggcctattttcaatcagagctgtcctgccacaaccactaagcttcattgcagtaaccatcctttggatctgccattgtattggcagtgatttcacaatctcaaagaagtatgtcgcatacccatattccggtcgctcaagaacaatcctgtgaaacaaaaaaaggaaggcataaaggaaagaagcatatcaaccattttaaccggcagtacctgaataatagtattggctaagaaagattacctgttatggcttttaaaaataaaaataaatgattgcaggtctctacaccatccccattcaacaggacaatcacgaaactgaagatagcgggactacaagagataaaggtgtataaaacactaaaattgaaagcctcgtacaagtgagaaaataaaaatagcaaatgttgtctagatgtggataaatacctgctcgatgagagaaattaaacaggtcaagcagtatatagccttttcccccttctcatgcctaagtgcagatttcaacagggatgttctttgcggaaacaactgtgtattgaacaaataaaacatgtcagtaaactataacatacataaccaccccatgccatttgctcttcacaattagcccataatactaaagatgcagatgtagtccctcaaccttggggaaattaggccaataacctctaagtcatctgtatttacagacataacacaattcacactgaacttcctggtgacatgaccaacaaatgaaatcatgtaaaccaaatcatagctgctgtattgctgggggggagggtgattatatttttcagttgggaaggggaaggaaaacgcaaggtaactaacaaacatgcaaatgtttcctctt

SEQ ID NO: 65428 - DNA, 3755 bp, Oryza sativa
tttttgggacgaaggtagtattatataatgcagcaaaagaaacttacccaaactttttccacatatccaagcaatgaagtataacagatgaaggaataaatcccattcctagaacattagtcatccccaaaacttgcccattgaagttaataattggccctccaatgccagactaaaatatttaaattatcgatatcagaaccaaaagcaacaaaagttaatactaatttataagataatcgtagtgatatttatacctgaccagtcgtgaaaccagtatacatatagtagtggcgctcaaacatacttggacccttaaattggacacgcccatgattgatagtcaaatttaaatcatcatctctaccaagggcaaatatgtcctgaccacaagtcacttcactgctgaaactaggaatcttagcacatgagtctacatcaaccttaaacagagcaatgttaaagtgcctgtcataatgtagcaaggctgctggtacagttgtctcatctttatctagcaagtgagcgtaaacctaaaaatacaaatgcaaaagacatgtgttacattattttaagaataaatcacattatttaacaaaagtgtattatttcctttactttctaattaaagtgttgtgctctatgtgtgtgctagacatgtatttatttgtgtgtggcaaaaacctaagctcaaaagaccattattactttgtatgtcaactaacaaagagactacagttaagtttgtatgtgaactcaccgtagcatcaggtgaatactcatctgaacctaaccactggtccatcgatgagtactttgagcagattagacgtgcagatgtaaggacagtgcacactttactctcctcatcccaattgatgaaaaaaccagatgaccgtgccattaatgtgccatctgtagatgcaatgattggttaggaaaaataaatcataaaataaacacgcaataaaagcaatgattagttagcaaaaataaataacagaatatacacaaaataaaggcagtgtattacataccaacataagatgaaaggctaataacaactttagctccttctagaattgttttggtcgaagaatcacgaacaggaagaagattttgatttcccatacacgagcgaggaacatgagggtcaagtgttacaagcttcaattgacgttctgcacagtgagacaagttacaaaagtgcacggtgagacaagttccaaaaataaaaacacgataaaactatggccatgtttagttccccaaaaacttttcccaaaaacatcacatcgaatctttggacacatatatgaagcattaaatataaataaaaagaaaaactaattgcacagtttgcatgtaaatcgcgagatgaatcttttgagcctaattaggccatgattagccataaagtgctacagtatcccacatgtgcttatgacggattaattaggctcaaaagattcgtcttgcggtttccaggcgagttatgaaattagttttttttattcgtctcgcggtcttttggtgataactgggacagagggccaacgcatgggagagctgaccacagacgaggcctccgtggaggaggaggcatgccatgcaccaagtgaagtcgccgccgccgcctccaccggctcgctcgtgcctctctccagaggaattttcctctcgccttgttgcgatgatgccatagcttccgattgagctacccctgcccggttggtcgggctgtgccgtcgccgttgccgttgtcgttgtcgttgccgccgccgccgctacgcccttgaccgggatcccgacacctctccaaccttctccatggtcgtcggtgccatatcctgcagttgtcaaaggagactagtaatatgcacatgctaaacactacggtgtaattctattatctttaataactattaaattttcatgatagaaaaaatatttttctatgatctaaacaattgagctttaactcaattcatgtcgtacataagatgtatttcacgccaagtacaataatatgatattgtgtatcatattacaataatgtgtacatcaataagggaataaccaatttccatatcatcaataaggttcacatgttcaagggtatttctatgcattaaaagagctaattgttcctgtccacttattcaagcagcaacatgtttgttttagaacctttatgttcagaacttcaaagaccaaatatctaagtgtaagaaggatatgatcacatcaacataaatggtagcaaaattcattaaaaaccaaatcaatgtggatgatgtaattgatgattacttagaaaacctaaactgacccatggaaactgatgatatatgcatgacactaactattttcaccgacatgtacaaatatggtttcagacataagaacaaaggagtaatatctcaattcatttcccaaattggatacgtcatgcaatcaaatttggaaattcatttctcaattcatctcccgaattgcattatccactctttcagagtacataataaacaacaaaatacgcagcaattattacacattttacctctacctccaacaacataaatatcatttcatacgacagtcgttgtacaagcaaatatatatacatagctttccattcatctaaaaaaagaatattccaccacaattttcattcacacaaagtagagagttaagagaaataaagtagcactaccaggcacgaaggaacacgttctacagtgcagtcagtcccatggcactaaatttctaaatatattgtaaataatacatgtatattaagaaaaaaagttaagctgcagcagaatatggatgacagtactaaaggccataggagaagatttaagtaaccttgaattaaataaccatgaacaactgacatgtgcaacaagctaataggtgttgtctgatttaagagttagataacccatacaggcaactttgttgcatgggcaatcgactttaataagaagtatagtgcagaccagcaccattcttatggagaagcatatcatacacttattcgtcaaagaaccagtgaagtacaactcaatgtactatgatatttgtcattgttttttttattttgtaaaataaaaagtgtgcatagatgccctcgcttatctttagaaacaaaaagggtggatagtcgcacttaaaaatgaaaacgtaaaatgatcaaatacatgaatgatgcatctcgttgttttattttggttgattctttcagatgggaataaagagagagagagggggggagggggaaggaggatgatatttgtaccttccggtgaatcaggttgatgcaggagacgttgttgaagaggccgggaccagtgggcgtgcggaggctgttgacgaggtggagtggaggcaattgatgacgcgcagaggagaggaagcagttggctatgcggagactgggggcggcgcggtgggacgcgtggagacggcagggaggatggtgtcaactatacatcattgagcacataggcaaacaaggttatgaggtttcttctgccagtaaccagcaaactgctgcccacagcagcaatggtacacaccagaataaatcaatgatacaacctagcttccataatatttattttgagaaggataaaagggtcagtgttgcctacaatatagttcaacataaccatctcacctaaatgagaaacatcccaaatttatcataggaaaaaaactgaaaaaaaaaaccattcaccttgatctca

SEQ ID NO: 65429 - DNA, 2190 bp, Oryza sativa
ttgctgccaaattttgataactatatatgccaaaattttggcaacttttgggcatcaaagtgaacaggccctaggatgtgtcgcattcagtccaagttcgctatattttgaaacgaagagtaccttggatcaatttggaaggaaatataagttttctaatgcttgcaatcgtagttaaggacaactacattgcaataataggctagtggcttgtctagattcattagcatccatatgaacatggacaatgctaaaaagtcttataatatgaaatattataaaacggaggtagtattaaattgctgatatgaacatgcaatgcaagcacaactagtcaagatcttggtacgcagttcatagcaaatctgcactgcacactgaaatgaagggtaaattttcttctatgccactggaaatttacccaaacccttatttgccagtcattctcccgatgctgcgtggacctagggcccgaatgagggcgatgatttgcgtgttaatctaaaatacaaataaattttatcatcaaaaggccataaataattgtttttgatcaaatgggaaacatctcaacaaattaacaccttcacagtcaaagatggaatagaatttacctaaatagtcaagacttcttttcctaaagaaatgtcgaaaaacaacaggaaaataacaagtatgaggtataattgagattatgtaaacgattgaaacaagaagcaaatcaaacaaaagaagcatcaacgtccacagggagcaagagggtgcaagaatgaatcaaagagagaggaaaaagaatttcaagctgcagtaaaaggtgagttatgtcaccctttgaactaactcctaaagaaacaagcagcagtaagtggcgatttaaatccctgaataaaaaatgagagaacatgaacatgaagttcaaaatgatgatataactgtagtcagtttgagcctttgaggagggatgtgctgtccttattgtattaagtcaaacaagaaactacttgtaatttatgtgacagtagatatagcagtgtccttatataacttcttcaaacaagcaatattcatggatgagttctgttgaaatttgtgttcaaaatcaattgttaagcacacatagaatgacttgcaaccctatataacatttgcccattcttgtcactagatgaacagtgcagcaattaagtgtgcatgcccccatgtgtgtccagctgtccactttcccaggaaatcacgaaatgtatacatggacaattaagaagcccacaagttcacattatcacatatgggcatcaattaagacactgaaatgataactaccttcttttgaaaaaggcaggatcaaataagcgacacagaggtgtgcgcacagtaacaccgttggattataggatagatgaatccgagccactagatcggtaggatgtaaatcaaccatacagctcaacaaatgcttttattacacatctaagagcaggtacaataaactagtttagccggcgataaaactgtcatatcagatttgtccatgagttgcacaagagagagaggacgagtgggcgactaaattgtcgctggctacacacacaacccaacgcaagtgcagcagcaccaggctagctttgattgggacaagcgattgtgggcccacgtgagctgactcgatgcaggatgaaacaacagcaacaagattaaaaaattggatggggaagctagctaaagagggctctttgtttaggctcaggcttattggtctagacttttaagtcagcttattggcttatatgatttataagccagtggatttaatgtcccaagtttagtggtggagtcatacatctatttcatataagccaaaaaaaacttctctaacctagcttttggcttaatagtgttagagtgacttatggcttcaaaaaagccaaatgaaaaagctgcttgtttgttttggcttggacttttcaacttataagttggcttataagcctaaacaaagagggcctaaacaaatagataatagtcgatgtgaacatgcttattgtatacattagctcttagcaatatctctaagaggctgatgtggtcatttttgcagcccttagcgggcggcactattgaccttgttctaatggttcaaaatcatccaatccaacacctagaggtggccaaacgggcggcccggcccggcac

SEQ ID NO: 65430 - DNA, 3125 bp, Oryza sativa
ggtttccctaattcaactttcatattgccagtaatcttttggtctacattgatagctgatggcattggggggggggggggtgattatacaaatgatttccgttggtaatgatgttttccctacattgcagacagaggaataccggacagttgttgtttttctttcttttcttctgttggggtgggttcatttaagaaatacccagtttgttaggttgatcacatgtccccattttgatctgcgacgtcacagacaattctcttgtaatgtatatgtgcattgtttgtcagaaacctgtatgaatggtaaacaccatcataattatatgatccagcattattgtcacgcccaatgatttagcccagattttcagactattttgtgcattaaatccctgtacaggatcagctagggtacacaaaacgacaagtaataaacagttccaaacataaataaagcgtaaaatacttacagaagaggcacttagtcctcacaccgaaacaaaagcagcaacagtggaaaaaaggcgatcctagcggggcttcagctccactccacaggcaaaactcaactggggtctgagccttggtcttctaactccgtcttcagctcagaagcactacacttctgaaaagggggaataatagcaaggctgagtacaaccaccgtactcagcaagccacaccaacgatgcagacgtgcaaggggaatacaaggatggtttgaggctatttgcataaaaggcggttgtaaaacgttttattgagcaaaacagtaacactgttgagtaattaaagtagcattaaatctccactgatcaacgctacaccacgttgaacaggcccaaccaaaacacctgaactacagtgcattgagtcgatttattaaggtgggactaatcacggtgaatctggtcgaccgcccataaccgcgggcacggctattcgaatagttttactctgatcagaggtgtacaactgcccacaagacacagccccacgacatgttaccgtgcgctgacatgccaccacgacataccggaaagaggccatgacaggacctttcgcataaccccctctaaccaagcacaccacaccttaggtttcaaccccactcctcgcaaggcagcgggcagtcccctctcgtgcctaggtgaatccggaagctgcataggccgtcgcagggcccatccaaactccatcacgcctacccttgcctggatgcgttagctagaggaaagctacactacaagcccagccgttgcccacgctgacttggggtaagtacgctgaattcttccagggtttcccgcgaaccggtccttaactgccatgggtgtgattagcaaagccatgcacccacagcccaccatacagtcgcattttagttggataattacgaccatgaagcatggccagatgtctcgagcacgcagctcattctgatactaaaaaggtctaatactgtaattatcatatcaactgagctagttgtaattaagcatggctaagcatatagttctagctaggtcacataagtaacatgagctagtcgatttattacccaatattgacaagggacagatatcaagtaaacatggcataagcaagcagataggtaatacccggatcccatgtaattagcaagacatgcatgtttatttacaaacggtaaaacgtttataaattaggatcaaaatgctcaaggggaatgtgtgacttgccttgcttcttcacttcgatcttccgaactcttttcctcacgaccgcggacttccaaaacgacggattctacacgctggcacgcaaaatgaggaaaaactctaataaaaaccaaggaaacattacataaaaagtaaacttacatgtagaactcaattttagatgaattttgcaagttgaatggcgcaatttggagttcgaatgaattagatatgaattttagaagttttgagccatttatatgaatttctagaattattattgatttatgacgcaattattaaataatttctcaaaggaaaggcctgctgctgacgtcatcaaaggggaaccagcgccgacaggtgggccccaggcatcagcggctcaagggggcggcccacggtggacacggtccaccgcgacctcgggtgcgccgtggaccaggaccacgccggtccacggacggccacagggaagggcgggcgcggccgagaccggccggccgagcggcggcgaacggcggcgacgacggcctagccggatggccaccggcggcggcggcgcaacgcgggcgaccggcgaaggggagatagagggagagggagggatgctcaccgagcgaacaggacgacaaggtgaggacgggaaggcggcggcgctcctcggggagacaacggtgacggcggtccggcggcgttccgcgagcgggaaccggcggacggcggctgcaaggacatggggaatgcagtggtatggttaggaggatgggagaaggcgtgaagcagcgggaaaaaccggccgaaggcgaaggaattaggggagctcaccggcgcgcgaagggaaggggaactccggcggatttccggtgaagaggggcggcggccgaggacatcctcgtccttgcggagccgttttggtggagaagagtggcggacaggcctgctctcgcggcggcgcaactggctgcggtggtggcacggtgctggagcggctcaggcggcgacggcgtgcggctggaggtggctggcggtgatgtagctcgggtcggcggtggcggtggggtttcggcgacggttaggggaagaaaggtgggggccggggtgcggtgtggagcggcgatgccggcggcacaagcggcgcggcgcggggacggcgggagcggcggctagaggcggctggagctcgccggcgacagtggagagaggtagcgacgcggggagagcgggaaagggcacggggagctcgggcgaggaggggaaacggaagaggggagcacgggggtgctttatatagggctcggggatggagatcgtggccgggagaggcgggatcgggcggcaaccggccggcgacgtgggacgccgacgtgggcgaagtggagctcaatttggcgccaaaaattggggaaaagtaggggaaaag

SEQ ID NO: 65431 - DNA, 2192 bp, Oryza sativa
aatgaccatcatccctctatctcccacccattttttcttgattttcttgcgttaaccatagcttctcttctagatctggaatttttttcttcgccgcctctccgacgactacctgccaccgccgcctcaaccaacatcgccgatccggtctcccgttgctgtccctcggccgctgaagtctcctcggactccatctcaaccggcatcactgccgccgccgctgtccctccgctaccaaaatcgtcacgcatcgccggtctcctccgacaaactgcttcggcgacctcctcctcggcctccgcctcaaccgctgccgatatggagccacgccgtcgttcctccgccgccgaaaggtatcttgaaccaaaacattcagactgaagcacctcatgtgttttgtgatcttgaaccaaaacattcagcctgaagcacctcatgtgtttctttgagaattggaaaacataggctggaatgcaatgttctgtagactgatacttaggatgttttgtaataacttaggctctgttcgaaagagcaggttgggaatgtttggctctggcacgaaaaacggaacgatccattagcgcgtgattaattaagtattagctaattttttttttcaaaaatgaaacaatatgattttttttaaacaactttcgtataaaaacttttttacaaaaaacacatcaaaatagtagtttgaaaaacgtgcgcgcggaaatcgagaatgagaggttgggaaccatcacaaacgaactgagccttagagtagcttatgactatagatatatatgacaagttcattttcaatgcagctgtttttttttaatttcggcttatgactgttgaaaaacacaaaaatagattgcattgttttgtagactgatacttaggctgcttcaacttctgataaaatattagactatatcaattactatgaaatttacactcactatattacagtttctagataatcagaatcaatcaattgataatactgccgggccaacgccaagcagttctatgattttctataatttatatagaaatatagagtgcaatacatttttttttacattcaaactttaattctactgtgcataaaattgaaacctatggtgctaaagttatgctttatcaatcagtactattttctatatatctttggtttctgacaacatatagcagctttggtgaggtcacaatctgattgctcttatacatgtttatgctttatacttctaagttgccaaatagtgaacaatttcagtttgtcaagtactatcacgaatgcttaaaattatttatgcttaaaatttcttcataacatgtatttcttctacatctacagtttcacagctgctctaaccaaaccggcttctacttttcccacagctgtggaaccaatcaatcttatgcagattcatgtttctttttgttcagttattgctagaatggtttttgtcattttgcaaagtgaaaatattaataagaaatcaagaacatcggataaaatgcagaggaataagaaatcaagaacatcggataaaacgcagaggaagttgcaagggaaattcaacgactaaccacacatgctgacatccagcctcacatacacgtgcacaacttcataacgaagtccattattggacttggcaaatataaccgtatcttcattttcaaacaggaaaaggaatctttgagcttaaggaaaatatcttagatacaaaattctcatctttaagatataaccgtatccgatcattttcaaacaggaccaggaatctttgagcttaaggaaaatatcttaggtacaaaattctcatctttaccaggaacagacaggtaaagtaggttctaccaaaaattcatagatcatcgcaaacgtagagcaagttgcaactatctcaaaaaagtcgcagcatgttcacccatacacacagcatccagaaagaggtaaagggggcggagcaatgttgaatcagggccagcaaatcatacaaggaatcctacaaatacaaacaatcgaaattagaaacttatataataggcattaatttaaattaggaaacatatgtgaacattagaaggtaggtcgttcttgtgccttaccccattcggaagagaaatgaagaatgaaaaactgccattgccaccatgcaagaggcccgtaacttgaacctgaccattca

SEQ ID NO: 65432 - DNA, 1474 bp, Oryza sativa
caatgcacggggcactaggcagtccgccaccctctgagcaagctgatcatccgcttctggatcatcaggaataggaaacaaatgattctgccagtctaaaagaagattaggttctggtcggagctccacacaaacgatagagctgacacagttgcggtatacccatctctctaatgcattggagaaattgtctggtggtgccatctattgaaatagtatacagataattaaaccttaatcagacaaaccagagaactatgaacataagcaattcagccatgtggcgcattgaaatttacagttacaagtctgactaggtagaagcaattccagcacagcatattggagagcatgtgaccaatgaaaatttacagttggcaatttatcatttatcattaactaaagacatcattaaaaggaataaagactgtgattagaaggaaatgtcagaaagattccacatgctatttttgtgactaagctgaatcaggtccacatcttttttttttattgatctgttacaaaaagactgggcgcacatagtgggtggttattctgtgccaactgacagacccactaatgtattcacagtattggaaagaagtgtctacccgatgggagtgcaatttatactcaagggtagctgcaacaacatgggcacttgtagacaaccatgcatatgtttttctttgttattggacaggtccatacgaagaacaatttcatcaatcaattacgggtggaggtaaataccctgttgcgctgcaaggtgactgcaaggcaacttccaacccgaaacatggagagtcaggagaccaagacgattgacaaagcttatgagatattgcaggctaaaataatatgttccatttatgtattggtcctagttcctagctaggtttgattccgtaggaaatcctacgtctaagaattgaattgtatggtctcccactcttcaatctaatctaaacacggaagggcaagattcgcgtgagcagtatattaccagccaaatctcgatctgcgtggagaggaggcggcagcgacctgcacaagagccggaggacgaaagggcaccaacgagacggagccggcggtggaagggcgtggaggcggtgccggcgcagctccttggctcgacttcgcagaggcggctgaggctccgagggttctcgtgtgacggcgcctacgggctagggctctggtggttggtggtttatttatgctagacagcaagaggacgagacgatgggtagtctgatgtgcaccgggaatttgccctccaggcctctcatccaactcaggccaggctgcacactgtgggacgggccggcatcccggcggccgaaaaccaactctcgcatcgcgtaaaatgaaatgaatggttgggtgtatgataattcagcgtcacaaaagaaggtttatcagcacctcagcgtgtcacaaaacacaatatgacaagtgagcaccatgg

SEQ ID NO: 65433 - DNA, 3834 bp, Oryza sativa
tttggttaaagtcaaacagttttaagtttgactaagtttataaacaaatatagtaatatttataatactaaattagtttcatcaaatcaataagtgagtaaaaaactttaaaatcctaagttgaaagttttcaaatatgagtaaaaaaactttaaaatcttaagttgacagttttcaaaatttaagtcaaaagtttttgaaatttgagtcgaaagtttttataatttaattaattttatttttacttttcaatttaaataaagttgtaaatatttcaatagaatgttgtcattttttttaaaaaaaaggagttgacactctttttgaaaaaaaaagaaagaaaaattacattttttaaggaaaatgatcaacgtacaacgtacacatcccgtacggtaaggacgtcgtctccaccccagtctccgcgtttccacgtgcgcgcgagatatgtttctagcgcacatgcactacttagtaatctcgctactttggagctgaagcacggctgcaaggcacatggaggggagatgaaaggaaatgccacaagtaaagagatttgcactcggatgtagatcctctacaatactgttgaatatcaatgtctgctactgtaccagcaacactgtaggcaatccccactatttcgtttcatttatacttatgcttataagctaaaatttaattttaaatatgtttttgtgttttttcatcgtggattattttatagctaaaatttaattttgaagttgattttttggtttttcatcgttgtttattttatagcatttactagacaagtatatgggtccaagcgaaacaatgatccaagtctcgttgaatatgggtccaagcatgcatgtcacagagagagctagtgggcatttcaaagattcagaaaatgtttcccgtagcacacccaggggcgtgcctaggttatactatccggtgtcacaagataccgggtagattattcaaatcctatataaattacactatattaattaatatattagtcaataattagataattagtatgtattggacccccggtaacttttgttctgggttcgccactgagcacaccgataaccactcagactgggcaccctcacacccccccactctcagctttactctatctccttccttgctacctccagatctcaccattcctttcttgctccctcctcaaacataggaatgcaacaacatctcatcatgatgatcctccttgatacaccgttgctcactaccggagtgcggaagctcaagataggcataggcagaacgggagagggggggagggctcagggtatagtatgtgacagcgacctaggcgaagggaggaaccaaggggaagcaactgacgatggtggcctaggggacagggagctcagtgccataatggcatagatccgagctaggaaaaagggggtgtggggtgatgtaaggggccatgctctatgaggccttgttcggttaacccccataagaaagggattggaggggatttattccacacctattgtggtgtgaaattattccccctcaatcccctctaaacggaacaaagcctgaaggagaattggtgatgatggcatagccgcgggcggtgtttgaggaagaggttagtggaggtggtaattttcagttaaatcaaatgttgcacaacatattttctggatgtattcaacaaatactttttgtaatgtttcaatagttagagctatatgtttcacgtctgatataaaaatgcttcaattagaatttggctgtgtttcaagtcccttgatataaaaaaagttgtactctgagtcaacaataatgtttcattaagtcgtttttttcgctttgcacagttcagtgtttcatgggaggtcaactgtcttatcccaaagatcatgtctttgagagtggcattttctgaacttatgcttccctctgaagggcaggcaggcaaggttcgtcattgggtttgggagttctagcctttgtaattgaaaaaaaaatagaataaatatatagaaaaaggccgtagaacgtaccttcctaggccgaagaccatctgaatcctttgcaaagtgataactgacatgtcccttttcttatatatccagcaaaacgtgtgtataggagtatggcgaaacatagtcccgatagtttcttcaacaaacatgggaacggcaactacatgaagaatcaaaaagcacacggttaattgacaacaggtctaactaatgtagccttttctgaaaatcttaaggagtacatacatacagaagaaaaactaaaggaaacttaactgattctgcagaaagtccagcatggatatagttgagcgaataaaactgtagcagttagcaccaaaattagcacaagcattagagcagtaaaaaatgagagtaatttgtggtgcttagctggagcccaagtcctccataagcttctatatgtaggtcgcttaatctggacagctagagctggtcttgtgcgtcgcgccttttagttggtgtatggatgggtggttgtgatttatggggaggacagtttatattctctcttttgtatttgttttctttatctttcttcttaattaaatgaggaacaattctctaatgtgttttcgaggaaaaaaaagtaggtttctaaccttgagtagttgttcatgtatacatccggttgagctagagaaccttgcttgcccaagactctttctgagattgagagaacgaattctttttttaatttttgccacttcagagatccaaagtttattgcttcctcggtttgaaaaatgcacttcagtgatccaattagtgttgtgcgagcgttcggtgtctctcgagtctgcgcagtaagatttctccagcgttgggaatctgcaaaaacaaatttggtaaagaaaatttctactaacagctaggagtaagaaattaaatgaagaggacaaagattgctgaacccctgtcccatcccccaccacgcatgctgcccacctctaacgaagagatttgccttttcaagctcacaccacccaccaccacggcactgctgatgccttttgaattactagctcacagtggtggtcgaggtcatcaatggcagcaaggcacatgtggagcaaattgggaacacgactgcgcatgcagtacaccggcggcggcactctactgcatgcacgtaccggcatggtcatggactcatggagatgctaaaatttaatggaaacatgctaagggtgataataagattcagatctagagtattgaacaactagttagggctactgtggaatggggagtccggatccggatctcgcggccatgaacgccaccggaactggatatctgattctcttctccctcgtcgttgtacacaaaaatccattccgttgatagggatcagctccgagatatgcaaacaaacttgataacctaccttgagagagggaaagcttcagcacagatctccatcgccattattgtccaaagaaatactaattagctcgatatgttgacgttgagacggaacatccatacccgaccacaaagcatatcggcgccgccgaggacgccgcacgcccgcacgcgcatcacggtcgggatccggcctcttcatcgatagatctcggcgaacatgtcgcgaatcgatcgagacgccaccgtggcctcctcatcgatcgatagatcgatcgagatgccaccgtgcctgccggttgcacctccaccgctccacgtacgttcatcccatcttcgatccgcgtgatgtgtatatgtgcatgggcagacaaaactccggccggcgaaggaactcggccatggagatcgaggagga

SEQ ID NO: 65434 - DNA, 1132 bp, Oryza sativa
aggaaggctgtgagtatgacatgtgggccccacatgggtcccacctttttttaatgtgaaactgacatgtgggtcccacgggttttattattttttccgatcgaattgtcacgtaagcgccacgtcaatgccacgtcagacgaagaccgagtccaattggccacgtagacgccacgtctgccaaaaccacccttaaaaccgctaagggacctaatctgcgccggttttgatagttgagggactcgttgtgtctggttttccgtttgagggatgaaaatcagattcattgacaagttgagggacctctgatggactttattcctttccgcgcagcgagcggtaaatcgttaattaacttgagtgctgggccgacggaagtcaaaatagtttctttaggccgtggtgctgtggtgggttaaatgtggccgagcggacgctttcggcaccgagtacgagtgcacgcctcacgaaacaacggaacggagggactctacgattggtcactcgatttaaaatggagtcggttcacattagatcccttaatttgtcaccgagtcagaaattcattgctaaaccaaattatcagatataaccgatctctcaatttataaaactggatcacctgagatctaggtagtattgtgtaaggttttaactgacgtgacaagctgacttagcatgggacccacgtgggccccacatgtcagtgggtagcactttcattctcctctctctctccccttctccctcttcccaatcgttctggacgtcggctgcccgccaaccaacgttttcgtcgtcgtctccttagctcctgctggtacatacgcatcaagacaactagatgaaactccgcgcattgttgcgggagcttagtatgataacaataagtaaaaacaatgtgtaacataggtacataacataagattacgtaagttaacgtggtttatgataatttaattttaatagtatatagaatgatgattaaatgtaaaagtaaggtgatatgattttatgaaagaagaaaaatattgagatagtttgggcctatttgaaagtagaaagacttatttggaaatcatggatatacacggtgatgtaataactttgtaaattctatttctctccctat

SEQ ID NO: 65435 - DNA, 1474 bp, Oryza sativa
cacaagcaaaaaagatgcaggattcgatggatggattacctttggcgcaaagagagatgggggcgccgggtggggaggcaagcaataagtagtagggtcgccattaggaggaacgcccccacaccgtatttaaaatgctcgcgaacggcagcatcaccaagctagccgaaatcctccgccttcgccttcgcatctggagttctggacagagtccgaaatataggttaacacgtggaaggcaacggattgctcgctgagtcatgctactcctagaaacggaacgaacaaaatcggcgcggctgtaaaactgtgtgctgcaagggtctgaaaagctactttcagtgctgcagttggtaggaacaacaacaacagagtactgcacgtatcttatgaccatggaaatgagtgggattaatgaccgtgattagagtgtgatccctgaagccagcgagagagtgctagctatctcctggtggttaggttttgagttttgacaatttgcaacatgccacgggccacacagcaacgtgacctcgcgtgacatcgtgatcggagagtgctagacgcgatcttctcttgtactaggactgcttattttttgcactactggcgtgtgcacgatggattgaatgctcacattgccctgctaacggatctggcgcgtgcgacgcatgaagagctggatttttcacaatttagtccttttaaaaaatcttatttcataaataaacccatgaaaaaacttatccgaaaaataatcctttttaagacgccagaatacgacggcgccagtcctcctgccaccgtggcggggcagcgctgaggtggggggagcgcgccaatgtggttggcgcccctccctccccccattttttcctctctctagtgtagaggagagatatgtacaacttattattattattattttcacacttagaagcacacaataaccaaccatacaaaaattaaactcaaatagatgaaatatgtgacttataaaattttctaaagctataccgaaaagaccccccctcccccgcgttctccctgcttttcgttgttttggtttttcctgtagtccccaaagaaagtagattaaatttcgaacactcttagacttttttacatttttcacatcctataaacaataaaaaaagttagggttcgtgtttctttttgttacattcgggtgtcatttcttgaaacagtcgtaactttctcatacggacttggaatcaggcaaataatatatccacggatatcttaaaaaaaaagttacatccgattctcccccgctttgctgggttcgaggaaattaaaacctccaaattccacttgcaagattatgttttcgaggcgagaagcttttcggtagagctttgaaaaattctataggtcacatacttcgtctatttgagtttattttttttatggttggttcttatgtgactcctaagtgtgaaaaaaatatata

SEQ ID NO: 65436 - DNA, 24862 bp, Oryza sativa
agtgttggacaaccaaccgaacagtccccaaatcctcccaagccggtgcgaatcagagaaacttctccccggctcccattactcgttgagcactcttcgcacacaatttcaaccgtaaatccagaatacgcgatccgaacaagcagagcgactgcctgtatttttacaagctttctcgagagggtgagtgtgcactgagtctgcgtacatgtcaacgtctcttgcaggatactggcccccgacatagagcaagccagccgccagcatggcacgcgtcttgcgtcttgcgtcttggcgtgctttgcaatggtacacacgtgctggccagtggaaaggctaggcgcgcgtgacgctcgcacctgtatttcgatcctaaacagatcgaaaatattttaataccatcatatggattctgaagccaccgaaatgtggagatactgagatccacgtagtactccgcctgagctgatactccgtttctttcgcccgttttgccacgtaccactcgcacgcaccaacatcatggctctgttgaagagagtatccacgatatatggaagagcgggtgctctgaagtcggaaagctacgcggaatggcagatggtcagatacagataggcattgatcgcaatggccaggaagcaaacgacgacgcaaatcatgcagcgcgtcaagtgaagatccaatcgcccttggctgtttctgcccccgcatgcagcgatgcaaacggagtgtgccatgctgcagtacacgggattacaggaaacattttttttgctcctttggttcagaaaaaaagggaagaataagaacatttaccccaactgtccagtggtgcccacgggtggctggtagcgatgggtcgcagcccggccggccttaccgaaaaggagaaaagaccgtacgacaatgggctttgtggtccagctcgttgggctcggcacggatggcccatcgttgcttggagcaagtgccagtaagcctctaagcaaaggttcaagtttgccggcctatttttaaaattggtttttgacaccttactaaaattttgataagttttctcaaagggtcaaattattaaaattaaggaacaaaccgaacattctattgttattgacaccttactaaaatttggtatttccataaacgttctctcatactagcattactaaattttgataaggctacaaactaaacgcttctaacgctatcaacatttggtactataaaaatgcgccaacttttgacaataccaaattttggtaaggttaattttgacatcaaattaaacaattgctctgagttaaaaacttctaaatgtaattatggtgtatttgtatctattatattattaaaacagctttgaaaggaggcaccacgttcgatgtgggggctagaaattcccacattaatcagagaaaaagaaaaaaagaaaagaagagtccaagtagaaatacaatctaaaaatagctgaaattcagaattaaaaataagcaatattgaaggaagtttccatataagaacccaatacgagattaattaatattcgaaataaaaataaaataaaatccaaaattagaaaaaaaaagagagtccaagtagaaatacaatttaaaaatagctgaaattcggaattaaaaataaggaatattgaaaaaagttttcatataagaacccaatacgagattaatcaaaattcgaaataaaaataaaataaaatccaaaattagaaaaaaaaaaggatagtccaagtaggaatacaattttaaaatagttgaaattcagaattaaaaataaggaatattaaaagaagagtccgtataagaacctaatacgagattaactaaaattgggaataaaaataaaaataaaatccgaaattagcaaaaaaaataataaaagaagagctcaagtaggaatacaatttaaaattagctgaaattcagaattaaaaataagcaatattgaaagaagaatccatataagaacccgatacgagattaattaaaattcagaataaaaataaaataatatccaaaattagataaagtaaaagagatttcaagtaggaatacaattttgaaacaactgaaattgaaaataaaaaataaaaatattaaaagaacacaattcgatattaattaattttttttaaaaaaatctgaaattagaaaaaagaaaaataaggttccaattaggaatacaatttataaataactaaaatttgtgataaaaataaagactattgatagaaaagaccatctaaaacacatgacgagataaattaagtaacaggcatataaaggagtagtggtggtggttgatacgacataaaaaaaattgttaatgaaacaccaaatagaatcctaatgacgattaaaaggaggggcgatagggaggccgtaaagcaaacgatcaaggcgattgccgggacttctagaaagtaaaaaaaataaaccccattgataatcatattcgatttttaaaatctcaatgacaataaaaaggagaagcagcgagcggggtgtataggagtatagttgcagagctgccgatggttgacgggacttctagaaaataaaaaatgaattccaacgatagttatgttcgatttttagaatcccaatgacaataaagagtaggcggcggacgggccgtagaggagcatagtagcatcgtttgacaagacttctaaaaattataaaaaaacgaaacccaacaagacaataaactctaaaaactacaaggttcaatttttgaaggttcggaacttctaaaaagtaaaaaaaaacaatgatagtcatattcgattttaaaatctcaatgacaataaagaagggaggcagcgggcgagccatagagaagtacaatggcaaagtcaatgacggtttagcgggacttctagaaagtaaaaatgaacccaaacgataattatgttcgatttctaaaatctcaatgacaataaagagaagagacagtaaacgggtcatagaggagtataatggcaacgtttgacgggacatctagaaattataaaaacgaaactcaacgtgaaaataaactctaaaacctataagatccaatgtttaaaggttctaaggagaatgaatagaaatagtggtagatcgagcaagcaaataaagaaggagatgacataaggggtagtatctggtgtgacttttaaaaaactatataattagaaacatggggatgataaggtttggtctttcaaactcttaagacaatgagatagctatttaataatttttttagtaaaatcataaaaaatatataattttgtttgggtgctagccgcacaattgcgcgggccacccagctagtttgaactacacgtaacactataaccggtatgtaaaattgtatatataagaaaatgaaatgaggtgatagctcgcgcacatgtgtattgcaagttgaagatttgattcttcctgcgcacgctgctatttctttccacttacggtgccgccacccggcctcctcactatcctctttccctcgctttacccccgttaccaatactggcccaccgtcccatggcttcgctgtcgcctctcgtccacccttgttcgccacccatgtaacgctccgctttttgtgaggcgttaaaaactaattcggcaaaaatcctatatgcgaaaattccattctctgtgtgagagtctaagtcgtgccgtggatcttaattcaaatccgtccttgatccctctcgtcgccgtcaaaaaaatcgcctcctcagaattcctcttccaaatttaagttcccaaaatcaaactcaaacatccaatctattcccctgaaccctcgccaaaaactttaccgattccaagaaaatattgaaccctcaccttgaatccctccctatccattgatcgatctatccacttatctaacctatctatccatctatccctctacctatcgatctacgtatccaactgtctatttatctattgatctatctaactacctttgaatccttgccaaatatttgccccgactccaaaaataaccaaatccccatttgaaattcaaaccccaagctccaaaccctccaaatcagttctctcggtaaaagtctattttgcctccctcttggtcaactgggccgtttttctctttccggtccatctctccctctcggtccgtctctctctcgcacgtgtgtcgcgcgtgttcaggagcaggagagagcgtcgccgtctccttcctctctcgctcgattctctctctctctctctctctctctctctctctctctctctccccggggccgctttgccgccgccgccgttcgaaatccggccgcgccctcgcgttcgcacgcgcgcgctcgcgcgtggccgaccgcccggtcgccgccgcgtcaaccctggccgcctgcgccgcgcagccgcccatgccgccctgccgctcgccccacctccgtgcgctcgcgtccaagacgcggaggcagcgcctctctctccctcacgcgcgttttcctcctccctctgctcgctcaaatcgggaaggaaccgcgctcccttttccccctcctttttccactttgcccgacaccgcccgtgaccgccagctcctctccttgaccgcctaggtcggtttcctccccaaaccgacatcaccaccgcctataaaacccaactcgagcccctccctttcctcctcgtttccttgcccaacctccaccgcgccattgccgccggaccatctctgccgctcgccgacctcgcctccctccgccgtcgcacgtgctggtgaagctggtgtgtgcgacgacacgtgacgcgggactacgggcaccctctccttccccttccccggcccgagtccggagagctcgccccgcgccgtcggtcgcccatcacagcgcccgtctcgactcggtagtgtctctctccgttctcccttctcgctcgccctctccctcttttggctcgcgcggtagctcggtagccctcccgaacgcgcgtagacgaagccccaagccccgccgccgcccggcatggtctcgtcgcgattgccgcccgttccggggagccgccgctcgtcgccggcctcactcgggactcctccgtcccatccgaccccaggaatgagctccccgagccccggagatgctcccgccgcctctaatcgaaccctcgttgaccaccggcgattcccctctttttccgccgccgacggtcgccgccgcaatccgccgccgtcggacctcctccgtcgcatccgagccgttgaatcgcttcctctcgtcccatccctcctcccggtgtgcttcctttttccgttgaggtcgcgccttgctccggtgaatgccgccgccgtccatctcgggcacagccttcgtcttcctcccgcttgccaacgtggcagccacgtcggcttgacccggtcacgccgatccggtcggcccctccctccgttttcccttccgtgctcgcggtccacgacaaggcgtgcggcagcacgtgggcccacctcctctccgtccacccggtgcaccaaccccaaaccaaccccaccgaaccctagcgccgctacccgcatgcgcctcccccaccgtgagccaagccgccgacatgtgggccccatcccgggaccccgcgtggtggaccgcggtccacccggtcggtctcctccccctcccgcgccccattgggccgccctcctcgcggccgtgccggcccattaggctcggccgagctgcgcaagcccctcgggccgcgccgcgagccgcccaaggaagtctgattatcatccctccttccttttcttttccaaagggattattaaatccttttccctcgttccataaatcaattctttattccatgaatcatttcctttggtcccacatatcaatgactaccaataatattattgagaatattatttctataaaatccataaaccatttctcctattccagatattccaattaaacttccaaaattcatatctctcgatccgtaactccgattgactccgttccacttccaataattccgtaaaattgagatctatctaatggcactattaattagtctaaatagggtgtttcttttggtcttttgtttaggttttcgattgtttacgtatagtcgcggttaccggattttcgtcgatcacgggttttctcgaagaatcgtgagcttcatcttcaccttgagcaaggcaagtcaccctttgaccaattgctcctataattggaaaatcattattattttgtgtgcaacctgcagcattagaatcacacacttaacttgcttggcctcggtttgcgtgccaaaccgacggacctacccattagtcacactaattcctgtaggttgtactacccttattccttgtcgctccacccttgtggtacttcggtatccgtgctctctgagcacgtataccaactactccacagacaccatcgattgtcgataatttgggaaatgagtttgagaagccttgaaaacccgacatgtggtgtcggtgtgtttgaaaataaaatgaattgtgaaaactcgcgatgcgggggttgtgcctacgtggcgctgtcccgtattcgcatataaggaccgattcctgtgggaaacttatcgagcataatcaaagtgcaaccacaaggtggaatgggacaccctggctaagtaactagtcggttcagggaaacctcgcatgccaatagttgggaacagggtcggttggagccaaaccaggttcctggtaagcaaggaagagaagcttgctgaattaccgatcgaggtggttggaatttgatttgtgaaaactaaaatggcctatacttatgtgaggatttgatccttctatgtggcatgaggtatccatgggtcggcttgggaaaggctttgttgcgaacctccgataccgacgggtgttcggaataagttcgtatcttgtgggtaaaatgtacccctctgtagaggttaactaactggtcgaacagccgcgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacgaatatgtgtgattcgggatgtctgcggacatcatagactaggcttcccgagtggaagcggattgttgtgctgctgggcaactagactctgggagtccgagaaaatgaaaaaggctatgggagccggttaatcaagtgaaatggctccgggagttgagaagtaatgatctgacccgggaggtcggtacattaccatttgagttgttgaaaagcatctcttaagtcgaatcgagacgcaagtctcctttcgacccaaagttaaaaagaaataaagcacttagtgatttcaaaaatgatttcaaacaaaggaattgtaaaacaacctcgcctctcttccaagcttgcattaaacacctaaattcccgtgacttgctgagtacgaaagtactcacccttgctctatataaataaatatatatagttcctccgccctgaagagaagatgaagtgaagtgaagattagggtttcgtcctggctcccagccgtcgcctgtggagatgggtgttagtccgttggttccgctgctgctgctgttgttggtgtttcctcgtccgtgtcgtcggttgcattctcgggcttttctgagctgcaacctaagttaaggtaaataaatcctctatttattttaaggatttgcaatgattcatatttgtcaccatgggtaccagcactatgtcctgggactagtactgagattgcggtttcgtaggaagcggttcgcgccgttattcctacgatacgctcctgtcagttgccgttgtacggcggtgccagattggggtgtgacaacccaccaccagtgcaccacctctcaggcgatccctttaaatccgatcccctactttaccctcccccagcaccacctcccccctccccctccccatccccgaaaacctaaccctaccccagctctcgtcactacatggttggaaaactgatcgcgagatgtctagttcacgcacattcgtgaactagtgttttcggcacccatcttctattggctcctcttgtgggtaacaagcaacgagcttcattctagctaaggtttgctagaccgacggatgcgagggttttgggaaaagacaggataatgaggcgggcagggcgacggcgtgaccctcagattgttgatgcgagaaatggcgaaatgcgagggaggagagtttcatgggccaatccaccaaacaaaacctagtacctagtacttcgcattggaagacccatttatttccgtggactgctatctcacatgaaatgcatactccacacttccacttaaaaaaaggaatttcctgaatatcaactagataattaagtagggagaatttgaaatctcagctaatagccaagcagtgaactttttttgtttactgggtattttgcggtcatatggtgtgttttatttcattctttgttggatactctcgtttcatattgtacaagtcattttagttttatgctaaatcaaactttttttaactttaaccaaattcctagaaaaaaatgaaccaacatctatagcactaaagaaatacaccgtgaagacataaggaatatttgtgtcgacggtgggtacccgtagaccggatatagagggtattggggtacgctggtacgaggatctacgtaatacgacattaaggaaacaagagacaaagattatactggttcagacctcttagcaggtaatagccctaatccagttgatatgggattatatggaaagaaccatatattacaaagggaaaagtagaactcggtagtaccgacgagatcgtagtcgagttgattcgactagatcactcggcgacttggctcctgtagtctccggcttcgtaggctgtggtcgttgtgtcggctatgagattcgatgccttaggtctcccggggggtcccttttatatcgcaggtcaggcggtccccaagtaggactcggagacattggagcctgcacgatatagtaacgacccagtcctatacgggtaggaacctttccattggtagacttcgtgatggatttccttagcgtgttcagagaacgtccgtatatgcaccgatataccgtattgccgtatagcatacatctaagggtagagggtataccttatccgtaaccctgacaatttgaaaactcaaattttatttaatattttgaatgtcctaaatattcattttggattcaaacttaaacaatcaaaatcagaagaatgaccctagctagctttgatttttctttccttttccaatattcacagccctcactgttcttggactgggagaattggcttcagcgtccaccgctcgtgcgtcctctgttgcatatcgcgtccaagtatattcaaatctcttgtaatgccaacgactgaggtgacttagtggagcaattttcagcagtcggtgataataaggatagtcgtcgtcagaatctagcaaaaagtctcccgaacagttatcagctacctccttttcaggggtacttatagtcatgctcttgattgaactcgagcttccgaacaacaatctcacgaggtccatttcctcatctgttcctgtgaagctagttaatcttacctcttccagaaattccaacgatatattacgattgtccgtccgtgtatcttggtccttggatgatcgatctctgtagatggagagtaaatacaagtaaagaaaacgtcagaacagatcgacgccttaccggtgtgtttgaggggtgcagtttgcatatatagagctgttatattgtgctaattaaataaattactagaagtgaaatgagctcacccccaccctctcaaacagatgcgaagtgatattagatcagggcacatcagtagcaacgaccacacacttgtgaccaaatattgatccaatccacatgcgtcgatgaccatgctcctagctttgtaaagtcgaggtgctccattgtccgtcagatcatcgacctcatgagtggcgagcatctcgtatcgaagtctcaaccgtagtcggtgttgcagcagttatgcccatgcatcgctagagtgaggtttttgagacggcgaacgcttgccaggccatgtatccgcaggtccaggttgtcctcgatctccagggtggagttgtttatggcgatttcctccagtctcggtgccgtgattctgaccaccaagtcgatgctttccccatagctcgtcactgatgtcatgctgttgaagtagtggagttcgaagatgcgcaggttgggcgccgtcacgtccatcgtctgcgtatctcgcgtggatgcaacgataagctcctcgagcgcctcggcacgaagcaccagctggggcaaccgcatcggatcgatgatctccagcttacgcaggcgagggcagcaggacgagatgaagtcgccgagggtgcggcggccggcgacggcctcgtcctcgccgaaccacgccgagctgaggctcagatctgtcagcgcttcgtaccttgccgctggggacgccgggagtttgagccggaaggggtaggacgacaggttgaggttgatggacgccgtcctcccatagctgggcaactcgacggttggcagctggtggccatggtcacgcggtggcggtgcccaccacgcaccgatcggcgtcgaatcgcaggcattgaaccagaaagttttgacgacgcgccgcacggcgtagcggagccactcgttgacctgctccggcctcgcgctgtcgaggcgggacatgaagatgatgacggattgtatgtcggcatcgccgcgttgtgcgaacgcccagtccacgaaaccaccgaagttggctaacctcctccatctcgattgccgatcgtcgtcgaagcagagtttctgggcatgaatccagacgcgccgccatcgccgcgagagttataaaatcatccctcaacccacaaaaccaacatctctcagcttacaaaaccgtttattttacattttaggtggttttaacactggttttatccgacgtggttatttagtcagcgtggaactcatatggccccgcatgtcagggtgtccacgtcagcacccctcttctctcccttccttctctctctcaccactctgcgcaagctggtcagcgggtggggaggacgccggcgggagaggagggcgtcggcggccggcgacgggcgacgcggcggcggtgatggcggcgctgcctccgcctgcgccgggacatgacgtaggaggtcgatggagacgacccgaggaggcggatgagcacgcggcggccgacggaggggaggggagcggcagcgagcgagtgcgcggcgggctgagcagagcggcagtggcgggcgagcgagcggagcggcagcggcgggctagcgagcagagcggcagcggccgcgagcgcgcagcggacgagctctgcagcgagcgggcgggcggcggcggcaggcgtgcgagcggccgtcctacagggagctgctccggtcgctgcaccgcctggcacgcgacctgtccgccgtcgacacacccgcgccattcctgcgcgcctcgttcgcgtccatctcgaggcggtctaagctactggcggccgcgttggatgacctgcggggcgccgcggtttatcttttctttctggtctgtgttttcatgttgccttctacatgttcaatttgattttttttttcatggatcgatggtatatggtttttttcctgtgtgttttgaatcgtcctctcttgctcctgttaaggttggggaaccaatatctctgtggtgtcaccatctttgcaagaaggggatagatcgacgcgtcaagaaatcatttctgttgccatggctccagtaggcaatacgattgttgcttgcgtacaattttttcttgatgcagactagtttcttttcttgtaccctgttttagaaaaatctcactcttctctgtttatatctgttctgttcatgcacagtgctaaccccgggcttgtcggactggaatcctttgaagaatgaatccccaatgactgtgctagatccaccatgccattcagtgttgcaggtcatgatgcttcgagctcgtgattggtctgtgtcagcgtaatggatacattcagttatcatatttcctctaaaatattcgtgttttcgttcattagatttactttgttagatttggcggtttggcaatgatgaaacaaactttcagcttaccatgccagttctgcttctgagaattcatgacagataaagctgatatagatctgaactgaatgttttcatttgcattatgagtgtgtggcgccgccggggagctgatatagatatcgaggctgtgcggcgccgccggggagttgccgcggttggcgtcgctgtgcctgcgggaggtgctcctggttcaaggcgatcgtcgccgattgctcggtgcgaagccggatgcggctgctgctggagtcagacgagatggaggcggagctacgggagctcaaccacgacctggccacgctgctcgacctcttgccggtcgtcgagctgggcgcctgggcctcgccgacgacgtgctcgacgtcctcgccctcgcgtcgcgccagtgccggcggtgctcgccggcaccggaggcggagcaggcgctgaaggcgagcgtgctgtcgctgatacaagaaatcgagccccggcaccgccgtcggacttccggtgcccaatctctctcgatctaatgcgcgaccccgttgtcgtggcaaacggccagacgtacgatcgcgagtcgagcggccggtagagtggagcggagcggcggcggcatccagcgacgcccaggggaaaaatgagaggaagggagagaagaggggaaagagagagtgtgggccgatatggcatccttatatgtagggctcacatggatcacacgctgattcagccgtcacctagaataaaccggggtcaaaaccaccgaaggacctattgtgaccggttttcattagttaagagatgcatatatctgtttttatggttggggacgattttataactcgatgacaagttgagggaccttccatgtactttttcctcctcctttacccgttgtggtccggcccatgtttccaggcccagcgaccgaagacgctgctggatcagctaggaccagcctagccggtaagatggtaatttcgcaataacacccaacccagcgatctcccccgcctctcccgtacggtacgtcgctttccccttctctctcccaccgacggtgaacagatgccgccggttgccggcttccatctcctccgttcgcgttcgagcatggacgccgatgtcgtcggctgccgtctcctccgctcctcctcatcctatggagccctcctcctccccttccctagcgcctccactcctgtcacctcgttaccagatccggccgcccccgtggtcgagggtgtcagatatggccaagggcacgatctttgcgtctgtttaaaacggtattgttccacacatctgattttatgggcaaactggcaaagttaaagcaccttcgaatgcgaagccaagaatgtgaagctgaaggaaaaacgacatctcggctcattatctctagaatggtcagaggatgatggcaccaacagcagagaagattgttcaatcattcttggtaaccttgagccaaattctaatatgaagaacctaaagatttcaggttatgctggtgctaaaatcccatactggattgcaaaagcctatgtgaaaaatcttattagcttagatttgggaattgggaagttgtataaattggaagaaacttccatctcttgcagaattcctactgctcaagcatcttcgattggacaaccttcatcttccttcagaattcctactgctcaagcatcttcacgcgacggcgggctcgatgcacgacagcaacctcatattcgcgcgacggcagcaggcggcggtgggctcgatgcgacggcggcgcggcgcagacagccggcacggacaacctgatacgagcagatggaagagaggagaccttatttttgttaggccgatcatatccatgctaaaccaatggttagattagattggtatctcagggtacctcgtacctcataatacctcgtggtacctaggaaagatgctcttgacagttctttattagccataagacgtggtcagtgttgcagcagtattgtccatgaatcaatggagtttggtcgcggagatggcgaacgcttgtcaggccatgtataaaccccggtgattaaaagagttttcctgggcagcacggataaagcgcacacggccgagcgagtgatcaacacaacaccaccacgccagtttaaggtttttattcagttttgctacagaaaatttcaagattcaaagatcagaatatgagaagatttgtacataatctttaagccaaaaagaatatcgatctatactagaaatcgaacgcaatggtgccccaacagcatagtacaaatgttggattcgacttcgcaacacaaccgaatagctagctagcctttgagagcagatacaatagcagactattagctaactataaacatattttaatgagataaaagataagatagaagagcagcgggctacatatttgtagccaactacagcacggacttcaagacgtggtgtgtgtatgataagtgggaccatatatgaatagtatagcaagcaattattgtatgaatttgctattagattgactatagataaattagagttaacagtgggctatagctctgatgtttaattctctctatctgagacagagagttggttaaatttcagcaggcaccacttgtcactgagtcactcagtgcgtcctctgttgtgtatcgcttccagctatatacatctccttgaaaacgccaacagccgtgatcagtaaatggaatttccagtagttgctgatgagttgttgtatcatcgtcgttgtcatcatcttctgccataatatttttcaacgagactttctctgtatcctccttttcagtggcatgtatggtgacgctcatgattgaacttgagctcccaaacagcaaactcacgaggtctatctcttcatccgtccttgtgaagccagttatagttacctcctgaagcaattccaacgttaacttcggatgattcgccaatgtatctcggtccttaaatagtgatatctgttcataaagaaaagtaggaaaaacgtaaaaacacgtaggcagtttaagagagagaattttgtgcacagctagtactacgtatagagaatgagatttgctactgtccagcacttggtacccaaggtaccagtaccactaggtactgaaacaaatctggctatccaatgtttaggggtaggattgggaatgagtaaaaatctctcccaatattgagtcaattaatctcgttcctgagttcttcgtcaaaaaagaaaaattctcattcttggaccccgctgcatgcttgcgtccattatttcctccctcatatgcgcgtctttgcagttcttccttgccgccagtgccgccgcctggtccgacgactcgccgctgctggcgtgatgcttaatccgacaactccacgaccaattcgctgcctcggccgccaacacccccgccgctgccgtggcacctagtctgacctctccacggccacctcgctgtcgcggccggcagcgcccctaccgccaccgcagccgcccgccatggccatcgacgccgagactggatctcgcagagtcgcaggccacacatgccgcacacggccgcggatctcgcagccctgccatcgacgccgggatcggatctcgcagcacgtcgtcgccgatgctagccttgtgacacaccctgatgctcgccaccgccgtcgaagctggggctggatctcgcaggctgcacgccaccttgaacccttgaaccccgcagctcgccgccgccgccatcaacgctggccccagacctcgccgtccatcgatgctggccccgcagcgcacctcgctacctaccgccgcaatcgacatcgggtctggaacccacagtctggtgccgccatcaacaccccaccacgcaccctggaggccggcgtctcgcccttacatgcgaaaagtctatactacccttccacttctcttaaagaaacggtaccactataagagctaatggtaccgcacggtaccgagcaatctcaaccgtttgatctgtcccaacggacggctaggatttggtaccgcctccctctgctggacggtagcaaatctcatagagaatagtagtacggtgctaaatattttctggaaaattaactcacctgtcccctttcagtaatgttgatgcagagtgatcttaggccagggcacatcagaagaaacgaccgtacacttgccgtaaaatggtggtgcggcaacttagatgttttcaagaccatgctcctaactttgtgaagccggggtgcgctctcgtccgtcagatcagcaagctcctcgtccgtggtgaacacgctggatttaagaagaaggtctacgtgtttgacattagggcagttcttgaggagccataaaccgtagccacggttgctgcagtattgtccatgcaccgttaggttaaggtcacaaagacggcgaacgcttttcaagccatgtatatgtaaatccggagtgttcatgaacacttggttgtccatggcgatctcctccagcctcggtgccacgattttgatcaccgaccgcgcgttgatgtcatcgagagttaaaccgtaccagcagaatgtgtgggtgaagacgcgcaggttgggcgccgtcacgtccagcgattgtagatcgtttgcgtaggaaatgcgaagctcttcgagtgactcggtgcgcagaactagccgagacaacagcttcaggctcgacatctccagcttacgcaagcgagggcagcatgtcgacaagaagtcgccgagggtgcggccgccggcgctggcgccctcttcctcgtcgaacgacgcccagcgaaggttcagctctgtcagcgcttcgtaacatgccgccggggacgcagggagccggagacgggaagaacccagaaatagaacgatggacgccgtcctcgcatggctgggcaactcgacgattggcagcagctgcaggtcctgaccatcacgtgcgttcgaaaagtaataaaacctgaaagctttgacggcgcgtcgcatggcgtagcggagccagtcgttgatctgatcctgcgtggcgctcttgcggtaggacatgtggatagtgagagattgtatgtcagcgtcgccgcgttcagcgaacgcccagtccacgaaactaccgaactggcctggcttgatggcccgtcgtcgtttgggattcatatcggcaaagtagagcgcctgggcattggtccacacgcgccgccatcgtcgcgagagcacggccgtcctcgtcaccgtagtcgcgttgttcagattggagaggatgatgtgtagcaagtcgtcggggagggcgctgatccggtcgagatcatcggctggatcgtcgtggtcatccatggtatcagcacgtgcgaaagttgccatgagagcgaaattcctgcacagtttacgtaatcaagatttgatcgatcgattaacgagtttatactgtagagagacaactggggaatcggatgagttcccaactagagcatccaatcgggcatgcagatcggaattgaacaggacacagccgtccggtctccgcatcccatctcaccccctcacgcatccacgggccacggcgtagtaaaagcagtcggtatagatagctataagacccgagtaccgacggcctagccctaggcttggcttaggcacgacacggcacgacacgactagtgtctggcctggcccaaaagttggatcgtgtccgggtctctgccttggaacagtgggctagcctggcatggtccaatgatcacggagtcaaaattgataagggagacaaaatagacttatttcagccatataaggtctagcccagagagaagagggatgcaaatagacttattctagtcatataagacacggcccaaagagatgagggagaaacaatagacttattgcaaggagaagcacaatgggttttcacgagtttttgtgcctttaggacggcccggcccaaatgttttgggtcatgtctgggtcattggtgtagcccatgggcggacccaacctgacccgacgtgtaggttaggtcgtgccagcctaattgatctcagattgggccgggctgggtggctcatttggccatttatactagtcgaacaatgcggcagataaatatcagagactctagtggacgagtttcatcactagaaacctaaccaatagagacctaaccaattgaactatgtgtatttcgtttgctaagaaaaaaaaagtcaaaggtccgctgaactcccaagacaagagtatatttacatattttttatgtcgaaaacaaactatactagaaacacaacacgagggccgcttgatgcatatgatacaaatgaagcaaatacatgatgcaaaccacatatatagtgcaaacatataaactaccgtaaacatttgatatttatccatatctccatgagtaaacttttactctttgtaaaacttttactcatcattaaatttgtgaataaaagttttaatcatagtgatgtggataaatttcagacgtctatttctttatgatatggtagttcataggtcttcatggacaacatttggatttcccccaaatgtttgatgcatcatcgcaaaacaaacgagccctcgtgtctaccagttctctcggttggagggacagggatggttaaatctcaatatgcacaactcttcccttgtgcaccttcatattgcgttcgcttccacgtatatttatctctttgaaaatgccaacaaccgtgcccagtaaatggaatttctagtagttggctacggtttggatcgtcgttgtcatcacattctggcagaatagtcatgcacgtgattgaagttgagcacccaaacaagaaactcacgaggtgcatctcttgatctgttcctgtgaagccaattatacttgcctcatgtaggaaatccatggtaatgttgggttggctcgccaatgtatttgggtcctcaaatagtggtatctgtggataaagaaaacagaaaagcattaatgtaagccgcctgtattttgaggatgcgatattgcatatatatagtagctaattatatagagaacaacatagtactagatatatatttcaggaaatcaactcaccttatccctaccactaatcttgacgcaaaacgatcttaggccaggacacatcaggagcaacggccgtacacatgtcacaaaacgatgttccggccacaagtaagatgttttcactaccatgctcctaactttgtgaagacgaggtgcgcccttgtccatcaggtcaatgagcccattcatggagaacatgtgtcgaagatatatgtctaaatgctcgatgttaggacagttcttgaggagccataaaccgtagtcagtattgcacgagtactgtccgcgcatgcgtaggccaaggttcctgagatggcgaacgcttgttcgatcgtgtatatgcatatacagggagtcggagccgaaaagaggacagtcttagctcgatggacgtcgtcctcgcattgctgggcaactcgagaattggcagcgggtgatcatcatccgtctcatagcttgaatgataaggcgaacaaagtttgaatgtcttgatggtgtgttgcatggcgtagcggagccagtcattgatctgctctggcgtggcgctgtcgctggtgggcatggagatactgagagattgtatgttagcatcgccgcgttgggcgagtgcccagtccacgaaaccaccgaactggcctggcttggctcgtattttcggatccgtgtcgacaaaggagagcttctgggcatgggtccacacgcgtcgccatcgccgcgagagcacggccgtcctcgtgaccatggtcgcgtcgcccaggatggagaggatgacgtgcagcaagtcgtcggggagggcactgatccggtcgagatcatcggctaactcgtcgtcgacgtccatggggtacgatcgtgtgaaaacagccatggaagcgaattgcttgatcgattgaacgagtgcagagagttttctagtattcagagcgtgagtataaaaatttcgtatatagggtggcacactggtttcaattagaactcggttcgaacttaggatatgatcgagttggaatccagcatgacaccggcatcacgaaaattcacgcgcatccgccgtatgcggctaataggcaactccaaatctggttgatatgcacggatgcagagaccgattcaaccgctcggccgtttcccgcgggggccacgacccggttcatcggatccaactgcctaaattcccatctcggtaatcggcatgcaccgtgtccacgcctgcatcctgtacctggaacgcccgggcccacttcccagtgactcggtccagagatttgcatggtgtggccattcttcctcctgcttgctcgggaggctcgaaccgaacacataaaagccatggcctctgctgccctcgctcctcacagctctctctcaatcgctccctgagctagagctgtccctgccaaaggcaaataataccagatgaacacggcagcctctcgatctcgacaactcggggcggaataattctggtgttcttctcatcaccgatcgtttctgtacatgtaacaagttgaggatcgtggcgcctgcatgcatttggtggacgccacgtcaagaataaccgaggttacaggtgtctccccctgcatgcagcagggggcatctgcagcttgcggaactcggatggtttgagtttgaacgagttgcagcatgtcccccatggagtcccgtcctgatgatcttgttcctcccgcgatgcacaagccggcgatccaatgcgccgccgccgaggtagatccgtatttgcgttgattttgcctctgcgttttttttcttttaactatcatggcgaggtggttaatttgtcatcaggacgcgagcctgctgcgaagcccgacggtgtcgtcggaggagttcatgcagttcaagaggaaagccacgacgatcttggaggagtacttctccacggacgacgtcgcggcgacggcgaacgagctgagggagctgcgcgtgccgtgctaccactactacttcgtcaagaagctggtctcggtggccatggaccgccacgacagggagaaggagatggcggccgtgctgctgtcctcgctgtacggcgacgtcatcgaccggccgcaggtgtacaaggggttcggcaagctcgccgagtcctgcgacgacctgtccgtcgacacgcccgacgccgtcgacatcctcgccgtgttcgtcgcccgcgccatcatcgacgacatactcccgccggcgttcctggccaagcagctgacgtgcctgccggagggatgcaagggcgccgaggttcttcacagggcggagaaaagctacctgtccgtgccgcaccacggcgagatcatcctgcagaggtggggcgggagcaagagcatcacggtggaggaggccaaggccaagatcgctgacatcctcgaggagtacctcgccgccggcgacatcggagaggcttgccggtgcatcaggggcctcaagatctctttcttccaccacgacatcgtcaagcgcgccctcaccctcgccatggagcgcggcggcggcgccgaggggcacatcctggatctcctcaagtcggcgtccgacgaaggcatcatcaacgagagccagatcaccaaagggttcaaccgcctcatcgattccgtcgacgatctgacgctcgacgtgccaaacgcgaggcgcctcctgaaatcgatgatcctgaaggcctcgtcggagggatggctctgcgcgtcgtcgctgaagccgctgggccccgagccgaagaaggccgtcgtcgaggacgacgctgcggtgcggcagttcaaggcgaagacattgtcgatcataaaggagtacttcttgacaggggacatcatcgaggtgatgagcagcctggaggccgagaactacgcgtgttcctcctcctacaacgccatcttcgtcaagaagctgatcacctccgcgatggaccggaagagccgcgagaaggagatggcgtccgtgctgctgtcctcgctcggaatgccgccggaggacgtcgtgtcggggttccacctcctgatcgagtccgccgaggacgccgcgctggacaaccccgccatcgtcgaggacctgaccatgttcttcgccaggtcagtggtcgacgaggtgatcgcgccatcgaacctagagaaaatggaggaggaggccggccgcggcaagccagggggatcctccaccggcttattggcgctccggaacgcccgtgccctgctcggcgcgaagctctctgcggagcggatactgcgttgctggggcggcggcgccaccggcaaggccgggtgggagctggacgacgtgaaggacaagatcggcaggctgctgcaggagtacgactgcggcggcgacatccgggaggcgtgccagtgcatcaaggagctcgggatgccattcttccaccacgaggtggtgaagaaggcgctggtggcgatcatggagaagcgtggcaaggacgagcggctgtggggcctcctcgccgagtgctacggccgcggcctcatcacgccgaaccagatgaccaagggcttcgagcgggtggccggctgcgtcgacgacctcgcgctcgacgtgccggacgccggcaagcagttatgctgctacgtcgagcgcgccaagaagggtggatggctggacgcgtccttccccaacggtgtgcgctcgtgaagaacacccggttaatttatatacatgcagatgcagcactggcattccaggggatttcatttgcaactttacacagctatatactactttgcattccgttccatgtatgtatcagcaaagggaatatgactagcacaagaaagaaaattgttgtcataggattaggaagctttgatcttccattttagcagttgcgcggcgtttagcccggaggatttgtgcattgaagagtttgtgttgtttttaatatgatgtgagagtttctgttgtttttgttttgtgaattggctgctgagagaattaccatgctacaccttgttatcttatcacatcctatatatctataaagtttatctccactaaatgtagttaatgctaattctctcttctctcatgaagccacatcatctcaattgtttttagcctttggatgattcatcaggggtgtaaattccatctcttccctccaaaagaaacaccatacaaccatccttaggataattgataaaggtacaaaaaatatataaacacatgaaaataaatcgtataataggtaagaaagaaaattttagaactcatatctctatattatcacgtaattctcccgcagcaatacgcgggatacctatctagtttttatgtttcgcatcaacttgtatcaaaccaccacctctttatagtaaggcaccgaacagtttttggggcgaatttcggttgataatgcatctgtttgataaactttcactgtcattttttgtgagggacactttgccatgtttaattcagttcgtatagccaagatttgtcgaatccatgatctgacatatacttagttacttctacgaactttgtttgtaacttaacgctctatggaccctaaggctctctctctctccctgaacggcagatggcagaacctgcacggctgcaccgcataaaagatggacttccagtccaacaaattgcaaaatagaaaaaaaaagatggctctctctatcatctcagtatgattatcgtccttcaaccacaaaacatgacatagaagctccatcaattattaaaaccgacccgtcttggtctcacaaggggttgagactatgatttcatcctacaagtgcatgcgtggcacgtgacctaatcttcatctaacgttacgtttacgtggtattataattaatcataaaaaaaggaaaaagtacgaattaccccctccccccgcggaactatcgcggtcgaccaaaataccccccttaatcacaaaaccggacattcttcacccccaactttgcaaaccggacaaataacccctctggcttaatccacggtggttttgatcctacgtggcagtccagtcaacaattcatttataaaaatataggtgggccccacctgtcagtctctctctctcccaatctctctctctctctcttctccatcagcgttccatcagaggccacgcctgtcacggccgacaccgccgctaacgtccagaccagccgctgcgccatgctcggcctcgtcgccactgggatcaccggcggcgccctcgcgcaggcagcgctcaccaaggccgccaagcccatcaagcttggcctcctaccactgccctccagtgaaggagaggttctacctgcagccgttgccgccagcggaggcggcggcgagggcaaaggaggcgaggcggtagcgggcgcgggctgctggcggcacgcgatgagccgaggtcggcgccggggatgggtgcggaggcgggctcgggcggcgggcgaggagccgaggccagcagcaggcaggcgcggaggcggctgcaggcggcgggtgagggaccaacgacggcagccgggtggggcggagacgggtgagggc

SEQ ID NO: 65437 - DNA, 5981 bp, Oryza sativa
ttccgcggttgcgtcgccgtgaggcacctgctaatcccagatgccggtgacgagcacatcggactccgtcgacgacgacgacaagaagctctgcccgggggagtggtgctcgttgcggttgtacctctacttgacactggcggcggtgcccacggcgagcgtgagctcctgctccgccgccgcctcctcgtcgtcgtcggtctcctccgcgtcctcctcctcggggctctgcgtgtagtcgactgccggcacgagccacgggccacgggcagaccgcgagccacaggcctccacctccggcgatgccgcctcgcctcgcgcctccgtcctgtccgcccccgtgcaccgccgcccaccgcccctgggcaccgccgccctctgccgccgcttgccgccagctgcgtccgccgctgccgctcgcgccgccgcccacatcctcccctgcaccgccccgtgatcgagagagagagtgaagagagaggaagaagggaacgacatgtgggtcctacattttttaaaaatagaaaatgctgactgggttgccacgggtacgccacataggacaaaaccgctctgaattagatcgaggggggtaattcgtccggtattgaaagttcagggtgaacaatatctggttttcgtgttaaggggtgtaattcggtcgaccgtgatagttcagaggggtaattcatacttttctcaaaaaaaataggtgtagccgtagggaggtctcttatcaaaaataaaaaaaaatgggatgcacacgaaataaaatcctctctctcctctgctcttctcccccttttctctctccctcagaaaggtaagctaccgtagggttaggaccttctcaagaagttgatattgtcgcagagctcaaactccatcgtggggcactgccaccttcaatggtgccaccgtcgctgatgacatatgagcatgagcttcttcatttgggcacagttgttggcgagctcaagctccacccgtgcgatccgtaagccctgttgttcccatgtcaccgatgatgaacacgagcttatcctctcggagctccgcacccaccctcggcatgccttcctcgagtttgggggtggggaggagggagagtgagggaatgacatgacatgtaagcccgttgcttttcttttttctttttttctttacttacactcgcattggtgcttatgtggacaatacgttaacattggttaaccgatcaacatatcacatgggataaacccaggaaacaaaacactgaaagaggtaaattgaaccggttttaattcttaatatgggtgctgtaatgctgtaccttgttttggggttgagaaaaaaattagactaggcttgtatgtgaaggacgtcttgtagactttctcccgttacaacatgacgctcaaactcttcggccatcttcgccaaagcccatatccctaaggtcctgagaattttcagccttggcaaacaaggccttcaggatacgtttcctccccagtgctactgcagtactgctacacaggatcagcccgatactattattcatgcttttcgtttgtagaactaacattcgtgtgaacatgccaaaaaatacagctagtttctcctaggataccgtggatgcagccacaccttgatttgaatctggcaaggcagggaataaacaaatttgacttcattattagttcattgtagcgtctagcgtggcatgctaaacggcgcatgcggtcgacatgtggctcattaaattctggaaggggacatgtgggcaacgcgagagcgagtaaggattgaatcgtgatcctgcaagatagagtcgctgataatagcactgcccacactgccaaaatatgccatatgttatcctagtgaaattacgaggaaacataccatgttctacgagaaggaatacagcaataacactcaggcaggtggtcatccagccgccgaagaaacaatagctcatcggatctaattctgatcatatctgatctaaagtacaagaaaaaaagtaatataattctcggacgagaacaactctgatctggtgaaccaacatgcgcgcgtaggagcctgaaacaacgctgaactgatgaagcatcacctgacgcgatcacgagaagacggggcgcggtccggggaaagcgatcccccgcctcacgcggcagctaagaccaggacaaacgcttctgtaggtaacaccaaaagaggccttctcctggagtggacacgccaagccagcgagggcggcacatctcacaacgcaaagctttagcgccggaaactgccgcacacagcgcacgggagcacagaccagtgccacaacccgtcgctccggcagtccgtccggctcgaaccgacccaaagtttacacgggaaactctcgcgattccgtccgttttggcctccacaaaccgggagcttctccgaaggagatcacagcacagcgatccgcgaggtgccagccgaaacttgccagttacccactggcaaccgcgcggcctggctgcacggccgcaccccgtcgccttccgttccctcccccacgagcccgcgtgtccccaatcatactagcgcggccgtgtccgtttcctcctccgtcgccaccaccaccaccaccacctcttccctccccggcgtccgctccgcccccattcgccgatgcggcgggtccccaaaccctagcccgatcccgacggcggcgatggcggctggccgtgcggggggcgcgccgccggtcaccggcgaccgctacctcgacttgctggtccgcttcgtgggccgcaacgccggggcgctgctcgacggctccgtcaccctgcgactccaccccgtggggctccactacgtcgcctcccgcctcgaggcgctgcgggagctggaggcggtcggcgccggcgcgcccgtcgactacctccgcgcctacgtcgccgacctcggcgaccaccgcgcgctcgagcagctccgccggatcctgcgcctgctcacgtcgctcaaggtcgtggcccccgggccggggcgggacccggcgccgctatcactcgtgccgttcgcgcgcctgcgcgtgctcgagctgcgtgggtgcgacctctccacctcctccgccgccaggggcctgctcgacctccgccacaccctcgagaagctcatctgttacaattccacggtgcgattacgacatgttccccagtaattctgatcctgcagctacttaattcgttgtttccggcaattcacatggtgagcagaggcgctagttttgatctcatactaaactatgaactatattaagtgtgaattgtgcttattgtttgcagtctggttcttctacatccaacgaactggttttaagtgttatcccacctatgccccacagaccacaaagccacaatcaatactatgttcctaggatctgacccatcctggtggctggcacatatattacaagtattgtactatagttactcagcatgttactggcttttctatgggtgaatttgcccattttccgagttctaagatactagtatgacatatgacatgacgccacaagcatttgatggttactaatgtttccattgtaacccatgggatttaacgggatgctgctaggtctttaggttatcatcaagcacccctctggtgaatatgaatttgatagcaatctaatccacatgctgtttctctggactagagaattgtgagcatctttgcaatactaagttctgatcacattcaggcttgtgttgtgggtttgtggcacatggtgcactccacagtattgcaattgtagcgtctgtcccttttgtgctcgctgcaattaccctcctgacgtgcttagttaatctctgaatgcagaagttgtgtggcactgtagccatttaatatctttgtacgtttgtcttgtgtatgctttcatgcagctgaaaatagggttatgcttcttgacatactcctttgcaaatttactgaggaaaacttaggcaatttgtcatttatctgagttagaggtttcagtggagtccgcagtggtcatttaaggtaataatgctgtaataagtcatcttgtctaggtaattatcacagggtacccattataaacaactaaaacactgttgattggaaacaaacaaagtgtttgtgtgtgtggatggaccgtgtaattactagtagagacatataattgactgtttagagcatatagcctgagaacctcaatatttggttgtggctttagaggctgcaatttactgggcagtgccattgcttggatcttttattggtacacaaacaaaagctcagtagcagcaaaaaagttaatagaggaagaagttgcacagttagttgcattggtcaaacaattcttctgattaggcttcctttttgttcatttccacacaatgcaacaatactgtccatggccatgtaacagttcagttttgcactacttcaggatgctcttaggcatatcttcacgagcaggatcatggatatcaaggactcacccgtatggggtcggctgttgtatgtatcatgtgcttcaaatggtctggtgctcatggatgagtcattgcagttgttacctgcagttgaaacccttgatcttagtcggaaccagtttgcaaaggtggataatctgcggaaatgcacaaagctacgaaatctagatcttggatttaatcatttgcgctctatatcatccttgagtgaggtaaaatgtcttttcttttgaatacctttggaatattgctaaaccggcgagcttgtttcccgtactgttgtttttgtttgatggcatgttacttccgtgcaggcttgcggtcgaattgtgcaacttgtactgagaaataatgctttaactacactacatgggatcaaaaatctaaagtcgcttatggaccttgatctgtcttacaacatcatctcaaatttctcggagctggaaatacttggtagcctttttttgctacagaacctatggttggaaggcaacccaatctgctgtgctcgttggtatcgagcacgtgttttcagttttctccacaactcagaaagtgtgagtagtcatcaaattgcattattttctcatgtttttttctttatgttctccatcataatagtctcttccacagtattagagtgatatgacagctctgttctgtacctttttctgcctcagttgaagttagatgataaaggtatgaacacacaggagtactgggaaaaacaagtactgttttcaagcaggcaaaagcaacctgctggctatggattttattttcctgcaaagatgaccatgaggatgaagacacatcaaattcaaagatggtaagttaacatctgccacaaaattcatctattgtatgcgacagaaaatattcaagaactgttagttagagcggtttatctcattaccaatagaaatattgcatagtgatctcttctcatgcttacgatttgtttatttcacatgcagaagctggtttcttatagcctcagttttttttgggggggggggcatatctatatatcctatatagttggaaccaaaagcttgacatgcattgggccacatcatttagaaaatagtagcctatggatctcttgcatgttttgatctcaatcatgtgtcatgtacatttacaacccacttattgtagttattgatataaaactcaatgtgcattgaaccatgtcacttagaaaagtaatagccattggatcctctcatgcttgataaatccatgtgtcatgtacaattgcaattctaaatcaattactatgagctcaaaatattgtttttcaggcattacaagtatataatttacaaattattttccttgtgttttctttaaagtatttttaaatttcccgctacaacacccggggtattcactagttttaacagagatttcccattgacatattatggtaatcttgtttcgagaaatgcaagatataacaccatctattaaacgcta

SEQ ID NO: 65438 - DNA, 6628 bp, Oryza sativa
acgccacgcgacgcgcgacgccaagttgccacgacccagcgaggtgaggagtgcgcgggggagcaaaacccagcgcagccgcgctgcggccaccggcaacgccgcgccgcgaccacgcaaccggggaaaaaagcccatcttgtcaccttcctcggccattaactgcgatccctccagctagccaccacagcttagctcgcgccagcctcgcgtccacacgcccacccacccacccacccggcgctgagctgcgcctcgtccgcatttactagcatccgatcggtctgatgcccgtgtgaggtcgtgaccgtgatgacccagccacgcaacgcacgcagccgtcgagtacctggatcgaacggccggctttcatcctcaccggggagtcgaccgtcgccataaatgtaaaagcgattaacgtcctccacaccggagcatgattgatgttttgaggcggaacggaaactgaggaagaaagccgtcttctctattcaaggaagagcctgtcccggaaaacatgtcggcacggcgactgcatttatttacgtgttacagccgtataaacagagggatattggaaattcgacaaagggtaagaaagggataatcagacaattttggattattgtacatctaggggcaagggcatgtttggctttcagctcctccgaagtgaagcgggctagaccgcttaagcgctcccaccgagactgtattgggtttagtattgggtttaggctactccacaattttatttcaaacctaactattagagttaaatttaaaagttggagttattctcagctagtcctctaattgtcaaccatagcagatcgggcatgtaagtaaacccacgtcgttgtcagaatttataacagaaatggaattctagcttaagagaggaataaaacgtgagctaatgagcacaactcacttcaaccagtaattagatggatcatgtctgaccggttgcatgaagtgcgagtcgattttaatctagtaagatgaactcaacttcagttagtaattagatggatcatgagttcggttcgagctaaaactcccaacgacggatcatgagtagctcgtgccctctccttcagatttttttgtacaatctcctaacatattccatttcttatcaccaaaagttttaagaccggaaccactgatttttcaggaacaaagaaggactgaaatatctcagtataatactacctctgtcctaaaataagtgtagccatggatatccgtacccaatatttgaccgtccgttttatttgaaaaatttatgaaaaaattgaaaatatttagtcacacgtaaagtactattcatgttttatcatctaatagcaataaaattactaatcataaaaattttcaaataagacgaacggtcaaacgttgaacgtgaataatgcaaaactgcatttattttgagacggagggagtacgcagttgtaatcaggtagtcatctcagtaataaattacgcatgtctgtatttggaagagtaatgtagtaatactgtactagggttttcgcaaatcaaaagagattaattggtgtgcagtgtaggcctaccagtctaccagagactatgcgtgtatccctttcgccagtaacgatacggattgcaactggagcctatgagattcgatcacgcccctcaattccccaatccctctccctcttcatggatcctgacacgaacaatcgaacaaccacggccacgctaaattggaaaattaaaaaaatatataataattaatctcctgtgaatgatcattccttatgtgacacatcagacaaagtatatcgatttaatccgtgtttatagcgaaaaaaataaaaataaaaggaagacaagaaaaaaaattaagaagcgagggaggggaaaggaggaaagaagaaaacaccacaaattaagaagctccaaagtttgaggacgcacgcttcgcgggtgacgtacaggtgtaggggaggtaatgcggcggcggcgcgacggccgccggcgagggcgaggctgaggctaccatggattcgatcacagcttgacgacctccgggatgtcgacggggtagcggtggatgcagtcgtcccacggcccgtcggcgggcgtcttgactgtgcggaggcacttccagacggcgctgttgcacttgaatccgctgccgaagccgatctgccagacgcggtcgccgcggcgcatgcgccccttggcctcgatgtaggcgagctcgtaccagagcgagctgctcgacgtgttgccgaaccggtgcagcgtcatgcgggacgcctccacgtgctgcgcggacaggtccaggttcttctgcagctcgtcgatcacggcgcgtcccccggcgtggatgcagaagtgctcgaacgccagcttgaagtccgggatgtacggcttccacttcttgttgatgagcttgcggccgacgaggcggaagaagaagagcagctgctccgacatgggcagcaccagcgggccgatggtggtgatgttcgacttgagcgcgtcgccggcgatggccatcagctccttggacagcgagatccccgagtgcccctgctcgtcctcctcctcgtacacgcaccggtacgcgcggtcgtcggcgcccttgtgcgtgcggaccacgtgcatcagcctgtacttggccctcctcgcctccctcctcctgttcgacagcaggatcgccgccgcgcccatccggaacaggcagttgggcagcatcatgtcccgccgggttccccagtagaagtttggtgtgatgatctccgtcgacaccaccagcgcgttcgagttgggatgcacctgcgcgtgtccgtccatgtcgctcgttaatggctcacctgattagttagttagctaaacagtagtaacatcaaagagctggctagtacttacctggagcatgtcgcgggcgaggtcgagggagatgaggccggcgctgcagcccatgccggacaggttgaagctgcggatgttgctgcggagcttgtacttgttgatgatcatggcggagagcgacggtgtcggggagaagagactgcagttgacgacgaggatgtcgatgtccttgggcttgagtccggtgcggcggacgaggtcgtcgatggcggagaagattacgagctgggcctcggcgcgcgacgcctccatggacgggttaggcgggatgtagtggttggccggcgggaggcaggtctcctccccgagccccgaccgctcgaggatcctggtctggaaccgcacgctcttctcgtcgtcggtgatgaggcgcgtgtgctccatgaacgtggcgaacggcacccggcagctgggcggcggcttgtagcaggagtagtcgacgaggtacaccggccttggccgcgacatgaagtacaccgtgccgacgaacacgacgaggaacaccgagcagaggatgtggacgaggtcgagctgcagcgaccgccacagcgacagcagctcaccgggccccatccgcgccagctccagcgccgtcgccgccatcaccggcaccagcagcagcgtcaggaagtggttcaccagatactggtaccccagcttcacgtacttcagcttcaccgacccggagtaccccgccgcccccggcatgatcgatgctctcactacttccccgcgcgccgccgcgcaccgcaccaacgctcgcacgccgcgtcctacgtacgactttagtttcttcttttttttgagcggtgcagcgtgcacaatttgtaggtgcgatgcggtgcggaggcggatgggtttgcagtggtgtgttggtgatggtgtgtccggtgcccggttggggggtctaatataggggacgcgcgcacggtggcggagacgagacgagatgacgaggagtaattgataaatctggggcggatggggtagtttaaagaggccggtctaccgccaccaaccggaagcgttgggctgctcttattagatttctgcatcatgggggggacacaaggttttctcccttgttttttgtttatacaagtgcaactcgtagtgacggttaacggcttaaccccggtgtcaatttggatatgtcatatgagtatatgattgctaaggagtatcatactcctcctatagctcctggactctggagaggaccatttttcagtgacaaccttgttctgcgggcattatcggaggaaaataatagagttcgtaattaagtggagtaatacacaagcaatgtgcacaggtactgtactgctcgcatctggatccaggtgagtacgttcagagtttagtcatgcatgatacactgaacataattctcttatgttgctagtagctgctgtctgtcccatctaaatttgcatctgatttttgagcaccgaatgatgtaacaagccaataacaataagtagtactattatcagtagttaatcaccaagtgtccaaatcataaccgagttagttcaactgttaagacccttgaggtcttgacccgtcgaaaaaactcttgctactctattcgtcaacacctgatttgagtccaaatcaggtcctctcctatcgccgagtgaacttatctctgaagataggtttcaaaaacttatctctgaagattggtcctgttttcttttttactcacttccttttgagatgtatgcaatggtagatcagatgagagggtaactttccctgcggaagtacggcaatacagataatggctgggactgaattgggctcccttgcatctgcaccgtatagggttgtgtgtttcgcaatggcatcaggttcaggactgcatgtgcaaattactctgttggtaccctctgcttgtacaatttaaagcactgttgttgcaggttgggtacccatcattaaactacgagatgaacactcatgtccaagtcttgcaaattcacatgtaatcttgtaagaactgaacagttttacttcgaaatagtactctttaaatgttgactctgattcgatcggatcgacttcgtcagtgtgcattacaagctctgtttggacaaattctgaccctgttaagcagctctagctggatactacttctatactagtacttttttttttgaaagatcaatagtagatggtactcctattaggctattaccattactctttggatggccacatctaagtgcctgatctggtaatgctatactcctagtatccttgaatcctgataagggtagtacagtacggagtatactcgtatttttgttacgagactccacttcataaattcatatactacagtagtaatagctcagacaagttcaggcagagcagtgatagctgatgacagaatactccctccgttccataaaaacgaatctagaaccggatataacatattttagtatgatgtatatccagattcatagtattaggatgtgtcacatccgatagtaggttggttttttatagaacggaggagggagtagctatataggtgcagcagcttctgagcttgtaagaaagagttaattgcgtatgcagtgatctgcgtagcaatagtgcaactgtacaattggtgaaaatctccctaaaaaatggctaaatatatggcctcctattgtcccggagccaatgacagtgtggtcctttggctgcagccctggcagcagcattaacgtagtagtgagtgtccagtgcgcagtgatccaatcaaaattcgagacaggatcctccgggaagcatcaagcatcttcgcgtacgagtcgtgagacgatctgtccatgcctctgaagaaacggaaaaccacggattgttcttcttcccctcgcgctgatacgagtgaaagtgcagccgaagcagctgtcgtagtggccgcgtgaaatgctgaagttgacgggtctgaatatgtgatcggtctggaggacgaatggacgatgggccgacatgggatggagttgggggttgggagaaagcgtggcgaaacgcgctgtgtttgctcgtcatcgatcgaccagaggaagggcagagactcacattaataaagcttagctgcaaccatacatccgccgcaggtgtgcaagggcaatcctgttcggttcacgtctctcttgcccttgtttcgcacgagcgaattccgtctcttcgttttggacctgtccctcatgtactacgacgaacggcacttaggggatcgacatcttcgtgggacaggattgtaaacttacaagtattattctacctgttcccttcatactacacattaaatgtgatcatctgcttatttaaaattgatcatgacctgtccatcgcgccaaactgccaatctgtattaggtttgacagaggccattacctgcaaagaaaaacgcttgcctaagttaatgctctaactgtacgtgagtacatcctgcctagcgagtggttctgattgctgggtcctttactcctgaaaagtcagtttaactataatcagttgcagagataatcttttttattttcataaacaagtattttctctgtttatgtttttatcaataaaatcgaacctctcagactcaattctttgaagctcggaggaaactacggatcggacgtccgattcctctaaaaaatcggagggtcaaatattgtagttgaccaacaagtgaaacattaagttatgt

SEQ ID NO: 65439 - DNA, 1637 bp, Oryza sativa
gcgagaatgctcgccccgggtgaccggcggggggtggagcagatcgggcgctccccattttcgatgtacttagtgaaacaattccgatatacttggtggaacatcagcaatatttaaaaataattcaataataagctaaaaaaattttgtccgaatatatccatgtgtggccttgttttgaagatttaattgcaacgaatttaatggtacaatcagataatgattgggatgaacaatacaacagaaaaattagcctaaagcaggtatgcacgcatgcgtggcactgacagtctgctgacataagcgcctgattgttgcacgcattgatcgggatcgacgcccgatcggtcgtaccctgcagattacagtatactagcgtgcatgaatcgggcaccctattgtgagcattctcctcgaaggttacgtctcaaacatttctatttcactacatgatatttttatgttaggatgtatgtcgcatatcgaattttgagcagtgtctttaattaatatgtaaacttattgagacggcagccgtgtcaagtacgatacatacccttctaataggtcctacaagagctcaaaaacattacaagcttttagtgtccatgtttgacttatgggtaaaatgcccatacttatttgaatatacaaatgttattgtatgttattaatttgatggattcaaacaaatatatattagacttagactattgcataatatcaatgactaatttgtaaatcttgtaaaagtattgatgatggactaacagcagaaccaccaccaccaccactatcgttttttttcagtagtatagattgatgctcaaagcatctatacacttcgagtgccatcacaaagcccatatttgtttgcacttttagcacattatacatacgtacagcgtttctctaaaaaaaattccacgttttgctatcgatggacgatctgttctccaaaatatcatcaacatgaatcctacaaaataccatgttacaagcatttttcattttttttatcaccattaggtttatatctatagaccttcattagttatttaaacagaggccatttttccctaaaaagaccttcgatacacccatttctacagttttttttggggggacatttctatataatttgcatgtgagaatatgcaaacaattttgctattaaattatttatgagatttaagggtagtttgggtatttagcatgatgacaatcaaattatagggacaaaatggtcttcttgaagacgtgatggaggtttatgaatgaagacttaacggcggtgggaaaaaaaagagagaaattgcttacattatggcatgttgtagatgtccagtttgtcgatatcaattcatagaaccagttgcttatcaagtaaaatgtagaatttctcaagaatatataagttgcatgctcgttatactatttttttcagcgttttggctgggctgaacactaatgcaaaacgagtcagatcatttgctcatgattaattaagaactaactattataattaataaacaaatttgtttgactatttttttaaaaaaacttttatataaaaaggttttagacgaaacacgctatccagtagtttagaaaacacactcataataaacgagaaa

SEQ ID NO: 65440 - DNA, 7183 bp, Oryza sativa
  unsure (1)..(7183): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagatctccatgtagctcagtagctttcatcccacgggcctccaacttaaatacaacatctttcaatggcttggtgttgttcataaatgcaataactgtctgagcttccagagcatggatacatctcctcaaagtgtcaactttgtgttgagccttggatatacaatagtaatgttccaaagatggtggtaagctgttaactgcagcttgattcactgaatttgatggagagttggggttggcatctgtctgggacagcacaggtcttggaacagtaattgaatcaagtggaacaacactcatagctctaacaaggactggatcgtgaccccaactcctggctgctcgtataactgaaaacggtattgttgcagaaaccaagatagtctggcgctcagaccgccttgcaagagggccaagaatatctctagatgaagtaccagatttccttcctacatgttcaagtattctatgcatatcttcacgataattgaaagacaaaagctggtcaacctcatccagtacaagaaagcggcaaccatgggtgtgtagcttgccccctgctgaaatttcagaaatacgaccaggtgttcccacaacaataagtggcttgttctttttcaatgcttcttcctgcctcgaacgattagccccaccaacaagttgttggacaagcctcttatcattagggcccaaaatcttctccacttctcgcactatctgcattcctaattctctggaaggagcaacaataactgcctctacacctgatctcttatcagaaccatcttgttctgtaggcctctttagggggcctatttcagaaagaatagggagaaggtaagcgagtgtcttccctgagcccgtatatgactggataactgcatcatgcttttgtgaaatgataggaatagcagcagactggacctcagttggagtacttagaccttccttgttcaaccgatctataagcaaaggcggcaaaccaagctcttcaaatgattttgcagagaaaagagattcatctatcttcagagtcttcttcactactgctgatttcggtaaggtgctctttgctggtttggaattaaatgaagaaacttttggtttcaccttaagagcagaagcccttgaagacggctttggacctccaatgcgtgttgctttttctttcttaccatattcaactttgttttgcccttcaagactagctagagttagtgaagcactcttatcttgtactgtttcagtaccaagccaagcggtctggtgaaatctaaccgctcgtggtaatgaaagcattctcaatgggaggttgtcaccgaggacgaagcatgatcgcgaagatgccaatgcaagcacatgtcgatgcacttggccaacagttagcctcatctgctgctctgcttatgaaaaccaattttacagcagccgaaatgtccttactcccaactgatctcgcaaattcaccgggggtgctcttggctgtgcaaagaaccaaacaattgaatcatgtaaactgcagcattcacaacttgcaatagtaaaacaaagttagacgcaagaagtctgtggagtatcggtggcatcaatcgtgttaaactcggttgaacccccaaattttcttgggaacaaactaaattgttattcgtgctaaggttaaggcaaaaaggtaaagagaaaggcaacctacagatctagaagagaagctagggccaacgcaaatcggaggggaaaaaaagtgtgggttagtgagagatgagaaagaggatgcgcgtaacgggtggggtgctcaccagcgggcgaggatgcggcggaagcagcagacgccggcgccgctgcccactggagatcgacgcaggcgaggcggccggcgaactcgcgaggagggaggagacacgcgggtttagggcttagttagcctgaagccggcgactggctggcgttcgtctatccggttgagtggggagggggctcgtgtggtcagggtgtcagagacacgaggtaggagtgatgggccggcccatcaactgtggcgccggccgcaggttgtggaagcgggccacacgggccacggcgccgccggacatgggggagaagactgtttaaatgaagacaaaccaaggataaagttgattatcaaatataattaagactaaattacaactgcgcattttcttacatccatggcatcatccattttctacctcaaatccgaaaatgtaacatgcccacaaccaaccacaatatcaacatgttttgtacatgaaaagtgacaaaatatagaaaatacttttgagatgttattgatattaaaacaaaagaatactccctctgtactcgtaaaggaagtcgttttgaacaatgatacggtcttcaaaacacaactttgacttgttatttctataaaaatatttattgaaaagtgatatatgtacacttttatgaaagtatttttcaagacaaatctattcatataatttttacattttcaaactcaataacttgagagttattcatgatttatattcctaaagtttgacttaaacattgtcctaaacaacttattttacgagtacggagggagtataccaatagatggatcagtcttggatgagctgcctccaaattttaccttacagttactaggaaactgcaacccaacttgctcacactctgccttatagcatagataatagtgagctataaattaattataaacttacgtggatgagagaggtagcaagaaaaaaaatgaagggtgttactcttgtgcaagaactagctcaatacgtgctccaagacaaatacaataaatgcataagtgagataaaagagagaggacaacaaaaattgaaggaaccttatagctaatctattatatatgttgtctttaaagtatgataatagctgatagtgagctctaatattaaatttgctcttaagacgtgaggatatgaatggaatccaggtgcttaatagccttacaatatccagtcacatattggactcctgcaaccatgagcctaatataactagtgatctttagaaatatcttagctcggattgaaatccatttacatccatgccctgatatgttacacctataatttggtcatagtacgccacaccaatttgcagttagacaacaaacttctcagtgaggcatcggttatcttcaagcaccaatccattcttaggctatttaggctactacaacagcaagagccaatgtttctatggactctagtcactctacactaacatcaacatttgccaatgacgagagtctctaggttatgggaaaagttagccagtggatagacttatcaccttactctgttataatccagcggttttaatgaaaccaataacgctgaaaagatctcaacgtattttacctggtcgtcatcgctaatccacatttttttatccatattaacatcgagccattgcaatcttcatgcctccaaaccacgacactattcactatcatcgagtcgctgcatttgagactagtctttgtcctttatcatgtcaaacttgatcatggcctcctaaccttctattttctttgccatcacaccaaagtcattatagttagcttactagatccatgtgtcatgtggtgccatgcagaccaccacacacctacactaacatcgctaagttattactataatagtcttcttcatcactttgatcgatcgtaaggacgattcctaaactgccagtgctatatactattcatagtgtttatatcctctacatcacctatgatttatattagacataactctctcaatacacatcaataatttaatgggctaatttaatgtaatttatttctcacaaggtttagatgtaatccatatatttttcatctttccttgttaactcatatgacaaaaaaatccccacattctatatgaaaatactcattccatttcaatttacttgccgttcttgtatttatctatttttccataataatcatctttttacaatttatagagatgtgttttcttccctactatttttaaatatagttatattaatgctattatctgttacaattaattgtactacttattttgaaaaaacaagatataattaataatggtaataaaattatagttcattaatattttttcgtatacaatgtaataaaacaacgacgacgacaagtaattcgaaacggagagagtacataggtgcagccagcaagggcttaatgagcaccaccacccaacccagccaaaatggccaacgagtccatcctcgtcctcctccacctccgcctacagaaccctgaccggggtcttccccaaaaccctcgccgagtcgccgggctccgccgccgtccccatcgcgaactactcgcaggctactcctccggccatgaggggctcggatccggaccggggcggaggcgagccggacatctccaagctcttctgccactacaacgccctctacttccacgactccctcggcacctgcgccgtctcctgggccaccgacgaggatccactccccaatcggtaaagcgtcgccactccgaattctcgccgttctcggtgttatatgggggggggggggggtccggtttactgaatactgcggatttaggtcttgtgtggatgttgagttgtgtgcggtggttgcaagattgctccgttcatgtcctgccactaagcatgcgtatcttagtagattcagtgcagtatgatggctttatagggggaacagcacacgagaacaatcctgttctgtaggggttctgattcggacattcggtatatgttggttcaccccgcatcaaatccactcattcatccaccagtggatcaatgccaaaaggaagtgcttaacccatatatcccttgttcgttagaactagaacatcaatcccctaaaaatgaattagggcatcaaaggggattatccatattcgggtattttgatctaaacgttcagccagaacataggtgatccatattattctacacgattatgccttgtcattatctgcagttctatctgttaacctctaaatctttgcgtcgttctcttgttcattgaccgtaaaaactacactctttgagagtatggatcaatgcctaggtctaaaccatgaaaaagtggaaagatttaatgtatgcttttggcatgctttctagaaagaaatgggaaaatagtgtaaaaacatttacttttgggaaggagtgaacaaatttatctagacagtagaatgaaaaagtcgcttgaactcttagactgattacatagacatctctgctccagttgttttgaacttcgaagacactggtatcatatctatgggcctattcattctgttcattttgttgccacgttctaccattgctattctaccaaaattggtagttctgaaagtttcccattcccactcataatgacacaaccaaaatttggaaagaaatctaacaaaacacatccaagtatccaacgctaccaaaacttgccacttcctaccctgccaaattttggtaaggttgtttttggcaccaaagtgaacaagccctatatacttcccaaatatgtttgatttgcaaatctattggtgaatgtgcatagcattttgaatggaacacagtgactgatgtattgctatgcacaattatgaagtatgtcagccacatttatggcactgtcatgtgcatatttttctagcaagcatgttcaacaagattcgtgagttgtctgtcatagtgtcatttagctcataatcgtcaactataattgactggaaatgatgctgaccatccgacccttccatattttcatcttaacactatctttttcacataaactctgtactattggataactttgtgagttattgcctataattgttttcttctatagttattctctgaaataagaaactttcatcaaagaccatagtacctgctattaccagtatgattgttttgaaactttccatttttaatcattttgatgcagtgaagtaggtggctgtgaatattatcctggtggtggtggctgtattatacttctttccagatccttgtatgaacaccacacagatttggatttaaagaatgcgctgcttcatgaaatgattcatgcttatatgtgcatcaaagatagtaatgataaccataggtactttttagtaccatgactggcctcttcttgtattacacctgaatttctgtctacttttttttttctcgttttgactaatttaaaaactgtgatcaagcagtgaccatgggccaaaattccagaaactgatgaatacaatcaatttaaactctgtagccgatcctcatgtaagttgaattcaggtgtcaattttcaatcagcatgtgcttaaatatttcttattatcgtaacgatatttttaattatatccagcgtcctcttggtggctacagcataactgtgttccatgagatcagaaagaaattttatatacacaaagtaagaacctgatctttaaaagtaaatcttattttctaatttcagattggcagctaacaatctctgtagtgtgaaagctgtggagatttgatcaagtcaaccaaaatcaaaggaccatcacaggatgactgcattgaggcaatgggtgctaatgacttgtgtgacagtttaatttgtcactggcattggtattagctatatatttctttgcattttttttgttccatgcatgccttattggtatatctctaaaggtgtgttcggaatccccagttcccaactcatccatctcgttttccgtgcgcacgcttttcaaactgtaaacagtgcgttttttacaaaaagtttctatacgaaagttgctttaaaaaatcatattgatccattttttaaaaaaagat

SEQ ID NO: 65441 - DNA, 2754 bp, Oryza sativa
ctgcttcaatatctaacattttctttgtgttgtcctgtcactttggcaattgcataatctaaaaagtggtaaatgatctgacataaatttttctttattggaggtgaaatcgacatgtccagcagccaaacaagattagtaatacctgaacaactatcatgctctttctcctccttggggtcctgggatgcaacttactctaaatttagtgtcattgagttcatggatggagtcatgatttggctttctgtattaatatatatataggcacaagaagcggtgcactggtagctatcacagagttcaaggatcatcatcaggttgtgtagagggttcaaaaggtaacatttggcttaaaaaggaggttccagttatgataacattttaagaccataaaacagtctattttgttgaaatgccttgagatgactctttactgcagatatacattttaaactcttagtatgcctactcatacaaattgatgatactgctaatttttgttggtagctttatctgtagaagcacctgattgcaaagttgaagaatcagcccctggaagttggcacaatgcgcatgcatcaattaagggtggaaaaggcaataagcatgaactggaagaaacctctgctgggtttcctcctgatgactctattggtatttctggaatggagtcctcttcaagagacacagctaataagaaaatcaaattgtcaaaggatattggtttggaccgtctaaccgccacaactgttcaggaagcaccgaagcgtccaagaacaacctcactaaagaagaatcaagagtgcagcagacagaagaaaagaaaaataagcaagtgggatggttcctactctgtaatcattgaatggttgaattactattctgtggatgagtcagatgaagatgaggtgcctttgataaataaaagaaccgaaagaagaaagcggcagaagttactgaaacttgttcttgctagggaatccaatagtggcagtgaaggtgctagttctacatcttttgtagaaaatggcagaaattctagcagtgctggctcttaccccctaagccagggggacaatgacaaatctgaaaatgtgcaagctaatcgagttgatgtaagttcattgccagatcatcctgtaagtagtcatgtagcagcagaggatcaagctggccaagctgcatcgtcaccattgaactcaccaactagaggtatcgttgttgacatttcagatggttgatggccagagttccattagtttctttcagctgaggcctggacgtacaattatccagactacagttgtaacacttacttttaattccttgcacctgtctactgctagacatgcaacgggacgatcctgtgaagcatgtgtcttgtacatgtcttcgtttcttcctttctcatttcaccttttcttttcttagcatagatcagttcagtatacttaactctgtcaggttgtgtgacccatcagtttctctccgtactagtctcttgaagaacagcaaagatcaggttttctctttggttgattgtgtgtggaagatcaatccaaatatgttcatttcttaagaagataaattcagttctattctattcataaacttttgtaaaccttctaaaatcctttaataaacaagaagcaaagtgagtaatacgaaaccattcacaaaatagagggaaaagaggcccaaattcccaagggttaattggattcatggcccatttatccaaccgtcttatctccctcgtgtccttccccaattatccccttctatccacccacaccagcaagccgctcaggcgcgctctccgctccaccgccatggcgtccatcaccctcctctccctcgctcccgcggccacattgctccacctcccggcctccacttcgctctccacctccttcgtcgccgctccaggccccatctccggccgccggtccgtcgtcctccgcgcccgcccgcgccgctgcgtcacggtcgtgtgcagcgccgcggcggccgaggccgcggaggcggagcccgcggagaagttccggctcgacaacctgggcccgcagaaggggtcgcggcggcggccgaagcggaaggggcgcggtatcgcggcggggcagggcgcgagctgcgggttcggcatgcgtggacagaagtcgcgctcggggccaggcgtccggcgcgggttcgagggagggcagatgccgctctaccgccgcatccccaagctgcgcggcattgctggaggtgagtctcttcgagcttcccgcttcccctcctcgccctcaatcgaagcctcacacattcaaatgcactggaaattgagtgggaacacgctagcaccttccatttggaatgcagaaatgctgggattgagaagtgacccgttgcaagttctaccttgcgattgcaggaatgcatattggcttgccgaagtatgtgccgttcaatttgagagacttggcgcgtggcgggttcaaggatggtgacgagatatcattggaatccttgaaatcgaggggtttgattaatccgtctggcagggagagaaagcttcctctgaaggtacactatacgacgattatccttcttttttttaagtcggttctgtagatgaccatgttttactgaaaactgaaatatgaatgccttgcatttgatctttgccagtgaattcatcaagttcaccagcagtcttgggtaatcctttagttgttgatgttgtggattgaatggctggcctttttt

SEQ ID NO: 65442 - DNA, 1178 bp, Oryza sativa
atttttcacatcaaggcaggaccttccatgactgtttcctcgccagagagaggggagagagagatcgggaggaacatgcagtggcgaaggatgaggtagctgcagaaatcctccatgtcggcctactctcatgggggatgcgattccgaaattatgtgcgcaccgctggttccgcaacagctttatctgccggatgcccagatcatcagcttcagcgctcttcgcacacatcataaaaaaacaaatcaaataatggaaataaaattaaggaaaaaaccaaatcgaccaagaacacccgattcccaaaaatccaaagaaaactcactacttgggggcagcggaagcagccaccgccgggctgcgctgtcctcggtcctcgtcaacccagtgcctcctccctacctcgctgagacatggatcgagactagcagctacgctgcgctggcgacatcacatcgccatggacatccacacgaattatccagcgctaggaggaacagggccgtccgatctatcgcctaggaggcggagggctgccggatttggtggccgtggacccttcccgcgctgacccacgcaccatgtcgctgctcaccttcctactcccactcctctcactccttctcgacgccgacgcgcgccatagcttcaagatccggcgcggggtggaccaaggagtctcgagccagtccttgtggtggagtcaagctcgagtggtcaggcggaagcttgccgcccctcaccggacaagctcgccgccggtccatcgtccacgagcgagggcacagcccgagtagtactagaagggcatttcgggtaaaactacagtaccattgtgtacccaccgtccaatcccaccagctcctattaggtgaaagagctacttttgatagagcagatacacttcactaggggtaaatgtaccatgctttaagattcgtgtgcacacgtgtagggtgcagatcgtgggtgcatatgaacccaggtgcagattatccaactcctataaataattactgcctcatgttataagttaaattttaactgcatgctatgtacctggtggggagcaaggtgagtgggttagaggctgtatcaggtgttatttaatacgtagcaccttataacttataagatgaggcagtaattattttactcagccttcactaggagtggtg

SEQ ID NO: 65443 - DNA, 778 bp, Oryza sativa
gcgcccccaccgattcaccacctacctcgtcacgcgcgtcaaccactgcctcccccactcgccaccaacgcctcctcatcctcgagggcgatggcgggctcgagaggctcctcgacctcctcgacgcggctgacgccggcgtcgatgcgcgggcggcgcttgagcgcgacgacggcccggtcttcgaggccgtagagacggacgcggagcacggcggtggcggcgcagagggggggcgcggcggtggtgcggcggaggcggggcgcgaggaaggaggagaggcggcggtgcgcggtggaggcggggcacgaggaatgaggagaggcgacggtgcgcagcggcgtcggggagacggagcttgatctcgacctccatcacgggaggcatggaggagagggaaggctagggtttggggttgcgattgggattggtagggaggctgatgcggttggacttggagggcgcggcgccgggcagcgggtggaggaggaggttggagttggaggacggcggggtcgtggtcggagtggatgaggcagtgggtgtgctggctgccgcggcggcggcggcaacgtagaggtggtcttcgagctcgtcgcagttggaggtggtcttcgcgcgccgccgctccggccgccgtcgccccacttcgcccgctgccctagtgcacatcgtcaagaagagagagaggataacgggaagaagatgaggggtaggaggatgacatgtggggcccacgtgggtcccaccatttttattattttgtatgtgaaacaga

SEQ ID NO: 65444 - DNA, 885 bp, Oryza sativa
atccaagaaagcaggtagtaataatcttaaaacaagcatgatcagacgataaaattattccacacgactccgagcccaaagtactactctttcttggggtgaagatcaatataatcaacagggccatgaacgtcgaataaatcagcccaaaatccattcttcctcctcgggttgcaccccatgtcccggcatagcttatcattgtaccagatgtgaaggaatccgatgcaggatctgcgaaagtaagcacgagaatagcgcttcatgaacttctcccattcctggacatcattctgcatcacactgatgcttggcaacctgaagccaccatccatgaaatgtgcgagccacttggcccttaattctgatgtgtacaggtttgccaagctttctgaatagccgataaccgccagctgcgggatcttagggtgaatgatctccctgtgagaaatcatgcagcaaattaattaactacgacacagtcctggatagaaattggaaattgtacaaattaaatttttgctccttgcaagaaacagttattgagttgacctgtagagaggtatagttgtagatgcagagcctactgcaatgctctgaaagtattcagaagtgaacatctccttgatcttctgtccccctctgaatccagttccaaagatcactatatcgctctttatcggcgaagattcgccttcaacaagcacaccttcattgcaaaagctaaatgtctttgatttcttgagaacgatgctgccttcttctaatctcttgtaatggtctttgggtgtaatggccatcaagcatgtaatcaaagcttcaaataggctatggtcaggcaccatgccatacttcttcattggaatggaataatagctttctgca

SEQ ID NO: 65445 - DNA, 10004 bp, Oryza sativa
caagaattgcaatattacttatatatgtgatacgaaagtatatatagttgagaataaagacttttggatatgaattttataaatttaattttatgtaaaaaatagaaaggcaaaacaaaaagaaagaaacacattagccaatggctatctctcgatcggcatggatgatgggactgggcgattggatgtctcgcgctagaaagtgatccgcccctgcgcgccacaaggttgcctctttcggaaccagctgaccatacccttcccatagtttgactttttaagattttatcatagttaactagaaagtgtcttttcgctacggtgtattaaaactaaaaatattttatttttaaccgaagttactttcacactgctttggtacttttgctcgttagaaaaagtctcaaatgatagagagtaatatagtagctaataataaattattattcaatagtgcgttgcaacatgaaaaactaatgttattaacttagtaaagtaacagaaaaagaagcatccacgttatctcttatggtctagatttctcatattagttggagtaaaatataaaaaatgaggagaactcattgtagacaatgtgatgaggacacaaactagcttggatataaccatgattaacttatgtattaattaatcaaaggtgcatatgttctatattagatttacttgttatatatttgaacaagcgttgctacataatgtgtttcgtgtgttttcgtttgcagaggtacttgcttgggtgaaagaaaagagaccgagcgtaatgaatgcatggatgattaaagaagttgattggggaccaaaccaagattttctcaagtccacttccatctcaccacatcacttttggtccatagaagacaagagataaagttctacacgttttggattcggattcgggcctcctgacagcatcaacttcaaacggacctagtctctgatctagaaggaatttcggggccatgagtacttgttggaaatcttatggagtctactttcaaatggttttggttccacgtcaaaattcctaccgagctgtcggaaatctacaaaacaaagccacgtatcttatccagtttgaatctgatttgagttttgggtcttgtaattatgtcgtgggcttaacccaagggggtgtgcgccctagggcaaacctaggacgtccctaatcatatttattcagtagctgtcatcgtttagagttaggtttgcttagattaatctgtcaagaacagtttcgccgctagatcagtttgtggaaccccaaattcgaatgcttaatcattcatatgcaatttggttgcaatctatcttgcttttgcttgtgttcttcgattcgcatgcaggaattagccttctcggcgaggtcaaccgagttttggcacggttgataaccagaggagatgtgatgctgtgattgcggggctcagtagcgtgttcgttcaaaagccggatcgagttgtgtcacgactccgcccaaatcgactgtttatcaatacctatcggaacatcgggacctattccccatcacaatgactcattcattttgttttttttaaaaaaatcacgctatccaattggatatatgcataaaacaaatcttttgccaaaaaaaaaactaaactgaataaattaatctatctatataaataatacaacttaatataaagtataaattataaattaaataatattggatgaggagtctagaatattctccaaaagagcctagagtgcatataggaatataatttagaaaaagaattaaaattcaaaataaaaaaatattgaaagaagagtttagagtccatatagaaaactaattagaacaataaaaaataggaatattggaagaagaatagagtccatataaaattaaaaaataattaatattatttaattttagtctacatttaaattctatatcatgacaaataaatatttacatttttagtcgacaaataaatccatatcatgagaaaaatctatccaaaattttagtttattcaatttagttggaattaaattaataagcagtcataaacaattaaaatggtattaatgtccctcgcaaaaaaaatggtattaatgctatttctgataatagaaagatgcttaaaattactaagagagaaaacattgattttaattgcggctcatttagaggcccaacagtccggtggcccgatgcgggagaagacgcagccgtccgatcgaatggacggtccagattgatcccagccaagataaatatctgtagccaaaaccataaccctaaaattcattccaccctccgcgcccacgatcccttctctctctcttgatcgaaaagcgatggcggcggttccggcgcccgccctcctccctaccacgagcggctgcggcggtgcccttccccctctccccgcgagcggcggcggcggctccctccgacctgtctcgctttcctcgccggcggccgctccctttgtcctgtctcgcctcctcgctccctcctcctctcctcctcgcctccctcccgcggtggcgcgggttgacggcggtcgcgggcgaatccgagggtggtggcggcggctccctccatcccctctagccttcctcctgtggcagatccgccggcggcggcggcctccgcaggcggatcaagcggcggtggctccctccgccccctctcgccaagtcccgcggtcgatccgacggtggtggcggcgttggcggcgtccgcgggtggatccattaacagtggcggtgggcagatccggtagcggcggctccctccgccgcctctcttctccctccggcggcggtggtggtgtcggcggcggccgcggatggacccagtggcggtagcaacggccgagggcagcggtggcaacggccgagggccacggtggcgatggccgagggcggatccggtggcaggcgagtgaagtttgtggtgtatattgttgttcttcttggatgattattttgtgattttgtgatgattgtggttgattttttgggggcaaagattggttaggttttgttcttttccttgcggtgtgtgcatctgattcggttgtgccgattttggaaagtgtttccttatccaattcggattcgggggctgcgaaggcgcaccgccgacggacttgcgacgaacagaaaattacgaatattttaattagttaagattaagatttttattatttgcttttaaattgttaatgacacatgcataaggttttacttataaattatttttttccagcaaatttggaaacttcctccacgcaaagccgtagcgaaattctcacctcaagatggccctcaccgtcggccacctccagccgccactcgccggagccggagccaaaagcgtcgccattcccggcccactcatcccacgccgccacatcctccttgccgacgccgacgtactccatccccgccacccggtggccgaacctgacgcagtcgagcaccccgaagcggcgcgcgtaggcgccgaggtagtccatcacctggcggtggtccgggaacacctccgtcaccgtctccggccacgggaagtcggagtactggtacatgggccgcggagtctgcagcgcggtgccctccagcgtccacgcccacacgccacccacgccggtgtccgcctcgaacaccaccggccggcagccgcgctccagcagttgcttgcacgcggccaggccgctcacgccggcgccgacgatgaccacccgcttcttctccatgatggctagtgggctaggaaagtgcgagctgtgtgagttgtttggagtctgatgagcgaggtggtatttatagttggtcagtgctatacttcctcgaaatatatcttttgaccatgtcatctaatcataatatatataatggataaaaatatttttactgttttttaaaagttatatatatgtagtgttaatacctttaaactatattttaaaagttatcgatgatcaaagttacaaaagtttgatctcaactttatctaaaccatcaataattataaaaccagaggtatgtcattaactgtttaattatatattttttataatgatgcattatgcactaaattgtttatggaacatgaattgcttaatgtgctatttttttatatggcgttactgagtattaaataataatggcatgtttgttatatgtacttataaatcattcttattatttttaatttgttaaacttatcagtggtgctaatacgcatgctgcgcaccgaatgctagttcgagcgcgcacaacattccctccgtccggttttcccgttgttttaccacccaacctttccgccgcaatccacctttccttcgtccgttttttttctttttttcacccccaccttccgtgtttcttttttctcttttccatctcatctatgcttcattaaaagagctgataaaatattaaccatccatattttctcattttctcgttccttctctccagatttgttatgcttcattaaaagagctgataaaatattaaccatccatattttctcattttctcgttccttctctccagattttttatgtattcttattttagtaaaatatttaccatctagtttttctactgtctcttcaagtttcaaaagtaagaaatttatgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccactggaatttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcagcaacagctttggaaaatggatgaaagtgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggatcaattacccaattaaatctaacaatttactctactgagttttccatttattcccagtatcccacctctgcaccttcaaaagtaacaaatttactcacataaatgcccccttcaaaagtaacaaatttacttgcatgaatgcccccgcatcgttcggcactattcctagatggtcataaaaaaaatactaccagcttacaacgctagtaattcttttaccagtgttataaataagagagaatcccttatatgccactgagtataggccgggcatggctaacaactcagagagggcaaatatgtcttttttacttaagagttaacggtcaacacacggtcaaccgacgggagtggcatgagagagtgcgcaaattcggaccaattgcatataagggaagagccaattttcagtggcatataagggatcagacagattttcaatggcataaaagggattatctctataaatatttagactttatagtctgcacgtaaaataattaccaccttcctcttaatttagcctatggtctagtagccaccatgtagtaataatataggagtaaaaactgatagtaagagtattgttaatatgaataacaaaatgaacaaataagtaaaaaatttacaggctcaatcacacacgagtgataaaattactcacaggtgaatcaaactagaaaagaacaaaatggtctagcaaaaaaaaaccatcatgaagttggggtcctgatggctttgctagatcttgtgataaggatgtagaggttgatctgtgtcttatgacagatggtggagagggcaaccgggtggcgagcgacagtcagcgataaaatcatagaaggatgtagcggcgtggtatagagatgagcttggcgatgtgcattagcaaccatccatcatctagcaaacagaaaaaaaatatgcaaaaacattcttgtttatgtcatagagatgatgagcaaaagaaaaacatcctggttgccctctccaccacataccaacctccccatctttgttgcaagatccagcaaagctaccatgatctcagcttcacggtggattttttctagaccatttttatttttctaatttgattcatttgtgagtaattttatcactcgtgtgtgattgaacctgtaaatttttcattcctatgggcattgtgtagtagtatcgcgtcaataaagacaacaactcttaaaagcatgatagtgacgacaacagttaggctaaccgtacgctgcaatctggaaagccactgtagatagagcatgaaaatcgccaatccacgatgtagtaaaagttttactagcatcaataattacatctcataaacatgcatatgtcggatgagtacatgcagatggtccttttagaaaatacatatgttagcctaatcatgacttgtacatgttttgagtcttgcatatagggatcacgtcatgtgttagacgtgtcatgtggcaggagattgaacgtgaagtgttcacgttgattacgcagttagaaacgtactgcatacatgagccaagtagttagctagttagttagcacttagcacatacatgtgttgcttgtcttataggagaataagtcttcaagttgttggacaggaggccttttgacttagtacagggacgtatagctacgaactggaggccccagtgcgaaatgcatgatagaaccctaaaattttacgaattttacatgtaaattctcacggtcctgttatcgcgatcaatgtgatatgattcatagaacaacaggggagacaaaatgatggccaactatttctagttacaactattatgctcttctacttttagttttgtgtcatagtcctgaccttttgcaggcttaagcattctatttataccactaattaaatagacttagtgctccatgcaattaaaattaatttggggggccttgaatagtcgcacactcccgcacatgctaatgtacggccctgcttagtggctatgcatgtgtggatcgtgcggccgtgtgcgagagactcggccaccacgactttggccggcgtgtatgtcacgtcgatgcctgggtctttataagcattctgtaagtgttcgtttctgagcgaagagagagctacagagaaaaaggaaaggaattagttgccgagaaaaacttgtgtgcgcgctgcgcgcatgtgcacttctgtgtactccagtgagcagtggcagatgtgtatatcggtgtcctaccatactaattatacttaggcggctatagcattataatatattggataagaagtttaatcataggttttgctaaaagtcatcgttgtcgcctgacaccaacgctaatactgtagatccctccctgagtgagcttctctgtgagtgtgtttactgctctgtgagtgtgtgctgctcacgtgagtttgatccttggccaaagctatcaacataggtgccacaacttgtaaaacaagcggtaggacctacagaaagatagcactctccagtcccataatgctcaaaagcgtgtattcccattatgctcaatatttcagcataacttatcatgacaaattttcttgttacacctttttttttttgcacatttttgtgaaaagagaaaggataacttgctgaagatgatatatcttccatggcatagtatctacctccggtggcaggaacgaaaagaaaaattgaactccgcttaggcctaactgcaaattggtaagagatcgtacaaatttaggctttaagagttactcgttaccgattccaaatcctgcaatcaaagaaactatgattacaaaataaaattatgttcccttattcctattggttgaaaaataatgtttgacagatcaaaacaactcaaaaccaaaacatgcttcgtgacagtagatcaacctatcgacagtatcatgaaattaagtagatgcatcaaaaacgcttttttttccttaaaaaatgcatttttttaatgatttccacaggttgcacaacttttataatgccaagtgccaaaggaaattctgaaggagtctgtaactagttcattatgcagtccagcaggtgcgatgaggaaattctgaaggagtctgtgattagagttccagttaatttggttggcccggcaaaaaaggatttttgatatcccctaactaaaacaaacttacacatttgttcctgctaacttataaaaaaaattcctgtacacttccctctttactgagaaacacgaactgagctcctgttctgcggcgtggtggcaggaccgctaggggattggctccgggaaaccatagtatagaaaccatatacagatgcaggtcaggtaacgacagccaggagcaataatcatagtatagaaaccatacatatgcaggagtcatacgaacatcaataatcatcactgcacatttctaattgtgaagaacaagtgcaaaatatatggtcatatcaatcacacaggattttaattcttttccccactatatattgatgttaccacttttaatcatggcatacaacctggagtttaattcttggaagtagttgcgctgtgaaacagcttcaatgtcctctaattaaatgatccctgtttagctaacttaaacagtttactggagtacctagatttatgtcagactttatacatcctaactcccaagtaaatggaacttctaaggaaacatcaagtcttatgtcagactttatacattcatgtgacactcaaccaatacaggcttaatgattggtatcttatttgaaggttagagaaggaaaatgcaaatacgcttgcaaagagggtatttggactataataggattatttatttataggttgtttatctcctagacctttactctcctagatagttaatcccccagacctttggtctaatataactcattagcattgattgcaattcagctatatatatgagagatcacctccccacattgtgtgtgaggcatctattccacttcttctacatggtattcgagtttaggctcttaccttcgtagctagaaacaggctgactgttgcatctgtagctggatctttggatcagtcgccgacaccgtccttgacctcgccatggagcaggatcagaccgctcaagagctttgggtcgccatggaagacatgttccgagctaacaaagaacgctgagcaatcttcctcagcaccaatttcactccatgattcaaggcgactcctccattaccgattactgcagaagatgaagaccgctaccgacgcccttcgcgacatcgaccacgccgtctccaactcctaacttgtg

SEQ ID NO: 65446 - DNA, 5839 bp, Oryza sativa
  unsure (1)..(5839): unsure at all n locations
gtggcagcgcacgccagatcttctccaatggtgagggtggtggcgatgacttctctggtggccaagcccacgccggcggcaaccgcgagggcaacgacggctggactggcggcaagaacgaaagagggcacggccgctggactgggggtggtggaggtggcggcgcccgccatgggtagccaaccctagctggaggctgggccttgggtttgttttaggaataagttcatctaaggtcccttaacttgtcaatgaatccgattttcgtccttcaacaccaaaaccagatacaacaggtccctcaactatcaaaaccggtgcagattaggtcactcgtggtttcgatggcggttttggctgacgtggcgcctacgtggctaatttgactcggtctcgatctgacatggcattgacgtggcgcttacgtagcaattatacctcgaaaaataataaaaaccacgggcccacatgtcagcttaaaaaaatgctggggcccacgtgggccccacatgtcattccctctcccctctcggctctccctcttcttcctcactcccgccgcctacgagctccgacgacaacggcggccgaagcatgccggagcacgggcgcacgtacaaggacgccaccgagaaggctcgccgcttccgcgtgttgaaggcgccattttcctttcctattgatcacagtaagtggtcacgggaaaactgtgagaaaaattcctttttgatgtcgattccaggggaagacaatcaagcaacaaagagaaagacaagaacgggggttggatgaagaagaagcaaaacgagcctcctttccacacaagctcgcggtggctggccgccgtcctctccagctcgctccgccaccatccagccaagcgcgctcgtccaccatctgcggagggccggagctcatcagtgggttgccgccgccactgtttcaactaattttgcctgccttttgagattgggaaattagttcagcggtaaagaaataaaggggaaaacagatgggataaacacggtacacgtagatgataagtagataagtacggtacagaggggggccgcctctcctcgcccggccgctgcgcgccgcggaggagggctccctgncnncnnctgcgcgggnggcctcctcnctgcccccctcctcatggtcctcctcctccncctcccgaagtgacacggccgacgggtcaggctcccggcggaaggggtcgggcacctcgagggagaatgcgaggcgttcggcacggatgggtggctccggctacgtcggcgggagaagcgacaacgtcggcagcagcagcgaggcatcgggcatcgggcgctcggaagccatgggggatgggagcgagcagggctagtgggtcaccaccggaggcatggcggcggattgggcgagaggtcgccggttcggcgaggtcaatggaggaggacggtggcatgagcaccgacgcccaactcctcttcaccggcccccgcagtcgccagagccatgcctccgtcgcgagagaggagaggggagagagagttgatgagaggggatggggagagaggaagaagggggttgagaatgacatgtggggcccgcgtgggccccaccattttttattaatttctttgtaaaactgacatgtgggtcccacaaggtttattattatttttgattgaattgccacgtaaacgccacatcggtaccacgtcagatcgagaccgagtcaaattagccacataggcgccacatcaggcaaaaccgccatctaaaccgccgagggacctaatctgcaccggttttgatagttgaggtacctgttatatctggttttgcggttgaaggacgaaaatcggatttgttgacaagttaagggaccttagatgaacttattcctttgttttaacccttggctagccaagcaaccggcctagcgcccctcggctggtcttcttgggctggctccggtggcccactactcccaggcaaataccaccttcgctaggctatctatgtcacatacatcaactggctagcccaactgggagcaagctgacctcgttgcataaccagatggcattttttgcctatgttggatataatttggcttggagagtcatttgaccactctgttagagttgctcataaataatacaattttttaagaaaacacactttttacctttttagagttgtgaagtaaaataatccggtgaaatagcccaaaaaaggaacacatatgtatccctctaattaagaaaattgtcagatctcttgtcccatgggttcagatttagtcggctcgtgctattacaacttgaagtttattgtggtcatgattcattttgtattctagtattgcagattttctagtgccacggatcacagctggcgaactgtgagctcaacacaacttcatgaacaaagctatctttgagatattttctttcttgcgggaattttatctggtgccaacacagcgcatatgtatccatcatcaggtgtacctgggaatatcttgcatgaaccttgtggatctgtctgtatatgtactatgcattttcaacgctacaatcgggtaaccagtttcttattgtccaataataccgtgctgatatatactccgtatattttatctgccatgcatgtctaagcattgacggtgactttttttctgtgattatcatgggtccagctccaccgaaaccttgaaaccttgttcagttaatcccctaagaaacttgaaaagaattaagagaaaagacgtggacttaatcccctcgatcttgtccgatctctttcttgtgaggattaaccgaaaaatcctgaaacggtgaaaatctcctaacggtaggaagcaatgaagaaaaacgcaagcacccgcacaaaggcttcatttataggaaccataggtgactgagatttctaaaagtttttggaaatatagtcataattccaaatattttaatccataaatataatcataataaacatgacttgtgataaacatgacatgtgaaaaagagagtgattctaccatggtggtacacatgaatatgctaccagtaacaatagcatctaagaacacatttaacaccgagatgagaagaatatacctagagaacgctccgaatccggaggcgacagtgttgttggttttgtcgccgtgttgccattgtagttttctctcctctattgccgttgttcccttcgttgccggtgacgaagaggaagaatagcctgatgcagatgaaacaatgccgaaagcagtcacgtgaagaacgcactccgcaaaaacatgatcgcctacctacccttgcaggtacttgtaagatcgcacggcaagaattaaactaaccaaaatggaggtgaatgattgaagtatccaaatccaaaacttttagcgaaattaaaagttaccctattattgatggagatcgatctgaccggagtagatctgtcggtctgaccggtgtagttgttccggtctaaccgcctgatgtactgttgttgcttgtcgccaccaccggtctgaccgccatggagccgccgatctaaccgggtcgatgccatcggtctgaccgctgatatctcgccgattggaccaccgcacctgagaaaacacaaatcgaaaagtgggagctcaccgtggggcagcggccaagagggctcggtggtgaggaacggtgacggtgggctcctcggggtgtggacaacggcggcagctccacggcatctcgcgggtgcgaagcggcggacggccaccggatggaccttgacaggaagaagagggctccggctgtggatggtgaaggcgaagaggcggccgaggcgcggcacggcatggcaaagccgttggtgctggcagcacggccgggcgaggcttctctcgccagtggggaacggctagaggcggtgaaggaggcgacggcttgggtagcgcggtgaaggcttgctctttttattatgcccttggcttgctttgcactcgagatccactttgagccttgttctttttattatgcccaaactttgtgtgtctgtgtttgagttagggatttgagttcttgtgagtgcttggtgttgattgcgtgaagatttgttcaacacttgtttcttgcttaggatattcttgcttcatcttttactcttggaggtcgaggattcctaaacagcgaggtcattcttgagccaccgatctacgtgtggttggccaggagaagtttgttaaggttggtatcgattctctagatcagcaagtaaatttatagggtgcactagatcaaggagagatggtgacactgagtttatacaggttcaggccctcagaagagtagattggatctgtatagatgtatgcgcggtacggcgtatggagtagcacgtagtgtccaaggattacccgcgctagggtttccagctcctatatagacccggggaggctgactaaagtcagtaggatatcctttataatctgggtacatgtcgcctatttacatgagataagacttgtattcttatctttaatccccttgcgaaattacatcatgcggcatgggcctaaacctagtccgcccaccccatgctacacaacccaaacgcctaaccttcggtacctaggtaccgtgtaccccgtagttggatcttgcctccaaaagataagagaccactagtggaagaagtagtgctttgtgtaacctctcgaggaaagggactcggctctttgtgagatcctcaacgaagattagaatcccctcaaggattcgaacttcgggaacaactcatcttgcaagaacttctgtgacatccttttccctctcccttccactatctttgcttgcttgcttgtttgagcttgatgttcttggttgtgactagctagatccattttgctagtgagtttgtcgctgctatgctatttttggaaatatccgaagctccttcggatatatccgaaattccagcttccgcatttacttgagtttaatttagcctattaaccccacactataggcctaagtgaccctttcaacaaacacccatttgcttaaagaacatcagactccaactagcataaaaagcagtcaccaaattgtgacgcaaccacacaactggatcggcaaaattgagaatgtgggaaccaagatcagcctggatggtgaaggttactactagcatatcaggctgttagccatagccagtccaattgcagcctatggccagtcggatgcagaaccaggaaatctatgcattggttaaagaatagaagaactggggtaacagtaacacaatgattccaactaaagaacagaatattttatgggcaaaataaacatccttctgctgttggatcactgccgagttgtaaaaaaatacacccaactgaattttgctacttcataaattaattgtctactaaataaaaacataaaatcatatctgcagcaagtcacacaagtcggcgcagctccccagtgaggagtgcgaactgacggtgctgtgacaacacggatagtgttatcatgcctctctttttaaggtcacttacctcatcaagggaagaagggttctcctttgtttctttgagtactgcttgaaagatctgtagtgggtccccatgactgacaataagaattgcagagctgcatggaattgaacatacaagtcaactccacataatactccctaacacagtatatggaaatgtgtgttgaaaaaaatactaagcagcaactggatgtggaacaatggtgattatgtctaatttagttgttctattgtgccaggaatagtactcatgtctacgagagctatgggcacccctcctcaagcttgtaaa

SEQ ID NO: 65447 - DNA, 6423 bp, Oryza sativa
  unsure (1)..(6423): unsure at all n locations
tgtaatatagagcatctgttctaacatttgtacacacagcagaacaaaatcaacagatatcccaaatagtttatgtgcgtgccctgaggcatggtagtaaatttgatgtttattctaggaagaagaatgtattatatccataatcattactagtgggttactgggttgtcaaggcatttacagtttacaatgatctacggagtcaacgcttgttattacaatgagattttttttaatcacataagggcaaaactgtaagcatggttctctgcatacgtgggtcttcatatagaagggctacgcctagacccaattttagaagctgaaatgtccatataggtatggcgataacgcagcaaaaagcaaatatcaaacttgaaaaatagatatattccaaatttcaatatttgagttgaagtacccatgaagctccatttctgcagcagacaggaattgagagaatctagtagcaacatctgcaacgctctcgccaccatctggtgccattaagggatctacttcatctactgcccatacttctgcatactagcacatcatatcagacttagtaagttaaataaaagataagatcataagaatgtgaaaaagatgaacatgtgcttatgtggtgtggacgtgtgggattttggaaaagctaaaacctctgaaatagatatgcatgaccagtaatgcagttagggaccatattgccatttatttggaaagaaaaactccttctggagattaagatcttattatgattcattttagtgtccaacaaaaactgagctgaaaagaaggaaatggccttgtttttcttcttgttcattctgtaatcgtgaaaaagagatgaaacatctgtttcccgcatgtgaggatgaatagatttgtggtgggttgcaaccttgcgtgttgccactaacagtagacccactgatttgtggtagtctctgctggatgaatcattacttatcattataagaaatcatatgtaatttgcaatctaacataattccatagctacattattaaaaaccacatgcacaaatatcaaattgtacttaaaagatccagaagttccagaggtgctctgtgacggacccgaagccatgacgagataagataaccactgccgggaggatagctgggcggagtcggctgttagggacgaggggaattagactgggaagaagaacgtggggagagagattagactaattgatattagttgcttaatccaaatgatgatacaatccatccttatataaatggagggaaggacccanactaatcttatccaaccgactctaacccactgagctaccgtgtgtgtacgaggtgaggatgggatagcantttctcaaccggtaccttgggcctcgttctcatggcccaatgccaatgacatgctcgcaggtggcagattcactattaccaccattaggttcacttctttaataatagagattgatgttcatgtcaaacgtggtaaataaattatattcatctgaaaaggataattagacttttttgcaatgacaatgtaacaatgaacctctttctagtggtacagaccacagaggcaatcaatcctcgaatatccgtagaaaggctcagttaataacaacagattagagaactataatttgaaaattggcttggaagaagtcagccaccatttctttgcttacaacaagaatgatcttttcatcaattttaatagatgtaatttttttattcttttaatggaggatgtatttgttacataacatgtttttgcacaatttcttatagcttcatatgacaagctcggtctgtgaaaaccgctaaattttggagttagtttgaataagacaaacaaggagggcttgtttctaaaatcattcttttgggaaaaattgcttagagcttcatgaaagttccctaacttttgtcattagcttcaataagataaaagaacacaaagaaattcgagaatatcgggctttttcttgttctgctcagacaaacatgggaaagaaagtctgggcatttcttgttctgttcgttagaagatggcatttcgcaaaaattacagctaatataatgaggaaggaaaattattctgattcaaatgagttcctgtatttttttaaaaaaaaatcatgccagtgctattagttaaaataggtctcagtttgtaccaccaactgtaagtatgcttagttgtttatttatatatcgaattagagtctgcacagtttgatagatcagcaaaacacaccttctcatgtgaaagcaattcatgcgatggcccaaaatagcgttcccgaagttcaacagctggctgcaaagaaattattattaccttaagaaagcagaatagaaatgtaaaaggtgtttcaaaaggaaactccacactgcttttcacgtttgaatagctcaggaaacaaacatttggcaaagcaaaaaaattggacaatgttttggagttaatacatttcaaatttgtaaatcatacatttgaaggggatgattatagttattgaatggtagaagttagttggcatgcctctgttaggttcacaggtcttctctcctaccagattatttacaggtcttgctagctgtaaacttgttctaaagaatgacaagtttaaacagggtttactatgacttatgtaaacatgcccagggaaaaaaagggaaaacaaagaattgcataattgtttagagtgaattaaacaaaagactacatttgttcattttaacttttgcattaataagaactaagaagtgccagcgcatcacttaactccagcgaacagaagcaggtactcctgggaagtatcacattttaaatatcacacatggaaatatcagttgcatgtcttttttcatccttccatacaaaattgtctgcggcctggccctttttcaatctttatgcacgcaagttggacaataaatcagtaactaattataaaatcttactacacattcatgattatcatagataaaagaatccaaagcctatagggaaagttacaagttacaactcgaataaattccatgcgaaattacttgttcctaaacgttagaatatctatgctcacaaataactgcacaataaacagtgacagattttatatgcaggaccaaaccactcacaatgcagctgggagtatcaaaggggacaccaagcactctagcaacctctctggcagtctccatggtccgtgagaatggggaatatcggatctgaacagaatccagtggcacacccaattcctcaagctcctgcacgcaatcagtcccccaaaatcactatggcacatcctctccaagagctcatggagacacgactaatgcacaccaaatcggataccttacggagcgattcgccggccaagcgcgcctgctcgacgccctgcggcgccagcccaaactccggcttcgtgccgttctcctgcgaggattggagcagttagaaggaaagatccgaatcaaactaaactgctaactggacacgaagttcttggaggcaagaaattgaagaagggtgaagacagcgaggtgggatgcacggatcggtaccagggaggagacgatgatgccgcgctcgttggggacgctgcggccatggcggaggatccagtacctgttgcggaaggagggcgccggcgccggcggcgagctgctgccggagtcatccattcccccccaaatcaaagcacgtagtgacacccgctccaatcaaagagcggagtttagagccaaacgtttttcttttcttttttaatgttttcgctatgcaatggggatcaaattcctcattttccatagtactagctaattcttagctaattatgcgctaatgatctttctcgttttgcttgcgtacgaagatttcatcccaatcgaacaaatgaacacagcattaggcctagctcacctgtttggatgagtttaagattatgagaaacagctggcaaatagtcagcttctaagaatctggaatccagcttttagtttctagttcattttctggattctacaactacagcttttcataatctagataaaaactggactacaactacaactacaattatagtttctaattgtgggagaagctgcagaacccccaaacagcaccctattcctcaactccaaactttaactttgtcgttttccattagcacgctttttaatcatgtgcaacgaggtttcttgtaaaactcgttttacatgcaacaaaaatccatccccaaactggagatcgaatgtggttttttatgttgaaaaacacacccactgtttatcattcccaattgttctggataaagattttttatcaaataactaaaatgctcttaggatcgaataaatcaatactagctctcctgaacccttaggatgtgttgcacattccccttgccaaacctatgcagaaagctggtggtagtgagtccaacaacagcagcagcatccacatctgacgatgacgaatttttcgtctacaatagcgaccatattccacacaagcattcatgacccctagctgcatgacaacgatggtagcggtggcgattatattgcagtaaccgtggtgacttacactagcagcatatctccctcgttgtgcacttctccttacaccaaagccatgaggcatatgttagggttatgggtgaggtataccctctacccttcgatatgcgtcacatatcgatatggtatgcttgcgcgtatacggacgttttcggcataagttaaggaattacattatggagtccacagatgtaaggagtcctactcggatagaactgggtcgtcattgtatcatgtcgggtccgacgtctccgagtcctacttggagaccagttgacctgcggtataaaaggaaccccccgggaggaactaaggcatcgaatcttaccgccaacacatccaccacagcctacgaagccggagcttacaggaaccaagtcgccgggtgatctagtcgaatcaactcggctacgatctcgtcggtatcgtcgagttccattattccttttgtaatctgtggtttccatcatataatcccatatcaactggattagggctatgacctatcaaggggcctgaaccagtataatctttgttttctgcctgcttgatgtcgtattacgtagatcctcgtaccagcgtaccccaataccctctatatccggtctacgggtatcccccgtcgacagtggcgcgccaggtagggggacttggtgctcaaggttctactactatgacatctagcttcgtcgacaacagcgtcaacaccaacctcaaccaaggagttcctacttcaacaacactggtgtggactcaagtcggtgaaatcgtctttccggtttacaccacagtgctgatctcagctggtccgccaatggccgaaaatgagaacgcagtggctacaacccgggacgactccatgtcgaaggatcctcccgccgaagcagagatcggaacgtcgacgacatccgagcccgagaaggatcctagtgcggccaagccttgtctttccgacaggaatcacgagccgacgaggattacttccgaggtgacaaggtcctggtgtcctatccacaaaaccagaaaacacaccttgcaagcctgctgggtttttctcaacgtctatgctgaaattcgtgcatgcaaagagtgtggaattcagcgtacctctccaactcgtgatgtctattgtcctattcacaagacaaagaatcacgacctctcgagctgcaaggtctttctcagcgccatgaagatgccacctcctaaggtccagcagtcacgcatccccctcagggatgaggacaaggaacaaggagcgacgccgatttcagatcgatttgttggggtaatcgacatcgatccccacgaaccatcagtcttgcacctgctcgaagactatggttcatcgacaacgagtatgccgcgtgaggtattggctattgacgatgtcggcacgtcagcacgcaccaattcggaagcggagaatcaagtgactacaccggcccagcatatcagagccgtcaacgaaatattgagggaaactccctacgaccccgttctgaacaacgatctcgcacgatggacagaacggttacgggagtcagtgaccaacctcagcaacgcgttcgaagaggccgctgctgcagcacacccggaacagccaccaactggcgatgctaatggtgaaaatcctgaacaccgggaatcgcctcatcgagccacccctccacctcgcggcaccggtgatctccgcgatcacctgaatggccgccgagaggtgcgacgcacacgagacaacgagaaccattctcgacatcgcgtctcttcacggcgtcacgataacgaagatcgaggaggccgttcgagcgaagaccgaggccatgataa

SEQ ID NO: 65448 - DNA, 8360 bp, Oryza sativa
  unsure (1)..(8360): unsure at all n locations
ctgcagcccattgaaaggctctgcacgttcatggctgatgcatctcccccctactcgatttcttcgtgggcagacctgtggcagcaattcgtcaccaacttccaaggaacttacaagcgccacgcgatcgaagacgacctacatgcgttgacatagaacccgggtgaatccttgagggattatgttcgacactttaatgagtgcagaaatacaatccccgaaatcaccgacgcttctgtaattcgcgctttcaagtccggtgtcagagattgctatactactcaggagttggcaatgaggcacgtcacgactacttggagattattcgaaattgtcgatcgatgcgctcatgctgacgacgcactgagacgcaagaacgacaaaccgaagaccagaggagagaagaaaccagccaaggacgcacctgagtcaagtaagaagaaaaatcgcaagagtgggaaaaggaaggctcaagcggaagttctcgcaacagaatacgtggaccctcccaagcgcccagacccacaaggcagcgacgcgaagaaaatatggtgccctatacacaagtcagatagacactctctagaagattgcctcgtcttcaaaaagtcgctcgcaaaacacatggcattggaaaaaggcaagcgagtacgtgtggtcgagaaggacgctgaggcggttactcaggaatcagactcagcatatccagactccgatcagcatatccagactccgatctccatgtttcgcacatcttcggaggttccacggcatactcctcaaagcgagaatacaagaaggtggaacgtgaagtctgttcgatgtggcaggaggctgcgcccaagatgaagtggtccgaacagaagatagtattctcagaagaggaccaccccaagactgctatcatcccagggcgatatctgatcgtggtagaacccactattcggaatatcaaggtcgcacgagttctgatcgacggcggcagctcaatcaaccttctcttcgccagtgccttggacgcgatggggatcccacgaagcaagttgacacccaccgatcaacccttccatggaatcactcctcagtcatcgtccaaaccattgggcaaaattacgttgcctgtgactttcggccaagcaaataacttccgaacggaacagatcacctttgatgtcgctgaattcgatacagcatacaatgccatcattgggagaattgcacttgcgaagttcatggccgcatctcactacacgtatcaagtgctcaagatgccaggaccgaagggaacaatcactattctagggaatactaagctggcaatacaatgcgacaagcggagccttgacatggtcgagcacacgcccagcccacccgccacagctgagccacccaagaaagtgagcaaaacaaacaagacgccgaaaccggacggcgcaatcaagatcgttccactctccagtgccaaccccgacaagaccgtcaagatcggggcatcactaggcgagaaataggaactcgcgcttatcaccttcctccgcgacaaatgctgacgtgttcgcttggcagccgtccgacatgccgggggtacccagggaggtgattgagcacaaactcatggtgcgacccgatgccaagccagtaaagcaaaaactgcggagatttgcaccagatcgaaaacaagccatacaagaagaacttgacaaacttctcaaagccggttttatcagagaggtactccatccagagtggctagccaacccagtcatggtgtggaaggccaatgggaaatggataatgtgtgtcgatttcatcgacctcaacaaggcgtgtcccaaggatcacttccctcttcctcaaatagaccaactggtggactcaacagccggtttgtgagttgttgagctttctcgacgcttactccggttaccaccaaatcagcatggcgaaagaggacgacgagaagacagcattcatcacgccgttcggggtattctgctacgttaagatgccgttcggactaataaccgcaggaaacactttccagcgcacggtccaaggtgcacttagcgaccagctcgaaaacaatgtcgaagcctacgtcgatgacattgttgtcaagaccaagacaagcgactcattgattgacgatctgcgggaaacgttcgacaacctccgacaatatcgcctcatgctcaatccagagaagtgcacgttcggagtaccatcgggcaagctactcggcttcctcgtctctggcagaggaatagaagcaaatcccgggaagatcaaggcaatcgagaacatgaagtcgcctacaagactcaaggaagtacagaagctaatcggatgcatggcggcactaagcaggttcgtcgctaggatgggagaccgaggacaacctttcttcgctctgctgaaaaagcaagacaaatttgtatggacacaggaagccgaagaggcattcattgcactcaagcgctacctatcaaatccacctgtacttgttgccccccaacctaatgcagaattatttctctatattaccgccacgccatattccgttagcactgtcattgttgtcgagagagagaaggtgcaacgaccagtctactacgtcagcgaagctctccacgacgcaaagacaagatatccacagatccaaaaactgctctacgcggtaatcatgacatcaagaaagctacgccactacttccaagcccacagggtcacggtcgtatcctccttccctcttggtgaagtagtgagaaacaaagacgttgtcggccgcattgcaaaatgggtagtcgagctaagccagtttgannnnnnnnnnnnnnnnnnnnnnnnnnncaagtcccagctgtacttgccgacttcgtagccgattggcatatgcctgataacaggtcagataaccaaatccacaacgaaacgtggacaatggcgttcgacggcgcactcaatagccaaggagcaggggcaggattcatcttgacatcaccttcgagagatcaattcaagcatgcaattcacctcaacttcagggcgaccaataacacagccgagtacgaaggactactcgccgggataagagctacagctgcactcggagttaggcgactaattgtgaaaggggattccgaactagtcgcgaaccaggtgcataaagattacaagtgctctagccccgagttatccaagtatctcgcggaagtcaggaagctagaaaaaaggttcgatgggatcgaggtccgacatgtataccgtaaagacaacatcgaaccggatgatctagcacaacgtgcgtccagacgagagccacttgaacctgacacctttttggacatcctgacaaggccatcagtgaaagaggcaagcggcgaaggtagcccggtcgcccccaacatcagctcggggttacagaggcagaacacgccgttgccgatatcgagaccacagacgactggcgcaccccactcattaaattcataggcagtgaagagttgcccgaggacgacgcagaagccaagaaaatatcccgtaaagcaaaagtctactgtatgatcggcaacgatctatacaagaaggcaccaaacggggtactcctaaaatgcgtcttctccgacgacggcagacatctcctcctccacatatatgaagggatctgtgggtcacatgcagccgatcggacattagtcggaaaagcttttcgacaagggttcttctggccatccgccctcaaagacgcctgggacatggttcagcggtgtgaagcctatcaattccacagtaaacacacaaggctatcaccgcaagcactccagactatccctctcacttggccgttctcgtgctgggggctagatatactcgggccattcccacgaggacagggcggctacaggttcctattcgtggcgatcgacaaattcactaagcggattgaagcgacacccacgggggaaatcaaggccgacaatgccatcaaattcatcaaagggatattctgcagattcggattgccgcaccgtatcataacggacaacggctcccagttcatcagtgccgatttccaggattactgcattaggctgggagtcaagatctgcttcgcctcggtttctcaccctcagagcaatggacaagtcgagagggcaaacggcatagtactacaaggaatcaagacccgcgtctacgacaggctcatgtcacatgacaagaagtgggtcgaggaacttccatcagtactatgggtcgtgcgtaccacaccgacaacgtccaacaagtagacacccttcttccttatgtacggctcagaggccatgctccccaccgagctacgacatcacagtacacgagtacagaagtattccaatgaggatcaggaggagcagcgacacgacgatgtaaatctactcgaggaacatcgtgaatgaattgctgttcgagcagccagctaccaaaagggccttcgccgttaccacgagaaaagcatccgagcacgcacgctttcgatcggcgactacgtcctccgatgggttcaaagccaagcagggcgaaacaagctctcacccaaatgggaaggaccgtacacgatcacacaagttctgcggctaggtgcattcaaaattgcagacggcgatggtcgcgagttggcaaattcctggaacattgatcaattacgtaaattctatgtataagtcaatagtatccatacttgtaagacatcttacagcttcaataaagcctatttttcaggtccagaccacaatcaaagtgttccttcccgatgatcccttacccaaatgacacctagcgttgaaacctatcctcatgtccctttacgccgtcttgacaaggcctccgaggaacctaagggaacttcggctggggacgcccagagccgataaggccttgtcggatcctgttgagacgaaagaccatgtaagatctggtcgtgtaagagttctcgccgtgcgtattaaccaagccgtgtaaccggaaataaattttccaacttcacggctgggggctaggatcagtgctggttcaaccgaggcaggtcaaaggtccaaaagtcttatctcccgagaagaattctccgatgacaaggctgggggctagggagagtgtataacacaaacgactaattgaagtcgcgaagtgagaagacactcatacacgctaaatccagagtaagaaagcttagttagatagatttcttctctatttcacaagtacttcttacatttccatcaaaatccaaaattatattacactttttccctaagacatttgtcacaggacacggagactaccaggaaggccaacgccagtgattgactggaagaccttctccgccagcagcgccatcgacttcgctagaccatctatctccgtaggagttctccgagaacgagaaaacccttcgcggaggaactcgaggtgcagctgcggacgatgatctcgtatgcaagccaacacatgccccccggcatatcggcttgaccgacgacactcctgcttcaaggcttcgtcgatacgttgaccgatgccttcgagctgggtgcaggcgccattcagccacgagatatatccggccgccgattcctcaggatccccacggggtactcggaggtctctacagactctggacatggacgtgcagcaactctttagatatgagttgaaccacacctcacgaccccggagtgtctctacggcctgatccttcttcacttccagcatagtcctctcgagttccgcgacctcaaacttcatcctccaatactggatgcaacgatcctggtctgcgcagcatggaaacgattaagtcaagctgctcttctctcccgagaatacaacaaatcaagtcgacccagatggaagcgtaaaggaaatgataacaaagacaaccaacctaagggagtcgctgccatgctcgtttccacaggtgaattttgagctacatcgccctccggcgcatgcggctcgaacgcaagtaacggaacgaccactggcaactcaggctgcccgtgctgctggacatcctcgacatcaacatctctacaaacgacaacaaagtactcaagatcaaaatgctaaagaaagctaaggcgataactgcacacacaaaggcggttggaaccaataagagttttacaaagcatggctaaagagtacaagagagctaagatcctacgcttcaatagcgggaggacggactccccaggtcgccgacctcctccatcacatccttgctcgcatcgctagccgccccctgatccaagatcttccgcagatcgagttcaggatgtgccagcctcacacacgcaaggacatggcacaccccggtatagatcccgttgaacgtctcctctccgaccctggccgcgtgcttggaggggatcgcctccatcgccgttgccagttccgcaagcgaagacgtcaacgagaactcgtcgggattcgccgggatggtggccttgacgccacactccccggcgagctggtgcaggccggtgtaggtgacccacagtgagccacagatctccgacaagtggttctcaagctccgacatacggtgctcgagcccttgccgttgtcgctcattgccagccaccagctcccgcatcttctggaggtcctcgcgaacctccgctaaatcgcgcgccagccgatcggcgcgctcattcgccgacgatgccgccttcgcctccgcgatctcgcggccaataccgtgagcaccagcctcgaggaggcgccccatctcgacctggagctcctcccaggtgagaacggcagccagcagaccccgaccagccgcaagatcaatagctgggccgctaggtgtcgcctcgcggctcctgggcgcgaccacgacatccgtcgaggccatggcgtgtgacgcgctggaggtccctccagacccgtcttgcgccgccttcgcccgcgccgccctgcaaaaagccgcaactgaaacaggctacaaaaatttgatgaagagacaagacctcaaagtcatccacttacttctcgccaagcgtcattagccgctgccgtcgtggaggcgggggagacgcgtccgaggcctggagtacaaccgatatgatgtgaggtggaagttttccgactacacgatcaaagggcaggagaacttaccgagggggtgggcgtcttccgacggtgtccgaccacagaggagaatctcctcctctttttcggaacattgccgccactcgttgtggcagcggcagcggcagcgtcagacgcctccttggcgactttctccctcagcgacgccgccacctgatggtccacaagtggcccgatgatatcagtcagagggagagcctacgcttcatgaagtcataatgcgatcccggaagaaaaatgcaaaaggaccgctgagcacacttacattgatggtagcgtcgcgctcggctgcccctttctcgcaaggggggacggggacgttgctcgccgttgtcgggccactgatcatcagttagccgacgcggcgctccacggtggcgctgtccaagcctgtagatcgagaccagaatccgataagccgggaacaacacgcgcataagggagtcaatttaactaaaaaggaaaataccccgaggacaaacccgggtcgcgtcctctggctcagaataatcaaaggctggatgggctcgagcctgaagtggctggatccgcctaccgatgaagtcggcagcgacttcataccccgacaacccccgttctcggaggtcgtcaacgatatcgatgaaagattggagggatagggtcaaggcgggtttggtggcccaagtggaatcttgtctggttgctcctcaggaacaacgaagaccggatccgaatcctctatctgaagatagaaccacctcccccgccatttgctgcgagatgaggggaactggaaggggatgtgtcgcgacttcaggccatcccgaagtcggaaaccaacacacccggacacctttttaggttccatccagcgtaactcatagtaaaagaggaagaggtcaagaaacggctctaccccaatgtaggctccatccttcccgctttagtcgtatcacgcgacacgcctcacagccgttcgatcatgcctgtcgtcctgacgtacatccgcgtggtcgcgctctaatggctcaatgagaaggatcaacgtagtgcctgctgccttttttttaatagatatgtatgtctttttcctcttcaaataaagttttctctcaaattacttatccgatctataatccgattataccattatgttcattacaattaaatcttcacaacaagatcttacatgattatattatgatgaaaaaatatttatattt

SEQ ID NO: 65449 - DNA, 3293 bp, Oryza sativa
tgtactcaataatatataatctgtagtatatggtaaaaagcaagcatcatctggtcaaagaagaagcatcatttgctgcccatcatctgcccaaaatggaacatgggctgggctggcaggcccaaaattatattttctcagggaggcagcccatgaacgaaaactgctcgttttccaccctgatcggacgattaattgcgactaatcatcgattaatcggacgatcagctctctgatcgtctgatcgacttacctgtgcctgatcggaggtaggggagcgatcaggacaattaatcgcgattaatcggatgaacaaataacaatggttatattgcaagccttctttatcttccaaaataggtcactatctaagcatacattatgcggtatggcctatacgactcattcaatcttaattatcctgatttaaggcctgtaaggtggactttctttctatatggtatctcagtaacatataagtaacaatacattatactacacaaatttacatgtatccatgttgggagcgatgattgcataagttgtcattcttactacaatcagactaagaataattgaattgtgtctgaggctagcaaattattctaatataattgaatcctaagccacagatagaacaatagaaccagcaaagtacgaaaacaatagtcaccttttcgcaggcaactgtgcgccgtggcacaaagtaaagaaagaattccctctgaagccctttaggctcatcgttcttaatctggcttgcaattaatttcatgaacttcagctcagagcgtacgagatataggatcttagcgcactcagtttggaggggttcagcagagagaagccgcaactctgcaccatattcctgacaagcacaaaaaaccatgcatgagctgtgtgcatgtccaaaaatctatatatgttaactgcaacagtcgcttaattgtccatacatgaaatgcagtgtaagcatactattgatacaatgctaaattttacagaagctactaagttattatttaagatgaaaacagttgactgttaacatatacatactgtatgatcagctcatcgcacctttagtagaccatatatgttaactgtgagagtagcttaattgtccatacatgaaatgcaatgtaagcatactattgatacaatgctaaatttcacagaagctgctaagtcatttaagatgaaaacaattgactgttaacatttccatactgtatgatcagctcatcgcacctttagcagtgaggtctgcagaatcagagacagggtacccgcgagcttgggatcaataactacacacttcttccccctaatctgatacacaggaaaagaatacaaacttttcagtttccaccgtcaataacacgagtatgaaaaattgaaaatgggatgttgagaaacgcacactcttgaggatgtttagcaggtccttctgcgactgctccctgcatgccaccagtcgaagcacatcaaacatacatgttgaaattcacagtcgaagcacatcaaacatacaggttaaaattcacaggaacaaacacaagggtaagcagatgagtggggatcatcacgagatacctgagggccgcgagattgagaggagcattgtcgagattggggatctgagccatagtcccccaatccaactcctcgttctcagattcagaatcctgcttacttcagagccgggccaaacctgcggcatgcggtttcagctaagggttaaggcgaagagaaaaggtgcggggtagagaggggatggaagagaggatgctgcgtacgggtgctcaccggcgacgaggatgcgggcggaagcagcaggtcggcggcgcccgctgctgcccccgggacggagatcggcgctgggcggcgccggcggggaacgagctggcgcggagagacgggggagtcgaggccgaggggaaggaaagggggagagagaacgagtctactagagaagagagaacgctgggctgtccagcgccgggtgctttctatagcccagtgcgtgatcacagtctgaatccattacaggccgaaataagtctatttggagtccctccttttccttctcatgattgaatgcgcctccccatctttgaaacccggtgtaaatcaactccttcaataatttgggaagcggtttctgctgacgtgataagttggctgtggttgactcactgattcaataggacccacatgtcagccaatcagcgaacatcatctctctctatatattcccctcctctcttttccatctcaccccgaggccggtagcacaaatcattctgaaaagaccacgagcaatcgatgttacatgcctcgccagtagtgacatggtcgtggatcccttggatgcgtgcggtaagcttgcagtgcacgtgtgcacagtctcacggtacaggacatcgtccatagttgccacctacgaccgggaagctttccgtaccggagcatgatgtcgtagagtagctttagatggtcaagggcacatagacatagcgctagagctatcgtcgcggatggagtctgcactagagcttcgggcttgcgtgctcctcatgctgcagctttaccaggatgtggtggtaatgctccatgattacatccccaagttgtgcctagacgtgctccggcgacctcggcacagtatcctgtaccaaactcctctcacttgaccaccatcacttcgacacggctaaaccaggcaccactgcttctcgctcaatcagcctcatcaacatttcacaactcaagcgctgcattctcgccagcctatccaagaatgccaacacgaacacctaatgaaggtataatcctgaccattactatctagattcatttacattcattttattcttgatgtggaaatcaccaatgtgcttgcttgcttgcttcctcctcaggctgatcgaggacgccatggtgcttctccatacttttagggattgggtgccaagggacaccacaagcttaccgcgcaagccaaggggcctccacggccatgttgtagccagcgaggtgtgtaacatcgattacttgtggtctctttggcacaatttgtgccgctagcctcagggagagatagaaaagagagtagaaaggaataaaggagagtcactactgtaggatcgaatcacaacaactaagccaaccagaggggggtgaatggttggtatcatagtagaaaaacccggaccggtcatcgaaccgcttggacccttggttcatcggttcaccggttggaccgctgggtcaaccggtctaatgctgaa

SEQ ID NO: 65450 - DNA, 1292 bp, Oryza sativa
atacccattcccacccattcaaattcgaatttttagcggaaataaaagttaccctcaaattcaacgaatcgcggtctgaccgaaggtgtgcgccggtctaaccgaaagtgttgcgccggtctgaccgcctaatgaacgtcggtctgaccgatgaagattgactggtcgaaccgctgagattgcatgccactccctgtcgccgtggccggtctgaccgccgtgtgcccgccggtctgaccgaccgccgaaacctggtgaaacaccaatcgaataactcttaaagtggatgacaactttattgattatctctgtgtttacaaagtgcaccaacagcactccttacaaaaaatttcgactaaactcgaaaccctaactcaactctcaactccattgctctcaaaagtgataccgggaagcctcacgcttcccctctatttatacccgaggtaggcagcctaaagtcctaaacaccttaggaaaccctctagtataagaaacaaactttacataactaatcataccaaatttggactctttccaaattcgactccgcattccatacgcacacaatacctccatcgtatgccatatggaatcttcaccaaccacgtgcatcaactctagcctaagtatctcgcatgatctctgaccaccacgaacgtcgtcttatccccaagccgactcccggtccatcaccgtaaatactctcccgaggtatcgagtcacctacacatgaaataaacaaagaaaccatattccgagaccaagctatctccaacttgactcattgttagtaaacaacagtattgcatacgcatagtatccatctagaagccataatcatgaaactatcacggatatccaaacaaaaaacccgaaaccgaaaccgacacagagtcggcccgtcagaccgcgggctgcgctagtctgaccgcgcgatatacgccggtctgaccggtcccaacagacagcagtacctgtagatcacctgtaaaatccaatcatctccaaaaccacttcgcaaataaatttcaaataacaaaaccaataatctcctatgataattgttcatcacagaataataatcaaaaacacctttgattttacaatctcccctttgatgaacacattggcaaacccataaaaaatattttggtgtttggaaaaataaaaacaaaagtggtaaaaagcacacttcgtacaaacgtacacatcgtgctcgaaaatccaaagaaatttctctccttttgaaaaggaagaaatcccaatcgattcaaaacacatgcaaaaca

SEQ ID NO: 65451 - DNA, 1161 bp, Oryza sativa
catagattcggtattcctcaaacgttaaagaagcttcttttatgtccaaagaagtgagaagttttgccgaatcttatgatattaagttgttgagttcttctctttactacgctcaggctaatggataagccgagtcgagtaataaaacattgttgaaattgccgttttgccagttgaggtaaatcttggctctcttcggtatttcaagcaaggcgacttgtcggttaaagattacaagaccttgatgggaagtaatttttgaagatgtcatcgacgagcgtttgaagactttgagggagatgaagacacttcgagatggtgttttcagagatcaattaatgggaaatacttgaagaaatacttcccgagtatttggcaagatgcttaggaagtcttatggccggtaattggattatcgccctgagataacatgttctatgcttttaggttcacgtctgttcaccaaaaaggcaggggggcatgtgtttacacccaaatttagcacctatggacgaaataggggaaaattgccaaagtttggaaagtgacgggtttccttactcgggaaggcaggtttcgtgtttcctttggtttctatcccgagttggatgtggagaagggcctgtagagggcaagaccaacccctatttaagggacaaggccggttcattgtaaaaccccccaatacaatctacttgaatcgttcttttactatgttttctattttaccctagtttagtccatctttgtcggtttgcgccgtaaaccgtccgccgccgctgcgagagtgcgacacctctttgtaggtttgtcctgaaaaccttccgttttgcccacgagacgggtagttatcctcatatcgatctaaatcggcctagaaactgattttgatatctaaatcggctccgctagccggtttagcttttctttttgcaaaacccatcttgatttggccctttggctagatcgaggtggttggcgactccatatcaccgcaaggtgtttaggtgttgcgatcgtgcttgtcgacttatcaaaaaaattatcaacacgtatatgagcacttctaaacacccgacgtactatgtaaaaattacatggaaaactccacgcaacacgggttaaccgactacgactcaatttaaccgaaaagaatattac

SEQ ID NO: 65452 - DNA, 2129 bp, Oryza sativa
tgtgttcatccaaagacttgctgtaaatcaatatgtcatcaaagtacactaccacaaatcgtccgataaaaggccttacaacctcattcattaagcgcatgaaagtactaggtgcattagtcaaaccaaaaggcattactaaccactcatacaaaccaaatttagttttaaaagctgttttccattcatctccaagtttcattctaatttggtgatagccactacgcaagtcaatctttgtgaaaattatagagccacacaactcatcaagcatgtcatctaacctaggaataggatgacgatatcggatagtaatattattaatggctctacaatctacacacattcgccaagaaccatctttcttaggaaccaaaattacaggaactgcatagggactaaggctttgacgtacatacccgcggtccaaaaggtcttcaacttgctgctgaatttccttagtctcatctgggttggttcgataagcagcacggtttggcaatgatgctcctggaatcaaatcaatttgatgctctatccctctcataggcggaatcctgggggtatctcagctggaaagacatcctcatacttctgcaaaaggttagtaacaacaggaggtatcgaactagcaatatcatctaaagaaaccaaggcttgtttgcatatcaagaaatagcacatatcatcatctgacatttcagcaatgtcacatttagttgcaagcataacaccacccttcaacttaattccctcaaccttagaactaggtgaaatcttatcctttttaggtggaaaaacagatttagccacttgctgattttcagattcatcaagtttcaaactagcagctcgctctttatcagcttctacaatttcagcaggggtcaaaggtagcaaagtaattttcttcccattatgcacaaaggtgtatttattactcctaccatggtgtgtagcatcattatcatgttccaaggacggcccagcaaaagtgaacaagcttgcataggatccacatcacaatcaacagaatctgcatattagccaatggaaaacgaaaccctacaaaccagtgttacctttgctcttccggaatcgtttaaccactgaatatggtaagggtgtggatgtgtaagtgtagtcaagccaagcttctcgaccaaatcagaactcaccaagtgtgttgcagctacctccatcaatgatcacacgtgcacgacggttgttgatgacgaaaaaaatctgaaacaaattatggcgttgcaacctgtcatgctgctgtacctgcatgctgagcacccactgcacaatgttggtcctgtagtccgttgtgtcatcacgaccaaagacttcgccatcctcatcctcaacttcttcttccccctcttcctcttccatgtcggaggtggtgatgtagccatcttctgtagcaacataggcccgttgactagggcaatctttctgcacatgcccaaacccttggcaacggtggcactgaatgcgtcccgtcgaggcgacagatgaggcactcttggcgggtacctgcgtggaacctttacctgactctgctggtcgtggtggtggagatggttttggtgccgcagaagctccggatgcagctggtcgcttgcccgctggctgggaggacacccgaaaagagacggccttgggcagtgccgcagatggcgtcgtgcgcggagtgtatgtgcttgccttgctcttgccctgatggtcgcgcccctgtaattccttctctgcaagcatagcaaaccgaaacaactgttgacagagttaaattccttataatcaacaatgttctgaatttcctccctcaaaccagaataaaaacgacaaatagcatcctcgaccccctccactatgccacagcgtctcacacccttttgtagctcaccatagtaatcctgtacagatttatccccttgttccaaacgcatcagtttcttgcgcaaatctctatgataagatggaggaacaaacctattgcgcatagctaccttaagttcttcccaagtagtaggtagtaccccctcagcagttaacccaacccaccacataatagcaaatccttgaactcactactggcttgtctaactctatgttgctcg

SEQ ID NO: 65453 - DNA, 2648 bp, Oryza sativa
acccgatcagttagcgtggatatccgcttgtccaacctctccatgtggttcaggaagccgattttagtgaaggcatcttggacagactttgcaacggcctccgtgatgtccttttgagtattttgttggagagttcgtagttgctcttggctgacacagtcagcaaaatcctagggactcttctcaccttcgttacctgacattgaaacaccaaaacagaaacaaaacggtgaaggttatccctaataatccactacgcaggtgtagtggtgcctttcaacgattctcagcaatatggagttcctaaccaagctcttataaggttcttaccagcaaagcaaaggatacctggaaggcgtagtcagtgattgcagggatcaagaacctgtgctgtccagaagtaataagtggagctaggaaggccaaatatacgaatatgagtggtacacaatccaatgacagatagtaatgctgaataaaaatcccaagtcacttgcccttagttactggactactcgtgtcctagacagtagtgataacaaagatggctcaaagaatatgacactagtaaacagcaaagaaggactggcaggcaagcttcggcgagtttcagcaaaaagtacaaaaccgaactggcagataagctcaatggagcgcgtcgtgagctcaatgcactagtggaaatcaacttttcttttttttcttttattttttttgatatttttttcttttttcagaacacgaaaataggcacacctccaagttacagctcaatcggagtagatatgtggcctatggatttttctgaaacctctataaacaaggtgcaggaacttgtgagctcgaacagacaattttgcaagccaaatttcgaaattttggattcgccaatccgccaaaggcggggagaaacagatgtaaattttttttctcttatccgaaaagttaaagtttgcctgattccaagtccgtatgcaaaagttatggctgtttgaagtttcggcttccgactaggttttccagaggggatataacctagtctattatgcggtggaattggaatgtggtggcagcggagttgtagggtgttttggtgatgcatggtgatctggatgggtgtttatgatggtggaaacggctctcaaaggatgaaccctaacacacggtgaaaggtggcggctagggttacaaaggacaaacacatgactagactaaaacacgcactagaccagcaacaggaacttaaactaggactcaaactcaacactacggactctgaaaaagaatcatgtaaaggctaaacacggtctaggttaaggtaactaacaactaaaattttttttggcttttctgtagactctaggttaaggaaactgagcgaacatgacggtgaaccaagagctctgataccacttgatgtgcactagggttcccgatcttccgaaaggttctaataaacaacgatttgggcggagtcgcgacacaaatcgatccggcttcttgaacgcgcacgctcttgagccccgcaatcgcagcactatgtctcctctggttatcacccgtgtccaaacgcggatgacctcgccaagaaggccaatccttgtttgccaatcgaagaacaataacaagaacgagatagaaaaacaaccaaaattgcagatgaatgattaagctcacgagttggggtcttacaaaccgatctagcggccaaactgttctcgacagattaatctaagcaaaacccaaaaagctaaagatggcagcgggtactgataaatagagtttagggtcgtgcaaacccctctcgacgcaaccctaatgggttccaacacgatacacgggccaaaggcccaaatacggtgacgcaacaccgggacagattttggccgtcaacttgttcggtcaattcccattggaaaggttatcttcttagctttccatctgtataaagaacgccccaatctgagcacgtatgcgacctgggcgcccgttttagtgtagactggtcctggactccgaattgcacccgacgttgacttggtttgggcctccaccttgacttggacgtccccgatggtcctccatgggtctaagtccttctccaagtgtctccttgtcccctccattgttcctaatcacaatataatcattaggtagcaatctattctcgaattcatacaaagaagaacataggaacgagctcacctctaaatttaattgtcgcgcacgagctcttgttatcggtccttgaatgaccgttggaggattgttgtgtgtatccgagatagtgatgtccgcatcatggttgcccttatgaaagggacatttacatgggtacataatgtaataaggactcatgggcccctgatgggccatcgggcgatcgtcggccttacggtccctggggttgatgggacggaaaggcttcttcggccctcgcgggggcgaacttgctgtggcgaagtcatcttcctccggtatatactcttcgccctgcacccttcgcccaagaggcctctggcttgacaggtactcgcacgatctctcgcccctcgccgttcatgttccatagtcttcgccatggggggacttcgccccgtctaacgtcgatgtctcgggctcgaatctccactattcacatggtttcg

SEQ ID NO: 65454 - DNA, 2520 bp, Oryza sativa
caataccccctaactatgcctacctgatatatcaagaaaccacccctaattgccgagttccttatgacaacccgttatgaccatccaacccgtaatgaataccgagaaatacccacaccaaaaaattctcttagtattatatacgcacatgggaggaatatccgtactgagctgtcaccatcagcggcctacctctacagacccatggcatataacaccattttctttagataatggaatataataccatttaataatactactctacatctcagcagatgacatagagcaatcatatagatgagcattaaagcaataccattgcagatctccagtaagctagctacgtaactattacgagacaagtatgaactaaagtcggtactcgaataattatataagtaaagtaaaggaccgaaactataataagaagaatattgagaaaattccctatgtaccttgaaagttcatccaatccttattataccctgagattttctcattcccttccatagccctaaatttcagtttggatcccttctgtaccccttccgtcagttggacgttaagttgaccgttaaattcatatcataaactctattttaccctttggtatcaagaaaatataaatttatgaattatattaatggagtgtataaatttagtgtatacgactattatatttataagtttattttgtgagatattatttagcaaaaataattttaatctcgcataacaagatttatcttataaaaaattcatactactataacaaaatatgcagtttttaatggtcaaaaatatttctttgttttatctaaaatattgccatagataaaaattattttgtttccccttcgcgaggcgaaactaaaatattacatttgttaaaaatatctcacaaaataaactcataaatatgatagtcacatacaataaatttatacagtccatcaatatacttcataattttatattttcttgataccaaagggttgccatagataaaaattatttttgttttcccttcgcgaggcgaaactaaaatattacttttgttaaataatatctcacaaaataaactcatacatataatagtcacaaacaataaatttatacgcttcatcaatatagttcataaatttatattttcttgatagcaaaggacaaaatggactctatgatagaaatttagtggtcaactaatggaaagggtatagaagggatccaaactgaaatttaggggtatcgaagggaatgagcaaatctcaggggcatagaatggattgggtgaagtttcatgggtgcataggaaattttctcaagaatatttcattaatgaattaagtcttacaaaagagagagaagctactaaagctatatccgaattctcctaaagacttgaagaactaagaaaaaaattctattcctacaccactagcactagaacaatataaataaactggagagagctcttgacttcttcttggcgccctttggaatagagagtgaactcctcaaataggctggcaatggcggttgtggcggttggaattgtcggaaacgcgcaggaggggtttcagccgaattagccctggtctggcccaattagcctgtgccttttctagtgcgttgcttgatggatcttaagtccagcggcatggtggtttggcccaattgcagatattttaatggggaataagatcactttgactccctcaactgactaccgaacctaaatcgtatccctcaatcgcaatagcagaaatcttgacccccaaacttgcaaaaccggtgcaattagactcccttggtggttttggagggccgtttcgctgacgtggcgcacacgtggcagtgttgacctggtcttcaccccacgtggcattgacgtggcactaatgtggcattaaaataaataatatatgtggggcctatttgtcattcaaaaaaaattgtgggacccactgacgtcatcttctctctcactacccttctgcttcctcctctctcccttatttctctctctctctctctctctctccccccttgacatgagccggtggtaggcggtggacctcgggcaacgggcatgggagcagctcctccttaaggatgcagagcgggcgctcaaggttgtgcaccacctccgattttgcggcggcggtgggtgcgtctcggcctcgaggtggcgacgcgaagcaatgagtggtctccggcgacgccttccaccgacgatgaaggccgacgccttccaccgagcctttactgtctctgccactgtgaccacatcaagccgccgccgccgccctgctgctgcagcttgtcctctagtcgcccgtcgtggccgattcggagctctggatctaggttgatggagctcggtgctacgccgcggagtcgccatgcattcctgagctcctcgtgcatggctgcgcgacaccgtcgagggcaccaccaccatcgtggtccaccgtgagaagccaccaccggcaccgtcactcctgcacccgcttg

SEQ ID NO: 65455 - DNA, 3092 bp, Oryza sativa
aagtgcaagtgaaaatagattattcttaaacaaatatgtatgcgggcgttactagttcttatttattttagatatatttgcacttttttttggactataatgacccttgggggtggtcgaatggatattagacatcacgtataacaattttatatgatgaaatagctcttgtaaaccgaaaacccactcgccatagcggtgtcgccgaatctacaaacactaaccacgccacaaatttctgaagaaaccttggcacccctaatgttcgagttcaatgatttgccatcgacatggtctctttctataatataccggtgactttaacaattgttctacgatataccattaggccggaccttcttttcaaaaaatacccaaaatacccttagagatatacaagataaacaattgatttatctcattagaagtttcaaaaaaaatatgaaaatttttacgtggcctccttacacaatatggaagtttctatacaagttgtaattttttttctggtatatttagtttttttaaaaaagtgtttttacgtggtatatgagagagagtttgcttatccaggagatgatagcataaaactatcttatgtagtgtgtgaaagatgatttatattaaaaactaataaaaaggtatttttatataccatataacagataagttatattttttttaaaaaaataaatgtaaaaaacttaaaactcctatagaaatttccatgttatgtaataaggaggccacataaaagttttcatattttttttggaacttctaataagataaatcaattgctaagcttctatgttcataagggtattttgggtatttttaaaaagaatgtcaatggcaaatcgttaaactcgaacaaacccagtagtatacaatagattatctcaactcgctggtagtacggtacataacccattaatatttctataagtacaaaaggctgtgatttacacgaaggcctaagtcaaggtctcctcgttcccctgaatttctctttcaaagcatgaaaggctaccgattcaatgaaactgtgaaacatcacaaaaaggaggctatatatataagaagagaagttgtaagcaagctatataattaagcaaactacaaagccgattagctaaatttctccagtccaaccagcttccatacatggccacttcgatcatgattacgctgctactgtacctctggtttttagcatctattgccattgcttctattgccattgcttcgaccccagacagtgtcaccgccggcaacggcagtgacacagacgttaccgcgctgctggctttcaaagcccagctcgccgaccctcgcggcgttctatccaactggactactgccacatctttctgtcattggttcggcgtgtcatgtagtcgccgccgggcacgggttgttgcccttgtgctgcacgatgtgccactccagggaagcatctcgcctcatcttggtaacctctctttcctcactgtcctcaacctcactagcacgggactcaccggcgccatcccagccgatctcggaaagctgcatcgtcttgaagttctcgttttccgccggaatagcttgtcaggcgtcattccaccagtggtaggaaacctcacaaggcttgaggttgttgacatggggcacaacagcatatcagggcagattccacttgagctgcaaaaactgcacaatcttacgcacatagatttcataacgaattacttaactggaccactaccgaatgatctcttcagcaacaattctaagctacaatatctagactttgggaacaacagtttgacaggaacacttccgtattctgtgggttccttaggcatgctccaacacctcgattttcaggctaaccacttctctggcccagttccaacaactatactcaacatgtccaagctgcaaatattatctcttggaggcaactggggcctaactggaactatcccaggtaacaataataccttcaacctccccatgctgcaaatgatctctctatttgcgaatagattcacgggacagataccattagggcttgcaaactgcaaatacatccaaataatttccattggagagaactcattcgagggccctgtgccaacatggctgagcaaactgccagacctccttttacttgatctaggttacaataatcttatcggtcaaatcccatctgcactgggtaatattactaatcttgtctcccttggtcttcaatcgtgtaccttatcagggctaattccacaagaacttggacagcttcagcaactcaatgcattgtatctggaccataatcattttactggatccatccctaccttttttgctaacttttctgaactacaagtctttctaatcggtgctaatagttttactgggtcagtaccaactgcacttggtagctcaagatcaattgagtggtttaatattggagggaactaccaagaagggagcctcgacttcttggctacactttcaaactgtcaaaatatctgggaagttggcttcgacttgaatgattttacagggaagctccctgactatgtcggaaacttctcaagtactctgataaatttctttgcagaaggaaacaagttatccggtgagcttccttctaccctgtcgaatttaagcaatctcgtttggttggacatttcaaacaaccaactgactggtactattccagaatcaatcaagctaatggacaagctccaacttcttaatctctccggaaatagcttgtctggttcaatcccaaggcagataggtcaactctggaacctacaaacactaatactcaataacaacaacttctctggtacgctaccaaacgatcttggaaacctcggtaatctacaatatcttgttctatctaaaaagagtttttttacagtccatcatgactggtggtacctcccagtacctgtaatcagagccatccattgagtccgatctaacggatgagaatcctcggtactgtccggtaccaaaatctcctcaatggtgcctccccttcgccgaacaggtggaagggcaaagctgggttttcccatggtccgctcctcccc

SEQ ID NO: 65456 - DNA, 3251 bp, Oryza sativa
ctcctctcccaaaacgtagggtataacagcctctctgggcaaataccacgtgagctgcagaatcttcgcaaccttaggtacatagatttgctagtgaattatttgactggaccactacccaatgatctgttcaacaacacccctaagctaaaatatctaaacttccggaataacagtttgtcagggacaataccagttggtatcggcactttgcccatccttcaacacttggaaatagcatataaccacttttctggaccagtacctgagttaattttcaacatgtccaaactagaaatgttgcatctcggaggcaacgggtacctagatggatctatccctggtaacaagagcttcaacctccccatgctgcaaaagatctgcttgtatgaaaacagattcatgggacagattccgttggggcttgcagactgcaaatacctccaatggattttcattggacataatttattcgagggcccagttccagcatggttgggaaaactgccagacctcgtattacttgatttagagagtaataaccttgttggtccgatcccatctgcattgggtaatcttagtaatcttgacacccttggccttcaatcctgcaatttaacaggacagattccacaagaacttgcacagctcaggaaaatcaaagggctattcctcgaccataatcattttacaggatccatccctaccttttttgccaacttttcggaactagctgtattcttaattggtgctaatagttttaccggagcagtaccaactgcaatcggtagcacaggatcagttgaatggttcaatattggagacaactacctacaagggagcctcgacttcttggctacactttcaaactgtcaaaatatctgggaagttggcttcgacttgaattatttcacaggggagctccctaactatgtcggaaacttctcaagtactctaataaatttctttgcagtaggaaacaggttatccggtgatcttccttctaccctgttgaatttaagcaatctcgtttggttggacctttcaaacaaccaactgactggtactattccagaatcaatcatgctaatggacaagctccaagttcttaatctctctggaaatatcatgtctggcacaatcccaagacaaataggtcatctaaggaacctacaaacactaatactcaataacaacaacttctcaggtgtgctaccaaacgatcttggaaacctcagtaatctacaatatcttgttctatctaaaaatcatatgtcatcaaccataccagcaagcctattccatatgaatagcttgataaccgttgatctgtctcagaactccttggaaggtgcattgccagtagatatagggcagctaaatcatattgacaggattgatctctcttccaaccggttgtttggtaggatccctgaatcctttggacagtttctaatgacaacatacctgaacctgtcacacaactcactaaatggttcatttccaaactcttttgacaagttgatcaacttgaaatcactggatgtttcatacaatgatctgtcggggacaattccacaatatttagcaaattttactgatctctctagcttgaacctttcattcaataacctacatggtccaataccagaaggtggcatctttgcaaacatcaccctgcaatctttgatgggcaaccccgccctttgtggtggtgttccacgtttggggtttatgccatgtaagagcaacaataatagtaataaaaggcaaatactaaaattcttgctccccagtgttattattgttgtcggagttatagccacatgcatgtacatgatgatgaggaagaaagccaagcaacaagatagaatcatttctcctgatatggaagatgtgctcaacaataggttgatctcttaccatgacattgtccgagccacggataattttagtgagactaaattgttgggggctggaagctttggaaaagttttcaagggccaactgaacgacggtactatggtggcaataaaagttctcaacatggagctggaacaagctattagaagcttcgattcagagtgtcatgccctgcgcatggcccggcatcgcaacttgattaggatactcaccacttgttccaacctggacttctttttttcgccgggaaggccgaaggaggccaaccgagtatattaagaaggaataaaagttacaagagaaaaaacaacaaaatgcaccaaggtgcattgcaacacaccacgcgctaccacccaagcacaaaccgctgagggtgaaacctagcaccaaacgacccccgctgagcgtggccgaacgccgctaggcctacagcaacaccacagagacgaggctccgaaaacgatgccaccatggtggtcacgacatccaagatgccgccatcgcccataaaaaaagatgtggttttcacccagagaagctcgccaagaaagggagagggtaaccctcgacaacgctccaaggagattacgacgcccgaagacgtagccgctgacggcccggtgaaccaccggactaggctttcgcctgggtccctacaaccttgactgcagatcgccatccaccaactcagaaccaccacacagacaaatggcagcacgtggcatccaccacaccgcaccgacgcccctccgtcggtcgacttcaacgaaccaccacccctgaaagctggcctaggactcctccgttccaccacccgccggccgcctcgccagatttggccgaaggagaacccgggactaggtggcattgcttcggcagcctgagcttcccccattgatgagctgccgcctcaatccaacctagaaactccccgcaaagaaggggaggagctccacgaaggccgagggtgccgaccggcaacgaggaagacggcccatcgccgccagctccctttgcactgccatctggccgccggtggtgctgctgctccggaccggcgccacccgccggcgcccctgaagtccggccgctgcgcctcacctagccaccgcgacggcatcccggctgcccggccaccacgccgagccaccaccgaggcctggacgacccaccgcgccatgggctggcgctgggtggccagggcgagcgagtgagcaggggcaccgctgccgctctgggcaggcttagctgcccgccgccttcgcgcgggcaccggctctgcgacccagccggccacgacgagccgcggccatccgctgcccgcgccc

SEQ ID NO: 65457 - DNA, 3272 bp, Oryza sativa
gggggtggcaacctggacttcagagctttggttcttccctacatgcccaagggaagcttagaaacacagctacactctgaaggtggagagcaactgggattccttcagagactggacattctgttggatgtgtccatggcaatggagtatcttcactatcatcactgtgaggtagtcctacactgcgacttgaagccaagcaatgttctattcgaccaagacatggttgcattggtggccgatttcgggattgcaaaactgttacgtggtgacgataactctgttatttctgcaagtatgcctggaacaattggttatatggcaccaggtatttctagtatgtttttttttctctcgttttgattcaactattagttttgctactaatttattcctctcctgtttggaaaaaatattgctagagtatgggtcagttgggaaagcatcacggaaaagcgatgcattcagctacggtattatgcttctggagttattcactggaaagaggccaactgatcccatgtttgttggagaactatctctaaggcagtgggttactagtgcatttccatcaaatgtcatggatgtggtggataaccggttactggtgcaagattcctctagttcattgaataactttatagtcccagtttttgagttgggtttacaatgctcacatgaattaccagaccaaagaatgacaatgagcgaagtggttgtgagactggcgaagataaaaaaggattacatggcttctgtctaaagaatgcagagtgcttagtgaagcaagtcattcgacagcatgattagttatacaaatttatgatcagccatgcatgcaatacatataagaaccaattacggggctttttactcatctatgattttgaaatcatcatgtgttgtggtgtaagttaatagcaatttgaaattacatatacttatatttgccctccagtgagtagagttaatggttttcctttgttttttcatcttgcaacttctctcaattattttccaccctctgagctaaccatgtgagactcaacatcctcggacagcctcccagcatctggcagtgtcgagtgtaagcacctagtcccttgtttagagttttggtgattactgataacataatcatccgggctaactatgtttaatttactaagtgtgaaaattaaaggagtttgggttccgattattgatgcgctacaacgattcaacgataaagaaaatagtgtggtctttgccaagaaaaaggacagagaggacctatgtttacaagtttaccacatcaacgaagttgaggtgatatgttgatacaattgtttacacccaaatttgctagataggttcaaaataagaaaaattgcccaagatttgggaaggtcaccggtttcctccactaggtcggtctaaccgccgtgtatgggccggtcagaccatggtctgagggccggtctaaccgaaggcatgttgctggtcagaccggcagagtttgagcccaagtccattttcgtcggcctcgggattccttactcgggaggctatgtcacaggttttctttggtttctttcccgaattagacatagaggaggacctgtaggtggcaagactaacccctatataaaggacatggccggttcaatttaacatacaatatataatctacacacaagtcaattcactggtggagaaaccatctttcgtcggtcgggctaattccacaatagtcccggttgcaacaaaaaccgggactaaagatgatctttagtcccggttaaaaagggtaatgggcatatttgaccgggactaaaaatgatctttagtccctgttcaaatgctgtcaggacctgtcaggccccccctgggatctttagtcccggttaataacaccaaccgggactaaagatcgtaactttagtcccggttggtaacagatcacggcgatctttagccccggttcataacaccaaccgggactaaagtcctacccctatatatatgtcttcttcctcctccagcccgagcaagcttcaaaatttcttcaaaaaagaggggaggtcatgccaaaatttctagtgaatttattttggtgattatatacaaatcggaggtgcctaaaaggttagcaacttcatcctccaatattttttttttcatattacatttggagctatgttttgcacacttttttgtcttcaaaattttgttgttagttgatgagagagaaaatttgtgtggagaagaaagaatatatagaaatttagtttatttgctaaagaaggttttataaaaaagttgagaaggaaaatatagtgaaagttaatcttgaataatagaaaacaaagtaaaatgaaaaattaaaataagtacaacacattaatattagtttaaaactttataaatagtaaatatataattattcggtgtaatatttcataatatttgtaggaataatgatatgtcattattgtgtgactgttgaaagagtttgtaattattttataattattgtatgattgtcattattgtacgaataattatgtgtgtacgattttttttcatgtcatgtagatggatcggcaatggatgtacgctgaccggcggtccaaagagtttattgacggcgtgcattattttttgagagtggccgaagctaacaggcaaaagggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgataatattccggactttgctcagtacgctggatttgaagaaaatcaaacgggtgaggaggaaagggatgctgatggtaacaacgttgcggatgatcttggtcagatgttgcaggacgccaaggaggattgcgaaagtgaaaagggggcccataaattggacaagatgttagaggacaacagaacgtcgttgtacccaggttgcgagcaggggcacaaaaagttggataccactctagagttcttgcaatggaaggcaaataatggtgttagtgacaaggcatttggcgatttattgaaactcgtcaagaacattcttccggagggaaacaagttgcccgagacaacgtacgaggcaaagaagatagtgtgccctctaggactggaagttcagaagattcacgcatgtccgaatgattgtatcctatatcgcgg

SEQ ID NO: 65458 - DNA, 3085 bp, Oryza sativa
tgatgtggtatttccctataataccacggctaaggcgtttgttcaggaacaaggggaacgctagaatgatgcggtggcacgctgaagagcgtcaacaggacgggatgctgagacaccccgccgatggttcgcagtggcgaaacatcgacagaaaatttaaagactttggaaaggacgcacgaaacatacggtttggtttaagtacggatggcatgaatccttttggtgagatgtgcagcggccatagcacttggcccgttacgatgtgtatctacaacctccccccgtggctatgcatgaagaggaagtacataatgatgccgattataattcaagggcccaagcaacctgttaacgacatcgatgtgtacctaagaccactggtcgaagattttaaactgttgtggaagaaggaaggtgtccccatgtgggacgaggacaaacaggaggagtttaacctacgagcgctactgttcgtaaccatcaacgattggcctgcacttagcaacctatccggacagtccaataaggggtacaaggcttgcactcactgtatggatgaaatagaaagtatgtatcttaagcactgtaggaaggttgtgtacatgggtcatcgttgattccttgcagcaaaccaccaggtacggaagaaaggcaagcactttgaacataaggaggaccaccgtacgaagcctaaacatcgcagcgggaaacagtgttttctatggttaaagatcttaaagtagtgtttggaaaggggcctggcagccagcctatagagagcgaagatggtcacgcggcgatgtagaaaaagaactctatattttgggagttaccctattgggaattcttggacgtccgccacgcaatcgacatgatgcacctcactaagaatctttgcgtaaaccttcttggcttcctaggtgtatatggaaagttgaaagatacactggaagcacgtaatgatctgaagcatatggaacaacgcggtgaccttcatccggaaccaaagaagaaaggaagccattacttgagtccagccagctacactcttagcaaggcagagaaggaaagtatgtttgaatgcttggagagcatcaaggtaccgtctggatactccatgaatataaagcgaataataagcacgaagaagaagaagttcacaaatctaaagtctcatgactgtcacgtgttgatgacacagctgctaccagttgtaataaggggtatcctcccagacaatgtccggacaacaataacaaagctatgtgttttcatgaacgcaatttcgcagaaggtcatcgatcctgatagattagaagccctgcagaatgatgtggtgcaatgtcttgtcagctttgagttgatatttccaccttcatttttcaatataatgacgcatctgctttgtcaccttgtcaaagagatcggtattctcggtcctgtgtacctacacaacatgtaacctttcgagaggtacatgggcgttctgaagaagtatgttcataaccgtgctcgtccagaggcaagcatcgccaaggggtatggaacagaggaggtcattgaattctgcgtagaatttatcgaagaccttcgcccaatcggggtacctgaatcacgccatgaagggagactacggggaaaggggactctcgaaaggaaagcaataatgacggcagacaactatttattccgtaaagcccatttcactgttctgcaacaatcttcattggtggctccctacatcgaggagcacttggctctagttcgcgccaaaaacatcggtaagtccgatgcatggattacaaggtatcacattgatactttctccacgtggctgcgacaacatctcatgggtagcaagacgattaaccaacaactggcctttctggcgtggggaccatctggctcgatcgcgacattccagggatatgaaatcaatgggtacacattctacacgagggcccaagacatgaagagtacaaaccagaacagtgctgttcgtatcgatgccatgggacacgatggtacaactggcacatattacggtgccatcgaggacatatgggaacttgactatggacctctcaaggtccctctgttccggtgccaatggattaggttgactggtggaggcgtaacgattgatgacagtgggatgacaacggttgaccttaacaaggttggatactcggacgaaccttttgtccttgtcgatgatgtaacccaagttttttacgtcaaggacatgtctagcaaaggaaaaaagggcaaagtgactgacgagccgaagcgccacgtggttctcccaagaaaaagaaaaatcgtcggagtagaggacaagactgatgaggattacgatcagtttgatgggcaaccccctttcacggtgacaattgaccctagcatcctcctatcaaatgaagacaccccttactcacgtagcgatcacaaggaaggaacaatagtgaggagaaagtacgtccggtcaaccgtcaccgccgatgtattgccgtaattgttctgtacacgatgtaaactatgttggatgtaccgaatatctatactaatcaattgttgtatggcaaatgttaaatatgtatgattattagaatttttatcaaattgaaatcatccatatgctagttatatatgattattaatttttttgttaattatgtatgattattagaattttcatcaaattgaaatcatccatatgctacatatatatgattattagaattttaatcaaattgaaatcatccatatgctacatatatatgattattagaatttctaaaggttttaaatcatgcatgtggtatttacatatgttaattagaatttttaacaatttaatatcatgatatgctagttatatatgatattagattttgtattaattttaaatcatgcatgtgctatttagatatgttaattagaatttttaacaattttaaatcattcatgtgcttattatatattatccacgtattctactacgtacaacaataattttttcgaaggttttatcattaattgttcgactttaaataattgtaatgcattatttactatttta

SEQ ID NO: 65459 - DNA, 2507 bp, Oryza sativa
gtcggcgtcgtccctcaagccgaagtggtagctagccatcgaaggaattcgcgcaggcaagtgatgtaaataagtgattgttagatatttaatataagattgttacacttagcatacatgattattacacttttaatataagattgttatcgatttaatataattacgattagtagtgatttaatatgagattgttatacttagcatatatgactattacaattctaatataagattattagagattaaatgtaagattgttagagatttaatataagattgttagacttagcgcatatatatatatgattattataatattaatatgagattagtagccatttaatataagattattagacttagcatatatgactattacaattttaatataagattattagagattaaaataagatcgttagagatttaatataagattgttagacttagcatatatatatatgattattacaattttaatatgagattagtagccatttaatataagattattagacttagcatatatatatatatatatatatatatatatgactattacaattttaatataagattgttagagatttaatataagattgttagacttagcatatataaatgattattacaattttaatatgagattagtagccatttaatataagattattagacttagcatatatatatatatatgacttacaattttaatataagattattagagattaaatataagattgttagagatttaatataagattgttagacttagcatatatgtatgattattacaattttaatatgagattagtagccatttaatataagattataagagatttaatataagattagcagagtttcaatattacggttagcaaatacatcctatatacctaacaaatattttttgtatgcacagatggctgatcgcgatgaggaacagatattatacgatacaatcgcagagggaagcagccagtactagaacgaagaagaggggaacgaggatccaaaccagtacttgaacgaggaggggaccgtggagagggctgcggaggggaacgaggaggggaacgatgcggaggaggctagtggaagtcaaccctctgctggacagaagagggcacgcggacaacgaggtgccgcgaagaagatagagggtcggcacatcataactgaggtggacgaagacggccgaactagtgccccggcagaagcagccaagaattttgtacgccacagcggttgggttgtgagggacaacgtgcctgtcagcacggtgtactggcgcagaacaagggcacgcggggatgatgacagctttgtcccggattcagagaaagagatgttgtggaccacaatgctcgagacgttcacgctacccgcgggtacggataacttagtgaaacggtggactctgaagaaaatggcagaacagttccagagcttcaagggagatttctacaaaaaatacatcctgaagggactaacaccgaacttcgacgtattcccaaagctaagggatcattgggatgagttcgttgcttacaagacagggcaacaagggcaagcgatgatggccagaaacaaagaaaatgccgccaagaagaagtaccatcaccacttgggctcaggcggatatagcatcgcgaagccgaagtgggaggagatggaggttagcttgcttgagaggggtatcgaaccggccaccgctaattggccggatcgatcgaagttctggtactatgctcacggtggaacgcttaacccagttgatggctcccttgtcttcagcgatcagatacgcgaggctgccagtcgactaacggacgtagtggtagcctcttctcagggcacattccgacccgacagagagaaggatgagctgtcactcgctggaagattgaatttcagggcacattccaggacgaacacgagggaaaggcgtgattccctggaagattgaatttaaggaggacatccacatgtacaggagtcggatgaggagcaggagagataccgaggcgaagattgcagatcttgagtacagggtatcgagctacgagctcagcatgcaagaggaggtggcaaggaaggtggatgaacgtatggccgcacatcggtcccaggatccccagccgtacattcatcctgcaatggtcagcccatcaggcaatcgtagcagctgcgcctcaacggggcaggtcggatcacagagtatggacgccatgcaaacctaggacgaaaccacctgccccgttgatgagatcacgcagcggacaccatgtgagctgcatattcccttcaagaacttatcaatcaaggtatgctcgtagtttgatgatttttgacttgtacattccgcaagttgctgcttaggttgattactaatagataacctctcatcacgtgaaggtggcgttgggaatggccatcccaacggacccttccgggacttaccacttcaggccgatttcagcaggatactcgagggt

SEQ ID NO: 65460 - DNA, 2930 bp, Oryza sativa
  unsure (1)..(2930): unsure at all n locations
cggggaatctattgctattatgttgatctcaggtaataattaattaatcatagcttgcaactgcatatgtagggcttgggatcggttccgtcaattggtctgcgggacttggaaagaaaaacttggacggaggtttcattttccagtgagtacatgcttgatccaaaattatattgaattgaatatctaattacagttaatataaagagtatattaaatctctcatcgtttctcatgtagtgtgcaaagcaggaccagggaactaacttatgcggctactacgtatgcgagtatgcccactgcctatcaaactaaatatgcacaacacgagagctcgatgtacgtatacataaaccattcaaaggttcattgcgtatcgatttgttaagttgtttattaatttcatatattgatacgttattatttttcgaatgatagcgtattcacatgagggataatctctcacacaaggattttatcacggctgttcaagaacaactgatgggattcatcaacgaggaagtacttaatcccgacggtgaattctactacgacggatcaacaatttataacgtcggtccttcctcttctgacataacgccggcgtcgaagtcgaagtcgtagatataactaccgagcaaatgaattgtactatatatgcatgtatatatatatatatttatatatgtacacatttacttgtgtgttaatatatattttggtaacatatatatatgcacataaaatgttaagtagctttaattatacatatgtgtgtgtatataatatatgatttatacatacacacacacatatatatatatatgactatatattatgcatatatatgtattgtaacatatgtatgtatatatatatataatcaaccatgcagcaaacagggccatgcaaaaaaaaaaaaaggtcagctcgatctttagtctcggttatttcacccaggactaaagatagctatctttagtcccggattcgtagtcccggttggacaaccgggactaaagggaggttaccaaccgggactacaaatggtttctccaccagtgattgaatcgtttttttcaatatttcaatctatttctagtctagttcatccatctttgtcgatttgtgtcgtaaatcggccgctttgtggaggagttgccttcagttttgtcgtcactatgcactacacccagtcgtgtgacaggtcagtcaccttccgttttagtatatggggctgaagctatgttgccgagtgagatggagtttgagtccctacgcgtccgcaactttgacgattatgtgttttaacatattttgctttggcaatatgtgcatagtatgacgccagtaccagttgttcattatgcagtaagctttagtagtaaagtgacgtgctagctgtattattctttatgtaattaagcttaggctgtgcatattattttaaaaaaccactcggatggttattataaactttttaacctttactatatgcttagtttgttcaaatacatagttggggggctacacctaattaggtatattttatattttttttatttttcagcccttcacatcctactgaataggagaaaatacttggaagactaaggcagagaaaattgaagcacttggctatggaaatttttggtttgagagaagattttattgtcgactatgaatgtctcaggggctactgtggagattatgggtaccatataaccacacggctggactatctaactggttataggggatatatcatgtaaatagaatatgtaaagaattaagactcaggtattacgtttacctgcctatcaaggaaatggattgttatctttgttcggtaagattgtgaactagttatagtgatttaaaccgtaaggggttatatctctatcttgtaacatgtctccttcgactatataagaagggcaggataccccttgaggatataaccacaactcagatggtcagatcaatacaacaatcagcgaatacaatccctaaactatagggtattacttctcatcgagaaggtctcatcgagaaggcatacctgtctgaacccttgtctcataacctatccactatctactttcttttttgtgcgctaccctttttcatattgttaaattttagttttgacacaattgagatgacgcaagtacatgaaccaggtcctggtgcagtcaaccacataacggtaatactacgataccatgtatcctattataagaacgtagataaatctatcgtagggaccctcatagtattaccctacgagttagtgtgacactataacaaagatgaataaaagcaggacgccaggaatgatgaatgaaaaatctaatgtcgataaaattcctttgtcaatctaatcaatattttagtttttcactctattttaaacatagtcctttagaagcctgtgcttcatactccctccgcttcaaatgaaaaggtgtgttagtgacgacgacaaatctccagagtagagctagggatgtgaatttttttttctaagaaaagcaaagggacatggacattaccaccagcacgtgagggaagaggtggaagattatcattgtctggccaaaatggaaagtgtacaggcagaaaaagtaatgtagtgtagctctcacaaaagaacaaaattaaaaaggttaattgaatgccaaaggagtgaattaacgtgttgtgctgtgctcatgattatggttgtgttcctttgtgtcggttgggaactttccctctgatatatcggagcagctcaatagcgtatgataattatgtattaattaaaattaagttaaaaatgaattaatatgtgtttttaaaacagcatctctatatagaggagttgggaacannnnnnnnnnnnnnnnnnnnnnnnnnnnnnnnnnnnnnnnnnnnnnnnnnnnnnn

SEQ ID NO: 65461 - DNA, 892 bp, Oryza sativa
atttttctcttttattccgggtgcgtccctgtcgtcaggattgtttctagggattcggcacccattattttgcttacatcgaatacgtccttgtcgtcaagactgtttccaaggattcggtattcattttttttcgtagttttattctcttttcacaatgagcaattaaagctatttgaggaataataattcaataaagcatatatatagagcatttagaaatcaaaccacatgctagcatcaacattgcatatttaagtgtcatgcatcatctcccttaaaagcaaaatctaaatctcatgaaaatactagaatacatacaagctatgctagagacaaataaaccttcaaagtattgttagcatgcacaagaaaataccatatgtataaacaaagctctcttttctcaatttttctcattgtcatatttttgcttgataaaaccatgaggtacaaactccccttcaaaacatgccaaaaggatgaattatttccaattcaccacaaagaaaagcaaagcgattagaatccaaaggtttagtgaaaatatcagcaagttgtaattttgtttccaaaaactgcaattcaacatctcccttctcaacatgatccctcaaaaagtgaaaacgaatatcaatgtgatttatgcgtgagtgttgaataggattcttagcaatgttaatagcactagtattatcacaaaagagaggtattttctcaaaagtaagaccataatctttcaaagtagataaaagccaaagaatctgtgaacaacaactagcagcagcaatatattcagattcaacagttgattgagaaatactagattgtttcctagaagactatgcaattaatgatgtaccaagaaaatgacatgttccattagtacttt

SEQ ID NO: 65462 - DNA, 814 bp, Oryza sativa
caaagaaaaatacaaattattgttagcaaatcaagaactcattaactactaactagagaatgctcaattgctcattgcacacatcattctggttaggtttctatttgtgcaatactaatgcaatctatcagaaagtttatagtttacaaactattgtgattaccataacaaaggaaaacatgacatttacagaagcactacgattttcagaaaagaaaaaaaattaattaccatcctgataagctacctgaaatgttacagtgaatagaaaagatttgggatataaatgcgatgtaccttggcatatagttcgacatagcggcggaatgtaggatcttcaacaagagccttgtcagtaggcaacttcagaagcccttctgaattctctttcagaagctcactgcattgaagcaaatggtgatatttaattaattctatagatggataagtcatatttaatattacatgaaataggagttatcaaatttcggaggattctttgtccaagcaccatcaataattaattctgtggagggacaagtcatatttaatcttacatgaaataggagttgtcaaatttcagtggatcctttgtccaggcaccatcaaatcctgatctttcgggacgagctttcccctgaaaatgaactattcagaacatgatctctaatttagctggaaaatagtagttgatatattatatacaccagtagaaagatgatgttgcatacgagagtatggccgcctgagagtgctactatgtccttgtctgataagcccatcctgtagaagacttccctcagatgcgcagcac

SEQ ID NO: 65463 - DNA, 6658 bp, Oryza sativa
ttcatttaatcatttataattagcaaaattaacccaagaaatcacagaaaaaagtatcaatgcatgggagctgatattttattttagattagtagataggagcagagataacgggtcatgaatcaacctttcttagcatctggcaaacggccttcctctggggaatctgaagaatcctgtagataaatgagaaaaaaaaaaggagaactcaagatggtttcataagatattcagtctggaaaaaaaatcaatgtcgatgcatcaactcaccctcctgccaggaacataatctatagttggcccaccggtgacttcaacggcaacaactccggcaagctgaaattagaggtgatgagatttataattggtatgtgattggtgaagtttaccagcaggaaagtaggattgggcttgttcggatgagattgctgctgcagcgctgcagctgcacggcagcagcagctacagtgctacagcagctagctaacagcggctgtagaggctgcaggcagccaacagccaggccgctgccagccaacaggcagacgaacggctgggctgtacagcacagccaaaacagctgcgtaatcgagctgccgaacaggcccattgtaaggttacttgttagtgttcaaatatgcagctgagttacctgatacaggtcagcataggtaatcttgggatgcttctgtttcatcggttctgcaccacatgaaagaaccatatatatcatctcaaatcaaacttgttaaggtcagaacaaaattaacaacaacagcatcaaaaaacaagttcacatcctgaacaagaatctgacagaaacatgcacagacctagcagatcaatagcaatcttgatgcccgcattcgcggcgtggctgtactcctgcgggaacctgatggagccgttgggccctcccgtcttcgtcgccttgtcgtacgtgccggcgtcgtgccacctgcgcaaaaacagcggcggccggcggcggcggcggcgccagagcagacgacatcagcggcgagctagacatacacgatcgtggagcatagcaaggacagcagagacaaaggaagaagaagaagaagatgaaacggcaacgcacgccaggcggagcatgatgggagcgcagctcttgctggcgatgagggcgcgcaggtcgcggcgcgccctctcgacctccgccatgtactccgcgtccactaccggcgccgccgacatcgccgccgctgttgctgacgatccgaggagaggtgataggtggagaagggaacagaacagaggagctcaggttttggagcgacacaggggtttttgtaggaaaagcggggaggaaagggcgggaggaatcgaatggagtggaggtgtggagaaggcaagggatgtctccagaggaaggcaacgtgcccaggaatctgtgggagatttctctggtatgcacatcactgggcctacacacagccacggtggaaaatctcttgatttctgacgagattactgattcaggcctgggttagttactcgaaaatgtttccaaaaaattttagacacattaaatctttagacatatgcatgaagcattaaatatagattaaacaaactaattgcatagttagggagaaaatcacgagacgaatcttttgagcctaattagtccatgattaaccataagtgatacagtaacccacatgtactaattacggattaataaggctcaaaagattcgtctcacggttttcagacgagttatgaaattaattttttcattagtgtacgaaaaccccttccgacatccggtcaaacatccgatgtgacagccaaaatttttttttcgtgaactaaacaaaccctcaggtgaggaagtttttcgctggctctgtcctaggccctgtttagttcccaaaacaaaaatttttcacccatcacatgaatgtttgatacatgcatggagtatttaatgtggaaaaaaaccaattacacagtttgcgtgtaaattgcgagacgaatcttctgagcctaattgcgtcatgatttgacaatgtggtgctacagtaaacatttgctaatgatggattacttaggattaataaattcgtctcacagtttctaggcggaaactgtaatttattttgttattagacaacgtttaatactttaaatgtgtatccatatatctgatgtgacaccttaaaacaaatatttttttgccaactaaaccgggcctaaatatagaaaactagtactacattctagatctggataggggtcttattcagccctactcggctactccccctcctaaatgattcacaattttctccaatttaattccacctacttttttaatacatgcatcaaatttataagttaatttgaaagaagagtactaggaataaaatacacaatttgttttatttcgaaataaggacttacaggacgtttcaagaatgttgggtatgaaatatagcataatacatatccctcaataaatcagaaaaactaaatcatactactaaaagtgagacctctcttgaattggactaataattttatcttatatgttgtgcatggatacagagtgttttgtttttattttttgaaatatccaaatacctcctacaagtcactagtgttttcaaacttcctttgcaacttaattccatacaaaacactcataataagtttgttttttttccatcttcccacctctatccatttctagctatttctcacaccctatgaccctccatcactgtgagggtagttgctcctttccaccaaaggtgtgtgtaccatagcattattttacctttcacttttacacactttaattccaccaactatgtgacggtaagacatgataattatctcatttcataaaaatgtgtattgaatcttatgcccaacaagagaagacaaaagcaacttcactagccatgctgagatctacaaagatgtgagaaattgctaagcgcggccagaaatcagtgaaaactagacagaggtgggaagttagaagaagaaaatggacttgtagggagcatatgttgcacaaaattaagttattgggagagattgaaaagaccagttacttataggggttatttggattttttttcctttttgttatttaaggcacatgcccgtagatagattaaaatccatctccttatattacacaactgtaccttacacttcacacggtttactgaatttgcactatgcaaaacagcagaaatccaagaaaccaggtagtgacaaccttaaaacaagcatgatcaggcgataaatttattccacacgactccgagtcgaaagtactactctttcttggggaaaagatcaatataatcactagggccataaacgtcgaataaatcagcccagaatccgttcttcctcctcggattgcaccccatgtcccggcatagctgatcattgtaccagatgtgaaggattccgatgcaggatctgcgaaagtaaccacgagaatagcgcttcatgaacttctcccattccaggacatcattctgcatcacactgatgcttggcaacctgaagccaccatccatgaaatgtgccagccacttggcccgtaattctgatgtgtagagatttgccaagctctctgaatagccgataaccgcgagctgcgggatctttgggtgaatgatctccctgtgttcatgcagcaaattaagttcaacagtccaagatagaatttggaaattgtactaattaaatatttgttccttgcaaaaaacaattgttgagttgacctgtagagaggtacagttgtagatgcagagcctactgcaatgctctgaaagtattcagaagtgaacatctccttgatcttctgatcccctctgaacccagttccaaagatcactatatcgctctttatcggcgaagattggccttcgacaagcacaccttccttgcaaaagctaaatgtctttgatttcttcagaacaatgctgccttcttctaatctcttgtaatggtctttgggtgtaatggcaaccaagcatgtaatcaaagcctcaaataggctatggtcaggcaccatgtcatacttcttcattggaatggaataatagctttctgcaaacttcgaaaatatccatctctgaacatgtgcaaagaggaaaaacatgcatggatcagtcttgcttcaatttaaccagagaaagcaaattttagcagtataattaaaacagaattgccataccaatggagtcaagagggtggccaagatgctaaggagtaagccttcaccaggcttgtgaataagaagctcagaaaaccgattaagatacagctttgagatggggacgccccatgcaaaatagtctggtatgatccaatgctttgttcggaccaccattgtacatggaatctcagtacctacacgaagaagaaacacttaataagtggggaaattctaattcagcatctaacaagggaaaagaatactgaaaaattggttgatggaaatcagattgttaatttgtcagtaccatttacttctgcacattctgcagcaatgtcaagtgctgatttgaggtagccaacgatcgtgacacgcttgcccttgatcatttccttacaattcttggtgcccatcttggagtaatccatggagtggatcacctggccatcaaatgcttctggacctttgcctggaggaaatgttggtatgttgggcactccactgaacttcccaatacaaagtatgacaaaatccgccttgtgtgtctggaatatgagaagtttgagtaacaaatgtgtgactaaattaatttagggataactatgatgaattatattacttcctttgttttaaaatatggtgcatattttgttttatattaggacaagattttgaccaagaattactgtattagaatatcatttatgtgatacaaaagtataatcaagatcgagtaaatattagtggatatgaatataataaatttaatttttatgtaaaaaaaaggcaaaacaaagaaaaataaacacattagccaatggatctctctcggcatggatgctgcgatttgtgcaattggatgtctcgcgctagacagcgatgcccccgctgtgcgccacaaattgcacggttgcctctttcgcaaccagcagagctagcccattccaggatctttgttgatggtgaacaccttgttttttttctttggatggtgaccaccaggttataaaggaatgatctatatcgaagaaaagcactgagactgctcaatgtcagagaggataagacatcagaaatattgccgtgactttgggctaggaatcaagttgcgatcgacggactctggtcgtagaatcgcaggacacagcgaactgtttagggtgtgttcggacctctaggttcccaacccaaatccctagttttttcacgcgcacgcttttcaaactgctaaacggtgtgttttttgcaaaaaaaatttatacgaaagttgcttaaaaaaatcaaattaatctattttttttaaaaaaattagctaatacttaattaatcacgtgctaatggatcgctccgttttccatgcggaggcagtatgttcccatcatccacatgcgaacatactttaaacacttcaaaccacttccatatcaatagaaagcatattgaaatatgtttcagggtatagtaaatgttagtaggttttaaaagtttgaaggtgaaaaccactggaaccttgatcaaaccacgttaacgttgatcaacgttgaaatatgttttatggtgtcatggcttttgttcttaaaagttgaaagcgaaagagaactggttttgtacttaggatgaaaaaatagatttcgaaggaagttacggcttttactttttcctaaggaaaagtagctgcatcaattactattcccccttaatttctttaattaacttgtctcaaaatgtaacaacttttagcaatgaatctggattagctaaaaatgcttatattttggccagattcataactaaaaatgcttatattttgggatggagggagtacgtttgatggcctatatacctaggggatatatttgttgaagctttaggttatttcattttctatattgcggtttcactagtaggatatataatagtgccaaactgccgtaaaaaccatataagtacatgtcaactttcttatgtatcgcactgatggtttctaacctaataaaacgataacaacgagacaagatcactactaggaaaaagattttttccaggcggtccaaaacagttttcgcaggcggggcttcaccctccggccacggctctcctccatccactgctcccacataggagagggaggagccgagccgctgcataagtgccgtcgtcatcgtcgttgcatcgacgaggagagccggcggccggatgcgagccgtcgtcgtcgcccgtcgtggccggtggcgtaggcggtgaggagggaagcgggcggcagaggaggcgagccattgtcgtcgctcgtcgtggccggcagcggagggggcgaggaggagaagcggacggcggaggcggcgaggagggatgccagcggcggcgggggagagccgttgtcgtcgctcgtcatggccggcgacggagggggcgaggagggaagctagcggaggaggagagccgttg

SEQ ID NO: 65464 - DNA, 2032 bp, Oryza sativa
atatttttgtagacggtcatttggctccaagggtcatgttcgactgcgaaaaaaagacccgcacatcaggaaaaatgctttttttctaacagtggatgtaacctataaaccaaagcactgtgcgtctgtgccacacaatgatatttatatgtactccctacatccgcgaatataaatattttgaacagataagaaactactctaatatctgttattaaataaaggatgaatataagtggaagatggatgggataaagatgactggttgataaataatagttttaggtaattatacatattaatgaataaattttaaatgctagctgcaacatttatattaatagttttagggtataagtaggtcgatccgtgaactgcttataggttaaataaatggtaatccatcatgctgcttattatttatttaacatataaataaattcatgagccgatatatttattccctccatttcaataaaaaaggttactataagatgtgtcatataatgtttctttattagggtgcagatgtcatactagcctggcccaggcctgcatttcatgcccatgcacaaagggtgccacctagctagtctagattagggggtgtttagatttagggggtaaagttttactgtatcacgtcaggtattatatagggtgttgcatagggtgttctgatactaacaaatcaactaattacagtatccgtcagtaatctagcagatgaatttattaaacataattaatttatcattagcacatgtttgctgtagactgtagcaccacgttggattgaggtgagatctaagcatgcccttactgtgtttctgtgtaagattgctcgtctgattgaatcacatcggattctgcctctgtccatgcctatccaaaatgatatgatgcggcgccccgacctttttcccttgttcctggcgctatgcgtctcttttctcctagtagaaacacaaattgttccatactgataaatatctcctactagcgacgcgaacattctctgctgacatatgattttgattgctcgcggtaaaataaattaattaaagtgtccgcctacatgttttaaataataagtgtagctttcgaactgttgataaaatcgtaacttattttgacagaacttcaaatatcaaagacaaaattctatgcctacataaaaagtttgaaatacaaatttaggaaaattcctttgcacaagagtatttattttaataattatttacatataatttttgacaaaatgaaaataaatattattttattcagctttattgaccgtacccttttccagatttttattacagtctatttttattactattggcttttagatcgttaatgacgcaggtataaagcttccacttataaattatttttttccaataagtttgttatgtgtcataaatgtaggccaaacaatatgataaatgcaaatttggaaacttcctccatgcaaagtactccctcctttttttaatagatgacgccgttgactttttctcacatatttgaccattcgtcttgttcaaaaaatttacgtaattataatttattttgttatgggttgctttatcactcatagttctttaaatgtgatttatatcttatacatttgcataaaatttttaaataagacgaatggtaaaacatatgagaaaaagtcaacggcgtcgtctgtttaaaaaatggatgtagtagtagcgaaattctcacctcaatatggccctcaccgtcgaccacctctagccgccactcgccggagccggagccgaaagcgtcgccgttcccagcccactcatcccacgccgccacagcctcctcgccgacgccgacgtactccatccccgccacccggtggccgaacctgatgcagtcgagcacgccgaagcggcgagcgtaggcgccgaggtagtccatcacctggcggtggtccgggaacacctccgtcaccgtctccggccacgggaagtcggagtactggtacatggccgcggggtctgcagcgcggtgc

SEQ ID NO: 65465 - DNA, 4924 bp, Oryza sativa
tatcggttattcgctggatcaagtcaggtacgagcagcagtagtatcggtatttgttatcaactactgtattagtaaaacaatccaagctgatctattactgttcacattaagaaaaaaaaatcaaaaccaattcactgtatcggttatttctgtgaagcttcaaactctccaatcttttgctaagcacattagcatacaaggaaaaaattctaagaccgtatattaatttattcggtcgacaatatttcggctatgagctatatgaccggatttaatcaaggaatttcttcatcaactttgacgagcgggaacgggttcaacaatattgctacacaatacattaggaccgatcaaggcatcatgaaaggaaacgtcccgctacctcaagttgtaatttcaccaaaggtaaccttcgattcgcccaacccgtcctttgctattcaaaacgttaataaccattgtgtagatgcatatgctacttctagttttgctcctatacaatatgcttataatgctacggggggtcaatgggtgattatacagccgattgcacaggaatcggctatatgcaaaacctagctaacggtatgaccggtcatgacaccggtctaaccgcgtcctatgccggtcagaccgtgcctaccatagccggtcagactgtaccctattctggccagatcggacctcctgtggccggtctgaccgcaccactgaccaccggtcagaccgggccatgggccggtcagatcggttccctgggagtttctccaggttttcataccacgactagcaatattgattttaattattattcatcacctgttaatactgttagtcatgctactccacatatccctaatgcctacaatgatattaataggggatatcctcccgatactaggtatggccaatataacaatattgtgccgcaacaaccaccttttaggccaccaagtccaccaccagatccaccaaggcctgaaactgtggaggattggtttagaaatattatcagggagaatttagcaaagctaaggaatcgcgctagggagtaccaaaagccgtatcctgattattatgacattttcccatatcctcgtgattataaaattcctgaatttaccaagtttagtggtgaggatagtaggactacatgcgagcatgtagataaattcttagcgcaatgtggtaggattaatagtaatatttttaaattacgtttgttttctttatctttgtccggtactgcttttacatggtttacttctttaccggcaaattctattgatacttgggcttaattagaacaaaaattttatgattattttcacactaatgaaactgagcttaagttatctgatttaacatcggttaggcatgaatacaatgaatccattgctgattattttgaaaggtttagagatgttaaaaaccgatgtttcaatttgaaaataactgacaaagatttggccaacattgcatatgatggattgcttgattctattaaagagaaattgaatggccagatatttcttgatgttgatcatgtgttgcatgaagctctggcttaggaaagccgagtggatgataatagcttacaagctagtttagacgaaaatgcaatatcatgtgtagccaaaccaagcgatggttcggattgtattaataatttgtgcaatgatgccataataagtatagccgaaccaaatgttggttcggattgtcttgctagcttggataatgatgcaacaaccattatagctaaaccaagcaacggttcggattgtgttattagtttaaacgatgatggaatagccgaatcaagtagtggttcggattgtgttgctagtttagacaatgacatcattgaaaatatagccgaactaagtgacggttcggattatatcacaagcgaaagtgaaatagcattgtcacctaagaccgaatcacaaatcggtcatatggatgttggaaaagataatgataatgtcttgcgggatagtagtgagatagaatctaaaatagttatgcatatatatcaaaggccgtatcctgaacacatagattcggtcccatacccgcaaggatttgaggtgcccaacttcacgaaattcacaggtgaggatgctagaacaacaatggagcatatcggccgatttattgatcaatgtggtaaggccggtagcgatgatttgcttaagttgaagttgtttcccctttctttgtcaaactttgcatctacatggtatagtttgcttgctcctaattcaatttctacatggtcataaatggagcatgagtttcatgattatttcaaagatgcaagcttgatggagaaagaccgattgatacttcatcggtcacttgtgaaacgatttcggttacacctatgcttaagaccggaattgttagtgatcctctccctattagtcctactgatgttgacaaaaagaaagggaaaagtgttgttattggggatcttcggcccaagaataggatcaataatgcaaaggccgaatatcgtaaggttacaaaagatgagtcatttagttcccaaaagaccaaaaagccgaagctcgcttttgagatgcttatggctaagtacaagaaaggattagccggtcaacgatttgataaccaaactagtgattcaaaaagaccaagatcatctcgtaggaagagatttggtcaaacaccaaagcaatcagagccatcaactataccaactccatacaaacctccggttgtgatgccatggtatccatatccaatgtcactatatggttatccctttatgtattacatgtcgtggatgcctcaaccatctatgccgtgtcatcaggaatggaagcaatcacctaggtcagtaccaagtcattctaacccaagacaagaccgttttccacaaaagaatcggtccggtggatcaaaggtgaaagaggtaaagaaggtgtgggtgaggaaagaagccaaagctccggaggtcgttatcaataaggagtctcaagttgttcatgtacctactggagatgtggtggaaaccatacaagcaaaggggatcgaagccgacaccgtgattgtcaaaagtggaggtttgatcgaggcatctagctggtctgaccgccaacctgtggccggtctgttcgaacctcttggccggtttgaccgacggcttgtggccggtttgaccgggcccagaggtcggtctgactggggggcattggagaagagtgggaaaattgagagcaacataggagcttccactccgaccaaaaatatgaagaatcattgcttagctcctgaaaaacaaccacagccaaagtggataccttttggcttatctcgctctcaaaagaggaggctacaacgtcttcgagccataggtcaaaaagaaaaggaggccgaagctgtagagaacaaaacatgtaataatttagagcctcgaacgactcctaagagagtgtggagacctaaagaagtaaaagttaagagaccggtgatttcccatagtagagataaatccaatttgatgagagaagaatcatcgatcattagagataagtctccttcgcatggtgctatgaatgttggtgcggtgtttgtcttgccttcgaaatcgtgcagtcaagaaagccgattttgctcggggggcaagacattaatatgctcatgagggaaccaagagaagatgaacggcgatggatacaacatcacatctttgagccgccgtttgttggatgctaaggcaaggtatgggtttattgtgttcaacgttatattatatgcctatgccatgttagaacattgattgatatatagcacatgtgtgtttttgcttatcaaattgatattatgcatatatgttgcaaatgccagttctaggtagtggaattggtaggttggcatatagtttgtttgaagtatgatttggctcatgagtctttgatatttatttaaagccaaatcatatgtgtttttatggatcaccatataatatatagatttcatatttattgcaccatgaaagttttgcttattagtaattcggctaatgtcaatggtcaatgtaatgatttgttctagagttattgtatttaggaacattggcattgttaatattttgcatacatgctcaagccgattacttacatttttagtttattggaatctatgcatgtgacacatatgactttggtgattcattattgatcatacttcaattggctaagtgttttgatgccatgatgattattgtctcaaaagccacttgaattctagacctattagttggatgtcataatttttcatatgtctagaaagaagaaagtttggtccaataatttgatacaccaagcatctggctattatgtgaagaaaaattatatactaaaggtcgatgcttgatttcaaaggtttggacgaaattggcaaagtcatagaccaggggcggtctgaccggcattgcacggccggtctgactggtgataccggcgctctgaccggctctgcatggccggtctgaccgggtagacagggcggtctgactggcattgcacggccggtctgaccgatctcgagcagagagctaggggcacgttacaattgattaaaaggccgaattaattgtgaattcggacatttgtgcccatgagttagaaatagcttggagaattccttagattagatatttgaaagatcctacatttatggttgatcgaaagattcggtggcaagtgttcaaatattatatcgccgaaaaatagatggagtattacttagataatgttcaatctaagttgctaggagagtagtacatgaagggattcgtgaaattcatcaatcggccgtaagataaattggttgcttaggagagtggagtttcattggccgaaaataattgatgattgtttcaaatgctatag

SEQ ID NO: 65466 - DNA, 4290 bp, Oryza sativa
ttgatatatatatacttaccaatcattcttattatttttaatttgttaaacttattcaagataatgtattgaaaacactaaataatttagagtcaaaacttccaggttggagctcactactactactactacacaacaacacatatgagatatttctcatctgcccaagcttccacgtgtgaaacaaatgaagaaacggtacatatgggaccacatatatgtcgcttccccaaaatgatacagcctaaccaaattacgtgacggcgggaaaaaaaaactgaaaataacagaaaaaaagaaaaacaatagtagattgataatttattcggggatcctaattgacctattacatggaacgtattgtttacacccaaatttagcacctatggacgaaataggggaaaattgccaaagtttggaaagtgacgggtttccttactcgggaaggcaggtttcgtgttttctttggtttctatcctgagttggatgtggagaagggcctgtagaggacaagaccaacccctatttaagggacaaggccggttcattgtaaaaccccccaatacaatctacttgaatcgttcttttactatgttttctattttaccctagtttagtccatctttgtcggtttgcgccgtaaaccgtccgccgccgctgcgagagtgcgacacctctttgtaggtttgtcctgaaaaccttccgttttgcccacgagacgggtagttatcctcatatcgatctaaatcggcctagaaactgattttgatatctaaatcggctccgctagccggtttagcttttctttttgcaaaacccatcttgatttggccctttggctagatcgaggtggttggcgactccatatcaccgcaaggtgtttaggtgttgcgatcgtgcttgtcgacttatcaaaaaaattatcaacacgtatatgagcacttctaaacaccgaacgtactatgtaaaaattacatggaaactccacgcaacacggctaaccgactacgactcaaattaaccgaaaagattattactcagattaatttcctttgttccaactcgcgcgctatgagactggattaatctcctttactgtgaacacacgggtgacacaacacacccgcccgcatcgcactttacctcggtcctcctcccgtagatagctcaacagcaatctttctctgcacataattcagctctgtccctctctgcaatcccgtgcagctaaaaacccagcacaacacggccatcagccttccaccactgctgtgtatatataatatacgaacagcaatgctactccatcttcacagctaccttcatgcatctatactggattgaaaattataacttctctcacccatgtgcttgcaaaccatcttcacgcaccagtgacgaatctagaatgaaaagagaggtggtgctcttaggtatactgcttaacacaagataatttttgctatagtctaatgctcacaaattatcaaattagtaccaaaccagagaaaatggaaaaatgatttgtgttcttgataaaaataaaataaattagtcgtcctaaaatctgaaattttgatttcctagattaccatggcctacggcctaggataggaaggcaccgaagtggcaccaaagtggcagctcttgttctgcaaactgctgctccagcttatggcctagtgctctgctaatattctgctactatgctctgtccggttggagctggggctttagccccaacaagccccaaccataaattcgctcttgtcacgcacccaaaatttgcacacatcatctcccgaatacattaactcctgcacatagaaattaaggttattttcttcagcaaattattaggcaattatactggttattctacataaattggcctgtctaaaatgaccgaaccataagccaaaattatgctactaacagatacgtgcaccttcagaaaactggctgagctttcttgtggtgatagggcaatggccatacttttgacctaaatcacccagcctttccatgctgttgtctgaacacgagccatcttgggacctactcaacgttccagcatgcatgaacagttgccagtagcaatcagataattaccattttcaggttcagatatcagaagacatacagagctttcaaatcttgctgtcttaacaaggatccagccatccaggtgttaggtcatgtccagaatgcctgaattcataccgaaatactacccccatcccaaaatataagagatcttgacaatgcaaatacatagctaaaatttatattttggatcggaggtatagtaccgaatagttcagttatggcatgaatcgagaaaaatcctggttcccaaaacagagcccttgagacacagtaaccgttctaaccaaaagtccaaaacagaggcaacagagcagctccatgagattggagacagtcacagtctgacagtgccagttgagcaaaaacaagatgcaaaccttgaagcaaaagaactctccaattctgaaacaattacaagatccatgtaataatagtaaaaccaaatcgttccttttccatatgtataaagttttctgttaaagcttgtcatcctaattataactttccctatataaaatcatctaagcttgttgcggcgttacatggtaaaaaagttgtccgggaatccaaactctgctacttgtatacacctccacgagaacctacttctcattcaacttcacatgttatggaggcttggaaaatacataccctgccagaagatgacaatccaaagctcctgttatgcgattatgctggaaatagttatgaatacaatgaagacaacaactcttaaaagcatgatagtgatgacaacggtgcaatctggaaagccactttagataaaccatgaaaatcgccaatccacgatgtagtaaaaaatttactaacatcaataatgacagctcataaacatgcatgttgaaggaggatagcaccagatggtccttttagaaaatacataggtggcacaacttgtaatacaagcagtctatggaaagcactcgatcaaaaaccagtcccataatgctcaaaaaccgatagcccgatattcccattattttcaactaggaagttagccagcgcatatgcgcgggcacctatttaatgtgtttgtaataatacaaatgtttgagtgactttttactgaaatattttttactcaattctaaatctgttcttttttgccaacaattcattttggattgctttgaatgctggttttgattcccttctaattacccttaaagcaaataaagtctaaactaaacttacttgaaaatcgaaatttataaaagaatattgtgtcataagaatggagttggttaccatgaaattatatatcatttgtattatgtgtatttactttttaaaatatttagcacatcttatttttggattttctaaactttaattaaggtaaaattttattgtatgctatatatgtctttacagattttagggcatattaattgaagatattttctattaaaaatatggctaagagactgtttcatctaactatagatatacctctatttacttctactttctccgtctcataattccgacgattcaagtcatatcccaaaatataaaggttgtaaagtactaactgtcccatcgaaccacccctcatttattttgttcctaatcttacctcaaccatctttattttttatccaattttatctcaaccgccatcccactctctatgtatcctttatttaatgagagttgtcataattttttttcctccccttaattcctcctaaaatagcatgatcccttacattataggataaagatgatagaaagtatcaagagctgaagagcaccatttatagatggatttatttggtttgtttgtacctatgtagattaatttggccttgcatgtttataataatgtggatacgtgaactattgatttagttgtagcgacataatattttacttgtaagaacatacttaatatggatatttgaactatccaaaatcaagggtttaaatatggttatttaaagctcgatcaaatatttagcaagtatgctcatgaatttagggtggtcaatgtgcacacaaattgtgctgcccgcgcatatggacatgtgaaaaaacagggtcaggtgctctacgcaaataattagttaacactccctaccatccaacaatgcaaatttgtttaaaatatgggtcattaattcaaataaaaaaatttaagagttgtatgctttaaaa

SEQ ID NO: 65467 - DNA, 764 bp, Oryza sativa
tgtaatcaaagcctcaataggctatggtcaggcaccatgtcatacttcttcattggaatggaataatagctttctgcaaacttcgaaaatatccatctctgaacatgtgcaaagaggaaaaacatgcatggatcagtcttgcttcaatttaaccagagaaagcaaattttagcagtataattaaaacagaattgccataccaatggagtcaagagggtggccaagatgctaaggagtaagccttcaccaggcttgtgaataagaagctcagaaaaccgattaagatacagctttgagatgtggacgccccatgcaaaatagtctggtatgatccaatgctttgttcggaccaccattgtacatggaatctcagtacctacacgaagaagaaacacttagtaagtggggaaaatttaattcagcatctaaagttgcacaagagaaaaaatactgaaaaaaatggttggaggaaatcagattgttaatttgtcagtaccatttacttctgcacattctgcagcaatgtcaagtgctgatttgaggtagccaacgatcgtgacacgcttgcccttgatcatttccttagaattcttggtgcccatcttggagtaatccatggagtggatcacctggccatcaaatgcttctggacctttgcctggaaggaaatgttggtatgttgggcactccactgaacctcccaatacaaagtatgacaaaatccgccttgtgtgtctggaatatgagaaagttgagtacaatgt

SEQ ID NO: 65468 - DNA, 10025 bp, Oryza sativa
tgcaattcggagtccaggaccagtctgcactaaaacatgcgcccaggtcgcatacgtgctcggattggggcgttctttatatggatggaaagctaagaagatatcatttccaatggttttggtcccacgtccaaattatttccgagtcaatgggaattgaccgaacaatttgatggccagaatctgtcccggtattacgtcaccgtatttgggcctttggcccgtgtatcgtgttggaacccattagggttgcgtcgagaggggtttgtacgaccctaaactctatttatcagtacccgcagacatctttagctttttgggttttgcttagattaatctgtcgagaacagtttggccgctagatcggtttgtaagaccccaactcgtgagcttaatcattcatctgcaattttggttgtttttctatctcgttcttgttattgttcttcgattggcaaacaaggattggccttctcagcgaggtcatccgcgttttgacacaggtgataaccagaggagacgtagtgctgcgattgcggggctcaagagcgtgcgcgttcaagaagcaagatcgatttgtgtcgcgactccgcccaaatcgttgtttatcagaacctttcgggagatcgggaaccctagtgcacatgtaaattcccctgtataaccaaaaccctagtggtaagaacctttaatgggggctataaatagtcccatagggggatccaagtaaaaatttctcaaattaatacactatagagtaaccacgtctttcgacgtatgcggttgtcgtttcgacaacagctggcgccgaccgtggggacctccgagcgaaaccactgacagcgaatgccaccgaagaaggtcgtgaaggaaaaggttacgaggcgaaaggaaagcgacgccggggcggacatggccgccgaagagggagcagagccttcggtgcccgttgccgaagatggaggagcgccatctgcttccgcacctgtgctatcactaccgccttcggcccctaccacctctgtgcaggtgccgaacgcggccgacatgacgaaggctgctgcggcggcaagggcactccagaccagggcggagatcctttcgacaagccaattgttggtgccacaagacgctccatcgcagccggcagcggccccaaccgcactcgccgccgtgcaggccgtcaaccatgaccccgaaacacaaaccgaagccgacatggaagccatgcgacagaacatgacacgtctccaggacatgcttcgccagatgcaagagtaacagtaagcatacgaggcggcgaggcggaccaagatcacttcggccccaatcctccagtattcggtaggctatgttccacctcaggtttatccacaagtgacgacccagccccttccgccacaagtcgcgcaggcgccaatgtacttcgtcgggcagccgtcgactgcagcagcgcatccggcccctcacgtgcaactgcaacctcaaccggtcgctgcccaagtacaccctcaaccacttggccaagtgccgcaagcaatggcagaaggggcttcggccctgcaggcgcagttccaagctccttcagcagctcaaccaaccccacatttcaagtacaaccccatcggctcgcccggaggggaatacaagtcaaggtgcgcccagttgtttgccatcaaatcagccaagaatgggggcttcgctgtagagtcaaggaccgcagttcgactttatcaatgctgctcaggcgccaaccgtttggccgcaagcaccaacgccaggcttcggagcaagccacgcaccaacccaggtcgccatgacatggtcgcagccaatttttgacccatccatggcggctcagcaagcgtaaccaattggagctaggcagccgaatgccatggcccaacctcacgcgcaagccgtgatttcgcccttcgccacgccgtacccacagcaaggtgtcgtgaaaagggcggggggcaaaaaggggctaccgctgagtgggggaatcaagacccgtccaatcccaccccaattcaagttcccacccgtcccacgctactcaggagaaaactaacccaaaagaattcctctccatttacgagtccgcgatcgaagcggctcatggcgacgaaaataccaaggcaaaggtaatacatctcgctctggacggcatcgcctgctcgtggtatttcaatttgctagcctatagcatttactcatgggagcaattgtgcaatgtctttgtccttaactttcgaggtacctatgaagagccgaaaacgcagcagcacctacttggtattcgccagaggccgggggagtcaataagggagtacatgcgtcgcttctcgcaggcccgatgccaagttcaagacataaccgaggcgtctgtcataaacgctgcttcggctggcctgctcgagggcgaactcacaagaaaaatcgccaacaaggagccacagacgcttgagcacctacttcgcttcattgacaggttcgcaaggggcgaggacgattccaagcgacggcaagctattcaagctgagtacgatatggcttccgtcgccgctgctcaagcccaagcacaaagtttaagttgccgaaccacctcccctcgctgttcgccaaccccagccggcaatccaaggacaaccgccaaggcaaggtcaagcccccatgacctggaggaagttcagaaccgaccgtgcgggcaaggatgtgatggctgtcgaagaagtgcacgccctccgcaaggagttcgacgctcagcaagcaagcaaccatctactgcccgtccgcaagaaggtctgaaaagacctctactgcgccttccacagacgctcttcgcacaccacggagcaatgccgaaacattcggcaacgtggtaacgcacaagattcaaggtcacagcagggagcagcggtcgaagcacctcgcgaggtagctcaagaacaagcacccccggccgaacagcgccaagatgcacagcgcagaataatccaagtgattacaagggctgacccgctaacccaactgttgaagcgacaaaagaagatgcagctacgaacgatccacaacatcacttcggcaggcgaaggggctccgcagtatctgaaccaccaaatctcttttgggcctgaatatgccgaaggagtaatgttcccgcaccaagatggggttgactacccaagcccttaccccagcaccagcatcacttcgaggcttcggcggagaagcagttcaagttcttggccaagcacagttgatgatagccttcggcacaggggaaaacagatgcaaagagcaagtattgttcgacgttgtcgacatcccgtacaactacaatgccatcttcggccgtgcaaccctgaacaagttcgaagccatttcccaccacaattatctcaagctcaagatgcccggcccaacaggagtgatcgtggttaaggggcttcagccttcggctgcctcaaaaggtgatctgaccataatcaacagagcagtgcacaatgttgaggccgaaccgcatgaccgggcgaagcacgtgccaaagcccgcccctcacggcaagatagccaagatacaaatcgatgatgccgaccccacaaagctcgtatcgctggggcgacatgggcgaagaagaagccaagaaaatcctagaggtactcaagaagaacattgatatcttcgcctggagccccgatgaagtgggaggtgtttcaacaaaatctcatcatgcatcacatagtagtcaagccggatgccaagccaaggaaatagaagctgcgcaagatgtccgctgatcgccaagaggcagcaaaagccgaagttcaaaaattactcaaagctggggtcattcaagagatcgaccacccagaatggctggcgaatccagtgctggtgcggaagccaaatggcaaatggcgcatgtgtgtcgatttcacagacttaaacaaggcatgtccgaaggacgatttccccttgccacgaatagaccagctagtggattcgacggctggctgtgaactcttgagttttctagatgcatattccggctatcaccagatccacatgaacccggccgacatccccaaaacagccttcatcactccatttggcaccttttgtcaccttaggatgcctttcggcttgagtaatgccggagcaaccttcgccaagttggtgtacaaggtcctttgcaagcagttggggcgaaatgtggaagcttatattgacgacaccgtcttaaaaagccgcaaggctttcgaccacgcgtccgaccatcaggaaaccttcgacaacctgcgcgcagcgggcatgaaactgaatcctgagaagtgcattttcggcgttcgtgcaggcaagttgttgggtttccttgtttctgaaagaggcatcgaggcgaatcccgagaaaatcgatgccattcagcaaatgaagcctccgtcgagcgtacgtgaagtacaaaagctcgcaggccgaattgtggcactcagtcgattcctctcaaaggtagccgaaagaggtttgcccttcttcaaaaccctccggagcacgggaaaattcaattggacacccgaatgccaagcagcgttcgacgagttaaagcaatacctgtaaagcccgccagctttgatcagcctagcaccaggaagcgaactgctattatacctagcagcttcgatagtggcagtcagtgctgccctcgtccaagaaacagattcaggccagaaaccggtctatttcgtctccgaagcattgcaaggagcgaagacaaggtacattgaaatagaaaagctcgtctacgccctggtgatggcttcgcgcaaactcaagcattactttcaggcccacaaagttatagtgccatcgcagtaccctttgggagaaatactccgaggcaaggaagtcactggccggctcagcaagtgggcggcagagctatcccctttcgacttgtattttgtcgcccgcactgctgtcaagtctcaggtgctggttgacttcgtagccgagtggacaccagcattcgcccccaaacccgagccggtcgaatagccttgggtgatgtactccgacggttcgtggtcgcacaggggggcaggcattgcagtagtactcacttcgccgaatggtgtgccgattcggtatgctgcaaggctacagttcgaaactaccaacaacgcaacagaatacgaagctattcttccgggcctaagaaaggcaaaagcactggggttcggcccttactaatccgaaccgactccaaactgttgcaggacatgttgacaaatcctttgaggcaaaagaagaaggaatgaagaggtatttggaggccgttcggtctatggaaaaaatgcttcaccggcataacggtcgaacatttgcctagaggccagaacaaggaagcagacgccttggcgaaatctgctgcttgtggcggcccacattctcctggcatcttttttgaagtcctgtatgcaccaagtgtgcccacggacatcttggaggtcacgacaatcgaccaagtgaaactgggcgaagacccatacaactggcgtaccccatttgtgaaacaccttgaaaccggatggcttccggaagacgaagcagaagcaaaatgcttgcagcacagagctacaaagtacaagatggtctcgggccagctctatcactccggggtacttcaacccttgcttcgctgcatctctttcgccgaaggcgaggaaatggcgaaggagatacaccaggggctatgtggcgcgcaccaagttgcaagaacagttgcctccaaagtgtttagacaaggagtttactggcccactgtgttgaaagtctgcgttgagcaaatcaagaaatgcgaaagttgccagcgtcatggccgaagccaaaccgcgcccaagtatgagttgcagcccattgcaccaatctggcctttcgccagatggggactggacatcattggaccgttcccggtggcgcgaaacgggtacatgttcgcaattgtggcggccgtcgaatacttctctcgatggattgaggccgagcccctcggagcgatcacttcgacagcagtacaaaagttcgtatggaaaaacattgtttgccgtttcggagtgccaaaagagttcatcacttacaacggcaagcagttcgactctgacaagttcagggaaatgtgcgaagggcttaacctggaaatcaggttcgcatcggtcgcacacccacaatcaaacggggcggccgaacgcacaaacggcaaaatcctagaagcactaaagaaaaggctcgagggggcagcgaagggcaaatggccagaggaaatgctgtctgttctctgggcccttcgaacgacccgtacaagaccaaccaagttcagcccgttcatgctactttttggcgatgaagcaatgaccccaacaaagctaggggctaactcaccaagggtgacgttctccggggacgaaggggggcgtgaggtgtcgctcgaactcttggaaggggtaagagtcgaagcactcgaacacatgcgcaagtatgacacaggcacttcggcaacttacaacaaaaaagttcgaccgacagagctgttgcctggccgatcgttgtaggcaagcttgaatcaaattgggaaggaccataccttatcaagcacaagtccaggacaggatcttttcgattggcgacactagaaggtgacgagttcaaccattcctggaatgctgcctctctcaagcgcttctatgtctagaacgggtggcacccaaatcgccaacttgtaaaaatgtacatattgtcatattagcccctcggcactacgtaacccccttggcactatgtaagcctttcggcaagaaaaaaaaagaaaaaaagaggaaaatgagaaaagacaaaaaaaaactggatgtagggctattatccactacggaggcccgaaccagtataaaacctctgtgtcctccgccttctttttatttttgtgtgattgacagtttgtcgaaaaaccccaaggcaaacgcctgatcagcgaaaaaggccagtgggcgaaacgaatcggccgaagcatcgctcgccgaacgttgaaaccgtaacagcttgtttcgggaaacaactaaccgaacaccgttacactccatcaaaaggaaagcacaaaaagctccttacaacgtggagcgaaactgatcgaaaacggaagccgaaagctgaaaagtcaaaacccatttcgctaatatatgcaaaggggccgacacattccgacccaacgaaaagcacacgaagtgacaatgcaaaaatagcgaaaagaaaataaaaaacacctttattgatttcaagtaaaaatcaaagtatacaaacctatcacaatggtacaagtgaaaaagaaaagggcaatggtgtcacggcccagctcacagataaattacatcttcgcccccgcaacctctctctctctctctctaaggagtggttagacgaactaggttcgtcatcactactaatatcatacgcaaccctaagatgagtagggggcgaaacacagactagactgtaacgacgctgggagatcgcctcctgctgatcagtcttctgatgatttcgccaaaagcgagccatatcctccaaacgtcttgagcgaacaaaatcgtagtcttctaaggttcgcccggggtgcgcccgcagccagccggcaaccttaaaaacattatagctgcgaccgtttatcaccatctcacggtaaacaggccgaaatgggcatcgcaccttcggcagacccttcaatgccacaaatttctcgtttgactccaccaactcccagaagggggccgaatgcacaactttcggcgaacaccctggtagacagtgcaaaaagagcaaaacacaatttacatagtaagaataggcgaaaaaagggaaagtattgtataatgcgaaacaggcgaaatcataatacgccaaagacttcaaccaccaaaaagtggctaaggttgagttgtacattccaaatatccaaggggcccttttttggctacaataagggggattagcggcagcctgccgaatatacatcgttcgcctctccaggcaaacacaaaaagaaggaaaactacaaaaatctaaggaaagggcggagggcctcacacctctgggtgatcctgggcatcgcctccaccctctttgtctgccgcgtcctcttcctcgcaccggactgccgcccccgccttcgccagttgctccaaaaggcgtgccttggcagtggaccggccttccttctgccagaaatgttttcgccatgcacgaaacgcgggtgaaatgttctgcgcactaatctcccagtcccctttcgcatagttagggaactcagcgacgtgctcacagccgaactgttgcaaaaggcccatagtgaaggccgccgatacgcgcgagcagcaatcgccgtacgtagtggcgcagtccgaaaccgaaccaccaacctgctaggtccactcggagaagtctaaagctgaggcatcttcagcagggacccctcacaccttcgcacccatgtcagtaagggcgaggcgcagcgtttggcacgccgttttcccggactcggttgtttttgccatctctcgagaaaaccgctgcgactcctccacagcgcttgcttcagccttgctgaccttcaggcgaagagcctccatcttcggctcagtgaggttataatagtcggtcagcgcagcggaatgggccttttctttctccagttcagccttgaggcgatcgacctcggccctagcctcgtttcctttctcaaactcggattggaggcgcctgttttcggttttcgcctctttgagggtgttggcgagggcctccatctccaagttcttgcggcctatttcgtcatccttggcccgaagacggttcttaaatccgtcaagacgggcgcgcacgattcgttctgtcgaacagtgagccgcaagaatctggatgcaagataggagcaggcgaagagaacaaaatgtcaattatgagacatgtaaaaaaaagaggagtggaaaatcaagaagagagaagaagcatacccgaaccgccaagcttttaatagcggaacacccctcatcaaactcattcagttcggtgaataggcttagggtgctggcaggcaagacaagattgcttactccctcgacaaagggaataagtcgcccgggtctcgaaatcgccaggggcgaagtggggcgccgcaagggaatattccgaggcggatgtttcggcggccgcacccttccccttcgttttgaccagaggcgaaacaaccggttgacgcgaagggctgccgaagaccctcgtcgcagccgtcacgatccattctgcggaagctgaaacctcggcagcggcgctaccgcctgccccatcggcaccgagtgaaagaatgggggcggtcgaaaggtccaggctgcggccagcgggcgaagtcggagtctcgtcagaagactcgtcgtcgctgaaaacgcgagcgacatcgacgagtcctctccttttggagatcttcttgaccggacctcccttcgccgccttgcctgacgaaaacgcaactagcgtcttcgccccctccaaatcctttcgtcgaaggggggagctgttcgactccaccccggtctcgttgtgacctggacttggagtaggagtgtagccaggggtgtcgacacggtcttcggccgcctcgttcgtgaccttttcggcaacggcctccgcttcttcttcttcctctccttcctcctcgccgtcaggctcttcgacatcgtcctcatcgtcggcgtcagaatcggaggaagcaggaacccttcgcttcctgggggcaagcttcacttgtccgcgtgttcactttcgcgaaggtcctgtatcgtcgtcagctttgtgggggttcgcccggggaggcaattcgccgttgtaaacccggttcgcccggccggctgcttgtcgtgtcagcaactggctgtactcgacgaccgacacgtcgccgatcatcctacgggcttcgg

SEQ ID NO: 65469 - DNA, 4551 bp, Oryza sativa
ggcaaaccatcacactcttcgccttgatcaactacgacttgccacgattggagaggggaaagatgcgaagcatgaaattcctccaccaagtcgcggcagctaaggcgggagcaaaccttacgtagcagagcaaaccgtgcctccatagcgtcgtccatggcgatcttgggtttccggttcgatgcaatcgccctggcgccggcacaggagggctttcgctgagtcggagccagcctcgaaggggatggtgtggtagaaccacctcgccatccaatatccatcccacttcgacatggcggcgttcaccggccagagatcggatcgctcggggcgaacattaaagttaatgctcccgaacactgtcttcttcgtccctgccagggtaatcaccgtcttcgagttcacggtggcagaaaatattgcaccgaaaagttcggcgctaggctcaaatccggaagtccgtgtcacgtcctaaatatcctaaatatataaactgtggtttaaatggaatttttagaaattattttaaaagcctacaagctaaactctaattttctaggaaaattttcaacataaaaatgagctacataaaattttattaaatactatgcttgttcctctattttctagatttttctgggaattatttgagcaagggaagtatttttaataattgaaacaacatttcacaaattgttttatttgaaaaagttcaaaaacctctcctttaggttattgggccgattttggcccaatactccctctttcccgcgcggccgagccggcccaagccggcccaaaccgtcgccgccgccccctcctctcgggagaccgacatgtgggccccacatgtcggatccatccctaacctccagccgccggctcaagccgcccgagccgcctccttctccctccaaatccgcctcaatccggcctccttgagtccgattgattgaggggttttgatcctctcgttctcctctatcttttcccccaagtttcggagcaaatcgttgaggattttatccgaatcgagttcgtttcgattttatccctaaaaccgagtttggatttttcccgagtcgattcctctcgtttggagtccgatctcttcaatccaaggctataaataggaccacctcgtcgtcctctttcgtttgccccctatcccgagctctctagtgccccgtagcgtcgccgcatcgagctccaagtcgccgccgtcgccggccatcttccggcgtcgtcgcgccgtcgattccgccgtcgccgccgccttttctcgtcgccgttaggtgcgccgtggtgaggagaacctcggccgcccgtcccccttcgccgccgaccaccggagctccgccgtcgccgttaacccgagccgccgccgccgtcttcctcgtcgccggccgtcgtcgttcgtcgtttgccgttgtggtgagtaccatcgggttcgtctcgtcgtcctctacgcgtagatgtcctccaaatccccggccgaccgtcctatctccggcgagcttgctaaccctagccggccggccatggatgacgtcagcatgacgtcatcatctccttttttctttcttttttccaattttctaatagattaaaacttcggaaaatcataactaaataaccgtagatccgtttcaggtggttcaagttgctaaatttttctaaaatcaagatctacatgttaaaaatatccacatgtactgtttatgcttgtttttgtactgttttgttgatttttgtttaattgctttagtttccgacgttccggaggagagcgtttccgttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccagttaatttatggctgaagatgactttattttcctatgggttataattggattagcatgaaccttatatattggattggttcagctaaatgctatatgtaagtttgcttagccatgcttagaaacattagctaactaaagggattaattataaactatgttacattattattattaattatggttacattaaatggtagctcacgatggtaaatcgtgtgatgttaattaattgataattaaaacctggttaaggtgggttgtgagcatatggttttgatggttgtgctcatgacaattaagaccggttcgcgagctactgttgtgaaacatttatcgtgccaaccacaagccagcgtgggcaacggctttatcttttgtatagcgtgattctttatagtgcgccagactgagaagtggcgagaagtccacgggggtcgctggggagtccatgccttgtttataagggggtgattatgatccaggaaaggtgtgctgtaatgggttatgttgtgcaaggggtattgtcacaactcctttccgaggtaccgtggtggtattgaggcacatggtaacatgatgtggggttgtgtcttgtgggtacagtggtacacctctgatcagagtttaatctattcgaatagccgtacccgcggttatgggtgagttgagcaatgtttttcgtgattagtctcacactactcattagtggtaataatgtggtaattaatttgactcctggtttggaatggataattcctggtttggaggtttaatttgttcaaccggggttggttgttcaaatgtggttgggcctatgcaacatgggtgtgttgtatagtgtttatttaatattgattaattatacaactgttttactattctcttaaaatatttactaaatgctgtttctgcaaatgagctatattatgccatcctttgttatcctgtgcacttgcatttttgctgtgtgacttgttgagtatgtcatatgctcattcttgcaatattcattcatcagaagaggagtatctcagtgaaggtgatgatctggaggattaggcttgttcttggttaagatgcctgtggagtagagtcgccatagctgttccgtagtttgttttagttttaattttccactgcgtagaatgttatttttttgagaggaactatccacctctgtaatattttattatttgcgaatgttaaatagttatttattcgtactctattattaatttgtcattgtgtgcctcggttgattcctggacgagggtttaacacacatgtaagcgtttggaattttggatagaaattccgggcgtgacaagttggtatcagagccaccttgaccttaggataagccaaatggtaaaccttaagtagccttcaaaatatttttgaaaaaaaaatagaactgctcttctctattctcttataaattaaataagttggcagcacatgcaaggttatgcacaaaatttatttaaatcaatttcttttcttttaaaagcaaaaggttgttcttctcaaaatgtttctttttctctttaccaaatcttattgattagtcggcactgtacatctattatggtatcgatttaatcatgctggcaccagtactactcatcccctttaatggtgacattgtaccgtgcttatagtaggtcttaagtattctggttttattttattcacttgtccaaactgatttttctctgttcaaaagttaaattcaaaaagaaaaatatataaaatagttttgtatgtgtcttttcctttattttcttttcgtttattttcttcctttttggtcaaaatcaattaagtctagttggtgcagctaacttaaaaatatgcattaattcttctcttctatgtttctttagatgccgccccattcaccgagaaatttgatcaggtgttaggattcgtcagggagctgaggttgatggcttttgaggtaggctatgaagttgctcctgagtatcgccggatttcccatgaccccgacgaggagaagtgtcgtgttcgtgtaacgttggctagtgatcgtgaagaccttccgtccattaagttcgaagctggaggaagatcgtacagccaggcttgtcaagaagcagctctggtggccattggagagttgcgtcaacgctttgaagaagagttggattcatcagctttccagtatcatcctcacaagcctcatggtcaagactatggaacctatacctgtcctgatggtgaagagagtgccactctgatgcatgcggtgcatatgcttagtgctatggatgcagtaagtgtggagcgagacaaagcagctcatgacagggaaaattggaatcgaggcaagatttgcaagttggagagcaaggtgtatcgtctacagaaggaattagctgaacttaaaggagaaacgccgcctccaacacccaagcttcacctcatcgcaagaaagagaacctgtccgccacctcgtctccagttagcttcgaagattcgcgtgatgggtgaagctgtgcccgatcgtgctgaacctgtcatcgacatcataagtgatgaggaagaagaggaagaccctgaagaaagagagccagctact

SEQ ID NO: 65470 - DNA, 4465 bp, Oryza sativa
ctccgctctaagggtgtctctctgtcgtttctttcctgttgtctctgcttatcgtcagatggtgaacacgcgcactggaactggaagtggaagtggaagtggaagtggagctactaacaatggaggagatcccacgctagctcagattctggcccaacaaacacaactgatcaatctgttagtgcagcaggcacagaatcagcaggcaaacaatcagaaccagaatccacccccacctccccaaaacaagctggcagatttcttacgtgtgagaccccctaccttttcaagcaccaccaatcccgtagaagcaggagattggctgcatgcggtggagaagaagttggacttgatccagtgtactgagcaggagaaagtttcttttgcttcgcatcaactgcatggacctgctgctgaatggtgggatcattttcgccaaggcagggctgaaggagagcctattacgtggcaggaattcacggccgctttcaagaagacgcacataccagcgggtgttgtagctctaaagaagagagaatttagagcactcaaccagggatctcgttcggtcaccgagtacctccatgatttcaaccgtttagctcgctatgctccagaagatgttcgttcagatgaagaacgtcaggagaagtttttagagggactgaatgatgagttgtcttatgctttgatgtctacggattttcgggatttccagcagttggtggacaaggcgattcgtcaggaagacaagtataaccggatggagcagaagaaacgcagggctgcccaattcaaggcacaacagggcagtaaccagaggccgcgtctcgttactggacctcaagctccatcgtaccctcaaggaggatcttcatcagttgtccgctcccaacgccagttctacaacaacaatactggtaatcgtggcaatgacaaccgcaacatggttgttcgtcctgcagcaactccagttcagaaccagcccgttaggaaggaacagggaagcaagccaggggtgtgcttcaattgtggtgatccaggacattatgctgataagtgtcctaagcctcggcgcgtgaagaacgttccagccccgaacaactccaatgctccagcaccaaaggcacgtgttaatcatgttgcagcagtagaagctcagaatgcaccagatgtggttttgggtacgtttcctgttaactctatacccgcaactgtgctttttgattccggtgctacacattcctttttgtctaaaagttttgcgagcaatcatgggatggaagttattagtcttgggagacctttactagttaataccccaggcaatcaagtgttttcgacacagtattgtccttccgttattataggaatagaagaagttcttttcccgtcctcccttatcttgctagaatccaaagatctagatgttatcttagggatggattggttatctcgtcacagaggagttatagattgtgccaaccgtaaggtgactttaaccagtagcaatggggaaacagtttctttctttgtgtcctctcctaaatctcatggggtgatcttaaaccaagttgctctacaagagatccccatagtacaagactacccagacgtgtttcccgaggatttgccaggtatgccacctaagagagacatagagtttcggatagacttggtacctggaaccaaccctatccataagagaccatacagaatggcagcaaatgagttagctgaggtgaagagacaggtggatgatttgcttcagaaaggatatatcagacccagtacttcgccatggggagcaccagtcatctttgtggagaagaaagatcatactcagagaatgtgtgtggattatcgagcgttgaatgaggttaccatcaagaataagtatcctctacccagaattgatgacctgtttgatcaactggaaggtgctacagttttctccaagatagatctccgttctggatatcatcaacttcgaatccatgaggaagatataccaaagaccgccttcacaactcggtatgatttattcgaatgtaccgttatgtcatttggactcactaatgccccagcctttttcatgaatctgatgaacaaggtgtttatggaatatctggataagtttgtcgtggtgtttattgatgacattcttatttactccaagacgaaggaagaacatgaagagcatcttcgtctagctttagagaaactacgtgagcatcaggtttatgccaagttcagtaaatgtgaattttggttgtccgaagtgaagtttcttggtcatgtcatctcgtctggaggagtggcagtagatccaagcaatgtggagtcagtgttaagttggaagcaacccaagacggtttcagaaattcgtagtttccttggacttgcggggtattaccgcaggtttattgagaacttttcaaagatcgccagaccaatgactcgtctgcttcagaaggaagtgaagtacaagtggacggagggttgtgaacaaagtttccaagaactgaagaaaaggctagtgactgcgcctgtgttagttttgcctgattcgaggaaaggtttccaagtgtattgtgatgcgtcccgacacggtttgggttgtgtgttgatgcaagaaggaaaggtggttgcatatgcatctaggcaattacgtcctcatgagaataactacccaacgcatgacctagagttggcagctgtggtgcatgcattgaagatttggcgtcattatcttttcggtaaccgtacagagatatatacggatcataaaagtttgaagtacattttcactcaacctgatttgaacatgcgtcagcgaagatggttagagttgattaaagactatgatatggaaatccactatcacccggggaaagcaaatgttgtagccgatgctcttagcaggaaaagctactgtaatatgtcagaaggtcgacgtttaccttgggagttatgccaagaatttgaaaagatgaacttgggaatagtcagcaaaggttttgtggctactttggaagctcaacctactctgtttgatcaagttagagaagctcaagtgaatgatcctgatatccaagaaataaagaacatcagaagccagccggtctgttacaaccattgaagattccagagtggaagtgggaagaaataggaatggattttataaccggtctacccagaacgtcggcaggacatgattctatttgggtagtggttgataggttgacaaaagtcgctcacttcataccggtcaaaacaacctatacagggaataagcttgcagagttatacatggccagagtggtatgtttgcatggcgttcctaagaagatagtgtcagatagaggtagccagtttacttcgaagttttggcagaaattacaagtagagatgggtaaccgtttgaatttcagtaccgcttatcaccctcaaacagatggacagacggaaagagtaaaccaaattttagaagatatgttgagagcttgtgttctagattttggtggaagttgggataagaatttgccgtacgcggaattctcatataacaacagttatcaagctagtttgcaaatggctccgtatgaagcattatatggccgaaagtgccgtacgccgctcctttgggatcaaaccggtgaacgtcaagtttttgggacagacatattgcgagaggcagaagaaaaagtaaagattatccaagaaaggttgcgcgttgctcagtcgcgtcagaagagctatgccgacaatcgtcgcagagatttggctttcgaagaaggagattatgtataccttcgggttacgccgttacgaggtgttcatcgtttccaaaccaaagggaaattggcaccgcgttttgtgggaccttttaagatcgtgagtcgaagaggtgaagtagcttatcagttagagttgcctccgtcaatggcgggaatacatgacgtgttccatgtgtctcagttgaagaaatgtttacgtgtacctacggaggaagcagatcctgatcgtatagagcttcaagaagatttaacttatgttgagaagccagtcagaattttggaagtaagtgagaggaataccaggaatcgcgttatacggttttgcaaggttcagtggagcaatcattcagaagaagaagccacttgggagcgagaagatgaattgaagtcagctcatccttatatgttcaccagttcttctgaatctcgaggacgagattccgtttaacgggggtaggtttgtcacgtcctaaaaatcctaaatatataaactgtggtttaaatggaatttttagaaattattttaaaagcctacaagctaaactctaattttctaggaaaattttcaacataaaaatgagctacataaaattttattaaatactatgcttgttcctctattttctagatttttctgggaattatttgagcaagggaagtatttt

SEQ ID NO: 65471 - DNA, 6287 bp, Oryza sativa
agaaattccgggcgtgacagtccggcacgcccagttgaagatagcgatccggaccagcgccgatgggctcaattgtgggagctccacctagaaaaggcgaaggatctccggcaacaacgcgctgcacggaaaccggagccccgcctcaaaaaacacggcgaacaccaccgttcggttgtcgacgggcttcggtacaacggctttccccggggcgaaagcctgtccttcgactagcgccccagagctgaccaacttcgccaattcaccgtcgtctatgagagagatccccaaataagcggtggagtcgtcgttgatccgttcaagatcgggccctttcgccgaagaggggttaggcttgcggggagccatgacgaagggtgtatacagtggcgaacagtgtgtgcagtggcgaacaaagggagcgaacgaaaggactgaagagccgaggagcgccgagagaagaacggaggaagagcgcgtgcgcagtgaaagtgactagtctggcagtaaaaagagaatgggagggggaatatataactcacctgagcgacggttcgcctacccaccagtaataaagcgccacgtgtcgcgagggtaggcgaaacggtaaattaccatcgaccgagctacacagtaaaaagcccgcaaagggaaggcccattactgttcctttctgcccaggaaaaataaaaaatatatatgccaccctccgaaggaggcgaagagcagcaaaataatatcagccgcacagataacaaactttatttgtaggaacaatgtaggtttcggcaggagcatcggtcgaaagggggcgccacataccataccacatggtttgcacggtctcggccgaagctccgatctcacccttgcccgtgaggggcttgttggcagtgtggcatgaagcccttcgaccaaatctaccaaaaccatgcgaacagtggagattcgagcccgagacatcgacgttagacagggcgaagttcccccatggcgaagactatggaacaggaacggcgaggggcgagagatcgtgcgagtaccttgtcaagccagaggcctcttgggcgaagggtgcaaggcgaagagtatataccggaggaagatgacttcgccacagcaagttcgcccccgcgagtgccgaagaagcctttccgacccatcaagcccagggaccgtaaggccggcgatcgcccgacggcccaccaggggccatgagtccctattacattatgcacccatgtaaatgtcccttttataagggcaaccatgtaaattcccctgtataaccaaaaccctagtggtaagaacctgtaatgggggctataaatagtcccatagggggatccaagtaaaaatttctcaaattaatacactttattttccaaccactgttgagtaaccacgtctttcgacgtatgcggttgttgtttcgacaacacaagtgtagactaaaatgactatatactagaaaaacataaatgattcttttcttattctttctccacttagtttagattattattttaatgagagtagtttggttagtttcttctgtgtgtcagcctaccctatattcgaattgattaacccctgtattagactttgatctatacaagtgatataaattattagcatagtactcgcttatcatatcttcccttgagattaaataaatacgatactttgaaatacttccgggtgaaatgctacagtgatatatccgtgtgcttgcggattatatatgtaatcgttaagacataccaacaattataatattccattgaattaaagatccattggagagagatttggtctatgagagctattttataaaaaagaaatgtagtttgatacattaaaatgaagacacaatgggtaaagcgagtgtagcacaactagttatttttcttgtggtggaaccagtccacccgggtaagtactagatttgacgttggcgctcgtatttacggctaattattcttttactaataggcgatgaacccatcaacaacaaggtgctcgtggtgacttcgtctatctcaagatatgtcggtacagtcttccagaagtgatcataggcatagggtgtgctgtgtgcgttcataggtgagtgtaagcgcgttgtaagtgcctgagtttgtaatgtgttcttaaaaaaaatgaagacacaatggagtttgcgctcgcgcaaatactctgactcaggctcccaatttcaaatcttcccactgcagctgttgaagttcacctcagaggagggtagttcggcattcttcctatggagaagcgactgctctttcctcagttcctcacagcttggcatcatcgtcgcacaagactcctcgcggcgaggaaaggcgaacagatcttggctgaagagcaaaggcgaccggatcaggaacaccgacgtcgccttctccatcacacattggccttcctcttccccatctctgccttgccagccgtggagaaggatcaggggagggaggagagatgccgatggcggcgacgaccaatggccccacggtgacgccatcgtcagcatggaggaggccggtgatggtgcaaggtagagggagacacggacgtcctagtcaaatgagtgccgatcgaagagggaggaggcggtgacgacccagggaacacagggaagtcgtaaagaacatgcacaaacttctctcgcttttccacttctgatttttttgtgctctttttcttcttttttcgtagggcgctctctctctctctctaaacacctttctgtatttcttttttttttcctagttttagtttttttttcttcaacataaactgaccaaggacccaaacaaaatattacaagctggacttcagaattaaaatataaaagttacacaagctcaaatataaaagtgcaaaccaaaaaattagtggattacaaaatagttttgctaaaatactgtcaccacatttttggcttgcttatagtcgatttctagatcatttgatctcctctaagattcgtgctgtggaaaattatgggatataaaccaaacaatgatgcaagacgttagcagctataaaaatatggtgacaaatttttaggtaaaaatacatcaaatgtaattagtagtacaaatttacacagctattacattgcacttacacaccacttacaaatataatatataattagtatgtaattttgggacttacatatgtaattgtaggatttacatatgtaattttgagacttatacattataaatacactaaaattatatatgtaattaaaggacttacaatgtaaatacatcccaactattttttggtgaaaaatatggtgccataaatataactccctagaatcgctatatttgtggcgacatatttcttccctcatcccagttagatttctaatcgttggattggctttgcggtttatgctgacctagaccggaacccatctcatcatgtcccttgtcacgttgacaggtaaattaaaatggggaggcccaaaatttttgaacaatagcatttctcaacttaaaataacagtacgtgaaactaaaatgatatatataattttaaaactcatattgtaaatatactaaaattacgtatgtaatttataaattacaatgtaaatatatgctaactattttttcatgaaaaatatgtcagcataaatataggtagtcacttacaaaaatgaaaatccctcgtcgcatatgttccttttttgcattcagaactcgattccaaaatcgaaatattttaggtcacggtatgagttggaaccggattcgggagtaagagtaaactcctgaacgtggaaagggggatcaattaacttgggtcttgacgtgagtgggattgtggactcggtctcatatggaaaccggcatgccaagatggatctgagaggttgacatgctttggaaacatcgcaccaaaacatctccagtaggttcaatctgttagttcttgccgaaccaaactgatccagtcgttttttcatatcctcttcaaattctactgaattcaaaatcagcctatcaattcaagctggctctaatcgctttggttttagtcacattctgaaacctaccatgcacgctcacacatgcatgtgctccagttacatcgtaattgtagttacatgacaaatatgtactccagttatattagttacatcgtaattatatacatttaatttgacaatttgaccttttcaaaaactaatttcgcaaatgaaccgcggccaaaacttagttcaaaagtaacccttttgttcagcgccaaatcttatggcgctgaaaagggttacttttgaaataagttttggtcgcggttcatttgtaaaattagttttcgaatgggtcaaattgtcaaattaaatgtaattatatatgcagatcctgtgtatgaatgaattgagtggataattgcacatgacatgatgcatgcataatgccaaaacttgggagactcgacctgataaagtctcgcaaactagtcccgattaaaaggcattatacatgacaacaaccgcccgaccagccgcatagtgttgtttctatttcaaatttatcatcatatatgtttattgtttaattatgcaccaaggccaatgatactttaaatcacatcaatcaaaacaccatgcgtatatttcccacgatacatgcatcgattaaaatatcatgacaattacatcattagcatgcacacgttctcctttgatatattaattatatttcgatgaaatccgtgtccatacggttatataaggatcaatttaagaaattttggattttattatattacgatcaatttggaaaaagggagtatcgatggaacagcacgcggatatacatgcaccaggacggatcaagaccttagctggatataaactgcgacaatgatagcgcaacaaccatccataattaagcggtcaactggacagataagagcaggtacaatagtaggctataagccagctataaacatattttaaagagataaaagaagagagagaaaagcagcgggctacagatcatgtagctagctgcagcacgggctccaagacgtaatgtatgtatgacaggtgggaccagttatttatagtatagcaagtaactattgtatgaattagctattacatttgttatagataatttgaagctggtagtgggctatactattaaacttgctccaacgaaaataaccaaggcgttctgagcaatttacttggcagcttgacctttggtttcttgggcgtgctggagttggagagcgcgcgcgtggtgataagcacaagtacacgataaatgagaatccggaagggaaataacccaaacttccacctatgtggagattatgggtaccacatacccacatgacgattgacgagtatatccgactggttataggggataatttatacagatagaatatatttaggaaaagactcgggaattatgttaacttgtatatcaaggaaatatctcgtagtcttaattggttgcaattgtaatatatttgttagcctagttcgtaatgcatatgggctgcacattgtaatctcggctcatccccttatataaggaggggttggagtgctcctaggggcgtaacttttctcccggatcatcatatcaataatatactcggcaaaataattccccggacaggagtagagtattatatcttctaacacatccacttttttagcttgattgctatcccttttagtgttgccgaaattttgtttcgacaatctacatcataaattctctattcccggtgtagttccatccgtaggatgctttccatcattttcagtttcgcaaaatacagtctaaaaagaagagaaatttatttctagagctgtgctataaatttaataattagttcatcctctcaactaccaaccctataaattcccctccccaactcccgcgttcgccggtggctccggcccatgttcttttttttttttttagaattacacagtacaacgcagacactcacaacgcacgcgcactcacccctacaaacacacgcacgcaaaccctacccctatgagcatcttcgaagactgtgccggcaaatcctgtagagattgacgaagtcaccacaggcgactcgctgtcgacgggtacgtcgcctaccacaataaagcctactctagggaacggcaatgtatgtcctcggtagtcagtagctaggacggcatcaatgcagctcaatctcatgcagaaacattctagcagaaacattctagccgagtttagttccaa

SEQ ID NO: 65472 - DNA, 7216 bp, Oryza sativa
aactaaacacaccctctcatattcttttttgaagtagaagcacacgaactgctgtgaacatgatgctatgtttgaaacctcatattcttttccgcacacgaaaataagaaattccattagcatataattaattaaatatttacggttgtaaatttcaaaaataggtttatttgatttttaaaaggacttctatataaaatactttgcaaataatgtatcgtttaatagttaaagtgtgctagtgctaaacgagggagttgtaaaagataaatgagctttcaaatgcagccaattccgaatccacttaggtgtactccctctatttcatattgtagtgtgttttattgttgtttcaaaagcaaaataccttttcatcaagtttgtggaaaaatacatcaagataacgtcaagagtaaaaatacatggctggtggttgaagttgtattgtagtgtcacttatatccctatattgtaaaaatgcatatttagctccatgacctaacacagtaggtccaaacctcttttgaccatgtacaattgtcaacgtggtgttccatgctagcacatatttttgcaatcagccctctcagagggaggacaggttgcacaagagggcgagcaatgaacaccagcggtgaagccaatggaggaagatatacattggggtgaaacagatagaggtgtgcacaaaagaggaaccagtgcagtgatgaagacctcgagctctgccatcagcgaatcccatgacaccaaactacattgccgcttgatctagagggaaggagatcgaggggacaactaacatcgatgtggatccatggtgcctgaccgccggccctgccgacgagcttcaacagtgtgggatgaacatgaagtcgcctctgcatcgcacaagccgtcgacgggtccaccatgcctgagcaccagccacactagacatggtgctagcgaccatcggcgttgcctctgcgctgtcggacaggtggaggtgtgcactggtggctacatcaggaggggggaggagagaagggggcgatatacgtgaagaggaggaggttcacaccaccactacgctgccccacccatccctggcctccaagctctgcactagccaccctatgcatcggtggtgatggaacctccattaccttgctcatccgccgcacctgaccaccaccggcatcgctaagagtggacatggctggatccacacttgtgttcactgtctagcgtctactctcttgtgcaacccatcctattgttggggggaggggggtaaatgcaaaatgtgtgccagtggagcgccacatcagtagtgcagtcatacatggtcaaacgaggtttgggcctattgtgatacatcaaaccaaaattatgaatctaattatgtattttacacgatgtgggacctaggtgataccaccgtgtaactataagaaccgaccatgcatttcactccaacatcaaactagtttaattaaaatccaccataaaataagtcttgacagtgcatttatttagtattgtagatgtgaactatttttctataaattttctataaattgctagttgagattgtagtttgaactaagataaaaaaggagtaaattgcagtttgggtcatgtattttttacccttgttgcagcttggacaggatcttagtcatgattttcactttggactacataaccttgccatttgtttcactcttcaccacaccctcatcgtctccaagtcaggcagcccatcaccgttgcccctctctttgctgctattatcatctctcctaacatgttctcgttatgctatcaatgatcattagtatgctaatgaccaaattaaactaatcgtatcacctcacctagcatgctaattttagctatcaatacaagggaggacatggtagtgctcaaactcaagctcacgtatagtggcttcagctcaacgagctcaacgaggaagagaagagaagggagattgaggaaacactggtccaatctgaaacttgtgtgaagttgtctagtgcaaagtgcaaatattactttgcccctagtccaatgtgtaactctggtaataagaggtagcccaatgtgtaattcactcagaaaggagtaaatgagaagtagtaccctatgaattctgtgaatggtaggtagtactctataaattcttatatttgtggataaattttaatatctttacctggaacggacttgttgctgcttccatacagtcactagtttctgaaccgttgaataggcaaaagatttttaggacgacgattgctacagtgttagtgaaacaaacgttagttttaggagcatttttgcctcaagcatgtcgttgtagtatagtggtgagtattcccgcctgtcacgcgggtgacccgggttcgatccccggcaacggcgtttctttttcggcctttttaagtgtgttttcagcccatactgatttatggcccatgtatatacaatctaaaggtataattgcacttcaataagattacttgggtcccttaatttgttatcgagtctgagattcgtcggtacagctcatctcacaactcaaaataacatcttgaaccaaatataatataatggtcagttttggttgacacaagtgggacctactgagtctcggactcagtaacaaattgaggaacctaaagcgaacttataatattgcactttaacttactagtccaatctggtttgtatccatcaactgcaataccggatatcttgactcccaactattaggatatcttgactcccaactattaaaactggtgtaaaatgactctctcagtgaatataggcagcgtggtcggtaagcttctatcatcgatgcttcgccgttgccttctctccacttcccatgacatggcggtgggcgaggttgctgtgggcgacaagctccgagtctccttgaccctcttcttctcacaccttggcaacggccgaagaggctgcaggtagtgatctctatccatctcaaagtagggggtggtggcgagcagcgagtaacaacgaccggtgtaggcgatgacgagcgataaccataatcctacccaggcgatgagaggatagagtagagaagatgagtgattgaaatgtggtccccatacgttgacttagctagttggattgatcaacgaaccacgctaacgaaaatcacaccctcaaaactaacgagaaagtaattctacaccaattttaatagtttagattcatattatggttgagggatatatttgacctatacttgagggagttaaaatggacttatttctaatctaaacgaacaaatattgtgatccaacgcgattaagctaactaggggattgaaactaggccatgttacatatctattaccctaatacaacaaggcacaacatcgtcaattttgtgagcaactctaatggcttcggcttcgatgtattatgcatgtccggcttcggcttcaatatattgtgtatgtcttttttttttaacgcctacacggtagacatccaacatattcccaaaaaccaaacgcccctctagcacttctagcactctctctctctctctctctcaatgttgcatgcatgcacaccacttatttttttcaaactataaatgattttatctaataaattgtttatccaatctacggttaaatcattatatttgttacaattaaatgtttgcaataagatcccatgtggttatattttgacaaaaaaaaatcaaacgttgtttcaccgtttataaaagaattatttcatcatttgatcaaattagtttcaaagagctgcaccacagaaaatactgattacaactagtcccaactagtgaaacacaaaatatattcacaataataagtaattttgctaaaacatttttagacagtatgagacctattaaaacatagcatgcaccatttataaatgaaatagtgaaacattaagaaaatataacatctaaataaaactgtatatgtttaaaaaataatttggatacaattaagtaaaatcttgttgtaaagatttaattataacaaatacatcagtatgattatattgttaattggataagtaaaatagaagaaaaaaaaattgaagtttaaaaacgaagttgctcgttataagcatatacatcgtataggagcatctgaacacataggagcatccaagcaggcagcaggagatgagaaaaaaagaagggagaacgaaaaagaagggagtaaacatctacgggcatggagtggagacgcctgattttttttcttttctttttcatttattttacttgcctaacattttattctttccacggattcatcagtgctttagaggctgtttagatgggactatgtctaataaaaccaattccataaatatggactaatttgtgagacgaatttattgagcataattaatccatgattagcctatgtgatgctgaaataaacatgtactaattatgtattaattagggttaaaaaattatcacgctaattacctctcatttatgtaattagttttgtaagtactctatgtttaatactccaatttaatgtccaaacatccgatgtgatagagactaaagtttaatccgtgaatccaaaacaccaccttagttgggtattatgtgagtacgtttctaataagcactacgtatttgtaactattttagcattggagatgtgtactttcctttttcccagcgtcgacctagcaacgaaaatcatgcccacaaccagttgtattttacggggcaagcaaaactatgttccttttttttcaaaatataaccgttctatgcccttcttttccagcgaaatctgcggttaatagtcaagtcatggtccaaaacgcctttgagggacttttggtacaaatcaagctgcaaaatgtgtctagaacagatagtgccgtattacagaaatgaattgtccgatgacaaaacgcacagatgcaaaatacagtggatttgaaagagaaataactggtgtcgttcaagtttgcacattcaacaagaggtagaaaaggaaaatgaaaacgggcaatagagaactgaaatgccaaactagaatgcggaattttaatctagaaagatctacagatgttaaaatatattacactcagtttgagaacatacaagggagcgcgtacaactatgagaaccaagtggagctcgggtgtgtgagagtacaatcagaaaagaaaaggatgtgcagcaaaagattatttactctatatcatcacctctttgctattggttataattggcttgagtattgtgttcccattgacaacctttgtggtcgcaacaaggaagtcatagcccatcccttcctgcgagtagatagaagtcacaaaaataaggaacttccatttttccctgatcaggagctctatttcattattcatgaggggcattaaacttccatagacaaccgaaaagaaaatcaagagccttattacgtcagatactacattgttcatcattagcagcttgattaccctccatatgtgcatactctaataaaagatcaattaacctaccgcgaagctcctgaatgacaatgaatgctgaaatatcttacgcacgatgccggtgtactaaataaagcataagcgagtagtaattcctccacataagggccgccgccagggtgtgggaagcaacctaacagacaatactcgtagccttgcagactggttcagttagtgagtaatttaggcttataaaaagccacaatgcgaatcaaggatatatttaacctataattactaattgttactatttgaaggagcgtaccaaaaagatattcccaggaacacaagtagaacagatgttaatgtgaatttcaaaatatcccaacttgacaatatcttggtgtcgaactgtcgatttgaggagaacatctaaaacacataaattattttggcaaaggatacctgagaactaaggaatcgaagagcagcaatctctgcaaaagtaaccccaccaataaagacaaccaaaaccagagaacgatgtccaaccctagaacaaacacacgttagaataaaaacagatgaagagaagaaacatgctacgaagtattaggaatttgacaagaacagtattttccatgtaaatgcaaaaacaaaaacaaaattcaacaatgtagtatctgacgttataaggctcatgaatttcttttcgattgtctatggaagttccaaaacaattgtgtactattctaacatgttaattcttaagggtctagaggtctaacagacctttgaggaccatgtatggagaacaatatggggatgacttgtagctaggagtgaaagtccaaccaagattagatatagctggttttcagcgaaatctattttagtggagcagatgatgtcaaattgatgatgacccaaggcgatagaagagctatggatcaatatagataacctccttattctgaatttctgatgggctctggagtacttgctggtaggcaacacagtatcaagtgatgaaataaagtcaagatgatccattaactactctagtctagagtttgaattgacaataacacaaacaatgaagcttagatctcagaccctgtttctggtttgctctcataagtttgtatcagatctctcataaatccctcatcaccactgagagcaaataatcttaaatagaagaaaccagcaagaaaatgattacacagatagcctgacattcagcataaattatacaaatacaaaagaaacatgaaggagatctcgtgcacaaagttaccatgcccatcagcatcaactggagccctaaacaggacactgaaggattgattttggctgtggctggcagtgagcactagataacacagagagaaagagtgggagcagcagcttttgtatgtgtaattatgcaggcagaacagaggatcagggaaggcagtagcaatgggcaagatagcacctaacaaacataataggctgtttcaaaaaaaataataataataataggccctattgggttaaaatttactaaatcaatcgctgggagtcctcacaattgtacattcatgaggtctagggaaattgggaaacacaaatacttaactcacgtcacccaactcatctcaacatggcaagtagctgagctgcataaactagaaacttataactactaaacaacaaaagaatttcatgaatagaatacagaattt

SEQ ID NO: 65473 - DNA, 1153 bp, Oryza sativa
ctggcttattagttaaggatgcgaattggaatccaagaagatttcaagagcccaagtcaccgtttttcatttctctacatggaactgttgaagacacaagaaaaaagctttctcaatgaaaaaggaagattaggacaataaacttaccatccagatctcacagcatgctgaacaaggcgaatactgagaggggcgtatccagaaaatatgtatgatatatcactagggctgagaacggaaacaagaacatgtaagtagtagttgttatcgtgaccaagataacaattataaatgacaagaaaattagtcactaaagattgcccagcaagcagtaggaatgattatactatatgtcagataataatatcaaagaatgacacagcaagaggcaatgcagagctttctgaataatctaagccaaacactctagttgctttctgtaacagaatgatcctatttttccagttgtgagttatctacaattcttattagttccagctcatactgccttatgcaacatattaaacaacatacccccagtttcagtatttgtagtgttcccactgcccccaatttggagcatatttattttgaagccaaaatttgcactaccaaaatttttgcattttaaatagaactttgggaatgcttcgctgtctaccaaaatttgtcaaccacacacacatgtggccaaaaaaatattggtaatacaaaaacttgcttaggttttgtcattaccaatattttggtagggtagcaaacgaaacaacattggttaccctgctgtaatagttgttttataatgtaaccaagacactagaaactaggaaagatgattggcaatgatctgtttgttttttataaatgcgtcaacaaaaatttcagacaccaagcaacaagcatgcatatctgtactcctttaaaaagaccgcaatagtggtggcagtgaatctgccaccccacctactcccattgcaatttttacatattaccccatgaacttcttaaatacataactaaatcgaaatggacagccacatataaaattaatgtggatagccacattttaggaaaatgtgggtaacatatttcatggaaaatatgatttatttattttagaaatattgtgatattttccttttatccgtagcaa

SEQ ID NO: 65474 - DNA, 3029 bp, Oryza sativa
tagcatttatagcagtcaatcaataacttgatatacacagaattagtggttctagtaagtgaacataaaaaagcagtaaaccttcttcttttttgcgtgcgtaaaatatgccatattttacctaatgacgccaaacatgttatttctccctgtgtcccataaaaaaccaacttctggctacaaactgagcatagcctatgtccagattcatagctagaagtagttttgttatgggacagaggtagtacttcctataaagcataccatgatttcctgtagatcccaatgactactagagctgaataaaatagtatcttagaaccctcgacccagtaattgcaagagatgtttatgcacgcatgcttccagcagcagtatcgcacttgtgcagaaaaattaaccaagacagtgcttagcaaaacaagataattcagttttcaacaccctacttatgatagccctgttcatatgggcaattgtacttcatattatactagttaaatgcacgtattaacaaaaaattcttacacaatgaatttgattggtacatcaaacatgtctttgcctctgttaacatgtaagtacatataaatgcatgataatttggccaccttcgaatctttcacattgaattaaaattctgttctaagggaatattagaagaaaaaaggatagcctattgtgtaatattgaagaacaccaggggacaaaaagctgtgtagataggtgggtgacagtttgagagagatgtattcatcgatactgtacagattttgcatacaaaattgttttaaaatatctatgtctaaaaagaatatggatactagtgccagcaaaacctctacttttcacataggaaagaatgcatcatactactcaattcaatattacaataggttactcaaacaaatagcctatgattattatctttattctacatgattttctcacatgaaaaaaattcaattttcattaggcacaggacaaaatttcaacatttctaaagggcctttcacaacctctacgctttcacataggaaataatgcatcatactactcaattcaatattataatagattaactcaaacaatagcctatgattattatcttattatacataattttctcacatcaaaacaattcaatttgcattaggcacaggacaaaatttcaacatttctaaagggcctttcaaaagtaaccaaatcatgttacgacttacaaacactggcacataatgaagttaaatatatgatacattaaacaattgctccatgtgctcaagttttcttggattgtaaaataaataaataaataaatcattttggtcattaggagtagtattatggaaagaaatcataaatatagccctgttatgttataacttaataagattgcacacattagcttgtcaattgtccacatcagacatcaaaaacaacatattattgccaatagttagctacatggttaagtaggtaatgctgggtgaatccaccagttgctgtggtgataatgctcaggtggttttctaatagttaagattgctagaagacacagctatagatcggatagctacaaaaatatatgttcaaggctaaacgattggccaacacatttaggctgtgttcggcacccccttttcccaacccctctccctcgttttccacgcgcatgtttttcaaactgctaaacggtgcgtcttttgtaaaaagtttctatacgaaagttgtttaaaaaaatcaaattagtccatttttgaaaaaaaaatagctaatacttcattaatcacgcgctaatggatcgctctgttttccatgcgtactgttccggttggtaacaaggaatggcgaacacagccttaattgtcagcataaggctactatatcctcctagatgcaaaaatatgaactgataatggtcataaaatttaatacaaacaaaagcaatacacaaaaagtaacataaacatacctcaagtagtcaaaattcttctttggcaacccagcatttgtaagtgaaagtaacactagaaggcgaagaacattttcaataggctcctgcttatgtatcatctcttcaatgtattcaaaacatctggggatgagttagatattattgttacatgaattcaggggaaataaataaaaaaaatgatggcagttattttatctaaaatgacgtaaaagcaggactcagatctcataacaatccacagtttggctcaaaggaagactgttaacaagaaatttccgcgtgttaaagttgcaataagaacaatagctgagaagtacggaagattgttttggtctgcccaagctgacgtagacacaaaacaaaccttagtcacctttactatcaatttatgaaatctgaataacacgagcaggagagatggattccagaagaattcagagctcaatatatctcttgacaaagaatggtttgcattttgatggtcaattgtggcagtgagccaacccaaactgactggctggagaaaaatgggggggagggggggtagatctagggactagggagaagtaaaatataaatgaatgagctaatttacagggttgacagaaaatcttgatatgttgcccacgtcacaagaattgcattataaagtaaataaacatgaactacagagtagtagaaagataaactcacatttcaaagttttgcacctccaatattgtttgttcaatgtctaatcgggcatgaaaggaaggttttccagtaaatgattgcaagtgttgtgccaaatgaacatgcctctgcatcaatgcagggtgttagttaatttacacaaaacaagtgaccaactgacagcacttaattaactcacagctatctctggcagtgaatgtaacctcttcacaaagtccttcagctccgaaaccgattgagtctgttttcaaacaataaaattatttacataagttcctgattcacagattattctaacaaaaaagatagctgcctgatcgaatggacaggagagaattaaacaaactggaaaaaaaaa

SEQ ID NO: 65475 - DNA, 1143 bp, Oryza sativa
atagatgcaaaggctcatataaatgccaaaaagaacaagaaatcaaaatagagtgtgacagtagttttcagagctgaaagtaccatataaaatgaaaaatatattttacctctctgtctaacaaaataacagtgtttatctccggagtccccatctaaatcaccaaaaagaaataaatgatcagcgaaactgaaagatctgagtcaaaaaagcttatcagtcggcattacatcatccatgttgacaggatcttcctgttgcatactattcagcaactctgcggctttggtggatgcaacacccttggcccgaacattgggaattactccaaaggcaaactggggaaagaaaggaatttgcataagtgcagtactataatatttctatagtgtatagatatttacgtgtgacggaattaaaagatgataaggttgcagatttgtagcactgaaaagtactctttaaactacagtatggtatagatgataaaaatttagtctgtccatagaatgcttctgctataaacaaatataattgaacttttgtagtacaccctctggtcttttgcatttgtcatcctagagtatgggccacaaattatgtgaatcttttaccacaagaaagttaggtattcacatgaaaacggtacagctagatttttcattataatactttgatatgattatgctttttgatgggaaatttgatatgattatgttactagaaaaggtgatggtgatggtcaaacactagttgttacgacagcacgaggggtcgcctagtcaactctaggacagcgcatcagccagaggcagaaaacagagatcaatgccgagatgaccaggattagaaaagtgtacagccctccagtgtctgacaagcttttcaccatcaccagcttcaccagattcctgtttatttcttacctctttgcttctagtgcgagtttaggatcagtgatgtgaggaggaagatgtgaaatgcagaacaggagagaaaactgagaatcttatgtttactgagaaataagagcatcctagtagggaggttagaactggcaagggataagttaagaaatcgtgaaggagggaggtagcgcaggtggacattgtgcagcttaagtggtcactgggctgcaggaat

SEQ ID NO: 65476 - DNA, 818 bp, Oryza sativa
caccccccccaacacacacacaccccttttgtgacactgtgacttgataattaggcacgcattggaatagcttcacatcatcgcaccactataataatgtgctgcttgaagatacatcgctgagttttgaggcggaacctcaccacctccaaggtaggggtactggtaggagtaattagcagtgacaacattgatcacaccatcactcagtttcatcccaggtacctcgaagccaatatgagggttaaaagtactgccgacgacacaattcataggtgtcaccacatggacaatattaacgacgttgggataattagcggcggcggtaaagtttgatgatgtcgttggataaaacgggtgagcctgaactggcaatttgctagtgccagaagttgcattctgctgcttgggcattgcaaggctcacctccacccactggccatagaggaagtgcctgtccttcttgagcgccctcgctgcggactcctccgacgcgaactggatgaagccgaacccacctaggcatcttcgtgttaaggtcggtgaccaagattgcacggtcgacctcgttgaatttgctaaagtattctttgagctgctattcggtgacggatgtcggcaagctgccgaggaaggtcttcctcttctggtcacctagactgagttgtgggccgccaacgggaggatttggttgggctaacttgacatccatatgggagaaaaaacagtagagttgatcaacattgtatgtactagaaaacagctcatgtgtccaaatataattagtaagtatgaaaaagtgtcgcgcacacaaacac

SEQ ID NO: 65477 - DNA, 7161 bp, Oryza sativa
cggtgaccacgattgcccggttgacctcgccgaagttgctgaagtattctttgagctgctatttggtgacggacgccggcaagctgtcgacaaaaatcttcctcttctggtcacctggactgagttgtgggccaccggctgatggctttggttgagctaacttgacatccatctagggaaaaaattagtagagttgatcaacattgtatgtactagagaacagctatatagctcatgtgtccaaatataatttgtaagtatgaaaaatatattgtgtcacacacacagagagacacacaaatgtgtcacacacacacacacatgcacatgagacctgatggtcctacatgaagtaaaatttgtgtgagtggcaaatcgatcctaaactacaactacacgcaagcaggctagctacgtatcaaattaaaggtccatttgtggtgtaaattaaaactttgggtttgggtgtacacatgcaaaatgtgttatttaattttggagatatatattgaatttgcgggctagctacatatgaacacatatcctaagctacatgtatattgaatttgctcagtcccacgctaaaatgaagatttgggtgcacacatgcaaaaatgccatcctcacacgtctgaccttgagtgccctaggccctagcaagcacaagaagttggagactaggaggtgttctatatatgcacccagccttagtccgaaaccctatcatggcatgatcttccataatttaatataaaattaaaacagaatgcaattcatccgtaacacttgggcacaacacgtgaaatcaaacaatcccagctagctacatgtactcttgttgacgacgaaccacattagcaaaataagtcacaaagagagaaattagcgagagccatggtagcattcgatggaacctcacagcaaatgggcagcactcggcaaatcggcctatcgacttcaattctttggggctgccaaatccgtcttctatcagtcaatctagaaggcctaggcgctgccgaagtgcaaattcttctcttggctggtcacgcaaaacagagtatggatgacagaaaggctggagaaaagaggatggcaaaaccaaaagatttgcccactttgctacactgttgacgaatcggcattacacctcctggccaaatgcagactcacaaagaggatatgggcagaaattcagagatggaccaggactgaccttcagatggacaattgggaaaactgtcactcagtcgatcaatgttggaccctcgtagcggagtccccaagcaccccgcgcaggcccctcaggaccttggtgattttaatcccgtggaaaatctggtgcgaacgaaacgcaagaatattccgcaacaatgcatcggcgccgtcctcaattttgacaaagatcaaggaggaaggaagagcatgggtcaaagcagggggcttcaatcctgcaggagtttgtaattttgggagatatcacttaatacctatttttttttgtcttcttttttgcgggttcttgctctctttcggctaaccctgtatatatctcactaattttctcctgctttattaatatatacaaggcaaagcttttgccttctttaaaaaaacaaagagagaaattagcagcaagaactaaagttttcgtcggaatataaaaaaaccttacaatgccttaaatattaatcaattgtatgagcagaacgaatcttacttttaccactaatctataatcattacatctaaattatgatgcaattaaacacagctcagctacaactcgccagctacacgtaaatttatgataccaaggactcgtatatagacagaattaacagagcaccaaaagcataccatttctaatcaagctctaaccatcacttagttaagagagttaactaatactgcggtcacctggtcacggatagcaacgacgacgacgacagtactgaacagaatcaccaacccaccgcgccgcgagcaacacgatgctacgagctaagcccaccatgcaacaaagcaagaagccaacctcgtcgcaggaaagcaaaaaatcgacgatcccacgctctttcacttgcacccgggcgcggaagcaaagcatgcatgatgcaagaggacaagaacatgtaaatcaaggacacatcgagtgagatcgatcacccgacggagaagaagagatgagacgagagcgtgtgatcgatgggaggaccggatgatctggggtatgtgtgtgtgtataccgtggtgccgcgaaggacggacgttgcggttgggtcccgcggcgatggcggcggcggcgtcgtcggggttcacgaactgcatgcacgaagcgcttgttcttgggcgcgccgacgaaggccaccgtgccgaactgcgagaagtgggcgcggagctcggactcgcttgtccccagcggcacccctcccacgaacaccttgccgtggctcagcagcttcctccccctcgccgcccgtcgtcacggtcaccgtcgacgtctccgcctccgcctccatgatctctcgggatctctccgacgaagctagcgagcgagagagcgagcgagcgtgatgaccagaaactgatgcggccgaattgtggaagcgcgatcgaggcaacgcgaacgcgcgcggagcgtgtgtttttgtaatcaggcgaggagagacatggtgcggtcgtcacgcagcacacgcgacgcacgcagccaaagcccaaagccgcctgaggatgactgacaggtggggccggcgtctccgcctctccgggaaagcaagacgcggagtggggaccacaccctgcagggccaggtagctaggggaggggagggaggagagggtcagcggtagggatgcacgtgggtcgggccgtgttgacccaaggtctgagccacggtggcttgtggtgtgatctgatcgatgcctgatggtgcattgtcagttcgttcgttacctgcagatacgtcaggaccaggagatagcaatggtagttataactagttagatgcaatatggatcatgtatcatcattatttcttcagaagcaatacctgctagctggctgcctcctgggtaaccataatgatagctcaagaagaaaaagcttcaaaatgtgtcatgagaaatgcaaatgttaccgctgattaacccatgttggcagttccttcatatacatgtatatatatccggctgcatatacacgccagacaacaccagattaacatattagcaggttcttttctcaacgttcagaaaaagaaaaaagttcatatgatcctagaccatgcatgcagcaggtacgagtagccaacataatcaggaattctagataaatgatgatgatgtaattaacaaaaaagggaaaatattttggcttcattcaacagtatgatcaacttagctagctagtcttcaaacagctagccagatgaccatatcaatcgcttgggaaacagccttcacagccaatcaataatagagagaattgaagagcgaacccacattcccacaatatcgatcaggagttttgttatctgctcaacaaaagaatatagtcaatcgcattgtttttgttaatcaactataacgaaatgttaacgagtgatcataaattaaaaaggcacgaaagcgtctcatttgactatatatatttgtcaattttgaccaataacagtaatctctgaaatttaatgtgatgacacacagttgactagtagataaatgggcattggtagcgcataatatatatcttaattggtaaaaacttatgaatggcaatgtgatccatgcacatatacatagtttaatctgctgtagcgagaagttaattacttccattacataaaaaaagttaaaataaaattgtgaaaaatgctttagaacaatatatttatccatatgtagtcaatttatattttttatgtagcaacagcaggaatattaatggagatatatatgtactaatctgaatattaattgaacacgttaatctatctggacttattaatttagcacacacgttgatctgcatttcactatggtatgcatgcattgttcttgcttatttagaaaccttgtataaatacaatcaattgccatgcatatagtccatagacaacataaaatgtccacttttatgtttgctgaagtgatttacatccctccttgagattaaaagaggagttattcgtacctctatcaaggaccataaatcactcttaagtaccgaatactaaacatatgcatatgtaaaagatctgaaaatgagtacttaagaatgacataaataaaaagcatatgcatgttttcaaaattatgttcttacaaaaatgagctggacatgatgtttaagaaacaaaggtaaataaaccttgggaaaacacttgacacccaaaactattaaaaacttaacttgaaagtctgtgtatagagattatatatatctagccatttagatagttagttaagaaatcataattcttcccgacctagctcactattacacacatcgaaaaattcagggaagtgagtacatgaactcgccagagcaaatagttgaaactaaataccatgagttctttaaacgaacaagcaagattgaagaaaattaaatgaagtaaataaaccacatatattgtgtgacactatgacttgataattaggcatagattggaacagcttctgagcttcacatcatcacaccactataataatgtgctgcttgaagatacaccgccgagccttgaggctgaacaccaccacctcccaagtaggggttctggtaggagtaattagcactgacagaattgctcacaccatcactaagtatcatcccgggtacctcaaagccgatatgagggttaaaagcattgctgatgacgcagttcataggtgtcaccatagggacaatattaacgacgtcaggataattagcggcggttgtgaagtttgatgatgtcgtcggataaaacgggcgagcctgaactgacaatttgctagtgccagaagctgcattctgctgcttgggcattgcaaggctcacctccacccactggccacagaggaagtgtttgtccttcttgagcgccctcgctgtggactcctccgatgcgaactggatgaagccgaaccccctgggcatcttcgtgttaaggtcgatgaccacgattgcccgattgacctcgccgaatttgttgaagtattctttgagcttcttttcggtggcggacaccggcaagccgccaacgaaaatcttcctcttctggtcacctggactgagttgtgggccgccggctgatggctttagttgggctaacttgatatccatctggggaaaaaaccagtagagttgatcaacattgtatgtactagagaacagctcatgtgttcgaatataattagtaagtatgaaaaatatattgtgtcacacacacaaacacacccgcgcgcacccacacacacacgcgcgcgcgaggcctggtggtcctacatgaagtgaatccatgtgagtggcaaatcgatcgtaaactacaactacacgcaagcaggctagctacatatcaaattaaaggtccatttgtggtgtatagagtcaatatagaaataaaatttagtaataattgaaattcaaaataaaaacgaatattgaaagaagagtatagagtcaatatggaaatacaatttagaaataactgaaattcggaatgaaaaaataaagaatattagacgaagagtatagagttcatataggattacaagtaagaaataattgaaattcggaataagaaagtaaggaatattggaagaagagtataaagtccatataggaatttagaattaattaaaatttgaaataaaaataataaaattaaaattagagtttagagtccatatagaaatataatttataaataactaagatttgaaattataaaatatatactggaagaagagtacaaagtccatataggaatataatttagaagttgctgaaaatcagaaataaaaaaataaagaatattgaaatatgagtttagagtccacatagaaatacaattagaaataatgaaaattcataattaaaaaataagaaatattgggataaaagcctagagttcatataaaaatacaatttacaaataaagaaaattcctaattaaaaaaaaggaatattggaagaggagtttagagtccacacatgagtataatttagaaataactgaaattctaaattttaaaatgagaaatataggaataaattttataagtaatagaaatttagaattaaaaaataaagaatattggaagatgagtctaaactccatatagaaatataatttagaaataaccaaactccgatactaaataattaataactatcatgtatatacaatacaatataaatattatacattggtagtttggtaaagttagtacaaaattaaaattatgttattattttaatatattttaagaataaaataagaaaaaatatatgctattatataagagaaaatataaggatgctcgctgcgcaatttctgtgggccactatgctagtttaatataaaagtataatgtaattcattcgtaacacttgggcacaacacgtgaaaatcaaacaatcccagttagctaataataagggacaccttttactcctgtggacgacgaaccacattagcaaagtaagtcacaaagaaagaaattaacagtaagaactaaagttttcgtcagagctaaaaataactttacaatgccttaaatacaatcaattgtatatgagcagaacgaatcatactcttaccactaatctataataattacatctaaattatgattcaaacacaggtcagctgtaattcgcagctacacgtaaatttatgataccaaggacgcatatagacagaattaacatatcaccaaaagcataccatttctaatcaagctctaaccatcacttagttaagacttaagagttaactaatactgcggtcaactggtcacaggtcgacgacgagtactgaacagaaactaacccaccgcgccgccgagcaacacgatgctacgagctaagtccaccatgcaacaacgcaagaagcgaacctcgtcgcagcaaagcaaaaaatcgatgatcccacgctctttcacttgcacccgg

SEQ ID NO: 65478 - DNA, 928 bp, Oryza sativa
aaggccaccgtgccgaaccgcgagaagtgggcgcggagctcggactcgcttgtccccagcggcacccctcccacgaacaccttgccgtggctcagcagcttcctccccctcacgatctccccctcgccgcccgtcgtcacggccaccgtcgtctccgcctccgcctccatgatcgatctctcggtctctccgacgaagctagcgagcgagagcgtggtgaccagaaactgatgcggccgaatggtggaagcgcgatagaggcaacgcgaacgcggagcgcgtgtgcttttgtaatcaggcgaggagagatggcgcttgtcgtcacgtagcacacgcgacgcccgcagcagaagcagcctggggatggctgacaggtggagcccgcagcagaagcaaggcgcggagtggggaccacaccctgcaggggccaggtaggggaggggacggggagggtcagcgccggcgttaggcgtttcggcggttgatagccgcgcggcacgcgcgtttgcattgcatgtcgaggcagcgagagcgagaaacgtgagccgttggcgtggtgtcgtccgcctccgctccgctccgtcgaggcgtcgagcggtttatggtccgctctgctggagttagcggtacagagactgttttggggatgcagatgtatgtcgacattggaaactgctgatgacgacgacatataaatcacgaatgttatcattagagacgagggaataccgggtagataagtatatcagcttcgaatttcgtatagcactagagtaagaggggaagtgtgtcgagttttgcgtagtgccagcttaaatgcgtcataagatattctaagacatttgacagcaaatgagaggatatcttgcattcagaatccagtaagtatgagtgctgcacgctatcgtggatatacagtgcacacgca

SEQ ID NO: 65479 - DNA, 1244 bp, Oryza sativa
aaaaaattaattggtgggatctctaagttggactaaattttattcaaagtgatactccctccatctacttttgatagtcatatttcatcttgacacatagaccaagaataagtaattctacttatcatccatttaaacatgctactagtcattcctcgtaaacaagcgattaattaatatttacatttctcaatgctcatatagccaatcatgtgtggaagaatggagagtcacgcattaaatttgacaaaatcattaagaggataggttgttggattgaaatatgccaatcaaaaataaaattttcagatttcgaaatatgactataaaaaataaatggagggagtatttctttaaacccgtacaaggcttgcacaacgatatattagcaagaaaaaacagtttttataactgccacccactaagtcaagtcctaggggttaccgccttaccgggagaggggaagagcacactaggctaactaagaaagaaaggcaaccgatcagcttaaagcaacaaggaaaaagagaattcataaggaattctaactgccaaaaggaattcataagggactaggtttcgctacaaccaaagcttcccttcttgcacgatgtgattgaccatagtgttcaccgtgaaaaacatcccctcaaatacgccagtgtttatttccaacaattggtgccagtaccaccagaacgaaggggttgaaccctttccaattttgatcttaactgtaaccgccgcgagaggactctcaccatacttgaaacgaagcttctgacagggtgagagggaggccagtcctatcttgtactccgacaagatatggtgatttgttttcaatctctctgtagacataacacatagtacggtgtaactgcctatttcacggttgcacatttttggttggccgccgctaaagcgcaaggaaaaagctccgggttgtagacgcagggggaagacatcgagtcctcaaagaacgtgttgtaagcaatgttttaaatagcaggctaaggcatttagtgattagcttctcaaatagctatagcggcagctatagcgggctaaataaagatatagcggctaaattgtacatgagagtaaatagctagaacccttctcaaacagctatagcgggagatagcgacagctataacgagagatttaaaaccctggttgtaagttgaggtgacgctctacccatcatccgtctaatgtcagatgaacttatcttgaacaga

SEQ ID NO: 65480 - DNA, 2906 bp, Oryza sativa
atggacccagacacacggctaccgctacgtgcgtgacgcgccacgctacgactccgattgattcggcgcgagaccgatcgagctaccgagactagctaaatccacacacgcacgcgatgaggcgacgtacgcgagacgcgcgagcgggcgcgctgctatacggcgacgtacgccgtctaccgccgcctatgctacgcacgcgcacgctggcgctacgtacgagagatggacacacggaacgcggcaggacgtatcgttcacgtggcggtgtcgggcgcgcgatcgaccatgacgtgaagaccgaataccaccgcgccgccgccgcgggagcgcgcgcgatgttcgcagcagcgggctatagcttagcgcctctcgcgtgcgtgcgtgcgtgcatgcacctatcgtcgtcgtcgccgtgtgcatggacggcagcacgccacgccacgctccgcgcggagcggagcgcgcggcacggtctctctccggtacgaccgctcgtccccacgggtcgccgtcgacacccggcaccctggacagcgacgccttattaatttgcacgtctaattaatccaccatggtcacgacgacgaacgggcgagagagtcgtagatcgactcgctgatcagcatgcaggtgtgatcgaatggcttagtacattgtctctgattgtcaaggccactgagtgtacgtagtacgtagtgtatcctgttcctgactagtccacgcgtgaacggggactcaacacgtacacgtgaaacaacccccgagttgtcgatcgatcgcaaggtgataatcggccgaagcgtcgaatcctgacttttttgcagtggggtgagccagtgagtgtacccgtaccgatcgatcgaggcgagactaacgtagccggcctcgagcgaccgatcgatcttagagggatcggagggaggggacagcacggctctgcggcctcgggaccaagggacagcggcatgacaaaagcccgcgagggtctcctcccgggaaaatatccggtaaaaaataatacggagtatcgaataaatgaaaaactccgtggaccatgttataaaagctctctaaaattttaaaaagttcctattaaaataacatccacaaaatttcaagtcgtttctttcgcaaacgcgaaaaaaatacacgtcaatatattagaataaagccgaaattcagttacacaatacaacagccagagacaattgttaagggaacacaaggaaacgactagggaagaagaaaactctaaagggagtaaagactccgaaaccattgaccgaaactggcaaagtatcaaaagagtactacgatcctcccaacaagactcctagatgagcgacgcctacgcttgaccacaaccgacctttaagcttgatcgattcgaatactgcatggacatgcgagagaagaattgaaaaacctcaagttccttcttcctaagttgctaagacaaaatttcaaatccagactcaatttgttttgggagaaaaaaaaaacaaatgaagctatatattgggattatgtacccatgcattaggaaataggaaggtatccttcgcgtgacgattcgctccaccccactcatcctcctcatgccctcgctccatgacgccacgtgctcgccttggtcgccacccaatttttacgttgcaccgaacaccttctctgctatacgcgttgctcttcgagtgggaggggaaatggggggagggtggggggggggatgagggatggtgggtgaatcggacgggaggtcgctccgtgtcggcctcgtctatggcgggccctccgcagagagatgatgggaaacatcgttgtcatattcatttcgtgttgagggaggatggagagcatcatagttctaccatctccatcctttcttctctcatttctctcggctagatctgatagctaatgggtattggtttataccaatgggtaaaaagtttagtatcgataggtgtcggtctgttactaataaggtatcaactgagacctaacgggtatggttcagtatgggatactagatttaacatcgtatcaatatatctgatattatctcgaatgagatctcgtaatatagtacttcctccgtttcacaatgtaagttattctagcatttcccacatttatattgatggtaatgaatctagacatatatatctatctagattcattaccatcaatataaatatgaaaaatgctaaaatgacttacattatgaaacagaggaagtagcctccttccggatatttcccctcgcaccggctatcacccagccggtggccgcgatcgatggtggccatggcgcacgcacgtacgcgcgcgcgtgtgtggaccgagcgcccgcgtctcaccgcgtgacgacgtgggcgcggggagacaggccgtcggatcgatcaccaaacgctacggactctagctagcgccagcgcgcctcggctcgaccggggctgcccccacgagacgttgctgttcccgtcacacgtttggttccccccctccttggcctcgagcccctgtactcatccgggcgagcgacctcacgtcctcaccgcaagcgtgctctcgatcgatcgcttggtggtgtcgctgtcacacgaggtacatgtcccggtggtggacaaaccgaagtttgcacgttggatgcagacgggtagtactgtttggtggtatagtagatactgcagctgcaggtgcccaacagtaaagggaacagagttcgatcacgattttcatgtacagtgtatggacatgttctgctattgctatggccatcagccaataatgcgcacgtagtatggactaaccacgtatgagttttgtctaatactccaacaggggtcgttatttgattattttcgtaggcaccgaaaaaatatattatatttagtatt

SEQ ID NO: 65481 - DNA, 6933 bp, Oryza sativa
gattacgagattaattaacctcgttctttcagtcaagtctacaatttccaaaacaaaatcaacacacaaacaaattgtcaaagactcagaccttgaaataaacgactgcttatctctggtcaagaaatcgccggaataacaaacaaacaaacaaccgggaaaatatataaacaataaaagggagaatgccgatcgagctagctcgtgcattccggtccaaaaccgttggctgctcgaccgaatcacctaccgtgaaccagccgtcttctttaccttcaagccatctccaacgtgccagtatacaccttcatcagctcttctccccctgattagacagtacggctccctaaaaataacaacggtacgatcagtggctgacttccaatggtgatgtgagctcctgacctgtctttccttggctgccaaatctcttttgcacaaagctattgctggttgtcaactgtgttgactttgcatggttcggctaccttggtttcgtgctgtgctcaccactgtctcctgctcttgagataggcagatacatagtagcttgagctgtagtgtagtagacttttggcatggaagcaggcaggcatacgtgagagctatgttaacttgacaagtggctgcgccgacctgcttgctccccttatgtttcatgcttaattgctgtgctgtgatgtgcctaccacctcagaattttctctcttttttctcctcttttgtgctgtgtgatgtgtttaactcctttgtgtagttacctgtattctgaaacttcctcatgagcctaacttacttgatagaatcgaattttatgatcttttgcatgtgtaggtagtagcagcgatctcagccactgagactgagatcctgggagaaacatcggaaaattccttacgctaaccctaggaaacggacaatgcagattacagctgtagattggtgattttatctgttgcagactcgcagtccatgtaaaccacatagcattgtttgtccaagtctgaaacgatctcagcagcacaagtctgcacattagctcttgtgcctatttcttcacctattgtctcctatagagtagtaaactaattggataagtgaacttacctcatcccatccacaagattctctgtcagcctaacttgctttgtagagtagaattttcaatcttttgcaaccagacagcaaggatcatggtcatacaattccttacgctatcagttctggaaacagattcaacaattgcacggagcattgcaggccacggatatgcacaactgaggaaacattattgaggatttacaagtatcagggatgtgacaatgatcaaaagctgcccgtcgtcgaatgacatgagttgttaacatcacggtgaattttgtctaagcatgcgcatgcagacataggaaatggaatctggctgcagcacgccattatcaacctgatttgactcgacagcctgattgcatcttcttggctcggcaatcattttttttcccgaaacacaatagaggctcatatacacacgcgcatgctcggcaatcatattggaagagattgttcaagctgcgcataagcaggcatttcggtgccaatggcctcataagcaagaaaataaaggaagggggaaaagattcctagtacttgtgcatcacctacaacaaattgcctctagcaggcaggcagggaagctgcccttgctagctgacgaattgtcagctctgcaagtctgcatctacaaaacttatcaggcgtatacgagagcataaactcagagttttgtacatgtctcaatgaactgcacagcctttttcataaggcagcagtacactaaggcagcagtacaccgaacagatgctgattccgttgtctttggtttagtgtgcaccgaacagaataatatatgcattgtggaactcaggtgtcaccctgttttccagaattatctgcagatctcaattctctgttcatattatctaggtagcgctgcacagaaagtaaaaatctttttaggaaaacaaagtatgatagtcaatgtcactaagcagatgttcagctaaatgaactatgagtactggttttcaataataattacataatcgaaacaacgaagtctacaatgacgtcatttggtatttgttgtatgtacctggagtatgcaaaccgcagcaaatttatctgtcattgttttggtttcaactgggtcatgtagtttcagaggatgtaaaagggcttctacacactggagacataaacagatcaatcaaaacacttcaccataaaaaagtacttgaaaagtaggataaaatggtcacatgagtaatgcaccccatgctaatatgtagtttcatgtttgagagataatgggcaaaaaagtaccatcaccttcgaggtaaaattttcatcccaataggtgtaactcatatcatcaagtttcccagttttacagagctctccaacaagaagccttacttgtaatgcctgcttaatagaaaaaggaaacatcaccaaacatatagtgagaaaatgaggtgcactatcccaggctcccagcacaagagcactttacatttggactagattgaccctgcaagttgaacggatagccgacaacaaagcctgcaagggagtattttgagacctattcacaaaaacaaagaaaaggaattggcttccatgtatgaaaaatagcaaaacatgagtgcttttaaatgttcaccagaatctaaaatgaaagaatatatgcatcatgagctgtctgtaacttctattgctaaatcatttatgatttctttgtggacaatgtcaccctcgagtattttggaaatgtaaatgacatgagtaaattgagcagtaaagaacagcatattagagaaggcctgtaaccctggcttccataaatgcatcgtaacctcaacacacatgctacaaaattgcttgtgcagtatgcaggcatgcgatgcagccatgcaggatgatgtgacatggcacattaagcactcgatctgatgtaggatgatgttacatggcatattaagaactcgatcttttggtaagtgattctacaatctgattactccagaatttaaatgtcagtaaacatattcagcataccaaagttacgaaatcatccgccatcaagctgatgtttgtctttgtcctgctcaatacactgtaggagacaatgcaattgttaatcccaataggaaaatccatttctttaagggaatgcatgcagatcatatatcccatcactaaactatcatagtattggccacaaaaaaccaggtaggcaggtggattgttgcaaattcaagagagtcaatatctgataaaacaggggtgttatcctgagataaccttatgctagcagtgcagacaatgaccacaaaattctagataaacgcatacttcagcaaatctagatccactctgtctgagtgcttaggtaggtaaaaggatatcagctttagccaagtgcagtccgtccatcttaacaatggtaagtgaagaatttctcgtgaagaaaagccttataaggcttaaatatgttaaagactaatatttttaaaaataataaaggtacactatgatagtagggataagatcttgtgtatcgatatattgtaaattgcaaataattttccttaaagtttgaaggcaactacagttattttctaacaaaccgaagtttagtatagtcgaattaatcaaagagaaggacctaatacaacagacacagcacaataatagactgtcttacaaaagccagagaccatacaaactgaaacaaattctgatagttggaagattccaatccaacatgataatgatttgaatgaagtacaacaaaaaatgccgatccattgaaatgagttggaaactcaacattcctactaatccatgagaggaatggaatatagaaccgcctgcatttaaatcatcacatagaaagtgatgttctaatttttatggacacactggaatcacttgtgctaaatatgttctggaaacatctcactatctcagtgaaacctttggatcaaggaacacaatattcagctacaatagtttgaagtgcataccttagaggcaatgcgatcctatttttgtcgtcggaaacagccagcccaacatacttactaccaacgtcaagcccaagcagtcgagattgctttctccacccgccgtcaatgactttcctgaacaactgatccgctttcaacagcctcattgtatatttactccaatttcaactgcaagcacatgaatcaacaaggggattgaattgaatgacaactgatgccacgatttcgacggcatagattatcccttttaagccagaatcctagaacagtcagagacaaaaggtaaatactaacaggaaaactagtactgaatcgggcacaaattaatgctcaaacaaaatgcatgcataaatgcacaatgctaatgtacaacagcataacactgtcacccgcttgaacagatgcaagttgaatagtagcacatacacacaaaattaaaacgtatacgaatctgagctcgtagtaaaattacaaaataacactgacctgcacaaacacacacacagacgggacgagccggcggcggcggcggcgcagcgagccgagaggcagacacacgatcccggatcccgaacagggaggaagccagagggcgaagctcgcaggaacaggccaacaaggaagcgatggagacacggcaacccaggagcccgcgcgacggcggcgtctagccggtgaccggcgagcgggatgcggcggtgagacggtgaggtcggaagggttgcggtttcgtgccttgctcttgttggcgacggatcgggccgagcaggtttgggccgagaatttccgcgagcggatggaaaagctttgatgggccggagcggcaggcgaagcaccggcccagcatttctgggcaatccagaagtgccggttgccactgaacagcaccagattcgcctctccctcccgaggccttggccggcgcgaggtcgaggagaggaagctcccatggcggaggaggcggcgcaggagcagcagacggaccccgccgcctcccgccccgtccgctgcatcgtcaaactcggtactcgcgcgcgctccgtcgctcccttgtttcctctctgctcctctttagcagcttcgatggcgcaggtggagcggccatcacgaacaagggagagctggagagcatcgacgcggcgagcttgcggtcggcgtgcgcgcagctgcggcaggccatgtcccacggcggcgcggcggggaaggttgtggggatggactggagcagacggcccggcgatccgaccggcccggtcgtggatgtggagggcttgtcggagatgggaggcttggggctcgactccaacttcgtcgtcgtccatggtgccggtatgcatggctcctcatctgaactaacaactgtgcctatctgtcattttgtattgctgatgagttcatgagcagaactgggggatcggtggtcggttgggatctggagacgataggatcagcttgattgctgtattttggtttcagaatactactacggctaagtgaaaatttggtgcgaaactgtgaaccaagtaccattctcaatgtgtatcaatgacaagcaattgtaaacattgttcacgacctgcttaaccggtctatattcggaacgtagctgaccttcgtggaatatatttgaataaatctgttttgattggtagacaccctgaaaatatagttttagatcatagaccatcgggcccggcttttatagaaagccagaagcggcacagtggtgggggagacccacttacaagagttcagcacaaaaacacagaaacagggcagaaaccaaaccatgccaagggatacaaaggggttgaagctaagcgaccaaaagcaaaagacaactcaggcacctctaaacaactcaacagataacagctaaccaacagcaccacagaaaaagcatcagtgcttaccctactccagctctgggaggaccaagggaggagactgcttccataagtttgctagccatggcctccagcttctcagcatccttcctgcttaggactttccactgcatcaataaagatttgatttgaaaatgtagtcctaggcaaccaggggagaataaagaaaatagctcacacttcatgatgcctgtaatactggccgactataattggcctgttgtagtttaaaggatacagcccacgattttggtggtgtaatagctgactacctacatctgctacctcagggtcttttggtcacttccaagcaagtagatctggagtccataaagggggtcttcattcaacacttgtgaaggctggctttgtggctacaagaatttcagtaaggctagtttttgaagttctcctttcacgttcatattataatctatattttttttctccatcttactttcagagatatatctttgttgcccagtatatcgtcaacatatgtagtgcttctttgatgcgcatgcttgaaaaataattcttatgatctgcatattacaattcaggtcacttctctcaaccaggagattgttagagctcttgcaagaggtacacaacattgagatgaaggaccactcttcatatttgaatcacaatcatgtttctttcgtgctatcaggatatctatgtggtcatttttgttactttgtcataaactcatgctccattataatctagagaatatatgtgttttgtctggaattttactgtgcggtcttcacttaacccgttgtgccatccaaggatccattgtcatttgttatgaacaattttcctatgtaatcttaatcctgaactaaccactatatgtatccatcttttatatgatcttgatgcattgcttcagtctattgctgtcggtttatcatcagtagctaata

SEQ ID NO: 65482 - DNA, 740 bp, Oryza sativa
ggaagctgctgcgatagctaggcttggagttgatgtgtatattacaaaggtctggtaactttttcctcccctcatgactttgtgtatataaaattttcaatgacccttttttttcctttttccgtgtgacttctgatgcaggttggtacagaacattcactgagagccttaaaaggggacacgagctcagaagattggcttggaaccgtcatacgatcttccagatagaattcttggcctatcattttcgggagtaagcatccattggcaaatattttatcaccattattgtaggacgattgtgaagctatgagctgatcacctgtcaaatgattcatggggttattattgctgaatctcatagcagacaatgaggcagagctcggtgttatgctacaagtaacagtcctacgacattataataagtaaccttattttgtttgctggaagttcacttgaccatttgacctcagaaacacaagaatgattcgccatttatcccgttacattatgttggtggaaaaagttctctacgttcatggcataaaaaagaatctttttttttccgaaaaaaaaaattgctgccggaagcttgttctgctaccgaatgacccagcctaggctgtatgccttatcctgaatgagcttagcctggctagccacatccaacaggcactgtttgcttgtctgaattagttaagccaggatggcccgaggttggttgaatacaaatgcatgca

SEQ ID NO: 65483 - DNA, 1746 bp, Oryza sativa
catggtttgataagaacccaagactaccatgacaaaaaaatatggataaaagctgatctaaagggaattttacgacatcgtggatacggtctccttgcgtatcttatggcagccccttaaaagaatgacttttcttcaggtctgaaatcgcttggaaaaattcaaattatgctcaaatacttgagtatcttcgggaagaatatgagctgaaccaacgttttggaagcctcgacttcaaattgaaatttgtggaggtaagttcttcgatttgtgttcattttcagtgtattagctgatttttttaaaaaattttgagttcccattcgtgcttacactttattattgcaacagcacaacattcattttcttcaagaagttctccagaatagaagatcagatttgctggagtggggtgtcattatactgctgattatcgagattgtcatctcattatacgaaattatcaaggattccagcatgatgtcctgagagcacactatccaacatctttgacagccatccacccacatcaccctactgttatgctaacccacactctacttcccacaattgatgctaaccttagttgaaaggaagtaaaagctccctttcatagctttacttttgtgttatactgcctgggatgcatttttgttagtttatttattctgctggttccaagtatacctcacagctaacaagagcagttaattctttctccaaatcccaggaattcagttcctcaggtttttacgggaagagttttggttttcctctttatgcatttcaacagatgttcttggtacatgccccatttgctgataccactgctgtcagggtttacttactcctgtaggacctatgttggtcccaaactcccaattttgtggtaagacatgagaccagcaggctgccggctattagaagggatgtaaaaatgatgcgaaaacgtcaaatatttaatggcatatcctctgtactataagcgtccctactactatatttgtctttgtattgatatttagcgagatgctatgatctctggttaaaccactcttcttaaattacctgtgctcaaggatctttgtagtttgtacaacccaggcgatacacagaagtgcttcagttctctcccactaaagactgcatgaatcctaaatcactactccctctgttgaacataacctactactattattatatgaaattctatgaatttggagactcccaaatatggcaacttatcgtatcctagttgtagaatatgttcaattcaggattaggttgctatagttttggatgaaggaataatagttttcaagttcaacatgctggagccctaccaattttcaggagtgcgcacggcctgaagtttaggaaacctgcgatgaatttctgccacattacggagatgcgcatgtccagatcatcgcaaccgatggctgcgaccgatcattacataaacaattccagtacacaaaaacgatgcaaaaaagatggtataaatctattatattatatgcaacatctccatatcatttcatgtgatatcctgcttctgcttgttcttgccacaaaatatagtgtaaacccgaataaaatattttctttcagttgtcccaaaatggatacctatggttgcctttcccctaatttattctttgatgccaggaaaccgaagctggcagtttacaatcgtaaacaatcaatccaatctcctcagcaagtaggctacttgaacctcct

SEQ ID NO: 65484 - DNA, 875 bp, Oryza sativa
ccacatggaaagcatttttatcatatatatcagcattgtagcaaaactgtgctctctctaagaggctgaatatgatgctgtcttcttgcctaaccaaggaggttctaatgttgtccaaggtcagtatttcacttttgatctatcctctgtttctcctccctgcaaaagtacaagagaaaagtattaatttctttgatgtaacacaaaaaggttttgtaggagtgccataatgacttaaccaggttatcaatatgttatttgtcccttgcaaagaaaaaaaaagttctttggtttccaagtcaattcccttttaaaaggtgcacatgtttatctagaaagttttgctgcgattcagggattgatactacagcagtcgtacaagaaaaataattcaccctttgttgagttttctacacaaagactttggtcaagtcaccagctgcccacgatttttggtcgaaatggcaaaataccttgcatgaaatttacatgtttaagcatccttggcatcacacaatgattaaaaccataatatggattcaactaatcaaaactcaaaactacagtatggctttaagtcaaagctggcaagcacaatcattagcacaatcaactccatgttgttaagaaatcatttgagagaaaatatttcccaactaggagaccaattctcaaccatcaactcgacatcaaaccattcctcatttttcttccgaaccagagaccacctcgaatcggatagtatacgattcatgaatccatcaattaaagcataacgctaacccggtctcgattcgcaaagcactaatgcacaaatcgcacagacgaagatgctatatgctactacaccaccaacgccaaacagagaatcacgc

SEQ ID NO: 65485 - DNA, 769 bp, Oryza sativa
ctatgctgacgtcagcaaggggtgaggcgcggaccgcgtcacaaaggggcgggccccacacgtcagcggcaaagcccaccgtggaccgagtccacggcggcagccggccacgtgggcgcgcacccgacgctccggatcggccggggccgatcggacggccgggggcggccgagcggcacgaccgggcaggcacgcccacaggcggcggcgaccgccgagcctagaccaccggcgacgacgccggcggcgggcggcgacggcgcgagaggcggcgagagagtggagagggaggctgttctcaccgagcgaatggggcggcgagacgaagacgaggaggtggccggcggcacggattaggcggcggcgggctcaccggggatcaaaaggaatggagcaccggtgggttttcggtggtttggagcggcgaccgatctgtggcttgaagcggccgagccggtgaaggaaacggcacggcttggcggtggccagggcgacggcagaggtgcgactggaggcacaaaagtggctgtggctcgggttcaccgtggagcgggcggctcgggggtggaatggaggagcggcgtggtggccgggcttgccggcggagcagcgaagctagtggtggtggcggcgcggcttgaggtggacgggaacggcggcaagaggctgccgaaggcggcgaaacggcggcggtgctcgggtgagcgatggaatcggtgttttgattgtggtttggggaaacggagttgcggacgggggctgcaggaat

SEQ ID NO: 65486 - DNA, 702 bp, Oryza sativa
tcttaattagacaaataaatttatcctctaatctgattaaacaaatgtcgctcttatttgacaaatgacaagttaactacctgtaatatgaaaaagaatgcatgtacaacttttaggtgaaacatcagatgggaaaacgttcaatataccaagaaaactatccggtcgttcagcttggacggttctgaaccgttcaacgacgtcgagtcgtcgacgcaagcgatcgatgtatgtcagcagtgaccgaagatgcacgagctatcatggctgatgtacattccaattaaccagcacctaatctagcaattaattattcatccacatgttaaatcttctgaaaaacggttttctgtaatactactccgtaactaatagttgagctaagacaattcactattaatcggggaccccagcaacgtctataatctggaaaaaagatgttcttgtttgtagataatggatgagggaataatcgatgattcgtgctagcaaatgcgtactacactgatcaacatgttcctttgcatgatagcatagcaatgatcactacgcgtgacggcgtgagctttctaaaattaacatttcgcgagaaggaaaatagaatgtgtgtggtggctacaaaggcaacctgaaagtgaaaaagggtagagctaagcttgaagcataagcaggattggctacctgacgagcaaccaatccaat

SEQ ID NO: 65487 - DNA, 720 bp, Oryza sativa
atgcaattcaaacacgcatgcgccacgtggctatcaaccgccgaaacggctaacgccagcgctgaccctcgcatcccctctcccctacctggctctgcaggttgtggtccccactagcgtcttgctttccccgagaggcaaagacgttgggcccaagcccccaactgtaagtcatcctcaggctgctttgcctgcgtgacgaccacaccatatctctcctcgccttgttacaaaaacacaagctctgcgttcgcgttgcctcgcacttacacaactggactgcatcagtttctgatcaccgcgttcgctcgatcatttgcttcgtccgagagatcatggaggcggaggcggatacgacggtgaccgtgacaatggaggagcagcagcgggaggcgacggacagcgagggggaggaagctggtgagccacaggaaggtgttcgtgggaggggtgccgctggggacaagcgagtctgagctccatgcccacttttcgcagtccggcgcagtggccttcgtcgacatgcccaagaacaagtagacgggcgccgcgcgtggcttcgcgttcgtgcagttcgtgaaccctgacgccgccatcgccgcggagtccgaccgcaacgtcctccgctggcaccacggtatacacacaccccagatctggtcctgtcatgcacacacatgctctcatcttctcttctcttcttcgtcgggtgatcgatct

SEQ ID NO: 65488 - DNA, 5827 bp, Oryza sativa
catccatctacttttgatagtcatatttcatcttggcacaataaccaaggataaataattctacttatcatccatttaaacatgctactaattattcctcgtaaacaaacgatttattaatatttacatttctcgatgcccatgtaactaatcttgtatggaagaatagagagtcacgcattaaatccgagaaagttataagaggataggtggttggattgaaatatgcctatcaaaagtaaaatttttcatatttgaaaatatacctatcaaaagtagatggagggagtagtatagctaactactagctccaaatcatatatagttaatttaatatcttatttatataatagttacctataaatatatactacaccattaatacatgatcgcacatcttaaatacataatattttaaagttcgtgctgcagctgactataaatctgtagcccgctttccttctctctcttctcttatctcatccacatatgcttatagctgatttgtagcctgctattgtactcgctctaagatgggatccactttcttatattcttttgtatataacacatactatatgtatattacatataatcttttcttgatcttaagctaggacctaaaaaaattctactcaacatgaatgaaaaagcaccatgcatgttgcaaaaaacatgaactaattttttatttcttatgatgtagagttaattttaggtttggccatagcaatattctttgttttctcctgtcccaatgcataaaggtagaaaaaaatattgctttattccttaagactattttgcatataatattgtggatgtcctaagactgcagcggatacagacggatagtgataatatcatattcattttcatatagctagatataaaaataaatacgaataactcggatacgaaattaaatacaagttatcttgaatataaataattagaattgaatatgattggatacaaatatggaaacaatatttctcggaacataaaaaccatcaatacttctaatagaaacaaataccatgttttatctcctttcatatacaaagtttcatcgtggagtaaataatgttcattaagtccaacacatgcaacattatcagcacaaatatgtgcctaactgatattagaacaaataacatattataatttgtaaaagtttttagaagttcaaataatattaattgtgtaaaatagggttagtgtgatgtgctgctattaaaattttaaagaggtagactgatagtccagagttagaaagtgcttatcgccttatccaattagacaacttttatagtgaccatcgacagtgtcacgtatttgtggtgtcttatagtgaattacactatttttggatgttctatagtaaattttgtgttaccgaaatgaatcatgatcacataacacaagaggaaggaatttattttcaagttagaaaaaaaataagttgaaagaaaataaattaatgaagagaaaagcttccctgggatgctcttttaacggtgaccgctcagtttgttactcgtattcgtataagagaagttacttctgctaggagctttccttagatgctccttgactcttcaagcctcatcggttggcctaataagtaaaagtataaatcaaaatttaaattttttaacttaaaattaaaatatttttaaagtaatttctttttaacattggcttttaagtcgctacgaacaaatatataaaagttttacatgttaatttttatatttactaataagtcattttagcttattagagaatatggataaccgatgagactcttggtacactacacagcaccaagtaatttgaataacgatatttctaccgatgtgatgtaatgtaaggcatgagcttcgttgcggttgactccacaaaatagtctaaagtcaacgatcaacgcccagcactgcacttctgcgaaatactccctccgtcccaaaatataaatatttttagcatagtgccaagtcaaacctttttaaatttaactattaacaaaaaaaataaaaaatcaattatataaaattgatgttagtagatttatcattaaacaaactgccattatatgtaactcttttttatttaaaacatcttatttttatagacattgtttgtcaaaataacatttcgaagactgtgtcaaagtaaaaaaaagcttatattttaagacggagggagcagtatatattattacagtatcaatttctctcttcagcaatgttcctgaatacatatacataaaaacatcagcccatcgcccatcaataattaacacttactctctctctctcacacacacacacaaaaagaagggcaggggcatatggcctgtacaaacccatctaagcttcaaatcgacaaaacattgtattttggaataagtgtgttttataactctcatctctttctttctcttgattgaatcactctcttaaccataaaatcgagtataacggctccatcatgttcaaaaaccggtgtaaatctactcctgcaatgttttagaaaatgatttttgttgatgtaacagtatgatcacgactgacttattcagttagcagatataacccacatgtcaacaacattttcatcatctcatctttttcctcacctctccctctccctccctcccacttttttgtaggcgtccaaagtcacgcgactaactggctattggctagtattcctgcatacttgtacttctcaaacattagccactacaattcaacactttttttataggagcaattcaaaccctcacacacatgcaaataataactagatgatgtcccgtgcttttgctacggatatatgttacatattggagaaatgataacatgatttagattgaaatattataacaatgatttgataatgatgatttagcatgtgtttgtttagttttagaataaaataatttataggcataattactatatgtttaaatgttgagctttatatgttcgatgggttgatgtggtatgcttacatggagatactagtagtgctagtaagtaaatattatgcttgtatttaagctttagatgtttagtggagagattcagcccttctacatcctacaataaggctgcaagccatgggccatggcccgtacacgcccaactttaggcccgaattcgcattcgatccgctaataacaatccagtagcaccgcgaactgtcatccgttagcaaacttcccttgatcccaacaaatttcgctcgaaaacactactctcttgtacactgcaggttgttcgcttcagagtttcagagcgtgtcgcgtgcaaccgtgcagtgaagctctccgtccccgaccgtctccgattttccagccgctttcgcgatctcctctcatccccctgttataaagccccactaccctccagacacgcctagcctctcatcgtctcgatcgatctctcacacgcgcgcgcctccattgttctcggatcaacaagctctccaagaacagcagcaaagatgaagccttcgtcttcctccgtcggcgtctgtaccctgctggtggcggtggcctccctgcagctcctcctcgtcgtcgccgtcgccgcctcggcgaagactgcaccggcgatgccagacgaggagttcttgggccgtctctgcgaccagcagcagggggccacgcggcggcggctcccgtggtgccagcagctgcacgcgaggcggcgccacggcggtggcggcggcggcgtcggcgtcggcaagcggcggcgggtgccgatgccgccgcccagccgcgccggcgaggagatcgacgcgcgctacgacgtgtccaagcgggtcgtgccgagcggaccgaacccgctgcacaactagactgatcgatcgatcgtgtatctgccgcttgcattgcatgcgggcgtgcgtcctcattgatctttcttcccgttgcgcgggggcggctgatcggcggctgggcgcgcgcccgcggtcagtccgcccctatagtactactgtactactactatactagcactactatactactatacctactactattcctacatacaataaatgaatgtatacacatacgaataaacataaaaatttattcatatgcatacattttttacctatataaaaactacatacatgtatatgttgtatacgtatatacaatttaactttgtatacgtgtatacaaactttatatacgcatacgtatacaaagtttgtttttttttttgacaaattgatccttgtagaaaacttatttcgaaattagtctttgccaaaaactatatccagatataggctgttggctcagcgccaaagttgttagcgctgaggttgttcctgtcagcgtcaacaggactggcgctggtattgcgccagcgtggcgggcgaggagcgacgtggcatggcaccaacgcaaatgtatttggcgctgaccccttatacatggtaaacagactgatgtcttgtaatgaattagttatgtactgctgcaatggtaagttcctttgcctggtgtaccttaggactagggttcgaatcccaggtcagccattttcgttttttttccttgttttttttcttcaaatcttcaatctccgtgcgtacatataaatgattaatgatgatttctgtttttgaaaaaaatatatacggtactaatcaccctattacccaccaaactgaaagaaaacatcggccaacgaacaaaattaatggaaaaaatgttgatatgtcaaggatttgaacccataatgtacggcatacaagtcaaaacattaaaagaaataacacattttttgtttaaattaatttttattaaaaagaaatatcacattcagtacagatttaaaaagtagaagaatggattaaaaaagtttagagtcaaattttaaaagaaatatcattttttataaaaaagaaattagaagaatggaaaaatctcacctttctagagcaatattgctagaggtgctaggaagtcgacgaaagccgctggaggcgatcccgcgtcgctcgtgatagcaattgcaacatgcctgcatcgggagcatcgcgtgcagcagctcgctataggcccgcggtgggagcagcagcaagctagcaagttggtagggttgtagcaagagcagcaacaatggtggacggaggaggtaccaccaattagggttggggggaaggggtcagcaatttctgaatcaccatgtaggatggcctattctaccaatttttggaaaaatccatcttctaatcgtgttattcctggccttgaatccaatggcaagtattatggatttacgggtgccaacagttttgatggtaagcatgtaattacgttttttaagttgtaaatttaataaaataccggttcaaaacagttacaaatagagattacctatacatttttcgaaagatttttatgatcgtatcacatagatttttaatctttgaattaaaatccaatagatataataaaaagcaaaaagcaattaagaaacactataatggacactaaattaccatatcctcaagcaaaagaccaaatccaatacaaaatttaaaatttacatgcgaagatttaaaaattacagtgtaacttacaaaagttacagtgtaactttcataaattacactgtaacttacaagaaaatgcaccgtaaatttgagtgagaaaatcgagtaagagataagaaaaaaatctttcgagtgagatatagcaaaatcgttacaaatatgcagttggcctttttttggaagagaaatgtcatcgagcccaatgggccatctatcaatggaggctaagtacgtactc

SEQ ID NO: 65489 - DNA, 2028 bp, Oryza sativa
gacgggccagactctcccgtgcttctccgctagggccttctcgtcggcctcggcggtcgccgtcgcggtgccgcacgaggcgcgcgactccggcctcgggagctcggcctactgggcctggatccgggcggcggccgagtcggccccggccccgcctccgcagcaagaggaggaggatgagggcctcgcgcgctgcatccccgtcaaggcgtacttcctctccaccaggtacgttggaagcatatgcgcgtgcttgcacgacaggtgtttgttgattttttttttcaaaggtgtatgttgctatcatattgtgctaattcaatcttccttatgccattttgatggatgggcacgactaatagatgcagaggactaaaatgatgttttgtttgtctgatttttctttccccctgtggcagcattgatttgaagagtttgcaggcggaccatgggagcgacgtggtacctccgtcgacccgatcattgaactacattgcactccgatactcagaattccctcaagaaatcatggttagtgattccaatttaccatcacatagttcctggtccaaatgcttttgaatcaacaaatttaagttattaactccaccttggtaatttgttgaacgcaattttgtgaaatctctctttttctgcactgcaaaatttaacttctctgcaatgattggctaacatttctgtaggacattggagttaaggacaacagattttgctatcgctatgtggttgtgttccaatatggttcggctgtgcttttcaacattgctgaccatgaggctgagcactatcttgatatcatcaggaaacatgcttcaggatggcttccggagatgagaaaagatggtattacacatgctattcactatcttgcttgtcatattttaccttgtgaacaaagacattttactcggtacttctagttttcttcacactgttccattatattgtgtgtacgactagcatataattcaattgccttctatgttagtgaaaattacattttgataaaatcccatagaactacaagagagtccatatgcatctgattgatattggacgtgatgcattcataggctggtaatatgtgaagtcatttagagttgagtagctccccttctaccccctaaacagttgcaaaagcttttctttcactgggacaaaactggctcatttgcaaagtagtgaagtagcgtgtaaggttaagaatttaagattgtattacatcctcacatgatatcaattctacaatgaccagattatgcagtagttgagaagccctccctgacaacatggatgaaaggaggtcttgactatatagttcttaaaagcctagatacagatggaattcgcatcattgcaagtgttcttggccaaagtattgctcttgatcattacatacggcaggtactgaaaaggggcaacttcgacaagctttttccatgtggtggtagccttgaaattttgttcttaaggttctaaaaaacactaattttggtaggtcgatgacatggttgaggaatttactgaaattaatcgtgtcatggagaagactgggaactttaccatgcaaagaaagaagctgttccaacttgttggcaagggtaattctaaccttgctgatgttatcatcagacttggcctttttgacaggtatctcttctacaatctaagtaccacattccctttttagatggttcatgtcttccgttgcaattgcataatttcctctcttttttatcatgtatggaagtaatctcattgtataccaatcctacgtgcattgtgacaagctatgctgtgggggaaggaggcatgtagtttgatattcttttctggtgtgtttaaaaggttaatgcattttagctctgaactgtaaaattggagtttacatgccacagttctgtgttataaaagcactttgttcattatacaaatgttatgttattgttttccctgatgctttgcattaaccctagctctgcaaatgccattttacttaaggaagca

SEQ ID NO: 65490 - DNA, 1049 bp, Oryza sativa
tcaatgcccatatagcaaatcatatgtggaaggatgaagagtcatgtattaaatccgagaaagtcattaagatgatatgttgttggattgaaatatgcctatcaaaaataaatttttcagatttagaaatataactattaaaattagatggagggagtactaattaccactcgacacatgtccagacaccagaatataggccaagaaaattcacgcacgggatggactagcagcgccgtcgtcttgctcaaccaccgccagttgcagcttgcagcactacgaatgaaatcaactcatcagtgacgacgccgtcgctgaaaaggctaggcatgatgagagaccagccgatttttttactgtaactacccttctttatcgtaccggtccacttcagggaacctccaattatgcccaggaaagcagagacagtgctgccacaaagtcaatctagcgacatacgcgaatgacttctaccgggctaatcaaccactagctttttcatctaccgtttcgaactaattgaacaccccttagggcacctgcaatggttatctataggctctctacaagagatccatatcagcatattttcctacttggaagagattaaatgaagagagagagcaaagctatctactaacctagagatagtctatagagaaaaacgagacaatgcattagagagctatagatacccatgtagacataccattgaggtggtttactattaatctagtctattgctgagatgcacatgttttatagagaacaccttactttaccattgcgggtgctcttagctagctactcctacctcattcgttcgatcattaattagctaatggataagtcgcgctcatgaacacacggctgcagccaatcacggtgctcacgtacctgtccatgttgacacatgcatactgaacactatacataatgaggttaataattatggttacgccttaatcttgacttgtgtacatctcagtgcgtgattaacactgattaaatatggtgggttgatgggatacatcatacttacatcaata

SEQ ID NO: 65491 - DNA, 3384 bp, Oryza sativa
atatatatatatatatatatatatatatatatatatatatatatatatatatatatatatatatatatatatatatatatatatatatgtatatatatatatgtgtggactctagactcgtcttttaatatttcttttcttttaatttcgaattttctgtaaattgtatttctatatagactttatgctcttcttccaatattatttatttttatttctaaatttttattatttctaattgtatttctatgtggactctaaactcatctttcaatattctttaattattaatttcgaatttctgttacttctaaattgtattcctatattgactttaaacttttcttcccatgtttttttaaaattttaaattttagttatttgtaaattgtattctatatggactctaaactctacttttaattttattatatttattttaaattttagttagttttaaattcctatatggactctatactctacttctaatattccttattttttaattccgaatttctattattttcttaattgtatttttatatgaactctatactctacttctaatattccttatttttaattccgaatttcagttatttcctaattgtatttctatatggactctgccttttctttttcttcgattaatgtgaaaatttctaaaccatgagagtgaacgtggaggctcatttttctatttctttaataatataaagatttttaaattaatcctttaacttctcaatattaaaaacaagcaaatgtaaatggataagcacatataaaattgaattggggttgatattctctatagcaaaagagaatgggtaacacattttgtgaaaaatatatttttatttatttcagatagtataatttctttcatccttagcaaagtacaggaattcagctagtcataaaaaaagactcaaaatttatacaaacaaattactgttatatacttgttgttgacggatcgttcggaaagggcccacctatcccgtaccgaataagaagagaagagataaaatttgctcgtgtgacacaaacaatttttttctttttaccaaatcaccgagggatagagttttcccacctgaattcattccaaacgcgagaccaagagttacgaaggtttacatagggattacatcataattaagagtggaggggggtaggagaaaatggcgttgatggtgtcgttcaatgccacaaacagattttgattttaaatatgagataaacccttgagtcctacttgaataaaagggataaatcacagaggagagaggacatttgcgataaaacccaaaatctaatcactcgatcaattaatgtctagccagtgttgatagcgctacgagggacttaatatctccagccagtgtcgatggcggacttcgctaccctaacagaaacggtaaatctaattgaagaggcctctccaattagtcttaaccagagacacccacgtgttaatactttatgagttttggttattattaatccattaagcaagtaggggaaatattcctatcatctatgcttcaaataaaattttctcttaaattaatcatccgatttacaatccgattacatcattgtgttcgtaataattaaatctttacaataaaatctcacatgattatactttgatgaaaaatcataaattacttttatgatatgtctaacttacttttagatttcagtaagttacttcttagacatataaaagtaaatttagtaaagcctaaaagtaatttacctaaattatagaagtaacttataacagaaagaaagtaactttaattaatgcctttttttcattgaacaaattatcatatatatatatatatatatatatatatatatatatatatgttacttttagatttgattaaaatacttcctatacattcataatgctctgaggtgattacttttattattattttagttaattccataatttgtgctgattaatttattttctagatagagtcatgtttttatctctacaacggatttacttcaaatgacatgctaaagttacctttattttgttctaagttacttttataatatatgtaaattaattttaggttttactgaatttacttttatatatctaagaagtaacttagtgaaatctaaaagtaatttagacatatcataaaagtaatttgttatttttcatcaaaatataatcatgtgagatcttgttgtaaagatttaattgttacgaacacaacggtataatcggatcgtagatcggatgagtagtttaagagaaaattatatttgaagtataggtggatggtgcctctatatagagtggtagctggtttagacaaatcagctgcgaccagcgcgcgacctcaagtcgatcaatgtgcgacctcaagtcgatcaagctggtagcctagctggtacccccgtttttcctatacggtgtaactaatggaagaataaagatcgcggcttcagtagcttcacaagaaaactagttagatcaatttcgttttagcagagatgatcgtgtaagactaaggctaaatcaaagtgaattggactcttaacacttccatccgagcgtgcaaacggcaaacatcagcagattggagggccaccagaaaggcacatttaaccccatccctttctccccttctttgttccttgcttgccgaccgagaactctgatcgtgacggggccagaacaaaccggcactacgtacactgaccggccgcttggactcggatgagctaattaatcaatcaatcagtccgatcgagagtttttattttcaattaattcctatcttccgttggactttgacgctttgattagaaattaatcgagtttgttaatttgccacgatcggatccgcggttgctttcagtgtggaacacacggcgctaattaagacttaaaaccagtagtagatattaattagaaggtgctttaattagcttagccactccagctccaatgcctagcttaaccacaattgttctgatcacgtcattgctgcagctagctagtactacgcctgatgcctcccaggctcccacccctctactgtgttctgccaccgttgacacgggacatagcccaataaaccaacgaccagatacatagttaattagaagttaatttttttttaagacagagacaaagtatgtatctatcttgacgaaacatgtgccacttaatccttgattggagaacacatcaaaatgggcaaaataaacgtacatgcgtacgtacgttgagatagctagtgtcggtgacatggggccgggggtatcgtgactagaggcttgggtagccgcggtcacccacgtggcctgaccccctcggggggggggggggggggc

SEQ ID NO: 65492 - DNA, 4254 bp, Oryza sativa
  unsure (1)..(4254): unsure at all n locations
gcttctcagcggcccgaacctgtctacgtcgcccgtgtcttgtgcacttcctctctcgctgacgtttcttagatcgagggcgaagaacctcacttagcgtccccggccgaatcggcaaaggggggcctgcgcggtctcccggtgaggagccccacgctccgtcatctggcgcgccaggtgaggggcgcgcgtgtctttctaagccctcgtcctctttcgtgtgcgccaagcttctcccgctcagcccaatggccgaacgggcagtggcgcacagcctctctccgaacgctagcggcgacgacggggagcagaacccgcgccgtcgggctcgcaccccaccgtccccctctcgccgaaatcttgggcggggggaggcgctcggggaggtcgaaggatccgcgaattcgccgcccgcgggcgacgggggaggacggcgagacggggcgcgtcgccgcctcgtctacggcgatggcggcacgccccagggcgcgctccaggctacgggcgcgctcctgcgtcacccgcccgtcgtccccgatccagagactccagcccgacgttggctggatgacgtggccgacttggtcatgacggcgcagcagcgcctaggcgccagcgggcggtcctccgccaccgaggcctctggcgctgccgccgccggctccatgtcntcaaggcnganggcccnacgagcggcggccgttacccgccgttcgtccgccattccctcgtcaacgcctccaacccaagaagatgtgcgtggggggctggatgcccgcctcgatatcgagcgccggcgcgacgctcgtcgcgccgcccacgcaacggagggcgcttcctcgtccggagcgccacttcggtccgggcacgggggccggccccccgtgtccccggttggcggtgccggctgtcgagcctttgtggcgagccttcggaacgtccgttggcccccaaggttccggcccaccatcaccgaaaaatacgacggaatcgtcaaccccgccgagtttctccagatctacacgaccgggatcgaggccaccgggggtgacgacagggtcatggcgaatttcttccccatggccctgaagggtcaggcgcggggttggctaatgaacttaccacccgcgtcggtccactcttgggaggatttgtgccagcagttcaccacgaacttccagggcatatatccgcgcccaggcgaagaagcggacttgtatgcggtacaacgaagggacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagctccggccgcccctgggtccgccgctcggtcagggcggcgggacaggaggaggaagaaggggtcggcccgttccgacgacgagggtcatgtcctcgccgtcgagggcgcttcgcgggccccccgaaaggggaggcctgcgagcgacaaaaagaaggaggccggcgctcccagcagggagcgcccgaccggcaagtggtgtactgtgcacaacacctccctccacgacctcgcggactctgccgcgcggtcaaaagtttggctgagcggacgaggaagtgggaggaggagaagaggcaggagcgccgtgagggcaagaccccggcggacatgcccggggtccccagggaggtgattgagcaccgtcttgccgtgcggccgggcgcaaggccggtccgacagaaagtgcggcggcaggccccggaacgtcaagccttcatccgcaaggaggtggcgcgacttctggaggccggattcatccgtgagatcatccatccggagtggctggcgaacccggtcgtcgttcccaaggcgaacgacaagcttcggatgtgcatcgactacaccgaccttaacaaggcatgtcctaaggacccttaccccctgccacgcatagattagattgtcgactccaccgcggggtgcgaccttttgtgttttctagatgcatactctggttgtcatcagattcgcatggctagggaggatgaggaaaaaactgcattcattacccccataggaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcactacccctatttaagctcctcaaacgctccgggccgtttacctggacggaggaggctgagcgggccttcactcagttgaaggcgtacctcagttctcccccagtcctggtcaccccggagccagatgagccgttgctactctacctggcggcaaccccgcaggtggtcagcgcggcattggtcgtggagcgcgacgaggacaaccctcactccgcgtatccccaccctgtgtcgactcgacccgggagagagcagggaggagaggcccccgagccgaacggcggcccaaggcccccgacggccggagctggccctccgcctgcttgtccgacggtgccaggcgcccccgacccccaggatggccccggggccactgcgggaaggccgcgcctgtcgccctctgaccccgaggtcgtcggcacagaagccgagtacgccccgcgtggcctctcggacgaagagcgccctagagatgcggcccctggcgaagaggatcggccccgccgaaaggtgcagcggcccgtctacttcgttagcgaggccctccgggacgccaagacccgataccctcaggcccagaagatgctttacgctattctgatggcttcgaggaagttgcgccattatttccaggcgcatcgggtcacggtagttacgtcttaccccctcggccaaattttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtctccgcccccgaggccagctcgggcccctcgcagctgcctcacaccgcctactgagtgatgcagttcgacggctccctgtctcttcagggcgccggtgcgggggtcacgttgacctcgccgagcggagacgccctcagatacctggtccgcctcgactttcgggcgaccaacaatatggcggagtacgagggactccttgcaggactcagagtggcagctggactggggatccgccgcctcctggtgttaggcgactcccagttggtcgttaaccaggtctgtaaggagtaccagtgctctgacccgcagatgaacgcttacgtgcgccaggtgcggcgtatggaacgccatttcgacgggatagagcttcggcacgtgcccagacgggataacgcggtcgccgacgaactctcaaggctcgcttcctcgcgagcccagaccccaccgggcgcctttgaagaaaggcttgcccagccatcggcgcgacccgaccccctaggggagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgcgaagggagtgacgcgtcggcgcatctccaagtgctacgtgctggtggaagggaccctctatcggcgcacggctaacggagtcctcctgaagtgcattcctcgggaacaaggcgtcgagcttctcgccgatgtccatgaaggcgagtgcggagcccactccg

SEQ ID NO: 65493 - DNA, 3645 bp, Oryza sativa
cccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggagaaacgcctttcttcctcgtctacggcgcggaggcggtcctcccatctgagctcaccctgaggtcccctcgggtcaccatgtattgcgaggctgatcaagatcagcttcgccgagacgacctcgactatttggaagagcgaaggcggcgcgcggccctccgagccacgcgctaccagcagagcctgcggcgctaccatcagcgccacgtccgggcccgatcactctacgtcgacgacctcgtcctacgccgcgtccaaacgcgtgctggactgagcaagctctcaccaatgtgggagggtccgtatcgagtgatcggcatcccccggccgggctccgttcggctggccacgggcgacggcacagagctgcctaacccgtggaacatcgaacaccttcgccgcttctacccctagtgggggtcgggtgtcatgtctcgggctcgggccaaccctgcaccccccctcccgggcgtgcagggttggccgggggctaccacatgcatatacttaccttttttctcttccgtatttcaataaaagcattttcgatttcctgaggactgtgtctgtgccatcatttccttttgaagaatcttggcttgaattagcacgctcgtgctcgaccctgccctcggtggcccgggccggctaaaatcgccaaacggggcccagaaccgagccgtgccccggggcgtggtgaactccgggggggaatcggcaaaggcccacaatcgggtcatccataaccctcggtcaccgtgctcccggcctggccagtctcgacacgaggatctccccaggcactagccccgacccgcgccgtttgaggctgggacctgggcacgagcccttgttcaagccaagacacagaaggaccgcggcacagaccatcctcgtctcatacacacaacaaacagaactgacgcagaaatttcctctttacttgattgcagattaaatcagtctatacaagaagggggcccgaaagcctcggaagaagaaggaaaagttattaagattggcgggggcctgggggctcactccgacgcgcccgggtcgtcggcctcgtcgtcgctgtcgtccgcaccgtcatcaccgccctcctcgtcggagtcgagcgcgaacgcgagccgaggggccgtaccctcgaagctgtggacgatgtggtcggcggcgtcccggacctgcgcgcgcgccgtcctcggttccgggagggaactcttccagcgctgcccacggggagaagtcagggtccctggcctggtagcttgccagtacgagctccaccgccccccgggtgaggtccctcgaggatgacttgatcgtctcctcgagctcctcggggagccgctcgagggccccggccatctctgagaggcgctgggcgaggcccccctggttggcggcgtacttcgcgtaccgcccgccccagaggcccgcctgccgcccggcgcggtctagacgggacacggcgtcccgaagcatgccgggccctacctcgctcgccaagcggagggcctcgacctccccggcggacgagtccagcgcgccctgcagctcggcgatggtgtgttcggcggctgcgaggcgggcggctaggtcgccgtggcccgcggccgccccgccgctgtgcgctctcgcgtccagctccttcgcccgcgcctcgagctcagcggcccgctgatccagtgcggccctctcggcgcgggcgccttccagattgcggcgcgcctgctcctcccgcgctgcctcgcggaggaacaggctgtccgccagccgctgcgccgtggcctcggcctcctcgagagctcgcccccgctcggtgagcgcgtcctcgcggaggcggagtgcggactcctcttcggcgcaggcggcctcgtgcgccgccagtgttgcctcccgggtggcgacggcggcctcgcggtccgccaggtctctctccttcgcgtccagggcgcgggcgcgctcctccagcgccgtggcgcgagcctcaagggcctcttcgcgctgccgggacgccgcctcgttctccgccgcccgccgttctcgggcagcggcggcgtcaaggactccccgggcggcgtcgagcttctcctctagctccgccgcccggctcccgtattggaggcggaggtcgtcccgcgcctcgtcgagcacggcggtggcgatgagggcagtctcccgctcctcctccacctccctggcgatctccgccaggtccctacgacgggcctcgagctgtgaggcgtgccggcggtgtgccttgcggcccgcctccaccatggcctccaccgagcgccgcccctcctcgacgcgcgcccacgccgcgtcgagctccgcccgctccgcctgcagggcctccatctgggcacttaacccgtccagcaccgtactgttcgcggcggccaaggcctgcaggaggggctccgcgctcagtggggcagcggaaggcagaggggagagccccctcggtgtgggtgccgcgcggctcggcccgccgatcgacgtgccggactcgggggcgtcccccgaagctggctcgtcccaagcgtcgcccgaggggtcgggcccgagcggtgcgcccgcggcctcgtcgtgggtggcctcggaagtcatcgtcgcctcgggcggagtcgggtcgggggtttggcaggccgcctggtgtgcgcgcgccgcctctgcctcccggacggactcccaggcccggcggagtctggcctcctcccgagcggcctcctcagcctggcgaacccggacggcctcctgggcagcctcctcggcttcccggaggcggtccgcggcttctcgccggtcagcttcccgcctccgggcctccgcggtcgccgtctcctcggcctcagaccgaccggacttggaatggcgggggggggcgcgacgggatctcgctgaggcagaagaaaaaccagaagacaaaaagaaacgggtgagtgaaaactcgccttgggagatgggagaatgaatacggccgcggtgggcgcggggacgaacctgcggggaggtcggctaaacgaccacctcgggggcgagatgaggttcccccggcatggcacgatcccccccatcttgcggggccgtttcttctttcgctccccctcgggctgcggcgtcggcaaggcaccctccgggcgcctgctgctggcacgcaccgcccctccccctcggggaggagatgggggaggggtaccctcctgcttcctcttcccccgggcgtcggcagggcggctgccccccgggcccccgtcgcggggcccagaagcacgaccccctcccggggtagattgttcccccctgcggctcccgcccgcgccatcgtggccccggggggcccgctcccccgacgccccgaccacctgcatgatggccaggatcttggcgcgctctggatcgcagcagagggggaggaccccttgggggatgagggatgcctccacggagctgagattcagcacccgttggaccaccatc

SEQ ID NO: 65494 - DNA, 1391 bp, Oryza sativa
ccgtctcccagatctaccgccgcccgccagctggaggcctgcgccgggggctggctcggaagtcggaggcgcgcttcgtcggcgaggggggtgtagaaccaatcgctcttccagtcgtcccactttttgcggaggacgcagggaatgtagcggttcagcacctgcccccgcggctggaagtagcagccaccgactaccgtcggcggtgacaccggctgtacggtgaagaaccaccggaatagccggagagatgggcgcaccccgataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctaccggccggtggcagattccggcatgaatcggcgcggcagcccggcctgcctctcgctcacgatgcgggaaggcggcagcacgctaccatcgagcggtgcggagccccgtgccatgacgccggcggaggaggagcttgagagcgagcgagtgcggcaagggtagggcacaggaaacgaagagttagagcacaagtggcgaaggcaaggggaagagtggcgagaggaaagaaacgaatcccttccttggcgtctttacacccttgccaacgctatgcccggctcctcgcttcccgcgcccactacctcgccccctcgtttctcgcgcccacgcctccactaaccccactcgcccgtttgcggcgcacgcggaagatgtgcggccgtggcggttgagatggggcagatcgtgcgcgcattaactacgcccgccaaccgtgaaaagcgtcatcatcatgtctccaggcgaaacgaaccggctcgtcccgattcgcgcgctgctcgagtaatgtagcggtcttaaagaggccgctcattattgtcggtcggttttcccttgccgatgcgcgcgatttgcgaccgccgggtttctgcccgcctgtagggaccggccccacctgtcaccgggcctaaggagtggcgtcacgcccgagcgcttccctcgaggggggcgatcgccctggcgtaacgccgggggctactgtcggtgacatggggccgggggtatcgtgactagaggcttgggtagccgcggtcacccacgtggcctgaccccctcgggggggtcgggcccgagggtgacgtggccacctctccctctgtctccccgaggggtcgggccgctcccgtttcggccccgagggctggggcgccccgacccctgtggttttggcgccacgtgtgtaggttaggtgagcacag

SEQ ID NO: 65495 - DNA, 2675 bp, Oryza sativa
gtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctcattgtaaaaagcatgtttcccttcttaggcagcaggaggcccatgtggtgaccccggaccagataaaaaggaggcccaggcctaaaaagagagagaaaagaagaagaagggaagggggttgggactctggcgaaggggttctagagcctgaactctctctcgctctccggctctctgtattccttcacgcacagatccaccagaacacaggagtagggtgttacgcttctcagcggcccgaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctccgtcagctagctaggcagctagcaacctactccctccgtcccaaaaaaaaaacaaacccttatttccgtgcccaacgtttgactatccgtcttatttaaaaaaattatgaaaaaaattaaaaagacaagtcacgcataaaatattaatcatgttttatcatctaacaataatgaaaatacgaattataaaaaaaatttatataagacggacggttaaagttggacacgaaaacccaggatttgtattttttttttttggacggagggagtagctacatctatgttccgtaacatggtaacgattgattaatagacaagggaatcgctcgctgctccggtcccatccggctaaccattggtttcgccggcttaaaaaaaaatctcctgattatagcgtagttaacttgtttaggaggttggggattcccccctatctaactcgaggctaactaagcagagcttagcttaaattagctcgtattacttctagttgcaagttgcacatacgtactccttgcttatgcagcagagagaacaggcaaccggcagcctcgcgtagctcgtcgtcctctgccaatcgcccacacgcattgtgtttaggcagacagagcatctttgtctcagatctccccccgagtaaactaattgccactgggattactgggagaagccaccacctacctgttcagacttcagcgtcacctgtgtgtcatggatgatgcattcatgcttgcatatgtatatgctctgtaccctgaatcgtgagacatacgtggtgcacaaaatgcaacatggatggatcatggatggatacatggttggatgcatgcatgtcgtactggcttggatttgcatgtgtgcgtccaggtgctggcatatacttccagcagcagctagctacgtgtatagaattgaataatgtttgtagattttgacttggtgtagagaagacggacgagagccagctagctgcaaattccaacagacaccaggtgcagtgggaaaatactagtgtttggttcaggcagagcgatcgatcgatcgatcatgacgccgttcctgctagataggtatcgtcctcttgtctctttccagataattaaactagcctagttgacgagtcttttagtttttttttattaatgctgggttgctcgatctggattttagtttatctcggagaggggaatggaataggtgtcatattatatgtgtactgttcaccaatctgcagatataatagtagaatacaaccgttgcttgatttctagatgaaacgagaatgacaggcaagctcttgtgtgctggctaccacagttttgagagaagaacctaacttggtttctgataaaagcattaaaaacaagccatctgaactctaagaaatgtacaaacataaaaaataggtcatgtcgttttcgctttttttatcatatcatttacagagtagttcttaattaactgtagaccagagcattcctcattgagaataactctcaatatatgtatgtacaggatatacggagtatttttttttcctttttgaattaatatgttgctcccgtcatctcagtatcaatccagtatacttttttttttctgtagtcttcccctgttccacatcaaagaccatgccgtattccgttgcaaagacagcaatagcatggcttgataaagaaacatattcaccaatcaccagtactgcccgtctctgaatttcagagtcgaaagccaaaaggtaagctactcgattgactgtatccacagttccacaccctgctgttccccgcgagaacaagtagtacagtattgcccatgcattcgcggtgcgggagttccgtgcgcgcgcgcgctccgtgtacgcgcgcaaaaagaacggcggctctcgaggcttggcacgttggcacgcacgcgcgcgccatatgggcttgctcgatcgcgcggccccgatcacgtacgtgcgactgtgcgagcgaccgagcgagaaccacgcgtgccccggccgcccaccccgcgagtccacggcacactcg

SEQ ID NO: 65496 - DNA, 10728 bp, Oryza sativa
  unsure (1)..(10728): unsure at all n locations
gtgtctgctactttatcaacagtactgtagacatttccactagcaaatttaccatttattttagtagtagtacaaggctgcacgatattgctgatactatagcagctatcgtgtaatgacagtacccaacacgtagtatagtagtgttgttaattgttttatatcctaaaatataataatttagtgtgggatgtaacataaagtattttagtaattacgaatgaatatttatattttatattagattgttatattttaggacatgacttatggagagttcgcgtatttgggatatacaacgacgtagatcgatcggtctgtgaagtgaacgtacgactcgtcggtctctatcgatctcggggtcaagactgacgttctgacaagggaaacctgaatgacctgttaaattggacgtggtgtactgtacacttggccagaaggggttgcgtacttgtgtacgtatttcagtatttctgctctcgatctctctctctctctctttcgctagttagctttgtcctttatattataggttgatgtgttgttccattccctgtacggctgagggtgcaaacgcccgctcttgttcctgtcaccatgtcccattcgatcgttttcctcctagtacagtggacacgcagatttactgtagatcctcgaaatggaccggcgcggtaacaccgatcgtaaatttctcagtgaaaaaaaaatgcaatgtaaaatcagttaaaacatgtggccaaaagatcagactctgctaattacagccttacaggggggctcagaaccaaacaaaaccatctctagccaccaaaattgactcacgagaggttaaaacttgattgaaaggaacaactcgatcgacagatcgatccgattgatcgatcgtatcctagctattagctagctagctactacttcatgagacgcgttaattgaaccgatgttaacgaaaataattgggtgtactagctagcacaagtcaagacacgggaaatagtgatcgtttctacgcctcgacccgatcgatggatgattcgatggacgacacgtaaaacacgtttggctcttcgcgatcacagaaaggggatagataggccgacacgcgcggtacaagctggattagtacattattgtctccacatgtatatatgataatatgattattgctgtagcccgtaggtctatccagccgtacaagtaccactatgtatatatacgtacgtaccctgtggatcaaccacaaattatttttgtgacgtgctaattttataaagaggttttggaaggatttgctaattatattctaacgagcttatatggaagatgagtcgacaaatgcagccaacacgttcacatgattaattacgtccagcccggcagtctatatttcgacgtgaagttaattagctagcagaagatcctatttgtgggtcgtgtgtgattagtaaactgtctgtgtgtgtgtgtgtgtgtgtgtgtgtgtgtgtgtatgtatgtatatgtatatgtaatactgaacacattttaaatggatttttagttagagccgtgttagattttaaatggatattttggaacactagcccgtcgtcagtcatcactttactaatttgaactgatgtcgatcgtgaaaaattttaaaccgatgaaagggtagaattcctagcataaagaaacttttcaaacttacattacattactttaacttgcaaataaaaaattctacaatgctaaaatgtcaaatattcttgtggaaattctcttgtccgtcaatgccccgcttgttccatgcatgcatctccagctgccggctcacttgtattaaggaagaaaaatcccatttctcctttcagtccctgtccacttaccatttccttaataccctcacactagcacataattctctctgatgatctggtcaggtgtggcgctgcacactactgtgtcgacacatacccaagcagcaacaaaacaccccctctcctggatttccattttcttttcgtccaaccttgataatacatttttataaacctattcatgtcgtatattacttattaatttctccatcagatgagaaattgccgttgattaatccggagacgaacaactacacaacccgaccggtcgggtaattaaaaccaatttagctctcgttcgtcagcgccgatggctaagctcgctgccggggcgcgccggccgcgcgtcccgtcgcggggcccgggcgtccgacgtggccgaccaggcgggcccacgtgccccctcctcgctcgggcagtgacgcccgtgtgggccacgccctgcctccccagtccccaccctcaccggcccgcctcgctcgcccgcgcgcgcgcgcgcgacgtgcatggcgcgcggcctcctccccccctcccgccgctatatatacccctcccttgcaaccgcctcctctcatcgcacactccaagctaagcctaagcgagcgagaaaaaatagcaaaagctagccggcaagcaacgccaactaattaggggagagagatattcatggctccggcggcggtggctgcggcggaggcggggtcgaaggcggcggcggtggcggggaaggccgtggcggcgtgcgagcgcgacgcggagaagctggagttcatcgaggagatgacgagggggttcgacgcggtgcaggagcgggtgctggcggcgatcctggcgcggaacaacggcgccgagtacctccgccgccacggcatggaagggcgcaccgaccgggaggcgttcaaggcgcgcgtccccgtcgtcacctacgaggacctccgcccggagatcgagcgcatcgccaacggcgaccgctccaacatcatctcctcccaccccatcaccgagttcctcaccaggtgtgtatagtagtgctagctaacccaaacaatttcttttttcaattaatccggcctttcatttgccggctcggctccgccattgactccaactaattgtttgattagtttttggtcgttgcttggttgatcgttcttgcttactaattggcgtgcgtgtgcatccagctcggggacttcggcgggggagaggaagctaatgccgacgatagaagatgagctggacaggaggcagatgctctacagcctcctcatgcccgtcatgaacttgtgggtgatccatctctgaatctctggccattatcctactttagccatctaactgttttctttttctcaccatgcctttgattgggacgttttcttgactcccggcaacagttgaagctacctagctaagatacaagtagccgtattaatttctagcatgcaatttttaatcttcttttaataaaaaagaaagaaatgatttcttaatctagtgtcattgatcgatgcattagtttaaggcctaattaatctaatctacagagacaaacctaaacctaaccgttttccgtttaaactttaccatcgaccgatcaagaaacagtacgtttaatttttcatatgctaaatataatacttgggaaatgtaatgaccggggcgagcgagtcatgcgtttgtagccttggtgacctcacaagggtttggctaagaaacaccgcaacttgcgagaggtgtggctaattaatcattcacgttgagcctaaaatataatgtgtttgtgtcttagacgctagaggtgctgctgccttgggtgtctctctactttttaggcaccgagattccttttctaatttgtaagacatctaacgatagctagctagcttcctaaaataagattatgtagcagctcaaagtcgctcgcatacgtaaccaggaagttggagtgtaaccttacaaacaaagcgacaaatcggctaccggccttgttgcgctaaaataagctaagagaaagggagttttcagaaccattcaattagcttgaagcttgaataaacacacacgtaaattaatggtactaacgctcatgctcataaaattttatcagcattattacgtgccctgtgtcaatcccacattaatgtatcccagctgaaaggaatggtgcaaccaccggtgtatctctgttaattagccatcacaatgctaaatctttcgtacatctgatatcttatcataggttatgtcaacatcggcctgaatctttaattaatccggcatgcagaactcagcatcagtgggccatcaattacactgcatgatcattgttgatcccttcctgcttaacgattcaacgacataaccaaccagctgctagctgactgaatgactgtagtagtaaactagtattatagctagatagtactgtactagtgattaatatgtttatctcagattaaattaactaaaggtaattaaataaaaaaatgacaggtacgtgccagggctggacaagggcaaggggctctacttcctgttcatcaagtcggagacgaagacgcccggcgggctgccggcgaggccggtgctgaccagctactacaagagcgatcacttcaagcaccgccccttcgacccctacaacgtgtacacgagcccgacggcggccatcctgtgcaccgacgcgttccagtccatgtacgcgcagatgctgtgcggcctcgtggcgcgcgccgaggtgctccgcgtcggcgccgtcttcgcctcgggcctcctccgcgccatccgcttcctccagctccactggagggagctcgcccacgacatcaggaccgggacgctgagcgccaaggtgacggagccgtccatccgcgacgccgtggcggaggtgctcgcggcgcccgacgccgagctcgccgcgttcgtggaggccgagtgcgggaaggacaagtgggaggggatcatcaccaggatgtggcccaacaccaagtacctcgacgtgatcgtcacgggcgccatggcgcagtacatccccacgctcaagttctacagcggtgggctccccatggcgtgcaccatgtacgcgtcgtccgagtgctacttcggcctcaacctgcgccccatgtgcgacccgtcggaggtgtcgtacaccatcatgcccaacatgggctacttcgagcttatgccgcacgacccggacgcgccgccgctgccccgcgacgcgccgccgccgcggctcgtcgacctggccgacgccgaggtcgggagggagtacgagctggtgatcaccacctacgcggggctctgccgctaccgcgtgggcgacatcctgcaggtgnccgggttccacaacgcggcgccgcagttccggttcgtccgccgcaagaacgtgctcctcagcatcgactccgacaagacggacgaggcggagctgcaggccgcggtggagcgcgcgtccgcgctgctgtccccctacggcgccagcatcgtggagtacacgagccaggcggacgcgaccaccatcccggggcactacgtggtgtactgggagctgatggtgcgggagggcggcgcgtggccgccgccggcggaggaggagggccgcggcgtgtcgaacggtgctgcctcgagatggaggaggcgctcaacgccgtgtacaggcagggacgcaacggcgaggccatcgggccgctcgagatccgggtggtgcgcgccggcacgttcgaggaggtgatggactacgccatctcccgcggcgcctccatcaaccagtacaaggcgccgcgctgcgtctccttcggccccatcatcgagctgctcaactcgcgcgtcatctccaagcacttcagcccggcttgccccaaatacagcccgcacaagaagtgatcactcactacactacacggtccagttgagctagacgacacaacgatatatagccttctactacaactactactaccagcactcagtcccagtgcttatacagtcggtgtcagtgtcagtgcgtgtgtaatttctcgtgtttaaggcagagggcatcagggccatactcctggatgcctgcttctttgatcttagatcatgctgtccagtggtagttaccatgtaatcatgtgtgagatgttatttctgaagtggaaatggcgagtgtttgtgatggggtaagctggtaacgtcattcttggccgaataacataataggccttgttggagtatctaccaactacttctgttgacccatatgtacttttttctgcttgtgcaaaaatgggagtgaactagtgacactgacaccccaggaattcaaccccactcatgttcctccatgagagtatgtctgttggtacagcgtcacccatgtctgctaggatacactacttatagtggagtatatgtttaaatcgctcttattattctattactacagcatgatcctttctgctaaagttttcaacacagacgtagctccctattttgtaatgcatgactctaaaataaacagtgtttttgggagggaaaaagttctgtaacttgctacactagtacactgcttacagcctagcccgggtttggtacaacatataattcccaacagacaaaagtatcaccttatgtttagatttgaacttttgatatagagaaatacgcaacacttcctgcataaattgaatcctacctgaactcatccaacttgcaacctctcacagaacattaatttaccagtttcaatcgttaaattattcatgaatattgtagtaggtacaagtgattctaattatggggctaaaactgctatagcttgcacataaaaggaaacatggcattgccactgccaatgacttgtgcaaaaacctatcgattccaatctaccacagctccactctcccatgtctgcttgtcacagaattcagtactaattaacagtcaaataagatatttttcttttttaaaaaaaaaactaaaagacgagctgcttgcactcatggcccgtttggttagggggagtttttaggagggattggaagtttagagggatgaggctattaaatgttttgtttggttaggagacatggaaattttggtgggatggggatggggaattgaggaatgaactccctccttttcaatacctgggtagggggtcctttacttcgcctaaacaaatctcagccatccgttttcattaatgacctaatctccaactaaactccctatcaatttctaccacctctaccaaacaagagactaggatgaaaaatcaaatttccatcttaatctcaccatcaattccctcgtgtaaactcccaatcctcttccctcaagttgccaaacaagccgtgatatttgggacaataaggaaatttagttgcttgcacaactcagataacacgagttggtgcttggtagcaatacagaaaatacggcacgtacaatacagaaaatacaacatgtgacccacattatggattacactagatagatgttggaataataaatatgattatttagatttataattactaatcatatagtggattgtgaatatgaccacgcattttgcagtagttaaggtgcctttgtaccgcttgggtcctgtgtaacaggaaggtgtccatcggacgagcatctcaaaacatctggaagccttctcaactttggtccttgtttcccactcaggcgttttggttttacatcctagccaaccattcaaatgtcacatactgaagttctaaaataaaattatcctacttaaaaagatctttatgaaggaaatattgtagactctagtgacttgcccaaaaaaaaaaaacctccattatttttagatcagaatgaatagcagctggattattgctagttcttactgcaatatgttaataaggttaaccaaagcataactacaaatgatatgttttttatctgtgtgccttgtgtatcctagttcttgtgatttgacctcagtagtaagtcagaaatcatcaggggagttctattttacgctgttttgagtctcttctatcactgagtcacgggtaatttgattattcaagcccatcacgaagtgtaaccaaccttaatcagaaagattactctataattgaatagagagcattatgggtagattataaatctaatcttcctaggccatcagccttaaatgccttgatggttacacaggagtttcaagtgtctaccaggaatgatatcgatttgttctgaacttgtaatacatggagagtactcattcacaattaattgttagcctatcttacatagttagatctaagatcagaccaaaggaacaagttataattgtgtcagtctagttctattactccctggttccctctagtaaaaaaaatttgacgttccaacatcaattaattttgactggagggagtatgatatattttgtaactaaataattacagattggtaacagatattctgagtaagggaaattgtgttcggttgttggcaccaaacctggtcaaatattgctgtagggatggcaagagttgccactgcattaggggagtctactattccagatatcctaccctcacatgggcagcatgatagcaaaaggtatacctgtatataatccgttaatatctgattttaggataatgttcagatcacataatattagcaggataaccaaaaatcctgtgtctacctgctccttggagtacccaaatctgaaaggtagnncctcccacccaccccaccacgcccttaggctactgatgcatcaagaaaatgatgcttcccagactggtcaacaatcatgccctcaaacactagccagtgtgagaaacgtggttccactgtacctatatcaaagataggattcacataaagtggtgttggacctattgtagtcaagtattccttcatcccacgtcttatgatctcacacctacacaaaatgtaagaatgaaatcagttggttttcacaagaacacgagaagcaaatcttcatgatcagattattcacaagcactcagcatctcttgcacagtcaagtggaaatgtagtttctcaagtacgatataactatgatgcatgatttaggaataactggtgctatatgcattagtggagcgattctgatttccacaaccaaaagtgatgcaaaccaacacaatgtctcaattagaaatcattagagcattttaacttacattgatgacagaaaagaagcataaactactgcagtgccatggagatggaatattacagaccatcacaattgacttggtgagtggtgacagcagtgctccttgatccttaaattaacattcttgatgtgcccattcagatgaaaagtctcaagcaagcagctatgtctatgtggatgatctatgcaggtgttcaagtctagtatatttataggaattgtgaaaaacctaacaatacaaggattagttacattagtgttagtggattttgttcacctttaagtagttgtttgggtgcatcttaacaagtactcagaattatagacaagaaaaaatgtaattacttgagctcaagaaatccactcatttctattgctcccagaatgagacttcgccgtcaccctgggaaaaatgcatgtcaccagtactcagatttgctccatcaacaaataccgggagataaaccttggaacctctacttagattcttgatgtcacaattccctccattctcccttccaggaatagttcttgctgcttcatttgcgattttctgccaatcagcagtcccttcttgaatctgaatcatgcaacaagcattatagacatggtttgttcctttaaaaaaaatacaaacagggctctttaaccaataaccatgtcttagattgatatctatatgtaaaattgctgcactgacagtctggaccagatgaaaataataattgtaggtactgcaacaaacaatgtttcatttaatccttgcactgaagtaaaaccactaatctggcagaaggtcatacctttccaagtaaacagttctcaggggttggtaagttggcaagaggcctctgatgtagaacttcacagattttgattgactcatgatttgtctcagccaatattttttccctctcatccatatattgagaagctcagcagatggtgcagtccccactataccaggatgagttaatcctggaaatcggacacctgatatacacacaatggaactattgaggtatcctaaattgaaaagcttcatttagaacaacaccaaaaaaaaaattctacctggtatttgaggggagtatgcataaattccttcaaaataccaaatcgcctttcttgcactagggaagtggtcggttaagaatccaccaccattctccctttcaaatatggcagtatatccccattcgtcaccgggaagtggaccaaggttgcagatctctacagcaagaagatcaccaggtgcagctggaaccccttcagcatcaactattcttaagggcccactaagataatgagtctgtgggaatcaatagtcagtttcgctgatatcttgttttgtaataagcgctgtgataaaaaaaattaaacggcatctcttgcaggagcgatatatatacttacaattgtgagatccaggaatttgatgtcatctgcggagttatcatcactgactcttcctccagtccaatcgaccatctcaacacggaacaattccccttcagttacatctgcaacaggagggatatctggatgccagcggttatggagagggactttttgctcccatggcttcttgctcacatctataggaactaccaatcttggtgttggaagagccatgttctgttgcagggagggaagggatcagaggttcatccttcc

SEQ ID NO: 65497 - DNA, 1874 bp, Oryza sativa
tctaggattgccgttgtttcatcagcagcagtacgttcgttccaggctatcgataggctgtcaagtgtcaacatgaatggttgctatgttctgtttggaacgcagcaatttcacaacaaaaagaaaaacaaattaattcgatgcagtacgaatgatcaaagcttcatcactcagtagtactccctatgtgtactgtctaatctggttatagattattacggaggatatcttaggacggagagagtgcttgtgtaaaaaatcataggaaggatgaaaccaaatagatgacgacgacggctgttactgtatagcacgattcttccagccacttttgatggttccatagtttatattcttcagtttatcagccatagcaaattaaaacgctatttttagcattgatcttgatcattgtatattactagaaaaaatatccgtgcgttgcatcctgaaataaaagttacaataaatattagaagtttgggtttaatttttatgatatatatcccttaaaaaatcatatttttacgtggacatggtaacttgttgaaaatagtatattccttgactaccaccttcaatatcaacacataatttctgtgatagatatccctcttcccaacttctactctcattttccgcacacacgcttctcaaactgctaaacttgtgcttttttaaaaaaaatctatatgaaagtttttaaaaaatcatattaatctattttttagctaatatataattaatcttgccttaatccatggctttgttttacgtgacagtgaagggttcacaaaccaacaaaacacagcctaagattttatggaaaaaaaaccttctcgtaaaataaaatggttctagtagtatatcatatactcctattgcctatatgttttcactcgctcctagttttaacgtgttagagttgttaaccacgaccattttctgttgaattaaatcgagaaaggaagaaaatgttgcaaagttaatgaaatagagaatgttgaataaggcagcaatgtggaaactggaaaaaaggaggtgcttgtttgacaacacaccaaactatagtcggggagagagagaggtaagtaaggataggattgaggaacatatataatcgaaagcagacccttacatggaatgcaaatatggtcatgtatgtttcaggttgcaatctagttctagaaatagatcctacgctaacatgaattgcgcattgtgcgatatcatccggaccctcaaatccaatccacttatatagaaaagaaaaccactacagctttaacctaatcacttcaacaatggcacctgtaggactggaccagaagcaagaacaaaatctgatttattcaacttaaaaaataaaaagcttaccatgtatttgtatgccggttttaaaatctgctcaacaattactacaaataaattatggaaggaaaatatgttggggtgcttgtatatgtgtatcttgtttccagtttccacatgtgatcagctttaacggaaagaaagtagcgttagaattggaaacgatatgttgcaacggaaaggaaacaatagggaaaggaagcggagttcgtctggctctcgcgtctacctgcgcattgagttataggaagatggaaagaacgaaaataacggatgaagaaaacaatatgtgcggtgaaaaattgtaatgacggactaaaaaagatgtggcgaacaaagagatgcagactttttaaataggttagattagattttttttcagtgttaactttgtagaccacgtgtatataaatgttaattactccatccatttcaagttattaggcgttttgactttgttcaaagtcaaactactttaagtttgaccaagtttatagaaaaaa

SEQ ID NO: 65498 - DNA, 4438 bp, Oryza sativa
cgacaactattttagtacggagggagtatctcaaaggattttcagaaaaaaacaattttgaggaatttttaaggattaggggtgaaatatcagcaggcagataaatcccatttcggaattattgattaatagaggtataatagcgtactgcaagtggaagacatgtaaattatcattagtataataacatgctgcaagtggccacaaacatatctgcgtcaagatgcaggacaataatcgtacactaaataccctctctatttgcatccacatgggattgttgctaatgcaagagacaaatccccggtacttaagcctagctgtccttgccaagatagcgacacagcacaactcaaacagatctttctctgaaaatgtgaatgtatattacaaaggctagaactagaagtactgaagtagtataacccagccatacagctttcatgtacaattgtacatcatgatattcctctcatgcataattcatactacataattgcaatcttgcattcacaaaatacatgcatagagtgatccattgctgggtttctcattactatctttcatcaaaaggtgtactattgagtaccacagtatgcatccatagtgatcggccaaagtacatttaaaataacagtatctccatttgaaggtaaactgtcaagtaagtagaaacaacccattctaaccactgagaattcttacaaaagaattgagacatcaaagaccatcattgcaggccgactccaaaagccatatatctacacccccaacaattcagagtctccgatgaattgtaaccccccatcaatgggaccagagcttcttgtctttgcatcaatattgtatcgttttccctttaccagaacttctctttgattgcatatccccctccaaagaaaaaaagaaaccgattataccacatgtattctatcactcgacttgctcgccgatcaagtcgaggccgacaaccaagaatgagaccccttggaacagaaggaagtagaaatgtatgccttgcaccgagagcaggcttcgagctgctgctgttaatagaaggaaggagagtgccagctccttctggtatatcctattgtgttttttctttttcgaatcctttttcggatgggactccttcgctagggaatcaaggttgggtgcagacccaactctctgttgcttaggctgcttctcaacaagagaaacgagatcgccctcagaagaacggcccgatttcttggtcacaacccactcgtaggcgctcccgagctggaacaagccagaaatcatggcattgaattttgtcactgacatggtattctcaaacagaaggtagggaacaataaatgggaaggatttgggtgctgggagaatattcagcaaggacatggttgctggaatgtagcacaccacccatgcagggagctcagcttcagggacaaacattgtcatgggaaggatgatgcagaaaagtgtgaaggaatagaagggcaatatgagtttgcgaaggagaaagaaaaggaagatgaggttgaacttcttccatactccaatctgcagttgaggtaagtaaaaatagttctgatcagtttcaacgactaaatatgtataaaacattgacaaatgctgttagtgtaaaattttgaattccatcgtagctgtgttttgatagaagtgaagttatctacagcatcaacaatttgccggttagcaatttatttgcagagtaattctatttacacccagtctttttttccagatgaagctcaggttagcaatttatttgcagagtaattctatttacacccagtccttttttccagatgaagctgtttagtctgtgtttgacgtcatgaaacatttgactaaatgagctgcaggtccattttactagtgaagaaatcagtctatgaaacttatgctctgtaactaacttgaagcgaaacaaggttcatgtaactattagtctgatgttgctcttgtaatgtactggtagatagtaaaacaatcccttgcaactatgcatcctgcagatgtttattggcaaaacaactgattgtgctagattatcctactgaatgcagccaaaatcttctcaacagaaagaataagggatgaacctaaccatgtagtggcatgctttatatgatgttgtcaaaaatagcttttggagtatgcctacgagagaaggtccatacctttgatttgatgatgtcgacaaaacagagtcgaaacaactgcatgggaccagaatgccatcgatgttgctgctttctgtatgcttcatatgactctgcagctcacactggcactgaaaggataattgtgtgcaacaatttgaattgtcatcacaagtttgaatacaacacagaacgcacataaaacacaaggaaatgtatgcaggtacctcgacatcattaatgtacagaaacttccaccccttgagatgtgctcggacagcaatatccatatcctccactgttgtcctctccatccatcctccagagtcctcaagtgccttaattctccatactcctgcggttccattgaacccaaagaaattgaggaatactccattaacctgctgttccacctcaaagtggaagcacagattaatgttttgcagtctagtcagcaagttctcgtctttgtttacaaaagaccatcttgcttgaaccaatccaacatcttcattgccctggaggtccaacacacaactagtcagtaaatataattttcattgccttggacacatataagaatgtaacacaagtccacaacatcagaaatatttcagctataccttgaaatggggcacagttcgcttcaggaagtctgcttgtggttggaaatcagcatcaaagataacaacaaactcataatctttaacataactgcagttcatggctgacttgagatttccagccttgtagccatcacggatcacccggtgtcggtacaatatgcggacaccctctcgctgccatttctccacttcctccttaataagtgcagaggtggcagcatcatcagagtcatctagtacttgtactaagaagtttgaccttggccaatccaggttgcagacagcaccaatggattgctggtacacctgcaaagatagaaattaaaaggaataagctaaatttaattgtagttctaacatgggtgttctgttagccttttttgaatgtcatgaacatagaacacatcacaaaggaaacaaaagtaatgctactcccgactcccgagcttagatcagtataacatcttatatctataattgtttttctaaattattctttatacattttgttgacgagaattaaatgaattttgtaaagatacaaaactttgaaacataaaacagtgcctttaaagcccccatccccccccccccaaaaaaaaaaaaaaaaaaactgaacatgttcttaacttcttattcacatattcaaatccccaaattaaatctacaacccaccaaacgcttcatatcaggaatacccataggccagaatgtagattatgtagtgatcgtctactttgagtcgtggacaaaaatcgaaaccgtttcatcccagcatgtaaccatcactccaatcccaatattgaagtatgcaagtagcagccaaattttgcctcagtggcactacgaccaagataccccaatctaaatctgccgaattattcctatccacttgttgagttcccccccaattgcagttcaaagaccgaatctttcggtctctgcaaaccacagatgcggccatggcactcaacgcccaatcctaaaaatgcaaccttgcgcaaatgccgaagcaacaaacaattggaattagttatgtttgttctcgcagctcacctccttctcgttgcacattggaatctgcacgaggaccatggggaactcgtcggcgccggcctcgacgtcgtccgaccctttgccgccgccgccgccgccgctagccttgggcacaggcttgattcccttgagcttgatccataagcagccgaggcagaggatgaggcggtcggcgctctggatcaagaagaggacgacgcaggcgttggcgaggaactggagccccggcgcgaggtactcgaggcggacgcgcagccaggacgcgtacgcggcggcgaagaggccctcgacggcgagcaggtcggggacgacggcgtgccagccctgggcgtgcgccgcgacgtcgacggcgaggaggagcacggacaggaggaggaaggcgcggaggaagccgtggaacctcgcgcgcagcgcggggctctcccccggcggcgccgcggcggcgtcgtcggagtcggtccgccccgccgccacccgcctccgcgcggccgccgccacggacagcgccgcggacgccgcgcccgtcagcttccccgccgcccggtgcgccttgagcagcagcacccacgtgatctg

SEQ ID NO: 65499 - DNA, 4938 bp, Oryza sativa
  unsure (1)..(4938): unsure at all n locations
cccaaaaaaaaaaattaaaaaattaaaattccaacctttccttttcctcctctcctccagctggagagcaagtacaggacgacggcctttacgctgctgctcgaagcttaatcaactaatccgccggagcattccaattaaattaagccaagaacacagtccctccctcgctctcgggatcgggggccaattggcgactcgatatgcttcggcttcttggcgggtaactacgactacggctccatttaagcaagctgataaacgcggcttaatcaaagattcaaggagagcagggaagcaggcagcgagtgcaacgggacacgtgaggtgcgggctagcacgtcggggggaggctgattgattcgttgcgtggagccgagccggccgggcgctgtcggtggcgaccggattggttggggtccccgcgggggttggtctcgttactgctctgccaccacgttgccccgcccccttgctgctgctcaccaccattgctcatcctaccacaggctaccacttcatcatcaagattttagcacagctactgctactcatttgatttactagtttagtactgtagtttgttttcgttgatccaaatcaactctgtttctttcagcaatgcaaatcagtgttcagtgaatggattggatgatcaccgaattttacagcgcatcatcggtcataattgatgcaagcagagtgattctaacagatagagagcaaaattgcaggcaaattaaagccagtgaaccagtgacttctgagaatgttcttcaggttttttttttttctgttgcaaaccggacagtggttaatactgtagtatgttctcccctacataacgatactaacaaacgttaaaaaaaatgttggaaaaaagaaccaacttgggaaatctgacgtgcccaccacacacactgctccaaccgtttactagccagcacttataccgacaccaaaacacgtagtaggaggcacagtacaagtggattattactcgcatcatcagtggtgcgtgcagcaatgtgacgtttttagaatgtgatttcttccagctgccatctgtctgaatctatagggttgtactactcagtacataagcattttctctgttctaaaacgaaacgacctaatattataaatccgaatacaatatagcagtttagtattgtattagaaacaacgtagcactacgaatctggacataatatagcaacgtaccatattagacaccccataatactatgatatatgtccagattcaaagtactacgttgtgttctagtacaatgaatatagacacaatatagctagctagtactcgattagacataatatgtccaaattcgtagtaggctacatctaattcattattaagttgctatattttaaaacggatagagtatgtttcaaggccccagaaataattggcataataattaatgaggtagagatagaaggtaacaaaataaggaaaggaaatgccaaacttacataaaaatatcatgaaatgaaatgccaagcttttgacaggaaaggcaaaaaaataataataaatgtataaatatatgtaatgtagaataactcaggaaaggaaatgccaagcttttgataggaaaggcaaaacaattaataaatgtaaaaatatatgtaaggtaaaattttcagaaaaggaaatgcctaactttttacagaaaggcaaacaaaacaggacagaaagctgaagctggtaagacaacagaaaactccccaaattaacttttcataatatatatatagacagagatggaagtataaaaaaaattatgtgaggtctggtccgagcagaagaggaataacaatctgaagagatccagtcagaagaaaacaagatcaaacaaaggatccgccccgtacttgtttttcagcgaaattatttgagagagaagaagcactggaggggagattagatctagctatgctggccagtggccacttgggtttgcttggagattgcatgattatatatgatcaaaatggttaaggaatttatagaagatatatagtgggatcatgtttggtaggatatatgtgcaaaaaacatcgccttttttagtcaaacttagattgcacattgctggattcatgtggcacggttactgaatgtttgaggccttccatatattgtatactacagcttacagactgcgtgtagacttcatattccctatgcaaattaagcagataagtttttttttcacctttttcagaacaatccattgtctgctccttcagagctgttgctagacacctgcagttacgtagaagtcaaaagattaatactgtccaaaaaagaaatgttttcaatacagaaagctatgctcttctggttgccaaagtcatattcttatagtattatgtttgtagtattattttttaaaaaaaaaaactgaccctgcaaaactcaaaataactttcaagaaacacattctgctgtcttgctgagaagcagtggacacacattctattcttgctatcaaactcgtatggctgcatcattctctctctctctcttctgaagaaagcattgtcaggacggaacatctgaagaaaggaggaagcagagaccacccatgaaagacagaacacatgatcagaacccaaagccaatatagaaacaaaccaagatcagatctgaaactgctcaacttgcctcaggtagggacaagtttcgtttgcatgccccatttacgacatccatccatgataactgatgaaagagaaaaaaaataagaaaagaaaagggcaattggcaatgccaatcgaatctctacgcaggctacagaacctggcaagcttgcgctgttagttactccttcctaagctgcacttgctaattactgatactagtaagcaatttgcttctactgaagtggtgtgatggcccccctctcttttcagtatttctgtttgttgatgcatcaagttggccgttgtgacatgtactgcactgacatggctgaaatggaatacgatggcaagaggcaatttcctaccccgcgttgcatctgagtaactggggcgaatgtttgttgtgtttctcatatggagtgctattaataaagattcagtaaatccccatttactaccatcatgtcaccattgggtcagtaaatcctgagaaataatgctgatcgtaccatgctaccgcatcatcggttgtactagagtatatgcccacgcgattcacatgaagattaaaaataacctcattgattaacccttctcatttctcaagatatccaggtgtggtctcccctcttctttagctatttcttcagagttcagagttcaggttgtagggtagatcttttttccccactctatctatcacatggtgattaaagataaccttgattaacccttctcatttctcaagatattaacttctttgatggcttggtttgctcacttcactgacagatccagcgttgagcatctcagagatggcaagaacacacgcatcgcatcgaatcacacaggagggcagcgtcgtcagattcagatgtgctcacgttcaatgctgctgcctgctgtaccttagcttggatgcagcgatgcaggcagcgagggtccagccattattaactcctattgctacaatactactggtagtaccacgcacgagtaggagaatcataagctactacgatgctgcttgttatttaatttaatccgttcttgtgctgccattgccggggaggacgtaaggaatcattccaatctgcatctcgatcgatccatcacccatgccgccttgctctgattgattcctccttttcaatccgtgcaatgcaatagtagcattacttacacgctgcacaagcatgaaaaggctgtagtttttcgtgtggaaatttaccgggagtagttcagttcctacgaaaatactctaaaattcctccaaaagggagtcttaaatttcaggttatcagatctcgatggttttagatgtgccgtataagtaagtctgtcgctgccaacctgatgatatactacaggctgcctgacagccgacattgtcattcagtctgtcaaccagcaaaataattcgctgcacaaccgggcaacggaaacttcactgcaataggagtcctaaattagtatactagccacagtgtgttcatcccaagaatcggggagtgttgttgctgcgccacgaatgactaacagctgattgtttatgtgttaatcgtggcgatttgtaagttggtcgcagacttgcgtatcgtgatgagaggcgagcatgggaaaaaggatggaattaacaaatcgatcgcatcgttgtaacggcaaatccagcaggagctccagcatgatcagcgtacgtgcttttgagttcaggcgcacatctttatgtaaataatttgcattaggtcgctcatcaatgtcattcgtgctagtagtatttgtttgagtttgactaaacttcaggttttgttttagacgcagacgaccactaatgattttccgtcgtggggtgcactaatagaacgtctgaacgttttctgcgtgcttagacgagttcacattgaccatcaatttagtactaaaaaattagcagaatatttagcagggtttgtactacttaactacttattgaaatagagttttatttgctataaatctttcgtattgatctgtaaagacaaaataacatagttgtaacagcgtcctaataaatacttcctaatcaatttacccaaagtaggtgggaatgaaatgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 65500 - DNA, 5673 bp, Oryza sativa
aacttgggccgtcatattcatcggtgttttccacaggcacttcatgcatcacttatgctaccaaacatgcacatagttaggtttttgtgataaatattcaaattaatctgaaggagcccatgtccccaataggctccaattcaggctaacttgtccatgtccccaataccaggaacagtctaactttatcttcttttgcatcacatttacaactagacagctggatatttattcttcaaggcaatgtctaactaacaggggcattgagttctattggttctattttcatttaacagtattaaacaaccttgcaaaaccttcctgttacaagctaaaatattactccctccgtttcatattatatgtcgtttttacttttttccaggtcaaacttttaaagtttgaccaaattcaacacaaaacaaacatattatcaaaatatattcaacattacatttaatgaaactaattcagtgtcgtagatgttgctaattttttttctataaacttgatcaaaccagaagaagtttgactagaaaaaagtcaaagcgacttttgactagaaaaaagtcaaaacgacttataatatgaaacggagggagtataatggaaacactagtacaaatagaaactatacacaagggtaagaaagtcattcctgaagtagtactacagaaggcaagaaaagtcattgttgaagaatatcgcttagtcaaaatttccattaacattttgcctaaggaccataacctgtacaattagtcaattacctccaacaaaaaatggaaatagattgtatgaaatgggagttgcggaattgtctgatttccaccaaaattaaccactctttgttaatgatggcattgaattaatagagcattatcaattttgcttcccaagtatagaccccacatctcatgaagtgcatgtgccaaaagcactcatcaatctatctgtgaccaataaaaccgttatcttagtaaagaagcacctttctacaattcctgctcccgaatcaacttacatgatcacatccaaactcagaaggaaagcaaaggcatgattctctacatggtatatattgaattaccttccaatgttgttcctcactcaacatactccaacaaacatccatcagtagtatacttctttgacttgtcctctaacattcgaaggctccagcctgcatctttcctcagtcccttcttcttcatccaatgcaagatcccctgagcttcctgccacctccctgtctcagcatacaaatttgataacagaacataatgcgatgcattctcaggttccaactccaccagcctcattgtcacatgctcactcaaccatgagtcgccacgggccctgcagcctcttaatagcaagccccatatcactgcatttggctgtgatggcattgtctcaacaaccctaaaggcatcatcgaggtgtccagagcgactaagaaggtcaaccatgcacccaaagtgcttgatcccaggttgaaacccatactcaccttgtatggccaggttaaatattttcctcccaatgtcaacaaacccggcatgtgcacaggcacaaagaacacaaataagtgtgacttcatctggctggacaccatcattctgcatccgagagaaccactgcaatgccgtcttgccatcctgtgcaagagcaagtgctccaatgatagagttccaagtatagacattcctcttggccatctttgagaacacatgcattccatctgagacttttccacacttcccatacatgtctaccagcgctgtgcccagtacaacatccatctcccatccctgcttctgcacgtactcgtgaatccagatgccagtgtcgaccgcacaatgggccgcgcaagcgccaagagcagcaaccatggtaacgcggttgggtgcaacatgagcagcaagcatccgccggaaggtcgccagagcgtgaaaggtgcggcctcggttcctgtatgaggtgatcatagtggtccacgcgacaacctccggtcggggcatttcgtcgaacatctgctcggcgtgcgccaggtcagggtcgcagtccgcgtagcgcgcgaggagggcgttgcggacgtggaggtcgggcccgaacccggacttgaccacctggcaatgcacggccctcaggtcggcgagggaggacagggaggtgagcaggagagggaaggtgaagcggttggggcggacgccgcggcatcggaggaagtggcggaagagcgggagcggggagcgggcgggggcgcggccgagggagcggaggagcgagttgaagacgaacacgtgggggcgcgggtggcagcgaagagggagagcgccgggtcgaggtggcggatacggcctcaggcgaggaagaaggcggagaccacggcggtggagcggaggagcgcgcggtcccagaggatggcgccgcggatgggcgcgagcgcgccggcggtggtgcaggtgttgatcgcgtgcagcgcgcgcgtgacggagggcggcggcggcgctgtgcacggtcgtagaggcggcgggaggccgccggtcatcacggctggcggtgcgtggggcgtggaagctcggccgccttgaacaaccctggatgtcctgggttgatgggttcgtcctccgcggccgatttgtccgttaacggcccagaaggcccgttgcgcaagcaagagttgcccgtaaatggagtatatttgtcaccgttgtaaggcaccgttgcaactttgatcacggaaaataatttttagatgattagattatgatgataaataaaactttaaaacttatgtttaagtatgtaatacactttgataatttgacatctatttaaatatttagattatttttataaaatagacgaatggtcaatgtttaaatatagattgtgcttagcaacaaatataaaggaactgagagagtacataaattgttccagaatccagacacgattttaagcaacacataatttgtttgaacttaaatcaataggtcaaacaaattgtaatgttgttggaagaagtatatatatacgctgtgtttagatctaaagtttgaatccaaacttcagtccttttctatcacatcaacctgtcatatacacaacttttcagtcacatcatcttcaatttcaaccaaaatctaaattttgcgctgaactaaacacagccataatttgttttgatgatctagtagtctcacggattacaagtttacaacaagacggtcaacagcaccccggaggatatggcaatcgatgacgttgaatgactgacaagcatttgttctttgatgccatgatcaacagaaatcttacacataaccgcacagtaaaggtatatgtagataaggagacaacaaacaaagataagatcagctaaatatacttgctgcgttcattgaaggctcaccgtttcgaggctcctgaaacttgattggtatttgtgacatctgtggttggtgtttcctaacctgccatgaagcataagaacgtatgtaactcattccaacacagtataaccatattcatataggtcaatcctacaaacctttacaccagccattgataacaacttgtgcgaggctacgtaaacataatcagagttgtcaatccttttctctacaaaatatatgacttcagatacacctgactgcaagaaagataagtattatagttagtgttgaaccaatttcttcaagtgaaaaggcgcggtttactagtaaattattaataaaatgcaatgtgtttgtatacattaactaaagtttaaccggcaaagcatgcagtaaatatgaaacttttaagctaaaatgtgccgttaggttttatgaagtgtatgattgagatatatggtgttataatgcatttcctcaaagtgagagtaatttaaataggtgatgacaaaaatacattttaactttaagatactgattctatccagaaacaaacctggataataatcttagcacactcattgcaggggaacatggtaacatataatttctgcaaagagaagataacacaagattattcttagcttataaaggcaaattaatgagatgctttaagtttgtaggagattagaagtccaaacctgtccagccgctgaagcatggtttgtatttaaaatagcattaacctcagcatgaacaacatagctgtcagggtgaaagatgacggtcacaattagggacttagaattcaacatctaagccttgctataggagactatttttgtattcaaggaatgcatatgtagtgtagcacagtgtaaagcttagaggaattaacaccagggcttctcacacaaattttacgcaactggattgggtacaagctaactaaagtctaagagcatctttcccatccttgaggaggtactacgaggtaccatgagatacgaggtactatgaggtacgaggtaccatgaggtaccaatttaatctaaccgttgatttaggaggggtatgatcgggctaaacaaatttagggtggcgctaatccctcaccctcttgatggcgttttgcttgcttgctcgtggtggctcaaagggacccaaccatgtccgccgccgccggcggcaagagctgcacgggaggaggcgaggaggcgattgccgggctcctcgacagcggcagcggcgtccggcgagtacacgctcgtgacgacgagggcgacaagatactcgtcggcgacgtgccatgaatgaatgaatctctcgtattctccaaagctttgccacatctccgtgccagcgagtccgccgctgccgccgtcgcgtcgcatcgagtccgccgctgccgccgtcacgtcgcatcgagtccgccgcggccaccgtcgcgtcgcatcgagtccgctgctgccgccgttgcatcgcatcgagtccgccgcggccgccgccgcgtcgcatcgagtccgctgcggcagccatcgcgtcgagcttccgacgaatcgccgccgtaaccatcgtcaagctcccgatgaatggccgttgcaaccatcgccggccttaccctcttcccctctcttctctttgccgcatccccgtgccggcgtcgcatcaagttcgccgcggccaccgtcacatcgagcttccgacaaatcaccgccgcaaccatcgccgcggccgtcgtcgccgatgaatcgtcgccgcaaccatcatcaagctcccgacgcagcttgcagctatcccggtcctcccgccacccatcgccgatctgggccgctgtcgggtttccgatctagggttcgggacctatatgcccctgctcccgccgccatctctcgccgccggttagttcaacgctgctcctgccctgtgagatgcagagacggaggaggaagagatgccgcgtgcgtgcgtgacgcggaataaagacgaaagtacaaaactgccctcccatccacagtaccgcttcaatgggaaggtgcggtaccatgaggtaccgacgatttttgaccgtagggtgttgccagatcaacggccgtactgcataacctcaaggatagtaaaaaatcttaaagtctagaacaacaaggatcagtagatatgagcctgacacaggagcatagaagtaaatttttaagggccatatatagagttgtagactaatccctttagataatttttaagggtcacatatagagttgtagactaatcc

SEQ ID NO: 65501 - DNA, 1339 bp, Oryza sativa
gcaagctgcggccggctgaacgcgggagattttggggatttttttcccttttcccgcgcgcgagataatccccttgtgtagtactatggtgctcgttgggctgggctgactagcaagtcggcccaaaacatccttcgcgtcggccgttgggctaaggatagcaaagttgcttcgagaaccctgctttggtgaaaaattctgataccttccatttgcaaaggaaattcgatatctaagcctctaaggggaaaaaaacgacactgtccatattcaaaatgcgtgtagagcctataaaaaaacttgcgtatggagtatttaacatgtctcatagcctctggctttaatgcacttttgaaataggaatgggaacgagtggaaaggattacagcacaataacaatatcccataaggtagtatgaaatattgcaaaaggattttgagggggaaaattataattgttccttgtgtttttcttatgtcatgtcaaacaactattctaattattttccaaatgttttgttcatataaacttccgagggcgagtaagcacaaagctaatactagcgatgatagtactatattaatctgtaaggatatctaaccgctcttattataattataatatgtgtctatggtcgctctgtctaattatattctagttttagaatggagtttaattctttctctataaaagggtgaggtatatatatgattatccttctctagcaccggttagctatatctcccctcattatactcatactttcttccctaattatctctctcttcccatcccctctatacagtggcggatccaacgcgagtacttggggcctaagccccctatcccatggagtagaggaagatggaagaagaataagaggggagatggagggataaggcggcaacgagcccctcgccaacctctctctttgctggtgtaagaattattagtcgttgtttcttcatttatttagaactaggatctcgatctgccctgcctctcgaagagggaggatcatcctattttgctcgtgtaagaattattagttgttgttttttcattgatttagatctaagatctccttttctcatcatgtaagaattactggttgttgtttattcattgatttagatctaagatctcccttttccatcatgtaagtatcactggttgtagttttttcatcggtttagatctaagatatccattttccatcatgtaagaattactggttgttgctttttttattgatttagatctaagatctcccttttctatcatgtaagaaatattgtttgttgtttttttcatcgattttagatccagcgccaggca

SEQ ID NO: 65502 - DNA, 3330 bp, Oryza sativa
  unsure (1)..(3330): unsure at all n locations
cgagccccagctcggcctctgcggcgtgtagccgccgcccggtggcaccctccaccgccaacaccaccgcccgcaggtgccagcaccgcgcctcctccagcccattgcccatcaccacgccgccgcccacctccccgcccctgtgcgctgctcggtaagagagaagagagaggagagggaggaagaggagtatgataagtgggacccacattttttgtaataaataatttgctgactggattgccacgcgtacgccacgtaggacaaaaccgctccggattgggctgtgggggataatttgtccggtattttaagtttagggtgagtaatatctggtttttgggtttagggcggtaattcggttgaccgcgatagttcagggggtaattcgtactttttcctaagtattttttttacccaaactaacgtaagcgcaaattttatcttaccagttcaccataaatccattataatcatgtaccccgtcccataatataagggattttagaggtatgtaacatattctaagactatgaatctggtcgcatccctctagattctaaggtagtcctactttctctattttataatgtaagactttttagatttattacattatgaaatggatatggcgtggagtgtttcattgctagtaggagtaacagattcctagtatctgtccgtttgccattacaccacacaggcacacatgccacacaccaaaccacaggccacacacgcctgaactgacggggtgtcatcaaacggactacggagttgacactgtagactcctctcccccgcgtcgccccgatcatggcgtcgtcggcggagccgccgccgaagaagcggaggctcgtcgaggtccatgtcccgtccccggccccgagcccctcctcctcctccgctcccgcgccggcctcgccacggtccccggtcccgccccctccgggcgtgccgccgccgccgccgcctcccccacaaaccctagccgccgccgcctccccgcggccggaggaggccgtacgcaagcgccgcaacagggaggagctgcggggcctcttcgagtgctaccgccgcatccgcctctgcgtggagcgcaaggacgcgcgcctcctgcccgagctcgagcaggtgtacctctcgctcatcgccagctctcgaggtgcatggactctcccctcccactcacgcttcatcaagatagcgcaattggaaagtgccgaaattcgtatagcgagtcgatgtggcgttttctcgataccactctacgctcgaagctagtagaatttagttctgatccgtctctaatctcgattgatggttattacttattacttgagcacctcgttcctatttttcttgctccgttgtgtgtttgtgttaatcaggtgagggaaagcagaaggcttgcatgggtgttggattatatcattagaggaagtatacagtggttaatggtgactaaaaggatgctttactgccagcatattatagtgaaatagatttatggatccataatccatatgagctgccatgggaataaaatatccagcaacaaatttcacatgattaacctgttctgtactcctgccccgtgtgtagtttgaaactttaatctacttggttaggtcttaggtcaacaagctgtgtacgtatttgatcaggctcacaatagagaggtatgtgcttgggagatgtactgtagggcgtaggcactacttatttacctgttcggaagtagttcctgagaataattcttagtcacatgcttgtgaccaacagtatggaaattattgttggtgtatccacaactggttcatcaccacgactgatttaaaggagcacctgtttgtttatcgatccttagagcttttgttggccttactagtgatgaactcctatcaaaatcagtgtccaactgtatttattgattgtatgcttgtgtgaatcataagcatgcatcacaaaaggataacaaatatattaaatccaggtttccaagttaataaaaaaacagaagcaaaagttgatcaaataatactgcatcactgatgtaaaactgaagtaagttcgtggggtatcgacattttgatcatcacatgttaaccaacaacatagaaaaaaactgcttagggttaaatgctctttatatttggaaacttaatctcacatgtttgagcttatctagctatgctcgaattttcttttggcagcattcatgtttctgtactctttcagttatatttttaccaatttgattaacagagaatggaacttttggaggttgaatatctctaggagagttattgtagcaacctaatttgccaagttatcttaagacgatgatcatataaaacttgaattgtttttcatttatcacttagcttttatttgtagcatcggactgaaagactctgatgttgtgaagttccgtgtgtttaatagagacattaattaatgtaatcactggggcatgtaggtacttgattacatggataaaacttcatatattgaaagcaattactgttttaccatgcttaaaaaccatcctcatcattttcccttaccttcgatgcaggttgtacaagcgttcaacgtattttagctgacttgattcctcaatatgcctcatactgccctactgcacttgaggcagctaccaaagtttccatcaacatgtataaatggaacctggccattgtaacaagaggggaagatgtggatggtgtggcataccagactgctagggcttgtattcttggcttaactgacatatgctccacagcatcctgtgaagcacccaaatcatctgttttaacaggaatctgctctgcagtttatattactgtcctcacattcttcatttcaacatttgatgggaaggatatctatcacataggctcaagaaaacttctaaatcttcaggaccctgtggagctgttagacattctaaagcaggattcagggggtgacaaccaacaggcagacgnntgtttagttgaactgagagcactttcattgctatgcatatttcttttatttccagagaacatactagatgcctgttttgcgctgattgcttctgcagaagatgtaaacggagaaggattgtactttctaaagcagctaacctgccatctgaacagtggtatcataactgatgctctcgatgttcagggggatggaatccccagtgtacaggaatggacgtagatcatcctagcaccaaagaatctgttgattccaatctatcttctcatagtgttggtgtttcaggaagttctatgttgcagccaaatgagtgttacatgacaatggtatggacca

SEQ ID NO: 65503 - DNA, 1041 bp, Oryza sativa
catttagtacccatcctttatttttggtgctgcagcctcctatcctgtatgtgcaactatgcatgtatctgtatatactttggcgctcgtatgtcaaatactgatataatgtcaaacttccaaagtgctactgacctaccattacatggttgttccttcactgcttagtccctagttgtttgctggtgccttatgtgcattgtatcatgctagtggctgctttttcaaatataaagcttcatacatatagccggtatttccattagctttgcctttgattgcatttctccaactgcatgaaagtctttttataggttttacatgcactaatattgacgtcaagcaggcctgtggacaaaaatttcgtcatcttaggctttcatatatcagtgccacctgatgatcgtgaaattatttggttaaggctgcaacctgcagaatgtaaaaaatatatggtctctgtaacatgggttttttttttccatgtgggtatgtcaagcttaaatattttccagaatactgatttgtatgtcttccctttccattgagctcatggtagaacattatgtcaactagtgttgtttgttatgctgctctttacgatctgcttatattttagtaatttgtatacctaaattaaggttttgagtgcttgaaagtcatttgttgcttgcaccttgggagtatcacattgctgctgtatgcaattgattgtttaattttacacatctatgaaacaatcaaatctgcaggaatccaagggtttcagggtataatgcaggcttcacagtaccaacagagcgaccaatttatggtaagtctagtattctttaatttaacaaattttgcgagtttgtgcatgagttggctccatgtaacagtatggttgacatgcaggtccatcggctcccagagctccacaaggcatccttccatgcccacctgtttctgcacaccgtggtcctgtaataccaccgccacctattcaaacttcttttgtccgtcctgtatatcctggtccaggaagtccgtgggaaaata

SEQ ID NO: 65504 - DNA, 9663 bp, Oryza sativa
ttcatctaaactgcaccatgagaacatttctacattttgtccttgatatatatgaatttaggtgccaggatcctcagcattgatgcttgttaatttggcacaagttcattgcataagggatctccattttatcatcttggttttatttgagatgattgagctaaaattaagtaataagtgaatattttatacctggatgtaagggaataactattttgagattttttttaataaatgcagtgctaatacttctatgttgtttttaaattgaaattcttgatatttaattcagctaatggtgcatggtcatatctctgaacttgaaatctggcaaatagcatcttttgctatttagttcagttcactatgtatgcatgaaaagcagcagatcgttaggaatgggatggtgctactagaagttaccccctattaagccataagccgtgagcagctaatttatagccgattgtgcggtcaatgatgataagccacttgtaggttagcatggctatgtttcagatgtggaagttgatatgtcaatgaattttctttggagtacaatttaagtacttgctcattgtggggcaaatgcgtccatataacgatttatctagattaaacagaaaggtttttaatatattaagagtaaatttcacattgggcgacatattttgaccaagatttcataatggactaaggttaaatcattgttttcacttaacaccatacatcttacataagttttcagtttggactaggggtgagcaaagcaagggaatgtgagaaaacttcatatgatttacacatggataattataaaaggcaaaacattttatgttttcttccttatttttagtgtgagtggtaattaactcttttctagtattttatttttattcatttgcccctatgtatatatcattttgtgccacttttaaacatgtttgcatcattattttagtgtgatttgctgaacaaagttgttttgtgattttctatttctttctaaagatatttatcttaatactatggaactaaaaatgatgatttgaactagcttttctctgacaacttccattgatttgctcaaccctagtccaaagtgccaactagtgcaaagatatgtggtgctaagtgaaaaggttgggttggcccttgcccattgtgaaactttggtcaaaacatatggtgcagtgtgaaatttactcatatattaatgatggggctgatgtatttcagtgtggtgcagagagaaaatctcgagctacttttatctatcgcatctcgcaggggaataatgtttactgtttgttatttcactttgcagagagaggtctgtcggctattaccctgttcgaatggtgatcagaaaggggtatgattttattatatacactgccaaccccactacctgaatatctatttttatatgaaaccacattaacccttcactacttatgtgtgtttatcttgcagttccgggattttatatcctatctgaaacagagagaatgcgccggtgtgatcaagattccatctgtcaagccattgtggtcaaggctactatttatccttcctcccacgcctgaggcctgtgggatgctagaacttccgccccatccgaccgaatgcctaattgcactgattttgccaaaggagacgactgctgaagcgacctaacatgattgtcgcgtagacacattccgtaacctcgttgcttccagtttcgtgcacagtaaacaattttgcatgaatgatactaagttcctacagctgcttatgaataatatgcttccagtttcgtgcacagttaacaaattttcatgttttcttttgacgagacaccaatactgtacttattccttttgctgcataactgatatatagttgctacaatatcacagaattgaccggtgatccggaatttttacacgcaaagatcactacagggacatgatctgacgaaccgctccgtgttctcttcgctgcttacttcaccacatcggaatctaggtcgaggacgaaggattggtgacttgcccggcgaagaccaccacgccggtgaggtcctccttgatcaggaacatgaaggggtggtcggcgacgaagtccacgacgtgaaccggcgccgatggcgccgcgcagccaagggtcatgacgacggcggtcgccgccgccgcctcggtgccttcctcgttcacctcgacgaaggactcgtggtagacggccgacacgacgatcttctccgcctccggcgatgactccaccatctccgacaggtcggcgccggggtactcgaacggcaggcgcagcccgagctgtcgcagcgtctccgccgcgttcgtcttgtacgacagggtgaacctcggcaccatgaaggcgcccacggggaccttctccgtcagggcggcggagctctcgatcagcgccgccgggtcggagcacagcttgcgcagcatgtcaggcaggccgtggcgctcgtcggggaggtagatgtacatcgagaagaggcggccggtgtcgcggccgcggccgcggccgccgcgcgcgtacgggagcctgaggaccttgtagccggcgcggcaggcgatgtactgccacttgccgctcgacatgaacggcgcggagacatggccgccgtcggggaggtagaagacgtcgtcgctcgtggaccgggcgtcgaacttgctttcccagtcgcccttgaagtagagcgcgttgccgaggacggccggcgtcgcgcggtccacggcgtctttgggcaggaagtccttgatccggccggccgtcgcgctctcgaaccactcgttgatctctcgcctcgcttcctctagctgtacgtgcatccatcgaccaagagagattatatcgtaatttttgcggcaagaaccaaaatatttcgatggatggatgaatcacatggagatggaggagaggtttgttagtcaggcgcgggggctcaccttgtctcggaaggacaccgggcgcgcctccgcgcggtacttgtcggcgacgacgcgcgcgtacgcggccttgaggcggagcgcggcgtcgacccagacgccgttggcgaaccgcaccttgggcccgccgcggtcatcgccggggccgctgtcgtcggcgagggagcacagcgcgacgtgggacgcgagcgccgcgtgggcggggccacccgcggggccgaggaaggcgatgatctggtcgagcgtttcgccgcgggcccccgcgccgaggagcgccagcgccgcgtggagcgagagcggggagacggccaggtttttgtcgccgccgccgccgcgtggggcgcgcgcgaggtggccgagcaggcgcatggccatggctgtctcgtcccggacggcctccgcgagctccatggctgagcggcctctcgagacggtggggtttttcttggatttttggttgttgttgttgttgtgtgtgtgtgtgtttgcgttgcggcgggtgtttttttctctcttttgtaccgtggaatggtgggattgggattcggttacattccccgtgacatgtccccagtccggaatggtgagtgtgttgggcgcgggaggttgtgccgcgtcgcgtggatgggacgcttcgggataatgttgttgccaattccagggttccacttccacatacggctgtgtttttttagagagaacagtgtacaggtggttttggactaggtccctcgcattgacatgaaaattgaaataaatccgtgggctgtgaagatatggttagttatactcccagtccgctctaatccatagagttagccatacctactacactaataaatacccaggtaaacagtaataatcctttgttactggtacatcaatcgactgaccaactcttctcaaagtctttacacggcgcattaagcgatcagcagattcagaagcatattgattgactcaattaggtaaaccaggacacaaccatatatccaatacatccatcagttacaggtttttaccgtcaggagtagaaaatgagtagtacatgaacatcaaagcatcatgaatatagcgaatgagattccgcgggtactttgagagaagaggactaaatgagttattactgcagtcttgtacgtcaactaacttgcgaagtgctacagaagaaaagctaacttgcttgggtaacagccaggagttgtagtcccgaaactctctccactccacagtaaggatcagcatctgttgacagtgttaatgtgtcattctggctcaaggagaagtcacccggttaaggagacgatttgagcgtctcaatggagttggcgtggtaacatccttcttctccacctttgcagcattttcctgatgcagaaaacaaaaggaagtgaataagtagcactgctacccacagctcgatattgtgtactaaaacaaatgcttgaccattatggaaacatattaatgtcagcagtatgatgataaaagacttatctaagcatctgaacactatgtgtagcctgtaggtgtaaagataagtgtttgaggacactgaattttacctcctttttcgtttttcgagcactagggcttttaattgctgtagtttccttctgcatcttcaccacatcttttctcagagttactgatggttcctgaactgcaacatccccagcatgttcatttgatcctttccgggagcttcctcttgagctacttgcatccacaagtgagaactccccaagcaatgccaccactggaggtctcgagctgtcaatgtctctacggccaacagaatagctgtctggaatcctagcactgccagcatcatcttggtgaactttctgaggacgattcccggaatcaatctgcttgggcagtggaaattgcacagcattattgaggttgacagatgacactggtatgggctctggcaatggcacctgttccctgaagctggcaaataggtcaggcttgtgcaaaggtgatagtgtagggatcttcaaattgacaggcggttctactttgggaactgtcagttgcacaggttgtagcacagattgtggtgaagggagcactggcaatcttggatttggagctaaaggggattgttcaagcctacgtgttgacactgatgcacccttaggagacctctggaaacacttgagcatagcagctgcaattgcaaatgctgcaacagaaaagcacgccaagatctccatcaagtgaagttttattgaaggccacagtgattttaccatagctactattgcctttgcagctgcagctggattctcatactccaatagctcggttgcctgatccaatctgtcattttccaggccctctccatcataccctacctcgttgttttcttgttctattgtcttctccatggaggccaactgctgggagtgttgcgagtgatcctcccctgcctcctcctgatgaactaaccctgactctccctccaccatatcagcggtgtaggttgaaccaatggaatctgcagtgacattttcattcaggcttacaacttcacccaattgctcggcattctcagaggttgcaaccatcaattcactcagttgaaaatcttccttggaattctgcacatcctccacggctctgtccccaatttggcatgtaaattctccgaatggaacatttgggcatgaatctgccaaacccatcgcagcaatcgccatgaagtttttacgagaaccacccatggggccatacagttgggctgcattttcactgccgttgggcacagtttgatctgtagcttcttcaaacacatgatgtgaacccatcatctcagttggtgctcgcaactccagagaacctacttgatgagcgctagcatcatgcacgctcccagttgttccagcaaaatcgagccccatttgtgaggtaggaaagggagaggagctcatacaatagatgtagcagcaagagcaggccgcggcgacgagcagaagaagcagccgccgtgcccacccaccacgaggagacggaatctcaatctcctcctcctcggcgtcggcgcggtcgagaccacgaggagacggaatctcaatctcctcctccttggcgtcggcgcggtcgagttcggcttcgccgcctctcaccgacgacccggaggacacgcactccgagggggtgggggtgggggtggccgaggtggcactggacgactcgtcctccgcctcgcgctccagccggaggaggatctcgcggcgcttctcgggttgtagcgcaggaactccggccgcggcgtggtgtagttcgtcttcgggtcgtacggcccctcgccgcggcaggagagcgacggcgggctcgtcgcgggcttcgcctgggagaagaactgcggcggcgacgcggcctccccgctcccgtcgcctccgccgttcctctcacccagcaccttcttcctctccagagacgcggtccactccgccacggcaccgagacgccccggattctcgctccacgccctcacgttctcgtccgcctccgcgtcccttcgcctcgtcgccatgggacttcctcgcggggaacctgcacacggcgcgtaaaagcggattgagcgacgaagcaaccgaaaattgaggggaattatacgcggagaggagacttagattagattagatccgggcggcagcacccactcaccatgcggaagaactcgcttgggcaaatccatggcggcgagggggttgatttgatggttcggagcggcggcgggtgtcgattcgggggggtgggatgatggggagatgggaagagacggtggcttggggatttgaaccggtttggatcttgccgaccgttggagccggcgatgcggtttttatacgcgcgccgtgtgacactcgtcatgagtccggacgacggtcgagccgcacgtgttgtgtcgtgcaagtagccgagtaggagtacactcttgtcttcggagaattgcagagaaattgctcagaaacacaaggattctattaggagaagtttgcactgtttacatctcatcctaaaatttttcaccctatcatatcaaacatttgaacacctttataaaatattaaatataggcttaaaaataactaattatacaaattgcgactaatttgtgatacaaatcttttaagtctaattgctccatgatttgataatgtagcactacagtaaacattttctaatgatggattaattaggcttaataaatttgtctcacgatttactgacggattctgtaattagttttttttaatgtccaaacaccccatgcaacaccctatataaaactcaatgtgacacgctaaaactttataccccttatctaaacaccccttactcctactttatccttcctaaaataaataaacatttttttacaacagctaaacatccattacctacctttagaaaccaagccttcccaaaataaataaacatttttttttacaacagctaaacccaaggcaacagtacacacgctgatttaagtaaaagaaaaatagtacacacgctgatttaagttaaaaaaaacactacacacgctggggttagcagctaaccagcaagtctcatggcctgtttagatactctaaaatagtaaaacttttgatattttagagttctttttgtcattttagatctaaacactaacagcaaaaggtggcaatttgatatttggcatttgctagttcatggtagcaaattttgctaaaaagtgctctgggaccacaccctctctctttttctctctctttagtgctaaaatgacaactttaagatgcatttaaacactaactagtatttttgcaatgccaattttgttgtcaccaaaacttttgccatttgctatttcccattccaggccctcacaaaaaaaaaagggagctcctcccccaccaaagtttatatcatataacaacctagtagggagtatatctgttcacaacatcgacacaacctcaaacccagcctatagcttttaaggcatggccaacgcaagggatacgctcaagtagatggggcaacacccccccaaaaagctaattaatttcccacggtgcaagttgcttcatgtggtagtctcgttttttatttcagcccctagtgtttttcactttagtactcacaattttccaatttactagcaatgatgcacgtgcgttgcaatgggtaaaggtaattttaatcatgtatactggtggaacaaaaataaaggaatcataatcataataataatattaataaaataaaattgcagtgacctttggtcaaaaagataaaaatatataattaattttctattaattccattagcaaaaaataatataatacgaagtaggaaaagttattctcaaattttagcaattttcaaaaggcttaaatagagcaaactaattatataaatgaaaacaaatttaatcacctaaataaaacaattagacctgtaattgaaaatctgttgccagttcagttaaacatgagcctgcgggtgtgtgtgatatatatctctcactcgtatgtcgtgatcttttttttttgacatagaaaaaatgcacgtgcgttgcgatgggtaattaaaattataagaaatataaaaatattatatgattaaggtttagttttacatgatatgagctctttaagaaaatatatttataatgaaataaaaaagttcaactgaagtgacctaaagtgaacttgttttatacggagcgtacacgtggtccatgaggcggcccaatagtgtgggtggcctgggaatagaatcgggtaggaacaacttaaatgacataaagtgaacttattccgtgtgggcggcctgggaatggcgttcggcctgacacgagagaagctagagccgtccgatctgatagacggtcatcccgacctatataaaagttcaacagcccaaaccctaaccctaaaacatttcccctcccccctctctcaaaacaatgtggtggcggcccgacatccgacatccctgcgacggcggtggcggttcagcagcgacgacgacaccctccccttccggtgtcggcgttttcttggtgttcttgaatctgatcttgtattcttgtagtagtgttttctttagaatttaggtccaaatttgatacggtgtctcatttttttctttcttttctttttttattttttgccatcggagagggattaaagcggaatcgatcgcacgtgcgatggaatttttttatggatgaaaactataacccataagccatacaaatttttttaattaggaatatatagatattgaatcggactttcttttttttttcattttttcgcccttttttcgttactacggatgtcaaaaacgtctttaattttttttaccgcgtcacatataatcagattcgatttttttcgcccgatttctttttcacgcttttttttcacggatggacgatggaaatactttttaatttttaagtagtagatatagagatacagatagagatagagagagaaacggaaaacttttttcgcaacttttttttttggaatcggacaaaaaaaattttacgcttgttttttaccgcgtcgatggaatcggattcgatttgtttttttaccacgccatgtcacatataataggattcgattttctttggaatcggacatgtactttttttttttgacccttttctttaccgcg

SEQ ID NO: 65505 - DNA, 10838 bp, Oryza sativa
ggtttttttcgcccgcggattttttcgtccgtttgttttatcggacatagtttttttggtccggtttttttcgcacggtttttttctcccatggtttttttacagacgatggaagcaactcttattttttaagtaaaaaatagagatatagaagtttaaattttacgctaaacacctaaaaatacagaaattaatataaaatctctcctccctccccctttttcccaccaacaccccaaaatcccctctccccacgccgtcctacttcaccattcgagctccgccgagctcctccaccctcttccctctgctcgagctctcctcctcggcggcatcgcggcctctcctctcttcttccctccccgacggcgactctcctctccctctccatcttcttctcggggtaggagcaacaacgacgcggggcaacggcttggggtgaggcatctccccaacgcggctccttgcccgttcctcgcccaaaaacaacgataagctgatgaaactacctggccctctactgcgtgtcgcggcactctgccaaggtgtggtatcgatcaagctggcgtgaatattcgtctcaggaaggatgagaccacgctccatgctggagcgttggctatgacctcagaaagaatgttgtcggttttgtaaaccctgactaatgaccttagctcaaccagggcacccgtaccctctgcaagacactaagtagcctcacgaaagcacgacctctactaaggggaagtcacggactcttggcatggcgagccaaagcaactcgtggcatcggtgcaccgatcagtggaagaagacaaaacagatactgcccctagatagaggtacaagggaattttttttactagaactcatgctggcatggtgttaaacaaagcacagctaaatagataaggcgtcccgcgttcgtgcaccatatacatagatcgaccgatcgaagcagacaaccgtacgacgccgcgccgcgcgcggcgtgcacgcacgcacgcacgacgacatcgatacgatcacgcgaccaaaacacacactccatctcacatagtcacagccggcctcccacaacccgcacgaacacgtacacaacagcacacacacgaacagacacgatcgacacccgcggaggcaaatttcctcgtgacgacgcggcgacggacggcgcgcgcggaacacgcacgcacggcggagctatagcttagtcttggctcatcatgcggtggaagtcgtggaagtcgagctcgccgtcgccgtagtcgtagtaggcgcttatcatgccctcgcactcggcgacggacgcctcgtcgccgagctggctgagcacgcgctgcagcccgcgcggcgtgatcctcccggaccccttcaccgcctcgaacgccccgaacgcgcgccgcaggtcctcccgctcctcctcctccccgcccttccgctccacgatccgcacgaagtcctcgaacgccagcatcagcccgccaccgccgccgccgctctcgccgccgcccgccgcgccgtcgagccccatcgccgcggcggcggcggcggcggcgccggagtcgtcgcccatggacgcgaagaactcgcggagctcgtcgccggagatccgcccgtccatgtcgcggtcgaagtggccgaagatctcccggagctccgccaggcggtcgcgctccctcccccgggacgtccccgccgacgacgacgccgacgaggagaacgacctcgcgccgacgcccgtgggggactccggcggcgagacggccgtggccttgcactgcccgcacgccagcaggctgggcaggctcagcttgaagctccccttcggcgacaggcgcctcgacggcttggagacctcgacgcccgccattagcaagagagagctggatttatgcgaagctagctaagctttcacttacttaggattcccgagcttagctagtgaggaggcagcgtgagtgtgcgagcgtatatatagcggaggaaggcgcgagactcgcaatgcgaagtgctgtattttacggcggccggcagcacgcagcaggggaagtttcaccctactttttctgttttttcttgctttccgtcagaaggatcgaccgatccaatggcccatcagtccatgcatgtttggcgagttagtcaccaatggtcactagcaggtaacagccagaaaagtttgtttgttttccgctctttttaatgagaaatgactcgttctaaataacagaaagtgattgaggttccgaatgaagtgacaatcactagctagaaatcaaaccagaataaccatacgtagaagcataaatatgtgttctttctagaagtatcattatgtgttctttctttgagaaactagctgcgttgcaacggatatttttaaagataaaagtaaaagcaaaaattacaggtttatagtatagttagttaattaggcatataatttcatcttcacaagcaaccctacggaaatatactgctagatcacctctttttatctatttccacaagttatacgtacggtcggataatacaagattagaagcttataattcatctgtagatgaaaggtgaatttaaaggttttgtatgtaaccccttataatttcttgaattaataattctagagtcattgacatgttgtgggtaccttatgtttatgatagctagtttgagtttctggtgttggtgtagacttggacaccaccactaacatcatttaaaatagtatagatatgaaccatggcaagttattactaacttattaggttggaagttctcatggtgcatttcttggaagaccatttgcttcgtggggaactggtttcccccccccccccctaaagatatgtccttatgtttatttttgtttgtaactcccaaatacctataacaaaatcttaaaaatgataatattgatgcattaatgaactatcacccccaaaagaataacttaaaattttcttcataggatgagaggagaaacaatctacacattgagtagtagaagtattattcattcgttattttcttcctcgcaaacaaaagattttttttagcatgcagatcgaatttaaacttgcatattgataaagtgatactccctccgtttcatattataagacttcctagcattatccacattcatatagatgttaatgaatataaacacatatgtatgtctagattcattaatatatatatgaatatgggcaatgctagaaagtcttataatatgaaacggaggaaatacatcgcacaattatctatgttattattttctaaaccatataaatgacatacaaataatgtgtgtatatcccctcataaattaactctcccatttatgcagataatgaattgtttctgtggtttcggcatctccggtgggcagcatgtgttcctaacatttgcaacagagagtgcttagcatagtatgtggagttgtggacatttggagtacactaacatatatagatatacacgcgtaagataccaatcagacaaaaccacaaaatactgcgctcgagtgctggttcgatcagacacccctgaaacatcgaggacaccgctgtaagtggtgtgatgctcatgcaagacgcaagccgtgaatacaagaggaatcatgcatggatattacgtgattattcctcgtataactatccctctccaatacagagctgcaattcgaaaggcggccggcctcctataccaaattgctgccgtgattaattatttacttcctaaatctcgcaaaatcccaatcagatatcgccacaaggtcgatggcacaaagcagccgcccacgcgctcaatttacctgatcctcgcacgcatgcatgtacatgttgccgatcaaatggccacatgtttatcgcaattgaccatgcacgcatacgttggctgcgtttgttcccatctgtcaggtggatgcgcagcaatcacacaacactcgtacccaaccttttttttcgttttttctgaatgatcaatcgcaagttgcatgcgtcgccggggggcgggttcaccaccgatctcacaattctcacctgaaccactactcgcggcggccggaaaggcgagcagaggcccgagggagataacgtcaggtgttcggtcaggccgtgcaggaggaaggcgagaggaagcttcctccgctagcaaaagaggaggggagagacgactcatgggctcatggcacgggcaacgcccacaaaaaaattgcgatcccgcagctcgtagttgcatatactcttgcatagttgcatgcgtggttggttaaatttactggtgacgtgcatatagctttacgatgtgccggaagataaggttgtaaaatttgtcactgatcgcaccgtgataggtgctgctctagatatttactagtaccagtttatcacattaattatagagtgtatatatatagaccatgttgcacacttgcacttaattctttgacgttagtcatagagtatatgtatatatcgaacagtgtccattgacgtacgtttcttttctatttttgtattttgcggggaacacttgcacttaatttggcttctaagtaccactcgaggggtttagaaacgtcaatggacactgttcgcctaatcgaggggtttgaaaaaaagcgttgttcttgtcaatggacagtaccctagcctagatgcaaaactgcaaatgcacctatttagaaaaggtacttttaaaaaactgcttttgagtgaaaaacttcaaatctaatctttatatgtaagatatataaagattagaatgtagttacgacataactaggatgataagccgctctcgcggtttcacgggcgcgtgtgtcgcagttgcgcagacatggtgcgtatggctggtgtggacccggagtgatcacacagcatggcacatacgctggcactggacacacggacgtggccaagatgggacgttcctggcctggggttgatcgacgggggcgtcaatctctcttaaggggtgaggatgtaacatcccagcctagggcttaatagaattaatagaatactcatatcaacaagttgtaactttttttccggaagccaatctccaaagaactcccgggttaagcgtgcttggcctaaagcaatttgggatgggtgaccgaccggtaaattcttcccgggtgcacacgagtgaggacaaagaaaagacatgtgtaagcgggcccggcctgggagaggcgggacgttacaaaatggtatcagagccgactctcgcggtttcatgggcgcgtgagtcggtttcatgggcgcgtgtgtcgcagttgcgcaagcatggtgcgcatggctggtatagaccgggagtggttacacagcatggcacatgcgttggcactggacacatggacgtggccaagagaggacgaccgggagtggttacacagcatggcacatgcgctggcactggacacatggacgtggccaagagaggacgttcctggcctggggttgatcgatgggggcgtcgatctctcttaagggggcgagggtgtaacatcccggcctagggcttaatagaattaatagaatactcatactaacaagttgcaactttttttccggaagtcaatctccaaagaactccagggttaagcgtgcttggcctggagcaatttgggatgggtgaccgaccgggaaattcttcctggtgttcccgggtgcacaccaggctatcagatgtaagcgagcccgccctgggagagtccgttacagccgcgaaatctgcacggctaatattgttatattttttttcctcaaataatacgtatatttttaatttttattattaaaatatattaaaatagtaattttgtattaacttaaccaaactaaccaatatataatattaatattgtattgtatatacgtgatagttattaactatttttaatttttaatttagttatttctaaattgtatccatatatggacttttgtctactcttacaatatttcttactttttagttgctctctattatttataaattttattcctatatagattctaaacccttccgtcaatgatctttttttaagttatttctaaattgtatttctatatgagctctatactcttatttaatatttttttaattctaaatctcagttatttttaaactgtatattcctatataaactcttctcctaatatttcttatttttaaatcctaaattttagttatttctaaattgtattcctatatgatatgaactctagactcttctcctagtcttttttattttttattttgaattttagttttctctaaattaatgtttttaagtctggcttacaattagttttaaattcctctatggactctagaatcttcttataatattttgttatttttaattatgaatttccattatttctaattgtatttctatatgtactctaaacttatcattcaatattcgttattttttaattccgaatttcatttatttctaaattgtactcatatatggactctagactcctttttaaatattttttatgttttaatttcgaattttagttatttctaagttatatttttatatggattctaacttctacttttagtttccttattgtttaattctaaattttaattagctctagatagcatacctgaatggactctagtctcctcttacaatattctttttttttttaattttgaatttaggctattttaaaattttatttctatatgaactttaattttctcttagctctaaatcgtatacatgtatggactctagtctctttttctaatatttcttattttgttccgagtttaggtaatttttaaattatgtttctatatgaaatttattttttttctccgattaatatgagatttctatgccgtgagagcgaatgcggagtttttttatattactttaataagttagtgtagttacaatataactacacttacagtatagtacactatagtacaatgtacctacatgatgtataactagagtgtagatttgtggagtgtaaaactagtgctagcacagtgatgaggatggttcaatggagtgacagagcaagcgggattgatccccttagctcacgtcatccctgttaatttttttcccaatctatctatgcacgaatgtcaggatggatcaatggcccaaaaatcaaaagattttcccttcaaaaactgtcgtaagatgtatagcaattccgttcagaaaatactctttcgcattgtatcctgaagggaaggcacgcactgaggctattcacagtgcacgtagatgtcattctctctcatgcagccagctcagagactcccctccacctaggcatagcttggagcctcgccaattttggctccccgttcttcgtcagaatcgcagctttggggcccacaagagaagaggtgaagaagagggagggaggggagaagcgtcgatgccgatgttgtcgtcctccccaatctgcgccggccgagactcaccggccgcgccgccccccgatccatgcctgccaccgagggaggaggccggacggggagaggaagcggcagtgcgccagatggggagcttcacccggtgcggtcgaagcttgggccacgccgccgcatcgtcgcctccaggcctgacgaggagagatggaggcgtggagcttggtgccgccaccactccgccgatgctcaaacgcctgccgccgccgccgctcgaccgccccgccccgctccggtcgccgcctcgctttctctgccactgcctcgctaccttcggctggtggggaatagatagaggagagatgaaaagtgagggtagacagtgggacccacttaaaggagtatgcactgtgtagcatgtagctaacaatattcctgggtgtttttgagcttagttggcatacgaaggctccataaaaactcaccgcgcactgctaatgcccttatgcacagcattggccttccgatcgaaaaatgtaccgcctctaggtagggataccgaggcgtttcgtgcgacgtttactcgtacgtcgtccaacttttgcccaacacacggggagaaaagtgctcatcagctttccagttaagttcggtctccgcgcgtgtctccctttggaaggtcgctctttcactcgtttgccggagcgcgcgcccgcatggcgagctgattcctgattgtgagagtttttcgtctccgcgcgcggctggcgcgtgtgctggcctttggtaagtttcggcgctcccctttttgccgggactactgagcatgggagctgagcctgggatggactactgagccgctggctctgaaaggaacttgccttgttacctgttctgatgcttctcgcgctgggcgtggttaaagcggagctgcgcctgcaccggaacgacgttttgctttcgtgctgctggtccaaggggaagaaaaagttgtatgtccatcacgacgaaccaacatcgtgatttgttcggggaaaaaaaatctacctcccttacccgtaaaaaaagtccaccaccctttactgtagaacgagcatctgaatttcctcactccaccacaatatcaaacataatagcatataatagcatatcgtccaactattaaaaccgattcaataaaccttcccggatggttttgacaggggtttcatttgacgttacatttacatggcgatacaatcaaccaaaaaaaataaaggaaaatgaaagacaaccaaatgagggtggtaaacatgatggtagagctagggtacattcggcgatggcaacggtagcaatccaccagagagacacccacgcgagaataccgagtatattcctcgcatcgttgtgccagtcgtaggtccacaaccgtgcacatcaccgtgcggcagaaacgtctccacatcctccgacaagctttcaccgtgacaaatgttgcatgctagcatacacaagtcatgcctagtgatgagagagcaaagagtgtggtggaatgggacaacaagtgcagcacgagagtcgcatcaatgtaggtgaagcgacgcatgtgagtaaggctgagatgggcgctaacaccatgttcgcaacttctcgtctcaacagcaacaataaggtaggccctgagttggcctacttatctggtgtcgccagtagtgccagcgactcgagcactgccgccccatctccgtgttacctttgccacaaggtagtctgtgagggagagagagagaggaggaagaaatacgttatgtgaaacatgtatcttttatttttctaactggactaaaaaactgcccgtgcgttacaaagggaagaaaagacaagaaaattgagaagaagttgagaaagatttacattatttaattaactaaaatacaatttttctggaatactggggtatttctaactaggtaggtaaagtaagcgtgacaaataaaattgcatgctgatttaacttttgttaaattatccatgattaatgctatgttcttatgtgagtgttgggaaccctcacctccgacacgaaaaacggagaaatagattaatacgtgattaattaattattagcttaaaaaactttaaaaatgaattaatatgatttttaaattaacttttatatagattttttttgcaaaacacgtatcgtctagcagtttgaaaaagtgtgcgcgcggtaaacgagagagtgaggttggaaacatagacttaagaacacagcctaattacactctctgaatttttcttggaatttttagaggccaattgctaattctaataatacaaacaccatgttagtatttatttaaataaaaatctaaataaaaaccctcttttctatatgggccatttatagctcattttcctcctcaacccgcacaagagccagcccaccttcctcccttattctctcctccacctcagcccgtgagcacatgttcggcccagcaagcaaccgaatgtctaattggtctcccctgttctctctcacactgtcacgtggacccatcgcgacagtatcatccctaacctccgtccggactccctcgggtgcctgacgccgcctgaaactgcctcctctgtaaaatccagccgtacccttggagataatccaaacttaattgagaggtttctatcctcatctcctactctttccgttttctcaagaatcagagcaaatccgcttcgtatcgagctcgaaattgagttctatcctaaacaagcgaacctacagtttagtcatccgtttcgtttggaagaaaataatgtagtggatgatgacaacgatggacgaaaaatcgttccggaagccttacttatttttaattaggtataaatagattatcgtatcggataatatcactgtgtagagaaaaaaagataaattgaactggttttgacatgtaaggatacggcgtgtctagtttaggcaaaaaaaatgggactcctgattttgtgggtgaggaaggaaattcagacttggagtcatcactagctggagtcagcacaaggaggtaatatagcctttattctttgctccggagcctgccgcgttgcatgtgtttgggctagcaggccgctatgtgtttgggtcggtaaagagggaggcctacctgagtcaagagggccctagaagtggccggactccgaacagaatcgcggaatcattgccagtccgtgttgtgaacgatttcggactacgactccgtgtcgtaaccaaccaaggccctataaagccacgtcccccgaggcccatcgacgctatcgtgttcgcctcaatcgaaacgcgcaatcgccttcgaggcttcgatcgatcgttttgttgctcggcgcccccggagacgtacgtcttcctc

SEQ ID NO: 65506 - DNA, 2985 bp, Oryza sativa
cggtgtcgttgatccgtgtaatgaatcgccgtaccttgtcttatgcaattacatcagttatttgtatctcttctctgacgatccatggtgtatcggtgtttgcttaggccatggtcgtacgttgatcgaggtcgcgaaacccggtcgtttctggcgtgcgcggtgcacccgacgccggttaccccagacgtacgctgtcgtgagctcatatctgaacactagacgagcaccaagctagtcaggttgtcacggccagatacagtggccttgtaatctgtacttgccgtaagtgaacatgtcgcgcagccatgtggtcgacggagtcgaacagatctgagtagctgaacattgaccaactttatctttattctgctctgctgtaaaacgatcatactacattcatacttaccgcagcccatgcacaattgcaatggaatcgtagcaaacaatgtgacacgcgtagcgttctattatatctgtagtatgtgtagttagaatcttttcgcttcaacttgcttcttgaatggttggcagctcaacaccccctccccacacctttatccgctcctctgctagcatggcctgccgtccaaaaacatttgaaaaaaaaattgaaactaagccgagacgatcagcttcgactagtcctttgatgaagcgagctcactgtacctctttctgccatttggttctgtagaggatgacaagcagaataacagtctgcaggattgttccgatcagcatccccacccaaatcccctgcattggttagtacacaacggttaccacatctccctgcaagaaaatcatcactgaaaaataaaagtttagaccgccggctttgtctgtcttactgttgcattaaggctcagcctgaagccaaaaacggctgcaataggcagaccaacgagatagtagcagccaatgtttacgaaggcaaccgatgactgccaccctgccccaatcgccacccctgcaatttgtgccatttaccaatggcacaacatagttgcatcaacaagtgtcaaatcctgaagcaatttgagcatatatttcacttgattatagaatggttctgtacctgatagcaccggctggatgctgttgaggaatatggtggctgcaagaagatagcccagttttgcagtctccctgacgagcacgtcgtcgtccgtgaaaagcctcggcagctgcttcctcgccacgagagcgaccagagtgaaaactagcccgacggcggccgacgtgaccacggcgacgatgaccgagaatttggctgctttcgggtggttcgcgccgagttcgtttgccacgcgaacactgacagaaaaaatgtgacaggcaaagcatgtgtgtgagctcagaaaattaccagtgagttgagtggaagcaacgcataggataagtgcgttacctcactgcagcgttaaagccaactgcaaccatcagtgtccagagctgatagttcatgctgtttacgacagagtaagttgaatcgtttaaacttaatgttcaatcgttgccaggtataaaaatatcagaacattgctaattgatgtactaaccatattgaaatcgcaccaacttgaatctctgggttcttcaggcaacccaccagaatcagcactgctgtgtaataccacatctccaagctgcaggcaccaattcatccatgaaaaaaatattttgctaattttcaccgtgaaatggaacttgaactgcatgtacaatgctacgaaccacagcataacggcggatgagagggagagcttgacgaagccgccgaggctggtgaatgctttccgcgagaagccgctccaggcctccgggaacgacccgccgacgaggtacgcgaactgcgccgcgttgagcagccaccaggacacgtcgccgacgagcgccgcgccgacgacgccgtggccgagcctggcgacgacgagccagttgagcagcgcgtgcgcggcgagcgcggcggcggagatggccgtcacggcccacacccggctctgcgcctggtagaacttctgcatggggaagttgacggcgtacgcgaacagctgcggcgcgcaccaccgcgcgtaccggccggccaccgacgagatggccgccgactgccggagcaggcgcagggccggggacgcgaggaggtagagcgggagcagcgcgagcgacgtggcgaggcagatgacccacgaccgctgcaggtagacgcccagcatccgcggctgcccggcccccaccgcctgcccgcacagcgtctccagcgcgctccccatgccaagctgatcaaaacgagcgcgacaggcgccatgaacaaaatgcctagcgatgatcgatcacatcaatactgaccgtcctggcgtgattttttaccaggaggccgaaggcgaggccctcgacgacgccgttgacgacggagacggcggcgagctcgaccttgccgatgtggccgacgaaggccgcggtgacgaacccgatgaggaactggaagatctccgtcagaatcaccggcccggcgatgcgccacaggttcccggactcgccccgccagttcttgcggtggccagcgccagccgcttccgtccccgccggcggcgccatttcgctcctcagccccgtgcgcgcgccaccctcagtacggttgtgtgtgtgtgtgtgtgcacacgacgacgcggtacacatatagagcagagacaagccacgcacagtgtaacgtagagcagacaagccaccggtcgtggtcgtacgacatctttgtagctgcgtgcgtgcactgtggatgcggttgcacggcggatcgatcagcatgctagctgaggtgtggggggggggagagcgtttagggtcgcgcaacgtggacgatggagtaggtggccgtggacttacagggcggatccagaaaatctgtttgttagtatcataacgtgtatatcgatatcatagtatgctaattatacttagaacataatgttatagtatatggat

SEQ ID NO: 65507 - DNA, 7193 bp, Oryza sativa
agtgtagcgtggcttggctccttcccgctgcttgaagtctgtttttagccaccgtagtttctctaagcttcagtttatttttcatttgctttttctcccttcccctaacataagccggtctggctgattgtgttgtgtaactaaaattctttttcttctaatatgacgtgatttttttgcgcgtatgtgaaaaaagagtaggcagctaggcctccgtggatatctggggcaatgcaaataaagtccgcttacactagcaaaggttctgaagatgatccaggtaatctggacactggagaagaaaggccgaattgtcgagggctgttcaaatccccaccggcgtaaaaacagatcccatttcgatatgcacagttgagaacaaaaaactgaagatattgggacgtggattttcatctctcaatgggacatcctctcatagtttgcatatcatctaaatagttataaaaaaattgaaaaaaatgacaacatagattaatacagaatatattactccacaagcatgcaagaccaaattcaacttctataaattgcaacaaaaataacaaattaaattgaaaatagttatttgtaactatatttgttatttttgttacaacttgtagaagttgaatttaaacttgcatatttatgaagtgatatatttcataaatttgcataaattttacaacaggcatcctattccttgggttaatttgatttggacctcttattactctgataaattaccacatgctattcgcccaagaggttccttttggtggaaggatgtgttgcaatttctagatattttcataagtctgtcaagttgtaaagtgggtgatgggaaaacttgtttgttctggagtgatttttggaatggtaaagtcaggtcagctgtttaccctagaattcactcttttgccctctctcacaaggactctgtaagcataacttctactaaaagcatagcacagctttttgctctgcctttatctgaacaagctttccaggaatatgaatccatgagtgaagcagaccccttaacttattatctggtgataaagatgtttgggcttatgtctgggggaatggactgttctcttcacagaaaatttatgcaataaatttcatgcatgttcaagcccctgggtacttaagttggatttggaaaagcaaatgttctatgaaagttaaggtgtttgcttggcttctcctaattgacagattaaacacttatgatatgctgcagagaaggcactaccctcctgaaaattctaatctagcatgtgtcctttgtccagctcaagcaagggaaacatctttccaccttttctttcaatgtcaattcagctcagattgttgggcgcaactgggaattgtctggaacctttctctcaattttgatgatatgctgctgcaggcaaagatctcatatagatccactcattttgttgaaaaaattctctatgctgcatggaacatttggaagcaacgaaatgctttcatttttcagaatgtaccaccttcggttgtttcctggaaagctctctttaagattgatctttcccttttagtctttagattaaaagtttttgagagacaagccttatctcagtggataaaccttttgtaaatattttgtattccttcttttaatttaatttattaactgtggaggcttcccctacagtgtttcccttaaaaaagggtgatatatttcatattaatctatgttgccaaaattttttatattttttatgactatttaggtggcatgctcgacacgaggaatatcccctgagcggtgaaatcactttcccgagatattgccactgaactaactcataagtccagtcccagtatttatattgccacagcccacaggtaagtcacagtaactttccggcccaaaagaaacggaccatatgaacaggtttttttttttttgagagagaccatgaactagacttgagttcagcttgctgagtggctgattcaacgccagatctcactgcaacaatcaagcttagtaagattactactagtccattaatccgaattagttggataatcccgagaaaaagaaacacggttggataaacatcaaactcagagctgagaggcctatggattatggagctccatgtacaaattattttggtgatggctacatggatctactattcagtatgccaacagccgaccaaaatatctgaaagcatccttaggagtctcgagatatttactccctctctccaataaaaaaaatcaaagtatttggtgatgtctggattcatatctagaatttattttttttatgaaacagaataagtatgttccaacatcatctatagtactcatgtttcaaacaaattttccatcaaatgaaactgagtgtataaatgcaaaattgatattactgttggacctttgatatgcccgagaaaatagccaacttttagggatgaatctgaactcatccctagaagttgctcttttttttttacagagcgagtacaggctagcaaaaaaaagtacaggtcaaattgctactgttttatggaactacaaatgtctaaattatactgcacagattctgcactcaatggatcaccagctaaaaaacaaggtaaaaaaaagataatcttagttgatttttttttgcattattgaatagtactgcaagttcgttttctgatcggggaagaatattacaagttacatacatcgccattaaggtacataaagttttattaccatcttggtttatctcagatcaccaaatgcaaagcaaggtagatattatggttatttggtgactcggattaaacaaactatgctgaaacagtaagaagtaagtattcagatattacttcaagaaattacttcaagttcatatagtacttgtatgggataaaataaggccatgtgcacataaagagaacagaaagtagaaaatgtccggtacaatattttaaattcagaaacaaattccaagtgctgatttcagatacaaccaatgatgtattgatgtatatgcacaatcaagaatccatatatgacacaaataatgcaagatattatccttgcgacagccacaggacaaggttggaatgcaaatgcattatgaaaagataacaaggattcaaacttcacttaaaaactacaaacaagacttgcaactgcacaagtaatatatcgagaagcacgacaacattatcagctaccactcattatcacagaatcctactagtaactactgaagcatcatctttgtactatctctccacactgatcaacccgtgggagctactacctaatattgacacaataaaaccgtttcatacaggctcatcaccgaggattggccatagctaactgcacacatctaaaacacaatcaagctggcaatcacaagaacaccaaccagaacaagcaataccttcaagaacacatcaacatgctggccctgcggtgcctggtgcgggaaaccatggccatgccagccatggaacgaatgtccatacccgtaaggaaacccagcggcaggtccatacgccgccgcctgcgggaacccatgaacctggaagctcagcaatgggaaaagccccccaatggccgccgagaaagtgtagttcccccagcgaccgccggccacaggggcgccggcgccgcccatgaaccacgggtcgtggtgcggcaaatggtcgtggtgatgatcaggctgggaagccgtcgccggccgctgcccggccggccggctggggatctggacgccggccaccgacctggagcggggatcggtggaggccttgccgcggccgtagagggggacgagcttctcctcctcgaggccggccttgcagacggggcactcgcgggagtgcgcgtggacgtggagccactcgtagaggcacggccagcagaagaggtggccgcagagggtgacgacggggtcctgggctagctccaggcagatgttgcactcgaagctgcccgagtccttggcgccgccgccgccatcgacggcggtcgccgacgactcaccgacgcggttctccatgagtccgaggtccgatctacaaaacgcgggaacgtaccaaccaactcatgagctcaagccatgaatccacgaaccgatcgacagaataggcgctcgatcgatcgtccactagtaggcccaaatttaggaaatctcttttctacgcacgcagcaaaatctaccatgccagacgatttaattaattaattctcggttgcgtgaaacaacatcactctctttttgtctcttctacaagcaatcccgaacaggtaggatcgattcgttcagaaaacactcacccgtagattgaggaacagccacgcaccgtgtaaacgacgcggatctggaccggtcgatcaacagcaagcgacgaccgcgatcgagcacagcacaagtcaccctgtcgaaacgagccactattcacccaaatccacgcggagtactccggagatagcgtcgaccaagcgcccgcgcgcggtgcactcgccggccggcgcgcggcgagccggggagcagacgctggcagctaccggcggcgaatcggaggaggaagggttggggatcgtgggggaactcgagtggtggtggtggtggtggacgcctcggtcttcgagtggagcgagccttcgagtgaaacacacaaacgcgtggcgtggcgtggcgtggcgtggatgctgcgactgcgactgcgacggttgggaagcggacggctacgagcccgtctccgttcttcctactgcggggacgaaacagacggtcggacgggcgtggtcgtcccgtcccgcgtgggagcccctcggcccctcggggcaatggcaagtggcttgataagttgatagctgccgtccgatgtcccgaagcttcggccaaagagcattgatgagatacgtgccattgcagaaaagggaagacgactatggccgtgttagttccttttcaatttttttaattatacggttacatatttaaattattaaacgtggactaataacaaaacaaattataaattccacccgtaaactgcgagacgaatctattaagactaattaatccgttattagtaaatgtttactgtatcaccacattgtcaaatcatggtgtaattaagctcaaaagattcgtctcgcaatttacatgcaaactgtacaatttcatattcgtttccactacaagaagtggattaaattttggattttcgtggcacgtttttcaaacggctaaacggtgtgtttcgtgtaaaaactttttatatgaaagttgttataaaatatcagattaatccatttttcaagtttataacaattaatacttaattaatcactcgttattgccacctcgttttgcatgaaacacttaatcttcatcttcatcttcagagattcaaacaccaccttaatgctccatgcatatgtgtagacatttgatgtgatggaatttttggaagtttgaatggaactaaacacaacctatttacgagaagagtttagaaagtatatgttcctttcgatttcataattctgaatagccaacactgtccctactcctaaatttctacttcgggctcagtttagttattgagatttcaaaaacaagttctccaaattaatcatttgggttaacatagtccttagacccacaaaatatgccttattagcatgccaagtcattctcgaatgcaactatataaatgaaatgaccattctacccttataaaccatatagaaagaaagaaaagaaaaaaatagaggaaaaaagaaaacaaccaaaatgaacaagcaacctgttagttcaagtcagtctccacacatgctcttacgtattaccaggaataccattacaataatctgtaagaatcatttttactttcaaaaagaacatgccaatcgaaataaaggaggatcaaagttgttgattccgtccgtcatcggtccctgcccgacttgagataaaattggatgacaaatcaaactcgtatttgaaggcctcattatttggcttatgcttattcttataagctaaatttaaactttagaacttaattttggattcgattttttggttttttattgtactttattttaccataatagtttttgagtcactaagaacatatatataaaatatttgcacacatatattattttatttagtaataaatgattcggataagcacatgaataaaacgaaacaatgggttgtgattatttatccaccgacacatatgtacaaattaaattggctttaccgttgcaacgcgcggatatcttttctagttatattagaaaatcaaggttaaatatatattttgtagactgtgtcattgtccaaaacatcaacaattatatatggaaccgggcggagtattgtaacgccccgattttcgttcgggtttaaaaattattaaataatgcattttctagaaattaaataaaagttaaatcaatttaatcaagtgaaataatgggagaattaaaattttcccttaaaaatcattggccgggaatattttgcaatattctttgtgccctaaaatactctccggatttttccgtgaattttcggagttcaagaaataattttaaagtcataaagttcattaaactaatttaaataaaaagaaaacaaaataaacttccccttcctccctttcgggctcggcccaaaatcctctctccttcccctcccgcggcccggcttgcctccccttttggcgcaagtctgcttttcctccctcccggcctcccctctcactcaggccgacaggtgggacccgtgggccccacctgtcatccccaacctccagcccgggccggcaactgccatggccgcccgagccgcccacgtcgccgcccctccccgcgcgtcttccgattcccgcgcgcgtgtgggcgcggtccaccccacgtcatccccttcctccaccatttcccccacttctcccctccaaaaccggcgccaaactgcccccactcacccacgtcgccggcgcccctttcccccttcaaatccgtcgccaaccggcctccccgtcgactctcgaggctataaaaacgatccccgggctcccctcctcgtttccccctctttcccaagcttccccatgcccgaaaccactccgccaccaccaacctccctccgccgccgccggttg

SEQ ID NO: 65508 - DNA, 1014 bp, Oryza sativa
ttagagtttttcctcgttttgcgtgccagcgtgtagaatccgtcatttcggaagtccgcggtcgcgaggaaaagagttcggaagattgtttgaagaagcaaggcaagtcacacattccccttgagcatgttgatcccaatttataaatgttttaccgtttgcaaataaacatgcatgtcttgctaattacatgggatccgggtattacctatttgctttcttgtgccatgtttacttgctatctgtcctttgtcagcattgggtaataaatcgactagctcatgttacttatgtgacctagctagaactgtatgcttagccatgcttaattaccactagctcagttgatgggataattgcagtattagacctcctagtatcatgacatgacgagctgcgtgctcgagacatccgaccatgtgtcatggtcgtaattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgccggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaataaatcgacccaatgcactgtagttcaggtgggttggttgggcatgttcaacgtggtgtagcgttga

SEQ ID NO: 65509 - DNA, 9859 bp, Oryza sativa
aggatcgccttttccgctgctgctgcttttgtttcggtgtgaagactaagtgcctcttctgtaagtattttacgctttatttacgtttggaactgtatattacttgtcgttttgtgtaccctggctggtcctggacagggatttaatacacaaaatagtctggaaatttgggctaaatttctgggcgtgacaagtatgattttgtaaatctacatgattaaggacccgttttaacatgccgaaagcaaattaagtgcgggtacataaaacaaaagttattagcatatagggagtgaatcttaaactttcgagggacgtccgtcattgattgcaatgtcacttaaatagttatgaaaaaaaataagaagatgtattaacgtgtgatatatcactctataaacatgcaacttaaaattcaacttgtacatgtcgcaaaaaaattgattgtgaatatacgttaactagctataatttaatttgtttttttgttgtgatatgtagaagttgaatgtttgtgaagtgatatatcacatataatacatcttctcaattttttttataaactatttgagtgtatgcaaacaacgaggggtcatcccctcgtatgaataattgagtcttagttatttcaaacttgaaaaatgaatttatatgatactttaaagccacttctatatataaagttttgttatgaaatacattctttagcagtttgcaaaaatcgtaatcatgtttaaacaggtgtaagtgttgtaatatggagtttagaggttgtccagatttattgtcttagattatctaattcttttttagattggtttattttgagtcgagacgagttgttgctagcttaactgtgaagaccgagatttaggccctgttgggagcttgtgccagcccaaaagctgcttctgctagaagctgccccaaacagtccacaacttctgagaatctatagttacatatactaaaaaatgaactaagaaaacagaagctggagaagctgggtttcagagctttttcagatcctatttcttagaatgtaaagctcaccgaacagacccttaatggaaatgttcggttgatcttccaagcgggaagtccagcactcatttttctgcttcgttcacgcgacggtacgacgccatttgacaattagaaggtgtagtacattgtctttgccttctctacatatgaccagacaaaatgaaaagaaacatactttctagattggcaaatattcatgtagtatatgtcacgtaattaatctcagactagtctagtacggtacaacgacagcaagacaaacggcggccaatggctcagaggcgcatgtcgccgacagtgacgccaattgattcattgcttcgggtgaggcatcagcgagcgtacatcgatcgatagtgaacttagtgatgactaaacgctacaaatcgctgcacatatatatcaatcatggacaaatgcagattaattgtcacggacaatgacgagcacttgaaaaaaacggctcatatattgtaccatgtcagctgaaaaatattcaaaataaccgtgggcggtacgcagcggcgagaaatgtctaccatgcgcgaagaaaaatggagcagataagatagctacgtgctgttcattttacggaagcaaaatagtttacctttggttgagtgattcatatcctgcatactatattcaaaattaaataaccgtttgtccgttttcaccatcaaaatcgtttgttccatatccgtcgcttccagaattatggttgcatagtgttagtgtatggctgtgtttggatacaaacttcagttcttttccatcacatcaacatgtcatacatacacaatttttcagtcatatcatctctaatttcaaccaaaatccaaactttacactgaactaaagatagcctattattagtagtcagtagagtacaaaacttcacgtcaattttttgcttttttttaaaaaaacaagtcatctccaagtcgtcacgtcatcaccgtaatgatcggctaaggtggtgtttggatctagggacttaactttagtccatatatttagatactaatttagagtattaaatatagactacttacaaaactaattaacaaatgaaagctaattcacgagacaatttttttaagcctaattaatccatgattagagaatgtttactgtagcatcacataggctaatcatggattaattagactcaatagattctctcacgaattagtctaagattatagatggtttttattaatagtctaagtttaatatttataattagtgtccaaacatccgatgtgatagatacttaaaattagtcccatctaaacagagtctaaagctagcatttcgcggaacgcgtcgtctaaggaaatctatgacagccaattgaattcctcgtagtacatgtccaagctcatcttatgctcatgcatcacagacaagtgataaattggcattttactattcgtactttgaccgataatgacatacagtagtaaaattgagcagcaaaggttagtgtccttgtaacactctgcacctggtttagtgatatgtcttccagataacaccaggaatatgagttaagataacaaaaactctgccctagtcaggaatatgatgatgtggatattgaccgtaaggcagggtccataccgaacatgcataattcttcaaaaattcacgggaatttcaatcggtttgttgcttacagtatcacatattgcagaatttgaattaagattactgaattgttagtacaagagcatgcatgacgccattcccctggactcctagttccattagtacaaggactgggcttacgagatacagtaagaaactacaaggacggcgctcacgacaagcacttgaattagtagaatccaagagcatgacaccgtttcccttgtaccgttaataccgctgcttcaacttgcttccttttttcttcccttctaaagtcagcgagtacttttccggttgcaatgaacatgaacttgtacatcacaattcacagcctccaagcagcttccagctaagcaagcagctacagtaaacttaagtcgaaggtgctagtgtctagtaggctacttgctggccgactgttatgcggataataaatcgtacgatgtatcagtataaaagggtgaaaagggatataatctattggttatggtgacctgagtaacatcctaatgttttgagtttaaatcttcatatgagtgaattttagattgatatatcccaaagtctttagttcaaatctccttagcagtaaatttcagactgagttgtttgcgggactaacgccgcatttgtttctctagcttgggaactcattccctccgaaaaaaaacggagcagtccattagcgcataattaattaaatatgagttttttttttcaaaaatgggtcaatatgatttttaagcaactttcatatataatttttttttgcaaaaaaacaccatttagcagtttgaaaagcgtatgcgcggaacacgagggaaatggttgggaacaaagagcaacgaacatagcctaagttaccaatttgaatgacctcgtatatctgattggatgcggatgccagacaaaaatccccttctctaaaataaataaataaatttgtataaaaagtatttatggatacattttatatacatatgttattagtgtcagtgtcagggttatgataccatatacctaatagtaattgactaaatctcggcaggacccaccacataccatgtcctatacggaaacaacctgcggatataggagaagttcttgataaggaaagacaacctgagttctacatgaaaacaacaaggattactcgaattgtatccatattggtttccttagttctacttggacaaagggacacctatgggtataaatacaaggccccataggaggagaggggacgatcaacacccgagacaatcaacacccaccacaatctacggaacaatagatcaagacagaagccacaacatacaagccaacacacgctaagacaagacgccagatatcgacttcagagataggcacggctagtcccctacggtgtttctaggtactgtcaggagagacgaaagcgctatctctgatctcgccgggcacgaacttaaggaggaaggctaccctgttgtcgactacgagtcagaccttcagactaccatgtcgacaacagttagatacgctaccccaaatattgtactagtgtgattatggtgaataagagtaatactggcttcaaccaacaggatgtaaggttattacctgacaattcaggggcccgaacctgtataaaaatcctcgtctccgtctcttttacctcagtctcacgtatatcctagtaccaacgatccccataccatgcaaataccgaaatcgtgacatcaaacgtcgacaattagtgattagaagataatgctgaaaactaataagagggcttagagaatgcacaaaatggatgaatcaaccagcaatggggtgtaccgtgtaccgtcagaaaccgtggttgccgccttgccggccgccatatcgccttgcatccgcttgccacttgccaattcgcatgggtgtgtggccgtctgtgtgtgaggcgtccaaacggttgtttcttggctccctgcctgagcatgtttaaatgatggtcatgatctgacctgacacgtgggctaatccacgtcatccacgtgcgtggaagatcaaactaaaaattgacactccctccctccctaaacaatattacaatcactttcaaactttgacatggtttctaatatgccattttcaccaaattatttccaataaaaagagtctcatattatattacatattataatagtttgtttaaagataagactattaacaccattttcacgatatcaatatttatgatcttttattgatcgttaaagttaaaaagtgtttatatttgtttaacggagagagtagaatattcagtatattggttaccagatggaacttcacttgttgccacggaaatataggttcatagaagagagaatttagaacatagattgatcatttaaaaaacctaaaaattagttgttgtggcatcatgggaaaagagaaatagtaaagataatgtagaacataaattaattctcggagtgctagaaacaattaatataatataacttaaggagagaagagagatgacaatgatttgtaaagaagaaatcactaaaccttacgcatagtgttaaaatgtcataaactaacgaaatgctttaacttaggaataataaaatgagtgaacaacactttaaaccaccatttattatccaaactctctttgcaagtacatcaatagtctcaagaagacggtacggtcggtaccctcatgcggatgttctcttttacttcatccccctaaaaaaaagccaatctagaagaagatgtgacccctcctaatacaatcctaattcgttgtggtaggaggggtcacatcctcttctagattagcttttttttttttacggaggaacccgtacatgaggaaaagttggatacttggattggatatactagccagacaaaagtgaaaaaaaaatgtataaaatgtgatctaaaataaactttgggtaataaaacgtggcaaaccatctcatgccgaaaactaaaaacagacactgttaaatctctcgagcatcatgctatcacaacggtgtataattttaagcattcgtcagtgatatatcacaggatagcgcatgtactgtgcttcaaagccgagttgcttcaagctaacttctagagagttttgacttcagttttatgagttccagtttacgctttgttcctttttttttccactgtacaaatacatatccatttacattcatcaccgttacatcaagatgaaaatagagagaaatttcagattctatggacgttcaaatgctgattatactccagccaaaaataataataaaaaaaagctgattatactctcgcaaaaaaaaaaactgattatacactggcagtagcagtacatgtattatacacttcgcttagcgcgcgaaggcctcggtccccaccttaatggcgccaaacccgccggcgcgcgccgctaggccgtctgccgaggcgccccgcctcaccggcggcgtggccttcagcgtggtgtccgcgacgaactcgcacggcgcgtcctcggcgatggtccccatcgccgcgcccttcttcctcggcgccgggacggcggccgccgcctcctcgaagggccccttcttccccgccggcgcctcgcgataatacccaaccttcttggctgcccccaccgccggctcggccgcgacgcgccgctgcctcgacgcggcgcggacgaggtcgtcgacgtcgcgggagctcagcccccgcaggcgcatcgtcgccgtcgcggtcgccggcctgccgaacccgcggccgaccgcgacggcctccatcgccgccggcacgcggcccgcgcacccggacatgccgcgcacgtagaggtcgcaggccgagtcgcacgcccgcgacagcgcccggaacggcgcccccaggcacccgccgccgccgctcccgcccttcttcttcatctctctccgctccggccgctccgcgcgcgctgcgtcgaattggcttctcgcgctggcacgaggaagagtggctcgctgtcctactactactagtagtactagctttgattgctttggtcggcttcgggatttcgtctacggggctcgaggcttcccgttttatagagcaatgtcaacgggtggcggtgacgtcggcgaggagacgaaggcggcatctcgttccatcgcgtctccacctggttgcaaagtcttgaattggcaatctgctccgctcatcggtggggccgatcgaggcggttttcaggcgcgggtttaactcatggaaatggtcaggtttcgcgtgtatttttgctcgatttcgtccacggttttgggataggatcgattgatcgagatggcaaggttgagcagagctgtgtcgggagaatttaggatattcctcggtaaattcaataaattttagttgaatttgactgtttcaaacttaaattcctgagagagaaatcccctaatcttaaagtattgagaacaattcggaaattttacttggagtctactttcatcccataatggaaccttaaaattttatggttttcgattggttttcgtcgaaaacgtaaagatcggtgagcggtgaggtgcaccttgtctgagtcagttcaagttaacagtgtgtgtggaaatgtgattaagttattacgttcagctaagccgtcgcagttgcttgtttcagcgctgcaactgcaaagtggaaagggtaaaaaggagtcatcaaatctgttggaagaaatgcgatgttattagttctttatgatgctatatgctaatctttcttgcccgtgagagaagttaccgtaagctggctgttgatgttggaattgcgaagacctaaggcgaaaaatggcagaaaaacacaccgccgtcacatcatgttaaaagcgaagaaatgttgagcgcgttaaggaatggactaggagcaagtgatgaagtgaaacactgatgagaagctttgctttaccaggacattttcatttttgtgcgtttctgtaaagccatttcgtttcgatgacacagagaatttttcattttgagacttgaagaagagtacctgtcctcgagaatccagagcttgacatttcgcaccaagacaatcactcaaaatgcgcgtgttaaattttcccagagataagagactgttcagttctcagaaagaaataaaacgtctgaactcttgtccaaagccaaaccgtctgctcaatcttttttttccgggctggcgaaaagatgccaaccgatttttattaagcaaagcactccatcttaaaatataacaactgatagctttcataatttatttaaaatataacaacttcttcacaaatattcttttctcaaccaatcataatccttcaccattcaaaattttccatttaccttcccttctccgccaatcaacattctcattaactatatataaatctaaaacttcttatattctgatacagatgtaatacattaccagagatacaatgaggaagaccatatataatgcattaaaggggttcaatgagacaaatcctccactcagcctgcccaacgacacccactctagctgcaacgatgttcctatcatcgcgcccttccttttcgcggtgcgtcttaagacggtcaccttgcaataaataaccttcttggttgttcctatagtaagcttcggttcggtcttgatttagcacagcggacgaggctgttgtcatcgagaggaggtgagggaacaagtttcataatatagtcaaatgccagctttaaaaaattgacgcatcatttacatccactctaatagtctacccatataattattttattaaatatatatcgcacaattaatacttaacccacctctcatacaaacgtaatatatttgaattccgtactgctcgtttttgttctatcttcttttctcactccacatgtatttatttctcactcctccatatgtatttataggtgtacttggtcttaagagagagtacagaataagaagctagtgcgcaggccaaggaggaggtagacaaggctagtggatgattgattcgtgcgattagatcaaactcattccttcttagggtgtgtttaggtcatactaaaattgtaattaaatttgattaaaattgaaacgatgtgtttaaaaagttggaagtttatatgtgtaggaaagttttgttgtgatgaaaaagttggaagtttgaagaattattttggaactaaacacggccataatcccggtagtcttcggcttttacatttttattctttgaattcctacatgggttcatgatcatctcgtttttcctttttcagcagaccaaaacagttcagtttacacggtctaaattcggtcccctttggtaggctgttttttaaaacagcttgtatagttgtatgtatattttgccttatcttttataattgttttaattcgtgccaagtttgtaagtataaaagttatatatacataattttttttcactggctaagagtacgtggaccataattcattgggtaattttaccattcttgaaaagttactaaaagttattacactttctattgtgaaatttggtacctctagataagtacctcaatgtaaaaaatttatgtaaaatttagatatctcaagatacttttttaagaaccataaaattttcataattgaaaaggaaacagcccgaaaaagaaatgtaggcgggcctaccactaccagtacacattcgtgagtatcgtcgatcctgcgttttacagagaaaataaactattttggacaacattacagacaggaaaatttactgatagagtcctaaaatttccaacaataccttggacgtattaggggagcttaaaattctaaaaaacaattggtcagtagccagtttctgagaatctgaaaaagttggatttcacagcttctagcttctaattcattttctggattctacaagtacagtttcttagaatctaaataactgtacttgtagaatccagaaaactaaactgttcggaagagcttctgattttggaagaagttgcagtagttagaaactcccccaaacagacccttagggtgtgtttgagaaggagaggattgaggagattgagaagatacgcaaaacgaggtaagccattccacatgattaattgagtattaattattttaaacttcaaaaatagattaatatgatttt

SEQ ID NO: 65510 - DNA, 2405 bp, Oryza sativa
ttgcaaaaaatttctatatgaaagttgctttaaaaaatcatattaatctatttttaaaatttaaaatagttaatactcaattaattatgagttaatggcttatctcgttttatatatcttttcaattttctcaatccccttcttctcaaacacaatcttagtggagcttatacggagaagttgcaactgaagctcccataaacatttcggcatgctatttctgctgcgctgctaaccccgttcggtggtgggccccttctgtcagtcaccttccaattccccttgggcacttccccagtggcagttaccctattcattttttttcctcttcccggtcacaactccaattttgaactccaccgccgccatcgaggtcgtccgcggtccgcaccgagctccgtggattcctccgccgtcgccgagcctatctgagcgcgcgatggccacggatccgagaggtcggcggccgcggcaccacgcggcggtgaacgaagtgctctcgacgctcgccgccgccaacagcaccctcgccgacgtgcagcgccgcctcgacgccgacttccgcgccgcctacccggatcacgtcagtaagctagcccctcctccttgctggattctcccccacccccccgcgcggcgaggctgatgcgtttcgcggtctccccgcgtgctgcgtttttttttttcaggcgaatccggtgaagctggtggcgcggctgaagcggatccaggaagaggtagcggcggtcaagggactctgccgcgatctgctcacccagaagcaggttacccaaaacttcgaatcgaccaccaaatgcgcgggctccgcccttcttttttttttttccgcgactgacgcctatagtgttcgttgcgtgcacaggagttgatcgacgcaatgcggacaagcctcgcggtgcagcgcagcgccgtgcagcggctgctcgcctcctccgggctgccccccatgtccgaagaggacgccgccaccgacgccaatctcaaccaggtgaattcacccccaccgtcccctcctccagtcattcgtcaagacaaatctaacataattttaccaacctgtgtgcgcgcttgcagatcatcgatgagtggacggcgcatgttgggccagacacaggtcatcttctaccttgctctgctgttcgttgcagcgattgttactgattcgtgattggaaactgaccgcaaccgttagttgcaaatgctttgttactgattcgtgactggaatttgactgtaacgggtcccttttacaggagatgacaaggatgaggataccaaccaaatcttcttcgccgctgtcgtttagagcgagtgagagcggccacaacctagagcagaattctatgcaaagtcaggaggtctcatgctctgctgctcatgtcattgttttgtgtgttttggcgagaagagctgcccgtgctgcagcatgcggtctcaatttgcagatccatttctacaatgaaggccagcgtactggagctggccgcgatggagattctacttcacacatctgttgctgttgtggagagaattgattagaaaatcgtagactttgattggattgcggtgtggttagcaggagagtataaaactgagagcctgttagctcctctctcgcttttctttttgtgtgtgttattttacttttctcatactcaacctttgtagaatatgctgttgaatagtacaaagtgagggaaaaattttgcttcgtataagcaggttgatgcagattgtgatatgcttttttccctcttttttgaggaacagttgatgatgagtttgtcaacaaggaattgtgttgttgagtgcacacgaaaactgaggatttcttggtttgggaaagttattctgtgcttgcaatctcctttcaattctggacaagaacacttgctctgagcaagagcccagcaaaaaaaatcgctgggaacttccctgaacaaaagatacatctcagatagtcatgtactggttttgaaaaattatactacaatttctctcttgccatcatatagagcacagatagacaataacctaagctactaatctgcgcactataaacaggtacctgaacacaaacatcaatatgaaaataaatacataacccgaaacatgtaatataaattaggggcaattacttatttgaccttgttttgaactgtaattgccgatttgaccctactttttgaactttgcttatttgacgctccttttcgagtacgaagcttccgtctgaccctctttcgctgactccgttaaggttcaattttaaaaaaaaaagaaaatgtttccagagttcctaatggcaaaaatacactccaaagccaaaccctattctgactctttctctctctctctcactcgcgcgtacctctctctcactt

SEQ ID NO: 65511 - DNA, 1823 bp, Oryza sativa
ccccccccccccacctgttttggaccgctacagtatttcgctaccaatgagtacagtacagaattgggctatttcaaaaagatccctggtagtgatattttatgcgatgtgtatccttcccgagcacgcacactcgccgccgcactccacttccccaacacgccgccgccgccgccgccgcccgagctcgccgcgatgtcatggctcgcgcgctcaatcgcggctaccctctcttcttcccactctgatgaagatggcgataacctcgaggcgagcagcggcgacgaccatagggacgagcagccggacaccccgagcggcggcggcggcggagtcaagggcgacttgtcggagctgaccgactccctcacccgcggcctctggggcgtcgcttccttcctcgctccgccgcctgcgcccgccgccgaagccgcggagacggctacgggggcggtgggggagggggaggatggggctcggtcgccgcggatcgccgggatccggagcgacctggcggagatcgggggcagggtgaggagcggaatctcgttgctctcgaacgccaacgccgtggcggagatctccaagatcgcctcgtcgctcctgccgttcgggcccggagaggacgacgacgacgacgacgatgccgaggctgtgggcgtgaccgaggaggtggtggagttcgtgaggcacatctcgacccatcccgagacgtggctcgacttccccttgtttgtcaacgaccggcacgcggatggtaagaggcagtagtatgaaacttctcttcctggatctcttcagcgtttgtagtgctttggtttgcttgcatagaatgctggattggttattttggtctattatacattcatttaggagaccattggttccagttgcttcagtgcttaggcttcttgctctgttcgctctgatactaagattgtgggatcttctgtcataattttagcagcttggctccagtcatgtttatttactaaggtttaatgtgggaagggtagttacttacaattaagagtggcactcaattcttaagatcatgttattttgaaattgagttcatttgtttacatgtatgaaggtttgccaggaaattgtaattcatgttaatagaaacttttattacttcatgtggttgcatttgctgatgttagttagacagagtaggtacatgaactgaggtgggttaatcgtttgttttactctagtatcgtagggctgtagttcaaaatttcacatttggattgtattaattcaaagggataattagtaaatagaaagttcgtttgccaaaatgaaaaaaagagagtaggaatggcttgtaattaaggaaggtttaaaagtatcgaacacaaaccttaatgtcgcatttcagtaatcttgctttttgtaaaaatgtctaatgagacttagatcacttgacatgtaagaactgtatgaaaccatcatttctgctgatacatcagtattaactatgcatttatcagaggctgtatgctataatcgacttcaccggagacattgagaaacaataaattaaacgagggacaaactattacacaaacttgtaacacacatacaacactgcaatctgattaatcacctaaccaacaaggcaacatcagaataggggttttgtcacaaattaattcaactgtcgaatcatcactttaacctttagtgttactatttcggtcaaatagctccaagagttgaatgctccctacactttgtggaagtctagctatatccaaggattcaacgtcgctaatgatgtgattacatgtgcaaaatctaatgggatcaaa

SEQ ID NO: 65512 - DNA, 1424 bp, Oryza sativa
tggaaattggaatggctagaactcgttaacctgttgcatatgcatatggccatcttcaatatgtagggaattactgttaaatggaggccatgcatgtatattgttccatcatgtcagtcatgccttacttgtcgtgcctgactggtttcctcaattcctttgcttactgcaatgcttcttgcgtacagattttgaactgtcagacacacaatatggacatgcattggctatagagcgtgttgttccaagcttgtcatatcttaggaccgagctttgctctaccaatatgagtgaagcatgcttttggaagatctattttgtgcttcttcactcaaaactcagcaagcaagatgctgaacttctttcaacgccacaggtatattccctgctcttcagcatattctgtctttatggcaaacattcttaagtaattacggattatcatgtcaacttgttacaatgcatgctttcctacacatagccccataaccttttttttttaacaaaccgtctatgcatatatattaccaaatggtatatcttgtttccaagttacaaactatgataagtcaggtgtgtaaggagaatgtaactatgtatgaacttaagaatgtaagttaccgaagcccaaaagttgcattagattgtggctgccagtgtgggagcataaacatagaggattacttttatgcttgtgtaagcgtacaatcaatatttgggctccacttctcattatagcatcaaaattgggcattcttcacttctcattgtagcatcaagaatttgttgcaagtttcaaccgacaaaacaaagctaaactacaggcatatatttagttaattatcatgttgaatatatccagtcttgtcaattcttttggtggaaacacttggcagtgctgaaaaatcatagccttccaaagggaaatatcagtgacgttgtagaactctaaaccagtatccagaacagcaggaggatatgcttgagaccttcgtatttgtgattttgaactgattttatattatatgttcggaattatgcatctaagcatgtagatctgcattcccaatttaattatgtatgctatcagcacatgtgaaggctgtgtaacgtttgattactaatcatatagtccatgtatgcatgcccctatagctcacgttgagaacatgtaacagatgtatagattgtcgatcatactgtatattttgttgttaagttactatcagtatatatgcagtagcaattttcttgtaattagtaccctatctcgcacccccccccccaaaaaaaaaaaaaatttcccaggatttgattttttttgtgggatacagggagtacattgtaacagaaaatccttattgcattgtttttactccactggaaggtccattgcgcatacacttttgctgcatttcaccttc

SEQ ID NO: 65513 - DNA, 1232 bp, Oryza sativa
attcctgcagcccgacgtctcgtctcgtccggtagagaggccggcgtgagaaaactgcgaaaattgggggcggtagccggtaccaggaggacgttaggtgtgtcggggtttttcacttttttgctcccgtgttctcggcggaggtgaggtggcgcgggcgcacggcgtaccacggggttacggggttggtattgtggggtacggtgcggcgcgtggtgtgtggcgcgaggagggccgggagagcgtgaggctcgtcaccacggcacgcgtcagcttcggcctcgggtttgaggcgaggcggaaacgaatggccaggtccaggtctgaatagtttctgctaccgtcaactgagacaaaacacaagaggcaccaaaaacatgaaaagtgttttaaactcctgatgtctccgtttatttttttaaaattcttcgagtggatgccctctaatttattaaaacactatctaacatttatgatatagacataaactacttttaaaaaaatcaagtcaaaactcaacccacacgttaagatattatcaaatgtgtagattgaatttgaatatgatttttggtgtagtggtggactttaatatactcgttcttaaattatttaaaattatacttgagaaaaaaaattatatgagagcatattcccttgagagtgagagattagaatcatcccccctcaaataaaaaagtgctcctaccatgtgaacgacactagttttgctggtcgtgtaagggtattagttactccatccgtcccaaaataagtgcagttttacactatttatctccaacgtttgactgttcgtcttatttgaaatttttttatgattattatttttattgttattagatgataaaacatgaatagtactttatgtgtgactaatttttttaaaaaaatttaaatcaaatagacggtcaaacgttggacacggatttctactgctgcacttattttaggacggaggtagtactagtccacgaaacttaatttaagttaaaataaactatgaacctgttctattttgacttataaattagttcataggttagccgctacacccctacaactgtgtaccactccatgtttgtcgttaggattggcttttttagacataggggtacggattaagaagcaactagtctaacacaacggaatctatactactagtagtgctagaggccattagctgtgcaaacactatgtttagtttatgtgct

SEQ ID NO: 65514 - DNA, 972 bp, Oryza sativa
attcctgcagccctggtttccagttttccacggaagtaaattccaattttccaatagatgtacgtcaaccctttgcttcctctccagctgcagagttgcaggtttgacgaatgcagcttatctacaaaattcccatcagagggaacacagttacagaagaactaggggaagtacagattgcaaatccataaggatcttctttagaaccgtatacgtaaagggcttcatggattggccactatatatgggtgtcaccctcaatcgtgaatctgcaaggtcagatatcagtatatcaaatgcagattgcctcattgcagattgctgtggattgttcaggttccgggttagcccagtcaccagtcttcactgacattagcccgctgtggttacatcagatagtaacaagctccttcatcatttcggaattcagtcggtggtaaggcatcggaaatggcatcaaaacaactcttgctgcctacctgaatgtatcacgcagggacagattatattaagtttgtggtccacttgccaattaaacgaacgcctcattataagtgaaaagctcacctttcagctatccgtgctgccatcatcgtcatcttcatccccagaagcttcataacgtggctgatcatacttctcacgaagctgcttgataggaatgaagtccccagcagtgtcctcgccaaaaaacagaaattcaatataggggtgatcaaatcttccctatttataaacggggacagcattagttcaatttgaccaaaaatgaaaaccaccaagcaaatgaagaactcaaactcactttctctgatatttcagcttctgcaagattttcttctgcaactgaaattacacagacataacatgtctcaaaatggcgcagcataggcataaaacagtaagtgaagatggatttgatcaattgactactgcatagcctactatcttgccttcttctgccattttaca

SEQ ID NO: 65515 - DNA, 2384 bp, Oryza sativa
agcatttactggataaaaaggttgattcggtcctttggacaagttttccacatttgctgtctccatccatgacttggattcacagcacacaggatccatgccacaaatcacagctctatatccttcagcaggtgatgttatcatgtaaaattaagaagagaaactaaagtgtgttcactgaagttaatatttgatataaagtgtgcttcaacacatgcaaatgttccatttaaggataatggcaattatgaaaaattaacttttcatataaagtttgaaaagaaattgtagtagttatccattttctgaacagcttcagaaataatgtgtgaacaacaatacgaagtaggtagtatagcagtactcaccgtgtaccttatgacgtactttctgccctagtcgaaatgcatattccacattttgatatgcaagggccttagcggagactgccagagactctgtctacatgatgtttgaagttaatatgttattaacacattaccatcacatggtcggtgcactacagttttgttgtacctcaagtttagcaatttcatcacgcagtgcagctgccaaagcataattttcactgtcaacagccttttgcaaatccgcactgaaacaaatggataaagctaagtgatctactgatctctcaaatgaaccaatgctacataacactggaacatcatggagaaatggaaactattaacataccgcacgcgtaaaaggtttatagctttgtcctgagcttcagtctttgatgagcctcttttagcttcacgttgcctaattatctctgtttcaatctagacgaggatattttctttagcaagcctcatacaatgaattcatttatcttcaagtgaaatcatttggtacctctgtgagtttttccctcaattgttttgccacatcaaattgctctatattcaatgcatactggtaagaaccaagaaattaatagttaggctggacgtgcatagataagtatcaaacatttgcatggaccagtagccagcaactaagaatgatgcaattatcatgatggtagatttcattagccgattgctactagtctatggaattgatccgtgaaaaaagaatcgttgccggctggattggtaactttatttgctttagaaaatgatggtaaggaagcaacaactcacctgtattcgggtttgtaggtccaattggaagtagaagattaagatgtcttcgttagcagactcactgcgttccagccttgcattactactgctacggtcatctcctccaaatagccatttagcgttagttctcactgtagtacccatttgccttctattggtcctcatatgtagttttttcacacaccaacgccatgagtacgctccacatgttattgaatttattttgtaaaacaacctcagatcatccactgcaagacaagctggtctaaaacatgatccatggggcgaggaaattgaaccacatgcaaaaatgccttgcattgtattggtatgagatttgaccagttcaattcccacaactgatgtagtccaatcaccacactgacagttgcaatcagcaagccagtggcatctccagctgcgcagagaacaaaaacattttgcttaaaactagtacaaaatgcactaggtaactaagaaaggctttgaattgtggcatctaaataattacaaactactattaactaacaaactaacaagtagtgcctggaaccctaccatatcgtaaatgtgcaataaacattttactatcttcttttttttttgtccgtagatactgatcaatctattctgaattattgaaggtaaatcgcacctaacgtggtccaggcgagtaagcaaagaaaccctcaaactctttggaaataataaagtgctagaacctaccagtacgctttgtttcgagtaatatctatcagtgctctctactatcacgcaaaaaaacaaaatcctcaaaaactaatgggttatacgggagaggtaaggggttgcccgcagcaagataaaacgccagaaaaaaaaaaaagctacgaaaccaatcaaagaagccacagttcatcaccaaccgaagaaacgaaaccaatccaacccttttcagaaggaagaaatcctaatgggactccggtctacgccgccggccatgtagcgagcgtggagagaaggatagataccttttctggccgaggcggcgcgcgcttcggtgggaggaggaggcggggaagcgtcgacgagtctcggcgaacggggaagaaagggggagggccgcgcgcttctcggccgtaactaccactggctcaaagtgtggcggtcgtcgacgggataccggatagaatgtgtgacctggatcaggagtgcatcgactgcaggtta

SEQ ID NO: 65516 - DNA, 2267 bp, Oryza sativa
ctatgtgtctaagatgggttgcatctatttgttgtatcctataccatgcacggattagaccggacaaataattacctagattatacatggatacaatggattattctaattagatatgtcatgttgggctcttggttataccacatcttagaaactctagtatgtgatacatagatgctagattatcatatatgatatccaggtattgggtcgaatacctaggtaccaagtatgaaacctataaatacaagatctgatgctgagttatttggcatgatacctataagtaccggatctgataactaggtatggtgtctgatacctatgagtaccagattggatacccgggtatcgggtatctgatctcatacctatgagtatttgttccaatacctatatgtaacgggtcggatacccaggtaccgagtatgatacttatgaataccaagtctgatacctaagtatcgggtctgatacctatgagtaccggattcaatacctaggtcaggtttgatacttatgagtatcggatccggtatcgcgcatgatacctatgagtattagatcggatcgccgggtatcgggtatctgatcttatacctatgagtactggatccaatacctagataccgggttgatacatattagtagaggatctgataccaaatatagggtgtgatgataccagacttcagatgtgataccactaattctaatatttatgggttatatacttctattcaacagtcaaataaaaagatggaccatgcatagctaggccagaaagtacagccaaacttgctcacgtgctgctgacatgctttgtttaggctaatgctactagctctagtgcttaattctaactttactagttgaagcaggtgttagacccatatggacctaaagaggtgtagaagtagtgctgtattagagtatttcatagctattttgtattgtaggagaaaagagacctctcgtcagtcatcactagtcggtagcctccatgtgaaaggacagcacacgacacgctttcagagagaaaaagaatcggtgagtgattagtaagtataaattataaactataccgttgagacggtacaccatcccatagtttttctcgatccttatccattcattgaagggtacaacagtaaattaatatttcataaaaagaaatttctatttctctttgtgggacccagtgccaccgaacaggccatttttaacccaaaactgtgggacccatctaacggggctaaaagtgagggcaaacggtgggttcatgttcaaaaagatgaggcaaaattgcaaactctaaaaagtaggagtaaaacagcagttgaggttcaaagtgagggcatggatgcaattatccctacaatttttggcccaaaaggaggaacgcggttccccgctcatctcgtcgcctgttcttcacactcgtcgggcactcgagcacaggcgcacggctgtcagatatggcaacggaccaccgatttggcattagggacacgggcacacgggcccgacgttagtgtctagcactccagcgtagatgtgcaccgagtgaccgaggccacagagatgcgctgactgcgttgtgctggtgcgcctggtgcctcgtacatacaatacaatagttttgagaccctcatacaatacattactccctccgttccaaaaaaaaacccattcgttgctttaggaagggtcacgttcccttctagattaagtttttttttttttaagaatagagtgtggttgttatgtcttttttttttcttattcgtgtgcagtactgtaatgcattagtactgtaatgcattaggtacaaaatgtctgatgttgttcgagggatgagttcatgagtacaaagaaggtggatccttcttttgcgacaagtagggcgacatcgtttggctgattataagcataagcaaatgacatattagcaaataaaaataatttgtgaatataacgtttatatacgtattcttaacgatttaaaaagcaaagcctacaaaataaactacgatgaaaaaaatcccaaaataaacttcatatttaaggttgaaatgcatattttggctgataaatataagcataagctaaaagataaggccggtagtatctatttgaactttgtgaacatctatttcatttgctacggcacaaagtgtatgtgctagaacatatttttctttatttcttcattaatttcttatggcacagtggcatgatagatatctttgagccctcgttcttga

SEQ ID NO: 65517 - DNA, 2280 bp, Oryza sativa
ccagtctgatgcgtactattcaaatgtactataagataccactacaaaacacttacgatcatataccattttacagtcagcaagaaaatcaaattctgcagatttatgtatggtgacaagcatgatcatcagtgcaaactttctgagcattcaggaaacttcacaagtaacagtttactgatgggacaagcatgatcatcagtgcagatttatgtacaatactatggtgacaagcatgataggacaagcaaaactacctagtcaatgccactgatgtgctcttgaccaaagggatttcctgcaaagaaacaggcaatgcaaaagatctaacacccaaggctctatatctagaaggcacatatagcataggcctatagttcctctccaatatgttatgaccccagcaattgtgtccctgcaaagaaatgaagagaatttctctaaggtttactataatagagcaaaaacaacattaaaataaatggagtcaaatactacctccgtccaaaatataaagatttttagagttggacacggatagtaagaaagtatgtagaattaaatgggagatgtttgtgattggttgagaaatggaggtaggtggaaaaatagaatggtgaatggttgtgattggttgggaaaaggatattggtgaagaagttgttatattttgggatggagggagtactatatactattggataacaaagaacaaatgacaaatacaaactgtagtgaatgatgcaaaagaaaaaaaaaaggaaacacagtacaactattaactgttatattattcgtgtaccaaatataggttcttctctatgactctatgtagtaataaaagaaatgctttgtgtccctatgcgcacaacactactcagcaatatctctatgtagtaataaaagaaatgctttgtgtccctatgcgcacaatactactcagcaatatgtgcataatacagattccccatttctcagtctatcgacagatggtaaacacttacaagttatgagatattcattatttcacttaattctcataccacaacatattgataaaagcatcttctcccactctcatgtgaatgcagcttgttagaccatttcaagaaaatgaattacactttattaactcaaacaaaaattaatgtatctacaaaatggtgagaacaagcacggcatttaattccttttatcacttcaattgcttagaattgacaggaaagactaacagtaacttgacaatcgttgtgtaaatattattagaatttcaaactaagtttcaaacagcaagatatctggatagtctaaagctgtcaaatacatctgtgaaagagaaatagatagcaaaataattctctgccatacatatgtacacactcctattctaaaataattatttgcttctgctacatgacaactactaacttttttctcaaaaaaaaatctactaacttgcacaatttcaagtaggaacaaatattaggtgcagaaaaaggtaaaacatatgtagacttacagtaaaacataacaaaagaaacatcactacacctctataaacagtgactgaaaaataatattatcttaacagtactgaaaggaagaaaccatacattagggaccgaagataatgaagttgatgtgagagaacttcggatatctgggttctaggaaaaataaacattcaggagtcaggacacagaaaataaaaacagattaataattaaagattaggagtgaacaatctgcaccctgaatttgttggtctggcagaaacggttggtagcagtcactccttggaatagctgggatgtcactccaacagccatctcaggcaggactcaaatgacacgtaaaataatcacatccactgaattaacttctatcagtgctgcctgagttataagtgcaacttcacttctctgacaaaaaaaacaatatgtaagaagtgtggtttgcaacgggcttaagattaatttgaaatattttttagaacatcaagtttcctgtttcttaattaagtatgaaggagtccatattactccccagtccccacccccacccccgagaaatgttctgccatcgtggtcattgatgtggctgctaacatttgcattcactcagaatttgttacataaaatattcttcctcatatgttcagggtactagtattgccaaaatattaagttttagcatgacaacatggtgcccgaatcaaataaatcaaggtaatgaagatacttttatgcatgaccagacactggaggctccacataccct

SEQ ID NO: 65518 - DNA, 13341 bp, Oryza sativa
ctgcgtccgggcgcggcgtggcgaggcgacacacgcgacgccgcgagagcgatgggggaagcgacggaaccacgcacgtgtagccttatcgcccttgcctttttgcctatgcgccgtgcctgattgaccagctgcttttctttattattatattatttcttcttttatattattttaaagtatatgcgatgattgactcataatattttttttcgtgcccctcacctccttctcttttttttttctttataattgtataaaacatgaaaaaaaaaggaaattactatagaacgtgtatcgaatttttttagccattggattagctccaaatttgtgcacgcgagatgagagaaaatttttggccattaaattcactccgaaatttatgcacgcaagatgaaagaaaatagtagagaatcgctacagagataaccttttatacaaagaattttaaattgtgagaagcagcttgtacttctgatttattttccgactacaactatctataattatagtctatagattcttgtaatctatataacaatctcaactatttcaaagagcttcggacagctaaatatcctacgtgaggcaataactatacgcgtgagaaactctctaaatatggcctacttatagaacgatgggtcggtagctaggattaagccaccggctttcatggaccacaagctgcttagcgagctgtgccaaattaccaaccatagtccagcaactaggaattgagccctcttgaaaagaataactagggctgtgtttgagaagaggagattggaaagatacgcaaaacgaggtgagccattagcacatgattaattgactattaagtattttaaacttaaaaaatggattaatatgattttttaaagcatcttttctatagaattttttttacaaaaaacgcaccgtttagtatttcgggaagcgtgcgcgcggaaaacgaagcaaaactcactaacaatcacttagatcacctaggaaagaacacagcctaaagcatccattctttttctcaactccaaactcgtacttttaaaactattaaatggtgtgtgttttgtaaaaataaagtttctatataaaagtataattattaatacttaattaatcgtgtgctaacgaggtttctcgttttacatgcgttaaaatctgtcttcaaaagtgaagatggaacgcaacctaaaaattgaactgattgaatcccctccattacaatagttcagttttatatacaagtcccttgcatttctatattactaaacagactaaaattcggaaatatacaatttcttaggaattacacaatttttaagggattgtctatgagacgaatggctgaaaaaatttgtgttctcggcccgtttgtctgactctctatgatccaaacacgcatctcccatccacctgcgcaaggaataagttcaccggaggtccctcaacttaacagcgagattttttgaggtcccttaacaacaaaatcagaaatgtctacccctaaattcacttaaaccgttcaccggaggtcactcggcagtatttttgtccggttttgctgacgtggcatcctagtcagcaaaaaaaatttaaaaaaaaaacttggggctcacatgtcagctgcatatcttttttcttctcttttcttctccttctctcctcttctcttttcttttctctctcctcttctccttcaggctgcgggcggagcaaccgcgcgccgtggccgccgtcgtcgtcagctctccaccgtcgtcgtcgccgtgagcgaggcaaagcggcgcggccgttcggcggcggagcggaggcagcggagcgcggcggtggagcggaggctgcgggcggagcagccgcgtgccgtggccgccgttgtcgtcagctctccaccgtcgtcggcgccgtgagcgaggctacgcggcgcggccgtccggcggcggagcggaggcagcggagcgcggcggcggagcggaggctgcgggcgaagcagccgcgcgccgtggccgccgtcgtcgtcggctctccaccgtcgtcatcgccgtgagcgaggctgtccggcggcggagcggaggcagcggagcgcggcggcggagcggaggctgcgggccgagcagccgcgagccgtggccgccgtcgtcgccgtgggcgaggcctagagttacatgcatatatgcattcattcatgaatatatacatatatattcgatcgatcttgtcactttcaacccgtgcaggagcctgcaaatcaatcacaagctgcttttgctttggtctttttctctctactgcatgcatgtatccctcacttgagagcccatagctagcatgcatgcgttcacaggcttttggcctttcttctcttgcgcgcggagggacgctattgccaccgacaagctcgcgagtgaagctcggccggctctctctcctctccggcaaaaagggcgccaaggccgccctgctcaacgacgatgattacgagccccccgcgccgccgctcccacccggggacggcgacgacgacgaggagcccatcaacctcgtcttcaagggcggagatgactagatgaggccggcgggagagggggtggcgtgctgcatcggcgaagaggtcgccgccgaccgcctgccgccgctccgcagccacacctgccccccgccgctcgccgaccaggccccccgctccgtcgtaatcgcccgccgccctccgcccaccgctgctccgcctaccgcgctcgtggaggtcaaccaacacgacgacgctaccggcggtgaagagctggagcatgacgagcgccgccgctccgctgccgctctcgcccgctgccctgcccgccgctcccgccgtcccagccgcctctctccccctctcccgccaccgctggcacgctcgctccacgccgcccgccgccacgcccgcctcctctccccccgcttcttccccgcgggccgttgtgcccgcaccgccgcctgtcgccacaccctcatctgcccagccggctcactgaagaagagatgagaaaagagaatgtgcagctgacatgtgggtcccagatactttttaaatttttttttgctaactaggatgccacgtcagcaaaaccgggcaaaaatactgccgagggacctccagtgggttgaaggagtttaggggtacacatttctggttttgtggttaagggaccgcaaaaaatctcgttgttaagttgagggacttttggtgaacttattcccctgcggcaatactctcgcgtgcatggtgcactttccagccattgtaacccattttgttgtgtcaggttggtggcaaaaaagcccatagccacacgaaggggcccatgatgttttctacagggcacacgaaaaaacaaggaataagttcaccggaggtctcgagattttttaaattaccttaaccgcaaaaccagaaatcttcacccctcgactttacaactttacaaaaccgtctaatttaggtcccaaggcagtatacatggctggttttaatggcgtggcatcctagtcagcaaaaataattaaataaatatgtgggggcccatatgtcagtgagagaaaatgatgtgggccccacatctcttttttttctttttctcttctcttctcaacttctcagttctcacgcgcaggcgggaagatggcggccgacggcggagcgggcgcggttgccggcgcagcgggcgctgcggcgcgcggggaagaagcgggggagggggagaggaggcggccggcgccagagaaggggagagaggcggccggcgcgaccgcccgcgacggcgggagcggcggccggcgcgcgcctctccccatccggagccacggcgggttagcaagcgaacggcgtactcgctatcgccagccacgccgcctccacggcgccgcgcacctcctcggcgcgacaccggcagaggatgcggaggagagcggccggggtggacgcgttcgccgatgggagcgccgggagagggctcgacgacgagcaggcggatgggcaggccgtcgatgctccaccgccgcttcgcctgcctccggaacgcgccgcggaacccgccacagaacgcgcgtctgtccagccgacgcatcgactccggcgtccgctccttcggcggcaccgtccccagctgccccgtctgcctccggtcgccgtcgtcgtcgttatgaaacacccattaattagtttgcacgctgcatgcagctagctagccaaccggattcatgggattgtccaccatgccctgcccgtgttagaaattaatcttgttgtttcttaatttcagcatgtttatctatatgcatatgtgtgtgttgcatggcctggagagctagctatatgtacgtgggtgctgcatggtttagtgagtagtggttggcagtgagtagtgagccaataaagagccaggagatgagagcacatgtatgtagcttagttagttagccatgcataattgtgggctagtgattagccgagtcttgcacaagattaggagtaggaagtggtcagtttgcatgcatgcaggttagttggttggttcatgcaactaacgtcggcgaagactcagtacttgtgaagttgcggccaagtaaacaggatgtgggcgtcgtgtgtggcttgagaagcggaacaaccagcttcgtgtgtgtatgtgctgtgttataaatagctgctcattgtaatcatttagtaaagtgaaaaaccagtgaaaagggcacaagttgttgtggtgcctctaagctcctgtgtgtttgcttctgtgtttgtgtttcttcctcgctgcctcgttcaaaaagtgtagcctgtattcgcgtgagttgctttgattcccaacagcccgaccatgggctggtccaacacgggaggatgccgtgcttctccagctgcccacgcagtccgacgccgctcaacatcagcagctgcaggccactcagcatcagcagctgcaggctccccagcgtcccggtgtggtcgcgtgcgccgatgggagcgccgggagagggctcggcggcgagcgggagaatgggcagggaagggtcgagctacggcctgcgggtggctgcggccgccgcccgccgcaggctccgctctccgccgctccgcgtgcctgctcgcccgtcttcgccgctagtagccgcgctcacccgtcgctgcctcccgcctgctccgctctccaacgctccacctgcctgcttgtccgccgtcggcactcgcagccacgctcacccgccgctgcccgtcctgcctgcttcgcagccgccgactccgctctccaccgccgccactccggccgctttgccgccgcggcgactgctgcagctctcccctccgcggcaagaaaatggaaaagagaagaggatgatgctgacaactgggcccttactatttccttctcacttactcgtgggtcctacattatttttttattctttttgctaactaggatgccacctcagcgaaaccggacatctatactgcctagggacttttttttttggacgttttacttaattaaggggtacaaatttctggttttgtggttaagggatctcaaaaaaaatctcgctgggatctcgggtgaacttattcaaaaaaaaaaagacaatttcattttacccctactttaatttttaatattgacttactttttagggtatcgttggcccttgctttttcaaaacgaagctgacgtttactcctattgttgacagaagttagtgcaccctggatagttgagtttaagaagtagaaaaaaaaagaaataatggattttaaatttattgatttacctttctaccttgggtggtcacaataccttggaatttttttccttcccttatcatcttcatttcgggttccccttatccttaattccttatactctcagcagctcggcaagcagcagagaagcgacgacggaggctcgacacgaagtgtaggcaactgcgacggtggctcctcatgtggaggaagtgacggcggttgctcggtgctgcggtggaggcaatggctggaggtggctccgcgcggtgatgggcggaaggcagctcgccgcgggttggagacgacggtgacgagcaggccaagaggcgacgatggaggcctgacccggcttggctgcgagcaggcgactgggaggagttgcttgaggtttttttttttttttgacatggggggttgctcgaatttgtgattaggatctgcttgactttgtgatgcttgtagcttgctatttgtcttctagttttgtaaaaaaaaaaagagtctcaaaattatgcctaaattctttcgattttttttcaatttttgtctaaattttatcaaatttgtggcaaaagtatgtcaaattttgaaacattttttatatttggtcaaaattttcatatttgtacaagttagtgaaaattgtaggatacaggtacaataaggagcaaatacacaattgatgaaggcaaatgtgtaataacaccattcgcctgtctatccaaagtacagataaaatttagcttcgtttaaaaaaagtagggataatttcatttttaccctacttttaaggtttaatattgattttaaccctactttttagggttctcatttttacccttgctttttcaaaatgaagtagacgtttacccttatttttacagaagttagtgtatctcggattattaagctaataaagaagtagagaaaaaaaaagaagtgatgattttttaatttattaattgacctttctacccctttcattttgccataggccatagccatacaacatccacatcctttttgcgccgcgccccagacaagcaggcagcggctccgcacgaggaggcaactacggtggctccgcttgaggaggaggcgacggtagctcggcatgggaaagaggtgacggtaggggctcggcttaggcagcagctccgcgtgaggaggagacaacggcagcgcctagtggggatcaggcagacgaggcggcgaacaggcaagaccgcagacaggcggctgccagctgcaacaggcctaatgatgccgacagcagaccagctaggcgacaagaagtaggtggctaagacagcgagcaggccaagccacagttgcgagcagtaagggtacatatttagaccgaaccgaaaagaccgagactgagaccgagaaattcggctatctgttcggtcctagccctcaaaagaccttgggctcgattaaccgaattaaccgaaaagaccaaaattttggcccagtaggcctaggaaggccaataagcccactagaacaaaccctagaagtgatacaaccttaccactgccacactcccatcgcgcttggcctccgcctgaccgcctctaccgcgccacctccagcctccaccgcctccgcctccgcctctgcctccgcctccacctccaccgcgccgcctccagcctccaccgcgtcgccgccgcctccgctctccactgcgcggcgacgcctctgtcaaattttttcattccaaacttactcctgaaaaatttcgatcagaccgagaccgagaccgaatttgtcgatcctaagattttttttagatgaaatttggtcctgagttttcaaagaccgaactgaccgaaaaaccgaaaaccgagaccgaatttttcggtctgaccgaacgcccacccctagtgagcaggcgagaacacggggagcaggcggtggaagaaaattttgtaggatagcggtccttcactcgtccgtaggacttcgccccttgtccaacacgtgttaggctggctagtcacaatcttaaagcaaaccttcatcttagtccccacgccgtgaagcgtgaagcggcggcgccgtaagcgtccagcattcttcctgactttactcgaggcgtgaagcggcagcgccgccggttgtgcccctggctgcagccacgtgagacgaagctacgtcgacagcagcgacgcggcgtgaggtgatgggtgttcttagagcaggtacagtagcaggctattagccagctataaacatattttaataagataaaagatgagagagaagagctgcgggctacagatctatagccagctgcagcacagactctaagacgcagtgtgtgtatgacaggtgggaccatatattaatagtatagtaagcaactattgtgtaaattgactattatattggctataggtgaattggagcttgtagtgggctatactattgaacttgctcttatccggtggaaggcgaagcagcatcactgatttgcggccatggattagatgtattgtcttggtcaaaaactgatctataaacattgagaagctacggcctacgaatgcactgtaagcttggagttcaggtttgcatattctccttaaaagaatagaagtgtggaatgaacatcatcgtcgtcgttctgagatttgtcagatcgtattaccactgcctaccatcgctggtttggaatcaagcttttgccatagatattgatgcatcgtctcacgggtttgctacaagacgagcagaagggcggcagcacccgtccatctcccgcacaccgcgccgtatcgatcgtctccgcactatattgatggccgcgcggcgcctgttcatctcccgcatgggacgaactaacgacgtcgggccacaggatttaccggtttagggggaaatgagggaggtttgctttgagattataattggacacgtgtcatgtggaggggcgaagtcctttggatatgcgaaggactgctgtcttaagaaattttcttccgcaggcggcggcgagctttgccaggctgtagtgaccagacgacgacacagtaggcggcaggccgcaagcaggccaagcgacgcctgcttgccttgctttactgcgactgcgagcaggccatttgctcgactttgtgatgctttgctacatgatgctagctctgtaaaacatgagtcaaaattgtgcccaaattttatcaaaatctgtccaaattcgtcatatttgcatattaaaatttcaagctacatgggggtataaatgtcttttcgctaaaaatttaacaccgtcaacttgcacatccaaagtagggtaaaacttggtttcgtttgaaaaatcatggacaaaaacgaaaacctaaaaaacaagagtaaaatcaatattaaacattaaaatagggtaaaaacgaaattggccaaaaaaaaagggataaaaatgaagaccctatactgtcagggtatgaaaaaaattacccaaaaaagaaaaggccaggatgttttgtcgttgaaaagaaaaggctatgaaaataaacaaagtgatttaatcaaagtcgtaaaaaagttcttagccccaaataatcaaagtgaccccagcatattcttatctaaaagttgtctgtcagtatcaccttttcacctatgcatatgtaatcatgctataaccaatcatgtaaaccatcacaatactccctctatcctatatattttaatcatcacctaagcaaaaaaaagaagcgtacagaccaaagacaataaaacattcatcattctgcattaatactcattggttaaggtgttacgtcgcttcgtgctccgtgaattacatcaagttttaaatattgcatgtagttggaccaatagaaattaatcttgggtagttgcgtacagtgcattcaatgatgctcatttactcttggcacaaataaacaaagatgcacttgttagaggatgatcattttggaaagactttaaaaaccttatgtgatgattaaaatgggatagagggagtataacacaaataagtagagcacacaattatcagtatgatgggacaaacctgagcaattgacacttgagcagggctccatgttctcaagcttagcagtgattcaggcctcacaacaacccaccaccaccttgttcagtatcctagtagagtcttgagttggtatttttttaacaacattactagaaatatgaactcccagcaatgacgccagaaacaaccctagtatatatatagttacagaagggatccgcaagcgcacggatatatcattgtaatatttcacccggaagtatttgtcagggttatggataccacatacctaatagtagttgactaagcacggcagagcccaccacataccatgtcttatacggaatcatacctcgtatataggagttccggataaggaaggatgattagagttctatatagaaacgacaatgactactcggattgtatccatattggtctccctaattctacttgaacaaggtgacatctatgggtataaatacaagccccctaggaggagaggggacacgccacaaagcaaacaacaacaacagatcaacacaaatcgatacaagccagcacacgccaagacaagccaccggatatcgacatcagagataagcctagactgtcacgtccagaaattcccgaatagaattccaagcagaatgtgcattaaaatccccgtccaggaccggccggggtacacaaacgacaatgttgacattcagatccacgtcttacaaacatcataaacgtcttacataaatgcagcgaaaaacgaaagacaacaagagctaagccttgactagaactgcagcgggaacaccactccacaagcatcctcgacggcacggacgaagcctatcctcggagaaacctccatctgacacatactcgtactctggggttgggaaaaatagagcaagactgagtactacccactgtactcagcaagtcataccggaataggggtatgatgcagggaattatcaaaggagagctagggtggttcatttgcataaagcgagcattcataaatagaagtttaaagaagaaaacagtcataataattaatcaatattaatcatccactgtccaacgctataccacgttgcgacaggccccaccatccacctatactatccaatttcaaaagactaaactagggtgagactaatcacggtgaatctggttgaccgcccataaccgcgggcacgactattcgaatagttttactctgatcagaggtgtacaactgtacccacaagacacagccccacgacacgttttcgtgcgccgacatgccaccacgacataccggaaagaggccatgacaggacccttcgcataaccccctctaaccaagcacaccacacctcaggtttcacccccactcctcgcaaggcagcgggcagtcccctctcgtgcctaggtgaatccggaagcgacagaggccgtcgcagggcccgccccgctccatcacgcccacccttgcctggatgcgtcagctagaggaaagctacactacaagccccgccgttgcccacgctggcttgtggtaagtacgataagttcttccagggcatcacgctaaccggtccttaactgccatgggtgtgaccagcaaaaccatgcacccacagcccaccatatgatttattttaattaaccaacaccaaagcggtggcactaatccaacaataccattagaaccaacagtctaaacattaataggattttccccactgtgtactagttgaactaagcatggctaagcaactcctagtccaacgtctattcatgttacaacccaagctaacaaaggagcaaggtaccaaaatagcatggctgtaacaataggtaaacatctcataataacattataaaacgatgcagtatttgaagaaaaacaatagagcatttgcaatataggatcaacatgttcaagtgacaagcatgacttgccttgctctgctgctggaggaacctcggcgactatttcgaagtacaccggagcgtcggaagaaccggaatctaagcgacatacaaagcaaacaatgcaaacaggctataagactactgaaacagagaacaaaaccatttttaatggattctacacatttttcttgatttactgagacttgaatgggcttaaacagagctcggatgaattagttatgaattttagaagattcactgtgtttattactataacaaaaagtccttaaataatttattgcgcaacaactcccagggctgacgtcatcaaggggggtggcgccgatgggcgggtcccactggtcagtgtctcgggagagaggggaaggggcggcggcacgtgggccccactcggcagcggctcaaggggagggaacggttggcaagcgggccccacagccccggctccacgggccagtgtacaggccaggcccggcatcaagccggccgaccggccatggcaaagcggcggcgcgcgcatgcgaccgccggagacggcaaacggcggcgcggacggcgggcgacggggaaaaaagggaaggaaaggaaggggaggggagacctcaccggaggggcggcaacggccggcggcggaaaacgagggaggcggcgaagaccggcgatgccgaggtgcggacgagcgacggcgacacctagggaaaaagagaggaggaattaggacggagggaaaccctcacggcgaccatccacgccggccggagtcggaggggagagagaactcaccggcgacacgagggagatggggtttcggtgggattccggcgacgcaaagcggcggccgggaaaggtcttgcggcggcgaagctaggggtggcggtggcttagcgcggcgacggctctagcggcggtggcacacggccggagtgcggcggcgggcggcggcgcaagcggcggcggtgcgagctcggtagggggcacgggatggagcggtgagagcggaaaacgagagaggagggcacggggagcattttataggcggagggggaggcggacgtggccgggaggcgccccgatttcgccggcgacgtgggggaggagagagagaaggtgggggcgattcaaaatcgaatcccgcccctactcgtgcgcgagcgcggccggaagacgcggggagagggggcggcgacgtggcgtgggcacgggcgacgcggcgtgggcgcggggaaagcggaggagtgggtgcggcggcggcggtttcggcggggtggtgaccggcgcgggcggcgggaggttaggggaggacccgacaggtgggccccacctgtcggtgaccccgggagaggagggaggcggggcggcctgactgggcctcggcctacggccggcccaacgggagaaaggggagaaaaaggaggaatgggccggcggcccattcaaaggaaaagaaaaaagaaaaagaaaaaaaagaaaagaaaagaaagaaaaaggaaaaagaaggaaaaaggatttttcctggattaaaattgcatgtgctcaattttaattggttaaaattatttcgagagctctgaaaattccactaaaaatcttg

SEQ ID NO: 65519 - DNA, 1870 bp, Oryza sativa
tggattccccgacgacaaaatactcgacgatttcggctgtggggagatttaacccgaccgaaatatgtctttcgacgagatcggaaccatcatcgccaactattcgatctgtcaagatcgaccaaacttcaagacatcatctccgcggatcacgtcaattttaaggttgtcagtcatggtgcttcgtcgtagattgaacaacctcgccgccgcgaaggatgtggacgccaaacttttcgtcgtgttacaaccaaccgagtctgattactgtgaggctaatccgagcagatatatgctttgattaaactccatctcggactcgcgatttgctaaacagacgaaaaactatgacgcattgcttcgctgacttgctgtgatcaagtcagattaatctgatggcatagcatgcttacgataggaccgtgtacagtaatctgatgccataggtacgagtgcatacgtacagaggtggaccatctacacgtgctgatagctgaggataatccagatcaactaagaggtaattagtaggattaaattttaaattaatctactgattttgtagatatatctaacatatatctacacaggtacgtaatattttatatacaatttatcatgcatattttcagatcatacaatattgtcagatcaatgatttattatgtttacctagagcatgttctttatacaatatctattatgcaagcattccctatattaggccgactacggtctaatactgggggctcgctctattccttttatataaatcatacttgtttacggtttacataatatctgatatttaatctgctcgttatatcctgataatactaaaagattcatgccgttttttagtacatactcgatattctctgctatatattgtcttctagaaaatatttttcaggaacaattgagcactcgagtaggttgtggccaagtacacccattatcaagaacgttctcgaaaaatgctgagttgtcgcacccaactcctggttatcgaccagacaattgtagcgacatctcgccgcctatcaatttaaattcacttatattccaatgaactccatatatcgttgtcaaaggctccatatctttacggtcttacactgggatcgaccaagtgagtacggtaaatattgataagaggagtcacagataacaagagatactctcacgaatacggtttgtttccgtatgcctctcaattgcctataggtgatcgagatacgcttacacctggtcatcaaccagtagatagtagcgatctctcaccaccaaaaatccattttcaggtgatcgagatacacctactcctggtccttgaccagtcggttccaacaatctctcgacatctaacgtgataatcaacatgattgtgatagcgacagccaagaccgactagatcgccgttgtcaccaggacgacaacgtctaggactaatgacaccaagacgacaacggacaaggttaacgacatcacgacatcacacgatgacgacgaaactctagatccccggacttctagagagcccgaggacgaggtagtaggtccaggagccgaacctccaactacgataattcctcattgtcttcgttgtcatcaggagacagttctcgcaggtcacgagaatgtcgtctatctattactctggattccatacaagtggtcaaggtacgactacgactggtctttgggcctgtttgggggagcttaagattctgagaagcagctgctgagaagctacctggtgagaatctagagaagctgggaaacccagcttctggcttctaattcatttttccagattctacaactacagattctcagaatctgggtaaaaagctagactgtttggggg

SEQ ID NO: 65520 - DNA, 816 bp, Oryza sativa
acatatacgagattagcagtatttatgataaatgaaagcatccacaaccaaacttctaatcatgctagaattgaagaatgtaaggtggttgtgattctcgtacaaggatgtggtactaattggacaggactctaaggattctttatgtgagcaggattcctgaggaattttgagagtgaaactttcatgctcattagtggagttttcatccgccagagttgatgtctcaaacttgtccatggcttgcaggttctccttctcaagagatgcatcgtgcaagaacaaggttgtttcttgacaaatgtcaagaacaatatttttatggccagagggacaaggttcaggctcgataggaggttgtgatggtggttctttggagtgcaattcaagggtctcgccagaatctttttgaatgaaacgaagatcatcatgctctagaatagattcaggggactcatgaagtagaaccgccattacttcctctatcggcgtattctcagggaggatgcccgtcaaggtataatcgctatgaggatcatccctgaatttaggagcgcaacccggagcttgaatttcttttgaatccggcgatggctctagggaggactctttagtcagacccggagatagtgaaggctcgggaaaagaaggttcctaccttcctgacacaaatgcttctggatggggtttaacacactgcctgacaaaggaggtattttctgatatgcaatcgagaatttccttgccttcggcgggagtttttttgcatgaatgaccctccagcagttatgtcaaggtagaatgcagactccctat

SEQ ID NO: 65521 - DNA, 6245 bp, Oryza sativa
  unsure (1)..(6245): unsure at all n locations
atgcataaataatatgtggaactaacaaacatgctatgtagacaagatcatggttaaacgagatttttgaccgggatgatacaataaagtaagtttaataaagcaagtttagggatctcgacacacgttttacaagttcgtagacacaggtgaaacctcgtttaaagtttaagggccgctgatgcaatttactctaaaattaatgtgattgattgtaggagagtttttaattggtacaaagaaatagatagatatatacctgcaatgtatatgaagtcctaaatattatattgtgcaacttgtgggatgcatgtatgcagaactccattctcacatctcactgcatcacctaatcctaattatcctacagatatgaggcattcccttcaccatgtctcttcttattcttcgaaacatatataatcctatagtgtcctataatgtttctgaactagtgtgatggcgtacttcctgtacttaaaataagttaattgcaggtttgaagcgaatgatcttaatatatatgcctaattgtgttagttgtatattcttctaaacactacagaagtttaagcagtaagattagtgaacaaattctctcgatcggagcaatatttaagctagctttcggtatatcctttccaatttattcaaagatcctcgacatataccagaacaaatacgtacacatgttccaaatttccagtgaatgaaacaaaagttaaacaggcaatgattcactatctgctttcacaggtatatgtgtatttgttagtgtatggaagcaattgattaagaatacatggtgccatttgtcatgcaacaagttaatcgatcgattattaattttatggcagctgcaaggaaacaaatcacacttatacgctaatttgtgtttgccttcttttatgtactttcatgtatagaaagttaactcattaaattatgaactccattgtgtgtcgatcagtattgatcaagaatataaaaccatcttctagcaaacctgttttgtagtactgtttttctccgtttcttgttttatcttttgacttagatgtgtcgctttacttctgcagacggccggcacgtacacgagcgaattaataatttctgctttacatatacacgcggtatatatatcgatatatacgttgttaattactacctctgttttttattatataatggcattaaccctttttacatacgtttgactattcatctttttctttaaattttttgtgtaaatataaaagatttaggtttaagtcatgcttaaagaatatttgatgataaatcaagttacaataaaataaataataattacataaattttgaaaaaaaaaataatggtcaaacgtatataaaaaatcaatggcatcatatatattattaaaaaccgaaaggaataattcgaaagcagtaataatatagaataggacgatcgacgtgcaaaagtcgtccatttcgatcgatacctttgcagatcgattttgtcttgactcactaagcgtcatctgatgagccaaacatatcagatgaagcgacatatctctacagcaaacgagctatctgctaggagttgcacgcatcagtccaaaccaacgacatgcaagcaagctagctacacatatcgaaccatgcatcaagtacgtcagattcagtgttaaccggtaaaacaaataaactattagtagctcctatacaagtcatggaatattcagatctacaaataaatcacctgaggatcgatatatctactagctagctaaaattaaattgaacacacctgaattcacaaagttaataatcagaggaagcatctaataattaataaacatgtaatgcaagaacaataaatgccaattaattcctccaaattaattttctagtaataactggtgattgattaacttaatccatctgatgtgttttgctacctcctctccctactacacacgtacgttgctggctgaaaaaccctaagtacgtacacgcgcgcgctgcttcctcttcccattcaacccgcacgtgcgatatgcatgatccatattgtgtattgcatgcacgatgcatcgcaggctcgatgatttgcagcaatggcggatttggacttgttggatcgatcgatctcatggcttccacgcgctcgcccacacgacaggctgctccttccacgcaaggaacgctccggcagcagcggcgccggcggcgtcgtccgtggcaccgccggcgtcccgcatcgaccagccctccttgtaccgccggagaagcgaccgcacgtcgtcggcgacgtcctcgctgaatgccgccggcgagaaccccgccgaccgcatgcgccgcgcccacgacgcggcggtctcccggcgctcggcggactgggaggccgggcatgacacgaggtcgacgatggcacggccgaccgccctctccagtgacagcctctcgttgcttgtcttggggaagctctcctccagcgagtccatgtacgccgagaagaagcggaggccctcgccgaacaccttgacgaacgcggcgtcggtgtcggcctccgacgacgcgtccgcctccggcgccgccaggtcggcctcctcctccacgacggtgaccacgcgcggctccaggcgccggagcgacgccacgaacgcgtcgcgcccccgcgcgaccccgcgcagcgcgtttacgcagttgacggcgagcgcggcggtggcgccgccctcgcggaggtccagcgcggcgaggtcgaggtcggccaggtcccccgagtggtgcacggcgcggaagctgaacgggacgcccatcagccgcgcgaacttctcgaggcgctgcccgatctcccgcatcacgcgctgcgcggccgccgacggcgccgccgtgggcacgacggtggtgatggacaggtgcggcgtgtcgtccgaggaccgggtggccagcgcctccaggagggtcggccactgcgtgcagaacgtgttgctcaggtcgaggatgtgcagccgcgtcggcggcgtcgacgatgaagacgacgaggaggaggaggcggcggcgcccgccgccgcggcctccaggaacgactcgagtatggcgccgttggcggcgacgtgcccgaacggcgtccacgggctgagctcctggaacttgagcgccgtgcggcgcgtggagtcgaacgacgcgttccggtccgacgcggtggcgagcgtccgcagcgtgcgcgggccggaggtggtgagccgcgcgaagaggccctgcaggaagtaggaggccagcttctggtcgacgtcgccgtacggcgaggccagctcgttgagcatccacatgagctgctgcacgcgctggctgtcgcgccccgccaccgcgcgcgcgcactccatcagcagctgcgccgcccacctccccgacgacgacggcgctgccccggcgccggcgccagcaccggacgacgacggaacggccggagagccgccgaagtcgaggctgatatcaacctgcgggaacgagaagtccgccgcctcaaacagcccgtgcccgcccgcggacgacgtcgtcgccgacggaggaggaggcaccggcgccgacgacggcgcgcccgttcccgagtggaactggcgggaggaagacgaggaggagaagtcttcatccatgtaaaactggtggccgttgccgcattcttctaggtacgccgccggctgctgctcctccgcgtagtagtaccctccgccgccgcctccaccaccctggtaatagtagttggtgttgctattattgttgtagtgggagtgggagtggtggtagtaggtgtggttgtgggtgtggtgggaggagggggagctggtgctccctcgcgaggaggggtacgacttgtgcggctggtccggcggcgacggtgaggccgcgtgctggtggtggtgatggtggtggaggctaaccaacctgaagagggtatccatctagacctaagacacctgcagtagtagtagccaacatatggccggggtgcaaactgcagtgcagtgtagtagctactcactggctaccaccatacagcacagcagctactacaacaatctttctcacctcactacactgtcctgcaacaactgatcatcgatggatgcaaaggggatctaaactagctagttgtgttgtgtttaccatgcaatgcaaatgagtgaaatggtggtgacatggggttataaacatgcaaagggaagcaaaccaacaatctacttggcttgctacttgtgatgtgaaatggtaggagcacagcttggtcaattctgaggagcctgctgggccggcccccatctattattctttttatcccactggctctctcaccctctatctgtctctctgcttttttttttgtgggaccgaggagggagggaagagtgctgttgttattgggggattttctagcaaccgcttttactgggtgcgagagagaaagaggggactcttctcttctttgcaggtagcgatctcctcttatcgtggctttggctccttcagctttggtaaagggataaagtggtgacagtaggattatgcacgacagacacacagacagacatatactagccggcactaatacgtatacggacgactagaagcatttgaaaattcttccttgtcgctatctgcctctccttatgcccttggtatatattatttttacaattgagacacgacctctttcggttgatctccatattacctaaagagccacggtaagcgctaacagtactttctacattttttcatatctatccggtgcctataagtgaagagcaagtttagtatggccagctatgggctctaaatcatctatagttaattctaatagtcaagtcatataatggttagctataaacatatactacacaattaatacctagtcccatctatcatacacatgtcactggtggagaaaccatccttcgtcggtcggccgaattccacaatagtcccggttgcaataaaaaccagggctaaagatgatctttagtcccggttaaaaagggtaacggccatatttgatctttagtcccggttggtaagatcatctttagtcctggttcaaatgctgtcagggcttgtcaggcccccctgggatctttagtcccggttggttacgctgagactaaagatcccggggatctatagccccggttcataaccacctaacccgggacataaaaagtccccaacccgcgtataatataatgtacttacttccctccctcccagactgccccgagccaagccttccaaagatttgcattccaaaaaagcagcgggagnngtccatgcccaaaagtttnctagatgagattgtattttggtgatctatataccaaatccggaggtgcctaaaaggttagcaacttcatcctcccaatgttttttttgtcatattacatttggagctatgttttgcacacttttttgtctccaaaatttagttgtaagttgatgagagagaaaatttgtgtgggggaagaaagaatatatagaaatttagtttatttgctaaagaaggtttttataaaatagttgagaaggaaaaatatagtgaaagttaatcttaaataatagaaaacaaactaaaatgaaaattaaaagaagtacaacacattaatattagtttaaaactttagaaatagtaaataagaattatttggtgtaatattttataatttttgtatgaataatgatatgtcattattgtatgactgttgaaagagtttgtaattattttaaaactgtcattattgtacgaataattatttgtgtacgattttttttcatctcatgtagatggatcggcaatggatgtacgctaaccggcggtccaaagagtttattgacggcgtgcattattttttgagagtggccaaagctaacaggcataagggttttatttgttatccatgcaataagtgtaagaatcataaggagtattctgcatccaggactattcatttccacttgtttgagtcgggcttcatgccaagctataactgttggacatcccacggagagcaaggggttgaaatggaagaagatgaagtggaagacgacaatattccggactttgctcagtacgctggatttgaaggaaatcaaacgggcgaggaggaaagggatgctgatggtaacgacattgcggatgatcttggttagatgttgcaggatgctaaggaggactgcgaaagtgaaaagggggcctataaattggacaa

SEQ ID NO: 65522 - DNA, 1936 bp, Oryza sativa
ggtcatcgtcgattccttgctgcaaaccacccagtacggaagaaaggcaagcactttgaacataaggcggaccaccatacgaagcctaaacatcgcagcgggaaaacagtgtttgctatggttaaagatcttaaagtagtgttcggaaaggggtctggaagccagcctatagagagcgaagatggtcacgcggcgatgtggaaaaagaactctatattttgggagttaccctattgggaattcttggacgtccgccacgcaatcgacgtgatgcacctcactaagaacctttgcgtaaaccttcttggcttcctaggtatatatggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaatgtctggatactccacgaatatcaagcgaataataagcacgaaggagaagaagttcacaaacctaaagtctcatgaccatcacgtgttgatgacacaactgctactagttgtaataaggggtatccttccagacaatgtccgggcaacaataacaaaactatgtgctttcatgaacgcaatttcgcagaaggtcatcgatctggatagattagaagcccttcagaatgttgtggtgcaatgtcttgtctgtattgagttgatatttccaccttcatttttcaatataatgacgcatctgctttgtcactttgtcaaagagatcagtattctcgggcctgtgtacctacacaacatgtttcctttcgagaggtacatgggcgttctgaagaagtatattcgtaaccgtgctcgtccagaggcaagcatcgccaaggggtatggaacagaggaggtcatcgaattttgcatagaatttattgaagaccttcgcccaattgaggtacctgaatcacgccatgaagggagactacggggaaagggaactctcggaaggaaagcaataatgacggtagacaacaatttattccgtaaagcccatttcacggttctgcaacaatcttcattggtagctccttacatcaaggagcacttggctctagttcgcgccagaaacatcggtaagtccgatgcatgtattacacggcatcacattgatactttctccgcatggctacgacaacatctcatgggtaacgagacgatcaaccaacaactagccttcctggcgaggggaccatctgggtcgatcgcgacattccagggatatgagatcaatgggtacacattctacacgagagcccaagacatgaagagcacgaaccaaaacatcgctgttcgtatcgatgccatgggacacgatggaacaactggcacgtatttctgtgccatcgaggacatatgggaacttgactatggtcctctcaaggtccctctgttccggtgccaatgggttaggttgactggtggaggcgtaatgattgatgacagtgggatgacaacggttgaccttaacaaggttggatactcggacgaaccttttgtccttgccaatgatgtaacgcaagtcttttacatgaaggacatgtctagcaaaggaaagaagggcagagggcctgacgagccgaagcatcatgtggttctcccaggcaaaagaaaaatcgtcggagttgaggacaagactgacgaggattaagatcagttggatgggcaatcccctttcatggtgacgattgaccctagcatcctcctatcaaatgaagacaccccttactcacgtagcgatcacaaggagggaacaatagtgaagagaaagtacgtgcggtcaaccgtcaccgtcgatgtattggcgtaattattgtgtacacgatgtaaactat

SEQ ID NO: 65523 - DNA, 1549 bp, Oryza sativa
gccaccgccgtgctgccacgcctcctccgcgcaacgccgccgccgcgccgcgcgacatgctgccgctgcgccgcgcgccaggccgccgccgcgccacgccgatgccgcgccgccgccgacaccgcgccgccgcgcgccacgccgccgccgcgcccgcaacgccgccgccacgccgccgcttcgctgccgccacaccgccgtccgctgccgccatgttaacgaacgaattatcgtgaacgaacgaaatgtacgtgaacgtgaaagaacgaacgaacgtacgtgaacgtgaacgtgaacgtgaacgaacgaacgtacgttaacaaacaaaacgtacgtgaacgagtacgtgaacgaacgtttctcgtgaacgaacgaacgtacgtgaacgtgaacgaacgtgaacctaacgtgaacgtgagcgaacgtgaacttaacgtacgttaacgtgaacgaacgaacgtaggtgaacgaacgtgcgtgaacgaaaagtgaacttaacaagaacgcgaacatgaacttaacgtacgttaacgtgaacgcaagtgaacgaacgaacgtaggtgaacgaaacgtgaacttagcgagaacgcgaacatgaacgatcgtgaacgaaacgtgaacttaacgagaacgcgaacatgaaatacaatatatgttactttgcgtttatcctaatacatctttttgtatgttgcagaaaagacgttgtcgtcgtcgtccctcaagctggagtggtagctagccctcgaaggaattcacgcaggcaagtgatgtaaatatatgattgttagatttttaatgcaattaagactattagatttaatatacgacacttagacttagcatatatgattacctagggatctaatatacgacacttagacttagcatagttgactaccagagttgtaatacaagattatttgagttttaatataagattattagagttttaatataatattattagatttgtaattagacttagcatataagattgtgtagggttctaatatatgacagttagacttagcatatatgactatttgagttttaatataagattattagagctctaatacatgattattttagttttaatataagattattagatttgtaattagacttagtatataattattgtctagggtcctaatatacgacacttagacttagcatatttgactattagagttttagtacaatattatttgagttttaatataagattattagagttttaatacaagattattacagttttaatataagattattagagttttaatacaagcttattagagttttaatataagattattagatttgtaataagacttagcatataagattgtctagggttctaatatatgacagttagacttagcatatttgactatttgagttttaatataagattattagagttctaatacaagattatttgagttttaatataagattattagatttgtaattagacttagtatataattattgtctagggttctaatatatatacgacagttggacttagcatatatga

SEQ ID NO: 65524 - DNA, 1309 bp, Oryza sativa
ctctctctctctctctctctctctacttgcatgtggaagatagaggacgtcagttgggccccactgtcatataggatgaaaggtggattttattgctgaaagttcaagtgccattaatttggttttggtgattaatgacaaatccaattacatgagactaacattgttataagcatttctttgtctactagtctcatatggatatgaaagtggaatatgtgagaggtgatttccggactttatatgagtaaagagagaaacgttcattgatggtgttcctaaatcacaaggatgaaatgcatagagatcaaactatatatgtatcactctttctctccatgtacatattgatgtgttcatatataatatttttcatgtgaataacaatatacatgtgagactaatgttttgtttgagccatatcttgtttagtctctttacattgataacatggagatgatgaaggtatatttttattttaatgcctacttgataaattccttctattcttgtataggataagcatcaatcatttgaagaatatatggtaaaacggtatcggcattggcgtccctcaagacaatgaaagaaagatgaaaaaaatacattcctaatggtataattatcttcttatttacatttgagtttaggaatgccgtactattaagagggatgcaacgtcgaggtgtttgtgtatgtctcggtgctcaaagtgacctatcatagtgctaccttgagagaaacccaagctttaacctatcttttgagtagttttagaccttgtttttggttgagttgggtagtcctttgagtgagctttccatagagtccaagttcattaaaaatagactcccgagcgaaaagttatagttgttttactctgtgcttttcggaaactccaaaaaattttcggatttatccgaaaattttcggacattccggaagtggctgcgaatctgagatttgcttctgtaagttatcggacttgtccgaaaatgcttttcggaaactccgaaaattacagtcttggcctccaacggctagtttttgaggggctcgggtatataaacttctccacccctcctttgagtggctgctgctcttgggaagtattagacacatccaaagccaaatagccatccccatttcccatcctttgtggtgcctctttgtgagggggatttgagaagggaaaagagttgggttaagagagtgaggagttgagagctagtgagcttcactccatcctttgtggtgcctctttgtgagagggatttgagaaggggaaagagttgggttgagtgattga

SEQ ID NO: 65525 - DNA, 1930 bp, Oryza sativa
ctaattccttgactctggagtatgttaaatcctaagtctggccttagttgcttgtacctaaagtatttaaccctggatttatatcttggaggcattgtctagagtttatatcttgaaggcatcctaagacaacgatctctgtgaaggcaactaaggccaaagcaatatcctaagacaactaaggcctaagcaacatcccaagacaacgatgccttcaagatgtacatcctaaggcaactaaggccaaaggaacatcctaagacaacacatgaatgaacatcttgaaggcattgtctagagtttatagaattttaatgaaaatctatagtctaatcttagttgattcgagcatgatgtgtcattcactttttattaggcgttgttttagggggcgtttatggttatttcaagaatgttgcatttatggttgtatatcgcagcggcatgattttcgtatagttgggtcgttctttttttttcttatgtaataacgatatatttatgcatcttagctattaagagaccgtggatgattttagagtgattatctaatatcaataaagcttttttatctttaaaaaaatttttactaaaatcttgttctaaatattaatgttgtaccactggtaagtcgatcgaatcatttttctacgctcacgagaagtctcggtgctgacgcaggccacggtactcaatatgaaaggccactggtgcctggtggagtggaaaatgtggaattgcttatcctctctcacactaattaacaagatcatatcgaggattagttcgtgtcaaaagggagtctaaaaggatgatgctgacatagaatcactaacaaaaagctgctcctggttcgaatatatattgggggctttggttgggcccaaccacggcatgtccaacatatgcaaaagttcaccttttgatagcaacaggttatgtagccatgtaggtacacacagcaacagcagcagctagcaagttggcttcaaatttcggtctgcaaatgaatctagctacgtactaaccgatggtgatgcaacttaatttgattactttatgtactcattactgtcctaattagttgtacagatataaaattacatgcttgccttttattaaattacttggccctggatttttttttctagaaaggtatttaatttgtaaccatgtgatttcttcttgttcgaccattttacattgtacatcatctgtgttagaaaaaaaaccaacttcagcttatatctaaactcatagctagaagatggttttttctaagacgaagggtatattattttatctattccttaattacgtaccactaattaagttttatcacctgtttctaccgtataccattgcagaagttttttgttttcaaaatgttcaaaatcattcttggagacatggagggacagaactaattgatgaccccaatttatgttcctaaaaactatgaaaaaaaaatcttcctagccacctgctggcagagcatacaaactcatatgtaagtctcagaatttctgccaaattaaaaaaaaaagatcgtacaagaaatggttcctctttgatatgatgcacaattgatttttttttcttttttggatgttgtttgctcttgggaaagccattcctctttcgtaatgctcaagtgcagggggcctgggggattccatctcccactaggtagcaaaagcaatacatgcaatggttggctggtcgcattggtgcccaggtgggctagctaagcttgcatatatgcatgctggaccagcacaagagagatctagtgggagctcctttttaggtcagagccatacatatatatgcattttgcatccatccatctattcgttgtgcttgttacacatgcatatatatggtcctcttccatcctcctttttcacccaccaacgtagtcctacat

SEQ ID NO: 65526 - DNA, 1799 bp, Oryza sativa
aacaggtaagcccagtggatacccgtcggcatacccatgcccgacgggcatgggattttgcccgataggctttgcgggcatgagtcgggcacgggtacgtgggtctcgggccgggcatggttttgctctacccgtactcgacccgacccgttgccatccctaaatagaatgcatttagttaattgttcaaatcttaaatcgttaatagatgtaaaaatatcagaaaagttatactgtgaaattatatagtatagatttatcatgaattaaaactctttcatcaaatatatatagttatacggttagaaaagtaatgcggaaggagttttcatgataaatctactaataatatagttttacatatattaataaacggaccagtaactattttggcaggttgattaatatattgttaccatatgctatactgtcccgtttgtaaatcagtttaaacattggcccgatatagatgattatcatccgtgacggcaaggaacctgatacagataacttttcgtatcagtgacctttggttcatgatggtactctatccgacactgacgaggctttccgttcgttatagatgagttatcccagtggtagtgtttgtattgtccctgtttccccaaaaatcaataacgggattacgatgaatctcgattgagcaaaaagttgggaatggagggaacaatataaagttaaactaggtggagtagcgactagcgccggaacgcgcgcgtgctaaaaaaaaaatcaaatcatgcatgccctgcaggcgctccgatcgatccgcgcgcacaagcattggacatgatgacaagatgcccctactactgctgctaccacattctcttttccagccttcattctatcgatagtgagtggggaattcgagatctattccccttcaaatcaaatcaaatcaaatcatgtcaaatcggtcccttcaatacatattccacctttgttgcatacacctgcctgcttggctaccaatgatatgccaaaacagatgcatctaggcatctagcataagcccgtgcgtgcttaacgtatgaagtagaactagcttcgtaaccagaaatcaacttattggaatcgagcaaatccagtgaaggacagattatccgccctataaacagtctgatcgaacaatacgtggtctagaccatgttatgtagtcctccaatcataagatatagcaactagtaccgaatggaatgtatcatatagagtgcaaagataggatggtttcttaggttgtgttcttttcttagagcaagtttaatagtatagcccactactagctccaattcatttatagccaatttaatagccaattcatacaatagttgcttactatactattaatatatggtcccacctatcatacacacattgcatcttggagttcgcgctgcagctggctacagatctgtagcccgctgctcttctctctcatcttttatctcattaaaatatatttacagttggctaatatcctgctattgtacatgctcttaggattagggttaggaacccttaccccttgacacggataacaaagcaacgaattagctcatgattaattaagtacaccctccatcttagaataagttctttttcccctcccatttgtcccaaataagttattttttgcgtaatcatttattagagtttatgaaagcaggagataaatacattgggagtagattaagtgaagattaattgaatattgataaagtgagggtattctggtctttttgattttgtattggtatgcgtggaatgaataaaaa

SEQ ID NO: 65527 - DNA, 6581 bp, Oryza sativa
ttttaatttagtcctcaataaaactcgcacccaaaagaaacccaagaaataccaaattagactcggagttcgactttgtgatctgaccggccacctcgcatggcaagacaggtctcttccaaatttagccacgtttttttttttttggctttccgggaaggatgatagcactatcatatgatccggattcatatagtacaatcctacggtaccaaatctatttctgaatcctattgtttttcattctatgaaacaagagaaactaaccttccatccatatattacttatctgggcgatcacatacgtgtgagaagtgctactaagagttaatagtagtgctaactactagctataggcacatttaaacctaacattttataatagattaggtataaggtgagctctactttttcctccatgtttcttccatataggtttatagtatatttatagtatacttatagctcactattgtccttgttctaattaactaaaagtatacagcaagcttaaatatctgatttgcttgctaggtcatgcattttttttcatatagagttttctattaaaatacttatccgatttacgattctattacaccattataaaaatagattttttaaattatttatagcataatgtaaattacttttagatttgattaaattacttcttatacatcaatgaatgtaaattcaataaagcctaaaagtaattatgtatatgctattaattactactctaatctcggtaccacgcttataaaagattaaggtattctatctaagcggagcgatgagaatatattttacttaaataataagagtaaataccataaagcagtcacaaacacttatatgaaggcaaagcatccgtcgaggtacaagctttgagaagagcgccaacagactcagcacttccccatacttccccctcactctctcctactctaagcattagctatatagagcttcacccttacaatatagcttataattttgtatcttggtgtgtgttgagaatgaggagtatgaagccaatagtgtggaggtgacttgagagagtggagatggcaagagaatattcttcctccagctgtctcaagcccccacttgtcctcaaaccgtcattggatggcagtttccttccatgagccttgcgccatcagctttaggagggcgatgagtggtcccctggtgggttctactgaaccctgggcaagcctcctcgtgccacctttcatctgggtcgctacttggtggaccctcatggcggtttgggatgtttgcgccaatttgaggtaattcgatcttctcctggtgtaggccctttgatctatatatgtactctcctctcgttgattggagttgtgtcttcttacttatgtaatcacctacatacaaatatttaccaacacttgtggaaatagttggtaataaaccactaccagcatatatgtttggtggtagacattgataagttttatgcaagaattgacggtcaaatttagtagttaaggaccatcaaagtacaatcaatagctgttgacactaaccataagcaatttttactcaccttgtcttggttcatttcatacctccccttcatcctaagaaactcataaacgtaatacccacaaagattgatagaatcaagttacttctggcactccatgaagcaatgcaagcaatatgtaattgtttcattgtttgtatcatcgtaatattaaggtagaaggtttggaaatgttgtcttacccaagagtgtacgttgaccatcatttgagctggatacttgggatcatgttgcccattcctttgttggatgcaccactcgcaagccctggtattgaaaatatcaagagtcattataaaaccatgtacgaagcacaatgattatttttatagttggaggcaatattcttacccattgatgatgtagataaattccttctataatttttcatcagaattgacggagttaattactattattctgctctccttaggatagagtactaataataaaataaaatgtagtgctcaatataaatctataaaacttatgttagtttctgggttgtcggatttagtaggtgcaaaatactacctccatcccaaaatgtttgacgccgttgacttttttaaaaatgtttgaccgttcgtcttattcaaaaaatttaagtaattgttaattctttttctatcatttgatttattgttaaatatacttttatgtatacatatagttttacacatatcacaaaagtttttgaataaaatgaatggtcaaacatgtttaaaaaagtcaacggtgtcaaacatttagggaaggagggagtaatttgtatgactagctatttgaattaatggaattatctaaagtgatagggagtaaatattttgtccttgactatcagtggacccattaattgagcttcctatgtacaccgatctccttcctttttttcccattgagaaatgtttttccttccttacttattggcttctttttttgtgaacgtgcaaaaatattgcatgttagtacttattgttagaataaatgagttaggcccaatttatttctactaaaatctcaagggcccataataaatgttaaagataataataccacattggggattaaatgtggagtatatcaacttaaagagagagttatcggagattccccgttgaccggttgaggtgggggtcggatagccacacacgcgtgcgccgagccaagcaggccggcccgtggcgagcgtgcggcttggctctctctctctctctctctctctccttttgcaatggttcagaattcaactccgcgagattacctctgtaacaggcgggcgattcaatattgattgatcgcgtcattacgctattaggacgagacacagagaccgacattcagtttttccacgaattctctccatcgctggttcgaggttacctctgtaatgggcgggcgattcaatattgattgatcgcgtcattacgctattaggacgagacacagagatcgacgttcagtttttccacgaattctctccatcgctggtttctcccctgtgcctgtgctgcttctgttcttcttcggttctgatcgcttgcgcacacaagtgattgggacgagcagggcctccggaaccacaccctcgcctgagatctgcacgggtaggcgggtgatcaggtttttggggagtgcttccgcacgactgctcgcttcttcgtcgtcgtacggttccgtctgcatcgcgtgatgtctactggtggtggcgcacccggagcggcaggggttggtgcgccaggagcaggaggtggcgcaccaatcgacaacaccaatggaggcaattctgactcacaatccagtggagggacattcacagggtatagcattcttctgttacctttcattttgttaaagctgtcagtcgcaaatattattgcgttgtctcaatgctgatgcttattttaccttaagcatgctcatggttatgtttagttttatcactagaccacttcacattgtgcatgtcatgtttattgtcttaatattttggattaaaatatgccgattttttaccatatttccaacacttattaccttcctctgatgattggtctcaagttaatcctctaacaaatacattgagatcaaggaagccgaccttgtatcccttcgtctctgcaggatcatgctgcattctaaaaacactgaaagtaaaaacattaaaaaaggtcacaatttaatgaataaaactaatacatgaaatggtagttttattagagtaaatacaatagcagactatatgccagttataaacacatttcgaggagataaaagataagagagaagagcagcgggctacaaatatgtagccaactgaaacacggactctaagatgcacacactggtggggaaagcatttgcagtcccggttcgtaacccccctttagtcccggttttcaaaccgggactaccaatccaggactaaagatcgctatctttagtcccggttggaaataaccgggactaaagatcgagctgaccttttttttttgcatggccctgttgctacatggtttatatatatatatatattgaacttccgcccaagtctttctctccatttgccgcggaccaaatgacggaaccgataccaagccctacatggagtttaaagctatgattcatagtagcaattaattataacaagattcttaattaatgtcacgcccagaaattcccgaatagaattccaagcagaatgtgcataaaaacccccatccaggaccggccggggtacacaaacaacaaagttaacatacagatccatgtcttacaaacatcatataagtcttacatatatgcagcggaaaattaaaagataattggagcaaagccttgacttggaccgtagcgggatcaccactccacaggcatcctcgacggcacggacgaagcctactcctcggagaaaccgccatctgacgcatactcaaattctggggtttggggaaaatagagcaagactgagtacaaccaccgtactcaacaggtcatatcggaatagggggtatgatgtagggtataatcaaaggataggtagagcggttcatttgcataaagcgagcatttataaacagtagttgaaaacagtaaaaccgttgtaacaattaatcaatattaaccatccactgtccaatgctataccacgttgcaacaggcccaaccatccacctaaactaatcaattccattagactagactagggtgagactcatcacggtgaatctggttgaccgcccgtaaccgcgggcacggctattcgaatagttttactctgatcagaggtgtataactgtacccacaagacatagccccacaacacgtttctgtgcgccgacatgccaccacgacataccggatagaggccgtgacaggacacttcacataaccccctctaaccaagcacaccacacctcaggtttcacccccactcctcgcaaggcagcgggcagtcccctctcgtgcctaggtgaatccggaagccgcataagccgtcgtagggcccatccaaactccatcacgcccatccttgcctggatgcgtcagctagaggaaagctacactacaagcccagccgttgcccacgctggcttgtggtaagtacgatgaattcttccagggtttcccgcgaaccggtccttaagtgccataggcgcgaccaacaaaaccatgcacccagagcccaccatttagttcattttaatttaccaacaccggagcggtggcactaaaccaacatcaacactaaaacctgaagtctaatcattaatgtgatttcccccatggtgtgctagttgaactaagcatggctaagcaatctctaattcaacatctagtcatgttatatcccaagctaacaaaggagaaaggtacaaaaatagcatggctgtaacagtaggtaaacatcccatagtaacattataaaacaatgcggtatttaagggaaaacggtagagcatttgcaatataggatcaacatgttcaagtgacaagtatgacttgccttgctctgctgctggaggagcctcggcgactatttcaaagtacaccggagcgtcgagagagccggaatctaagcaacatacaaagaaaacaatacaaacaggctataatactacagaaacagagaacaaaaccatttttaatagattctatgcatttttcttgattttctgagacttgaatgggcttaaacagagctcggatgaattttctatgaattctagaagattcactgtgttttactataaacagaaaaatccttaattaatttattgcgcaataattaaattcccggggagagaggggcggcgccgacatgcgggccccacatggcaatgactcgggggggcggttcacggtggaccgggtccacggaccggggaggagcggcgcaccacgtggtgcacacgtggcgccgacgcggcgcacacgtggcggccacgtggcagccacgtgggcggcggggttgaacggccccgatctaccgcccggtagatcggacggcggaggcggctcgcggccgggcgcgcacgagcagggcccaagccgacccggcggcagtggcgcgcggcggcgcagcgcgacgcgacggtgacgcaaggcggcgagcggccaacggcggagagcggcggcgatcgacgacgagcggcggcgagggatgactggggagatgctcacaggggttcggccgacacgagggggcgacggtgaacggcggcgagggatgactgggggacgacggggaacggcggacggtctccggaaccacctagcgaacaagatgagaggggttagagggagaaaggaaaatgggagagggcgaggacgccggccgaaggcggcggccatggtggtgctcaccggcgcacggggcggagagggttctggcggcggattttgacggaggagaggtggacgtgacgacccgcacgacggcgagcgcgacgacgttgatggcgcggcttggcacggtggctagcggcgctagcggctatgcggc

SEQ ID NO: 65528 - DNA, 3231 bp, Oryza sativa
gggaggaattcgaatcccggccgtctcgagcgcagcgcgggcgggagagagagggagtgggcgcgggggacacgggcgtgggtggcgacgtgggcgacgtggcccggaagacgcgggagcgagggcgcggcggcgccggctggaggttgggggggacccgataggtaggccccacctgtcggcgaccccaggagagaggaggggggcggccggctcagctgtgcctcggccttcggccggcccagtgggaagggggaggaaggagagaatgggccggtggccctttccgaaaagaaaaagagggaaaaagaaagaaaaagaaggaaaagaatttccagggaattaaatattgcttgttctcatttttaattggttaaaattatttctagagctctgaaaattccactaaaaatcttgttagcgtatttcgacatgtagaactcaggaaaaatcccacatgccagttccgattattatttgcattaattccttcaaggtttctctcttgcttttacaccggtattttcttgagaccatttataacttcaatttaggcttgggaaagaacttcaggtgtgacaaacctaaccccttaaacggaatcttggccccgagattcggaagagctggcgaagaggtgcggatgggcggccttcaactcatcttccctttcccaggttgcttcttcctctgagtggtggctccaccgaatcctgcagaatctagtgaccttgtttctagtcctcctttcactggtctcaagaatgcgaactggcttttccacataagttagatcttattgaatgtcaatgtgctccgaatcggcttgttcttcgggtaccctcaagcacttcattaactgggacacatggaacacgtcatggataccgatcatgttggatggaagttctagctgataggcaacttctcctcttcgttccaagattttgtatggccctaggaagcgtggtgccaacttgcctttcgtctggaaacggtgcactccccggagcggggtgacacggaggtacacataatcccctgcttcaaaagtgaactcccttcggcggttgtccgcgtagcttttctgtcgagactaagcaattctcagcctctctctgacggttctgactttctcttctgcttccgttaacacttctgttccgaacagttggcgttcacctgtttgatcccagaagagaggtgtgcagcacttccggccatacaacacttcgaacggtgccatttgtagactggcctgataactgttgttgtaagagaaccccgcataaggcagactcatatcccaagctccaccaaaatcgagcacacaggctcgcagcatatccttcaagatttgattgaccctctcggtctagccatctgtctacgggtggtaggctgtgctgaaattcaaacgggtccccaattcttcctgcagcttctgccaaaattttgaggtgaattgactccctcgatcagatacaatcttcttgggtaccccatgcagacacatgatccttgctaagtacagctctaccaatttctttcccgtatacgtggtatgcaccggaatgaaatgggcaactttagtgagacaatccacgactacccagattgaatcgtggctagatgatgtcctgggcagacctgttatgaaatccattccaatctcttcccatttccattccgggatctgaagagggtgtaacaatcctgcgggcctctgatgttctaccttaactcgctggcaaacatcgcagagtgcgacaaattcagctatttctctcctcatactagccctccaaaacttttctttgaggtcttggtacattttggtactgcctgggtgaatggagtactgagtctggtgagcctcggtgagtatcagatcctttagttccttgtcatcaggtacgcacaatctttctcccaaccagattgtgccgtgttcatcttcatggaaatcccgggcttttccgaccctcatattctttttcagctctgctatttcaggatcatttacctaagctgctctgacttgatccacgagcgtaggtcgtgcctctagggcagccacgtacccgtgttctacaagtcccaaattgaggtgttcaagctcctgctgcaattccttacacatgtcttcggcgcataaagcattgcagtagctcttcctacttaatgcatctgccaccacattggctttgcccggatggtagtgaatgctcatgtcataatccttgataaactccaaccatcttcgctatcggagatttagatcaggttgggtgaagacatatttcagactcttgtgatccgtatatacttcgcagcggttgccaatcagatagtgcctccagatcttcaaagcatgaaccaccgctgccaattctaagtcatgtgttggatagttccttcatgtggacgcaactgccgcgaggcataagcgaccactctgccctcttgcattagaacacatccaagcccgtgacgggatgcgtcgcaatagacttggaagtctttcgtctgatcgggtagaatcagaactggagcagacactaatttcttcttgagctcctcaaaactcttgtcacactcagctgtccacttgaatttctcgtctttcttaagaaactgagtcataggtctggcaatcctagagaaattttcaatgaaccgacggtaataacccgcaagtccaaggaaactccgaatctgtgacactgtcttaggcggtgtccacttggtgactgactccacattcgatggatcgactgccacgccctgagctgtaatgacgtgacccaagaatttgacctctgataaccaaaagtcgcctttgctgaacttggcataaagctggtgctcctgcaacttctcgagtaccagacgaagatgttgctcatgctcttcttccgacttggaatagattagaatgtcatcaatgaataccacaacaaacttatccaaaaattccatgaacactttgttcatcaggttcatgaagaatgtaggtgcattggtgagtccaaaagacataaccgtgcactcatacaacccataccgagtggtgaaggctatcttgggaatatcctcttcccgaattctcaactggtgatagcctgatcgcaggtctattttggaaaacaccttggctcctttcagctgatcaaatagatcatcaatccgcggcaaaggatatttgttcttgattgtgacctcattgag

SEQ ID NO: 65529 - DNA, 9195 bp, Oryza sativa
ttaaggagatcccctgcttcagtgagactggtgacttgtacaccactgcttctaccttctcattggtcaaggtgactatgcgattcgcacaatcaatgacacccttgaacttggtaagccaatccatcccaagaatgacatctaggtctttggattcgagaaggatgaggttggctagaaatggtgatctttggatttctattagcacggaagggctataactgacctaggttgaactatttcccggggtatgaaccctcattggtgtactaagctcttcttttcttaacccatgcaccccaacaaacttctttgaaatgaatgaatgcattgcaccagaatcgaaaagtactgttgcagggatcgagttaacaggaaacgtacccagtacgacctctggtgctgcttgcgcctcttctgcggacgcgtggttaacacgggcttgggcaaaccttggcccggcacgcctgggcttcgggcacttgtcagcaaagtggccatgctcgccacagttgaagcaggaccctggctttgccctagtctccttggcttgggctgatggagctgattgtgttggtgccattggtgggcgcggagctgcactgcggttgggctgacctcccgggtggttctggctaccactggcgccctggtggaagctgcttgagttgaaaggacgatgctggcggacaatcatagggtaggtccaccctgctatccggaagtgaagcgtggtcgctggtgacttcctgggttggaccggaactgagccgcctttctcttcctgtccattttgtttcgctgatcctcctgacggattgccttgtcaaccagcttctcaaagtcggcgtagtctctagaaatcagctggttggtaagctcgttatccaggcccactaggaacttctcctgtttctctgcgttagtgcggacatcctctggtgcgtatcgcactaggcgattgaactcatgcaggtactcggttactgtcctgttgccctggtggagtgcgcggaattctctcttcttttgtgccacaaccccgtctggcacctgcgccttcctgaagctgcgacagaactccgcccaagtgacctccgtacctggcggacgggtagccatgtgattgtcccaccaagctgacgcggaaccctggagctagtgtgtggcgaaggcgaccttctcctgatcattgcactacagaagattgagcttcttctctatggcatggagccaatcattcgcctccatggggttggtggtgctagagaaggtgggtggcctgacgcatagaaactccggcagcttggactgagggggagggggaccaaactgctgctgctgctgctcggcttgctgctgcatcctctggtgcatctgctggtgctgctgctgcatctgctagtgctgctgctgcatctgctacatcatggctgccatcatctgagtctgatgggccatcacttgtgcaagagtcgggttctcggggagcggtggcggaccgttgccagaggcgctgttgggatatccaccatcggtacgttctttgccgttgctgccctcacctgctgcgcagctgccattcctggtgtttaccatctaaaggaagagcagacggaggaggtggaaaagaagaaaaacagatgctcaggaactaagctttcttatataggaatataaactgcaattgttctgatctgaattaaaacacttaaaacagcaaacaaatctttattaagacagccacatcataggcacatgatgtcgaccgtcgactgacccacaagcgaacaaacctaaacacacaagctgacaggcaattactaagcagtcgataaactaagggaaaacgagcctaattctcggaacggctcctacggttggtggagtcgaaggcgtcctcctgcttgtcgctaggtccctctaagcggctcctggagtctggcagatacgtctcgccattgcccggctctgagccactggaactgctgctgctgtggtcgcggctgccactggagttagcaggcaaccaacctccgttaccactggctggacccctggtggctgacgctggagtgaaggagagagcggacatcggagctgacactggaacaggagctggggctggagctggagctgcgggtgctgcgggaactgcgggaggtgctggaggagttgcgggaggaactgcgggaggtggtgggttcctgggcgcaagctgaatatgcacgggagcagtcgtcgacttgcgaggcgtggtgcggatccggactcctctaggagcagggagacccttcagctgagcgttctccttcttcagtcgtgctatctcatccttcagaactatgatcctcacaagcttcccatcattcaaggccttggatgccttgcgcaggtcggagtgcatcctatccattcccctcatcacggcgcacatgtggccaaaggtggtgtcgttcttgccggctatcgggcggaaggtgctaatgtcgtcgccacttgcttggcgagggtggaagcggtacgccgtgttgcagaagatgtagttgtggcgatcgcgaagcctggccatcatcagatatgctgcctcctgacaggcgtgatctgcggtgcctccagatgcctcaaccaccatgttagcgaggcaggtgcccacatagcgatgcaccaccagacgaatacggtgaggaagctcgccactgagcggccgaatagtcgagtactctggcgcgttggggtagcccaccaccagggtcatgcgagccaactctgccacaaaatcgtccatgccttctccgcggtggttgggtgggtggtcagccatctagagaagacaagggggtaggatcaatgcatgctcaaatccaatttaaatgaagcagtaaaggactcaaataaaataggcgaataagagcggaattttatgcatagatcatttttgcatgagagcgaataaatgagacggacttacatagcgataaaataataagaaattagatactgactaataataacaataagagcataaataccttgcaacccatattcctgagttaggacctaatgcattcctcccatcaaataccgactgactgtccaataaatctcaaataattttactaaaaccctaagcagacctaatttgataaatctcgcctaaacgcacgaccaagatttttcccattgaaccacagaaacaaatccccaatttttcccggaacaaatccaattgcaaagtacatatgcaatgaaaaggattcatagggctcttaggttttccatttggcttgtcctacggtcaaggtcggctctgataccaacttgtcacgcccagaaattcccgaatagaattccaagcagaatgtgcataaaaacccccgtccaggaccggccggggtacacaaacgacaaagttgacatacagatccacgtcttacaaacatcataaaagtcttacataaatgcagcggaaaattaaaagataactggagctaagccttgacttggaccgcagcgggatcaccactccacaggcatcctcgacggcacggacgaagcctactcctcggagaaaccgccatctgacacatactcaaattctggggtttggggaaaatagagcaagactgagtacaaccaccgtactcagcaggtcataccggaataggggggtatgatgcagggtataatcaaaggataggtagagcggttcatttgcataaagcgagcatttataaacagtagttgaaaacagtaaaaccgttgtaacaattaatcaatattaactatccactgtccaatgctataccacgttgcaacaggcccaaccatccacctaaactaatcaattccattagactagactagggtgagactaatcacggtgaatctggttgaccgcccgtaaccgcgggcatggctattcgaatagttttactctgatcagaggtgtacaactgtacccacaagacacagccccacaacaagtttttgtgtgtcgacatgccaccacgacataccggatagaggccgtgacaggacccttcgcataaccccctctaaccaagcacaccacacctcaggtttcacccccactcctcggaaggcagcgggcagtcccctctcgtgcctaggtgaatccggaagccgcaaaaggccgtcgcagggcccatccaaactccatcacgcccacccttgcctggatgcgtcagctagaggaaagctacactacaagcccagccgttgcccacgctggcttgtgataagtacgatgaattcttccagggtttcccgcgaaccggtccttaagagccatgggcgcgaccaacaaaaccatgcacccacagcccaccatttagttcattttaatttaccaacaccggagcggtggcactaaaccaacatcaacactaaaacctgacgtttaatcattaatgtgatttcccccatggtgtgctggttgaactaagcatggctaagcaatctctagaccaacatctagtcttgttatatcccaagctatcaaaggagcaaggtacaaaaatatcatggctgtaacagtaggtaaacatcccatagtaacattataaaacaatgcggtatttaagggaaaacggtagagcatttgcaatataggatcaacatgttcaagtgacaagcatgacttaccttgctctgctgctagaggagcctcggcgactatttcaaagtacaccggagcgtcaggagagccggaatctaagcgacatacaaagcaaacaatacaaataggctataagactactgaaacagagaacaaaaccattttaatggattctatgcatttttcttgattttctaagacttgaatgggcttaaacggagctcggatgaattttctatgaattttagaagattcactatgttttactataaacagaaaaattcttaattgatttattgcgcaataattaaattcccgggaagagatggggcggcgccgacatgcgggccccacgtggcagtgactcggggggggtgtccacggtggaccgggtccacggaccggggaggagcggcgcaccacgtggtgcacacatggcgccgacgcggcgcacacgtggcggccacgtggcagccgtgcgggcggcggggttggatggccccgatctaccgcccggtagatcagacggtggaggcgtctcgcggccgggcgcgcacgagcacggcccaagccgacccggcggccgtggcgcgcggcagcgcagcgcgacacgacggcgtcgcaaggtggcgaggggccaacggtggagagcagcggcgaccgacgacgagtggcggcgcacggcgagcgacggcggcgcggccccgagtggaaaggcagcggcgctaagagggagagggggaaagacgacggggagatgctcaccggggttcagccggcacgagggggcgatggcgaacggcggtgagggatgacctggggacgacggcgactggcggacggtctccggaaccacctagcgaacaagatgagaggggttagagggagagaggaaaatgggagagggcgaagacgacggccgaaggcggcggccatggcggtgctcaccagcgcacggggcggagagggttccggcagcggattccgacagaggagaggtggacgggacgacccgcaccacggcgagcgcgacggcgttgatggcgcggctcggcacggtggctagcggcggctagcggcgaccggagcggtggcggcggtggcggagaggagggcaacggcgctagggcgatggagggcatgggagcgggtggttgcaaaacgaaaaagagataagaggagacagggacgctttatatagacccacgggggtcgatcgtggccgggatggccgcaatttcgccggcggagtggggagaagtggggaggaattcgaatcccggccgtctcgagcgcagcgcgggcgggagagagagggagtgggcgcgggggacacgggcgtgggtggcgacgtgggcgacgtggcccggaagacgcgggagcgagggcgcggcggcgccggctggaggttgggggggacccgataggtaggccccacctgtcggcgaccccaggagagaggaggggggcggccggctcagctgtgcctcggccttcggccggcccagtgggaagggggaggaaggagagaatgggccggtggccctttccgaaaagaaaaagagggaaaaagaaagaaaaagaaggaaaagaatttccagggaattaaatattgcttgttctcatttttaattggttaaaattatttctagagctctgaaaattccactaaaaatcttgttagcgtatttcgacatgtagaactcaggaaaaatcccacatgctagttccgattattatttgcattaattcctttagggtttctctcttgcttttacaccggtattttcttgagaccatttataacgtcaatttaggcttgagaaagaactttagggtgtgacaattaacataggaacttatgacaatacctgtctataagttcgaaagccttgtcaaacgtagactcttttttatccattgagtcatatacgttgacggtggaggcctccaagtcgaagagtaaaaggacccagtggaatctgcattgtgcgtcggatgcattacatatgaaacacttagcatgttcgtacgggaatgaaatttggtataggaagacagtaaaaactaacactgtgttgtacgacaatagtatgaatgtcttgtaatgctgcgccttcaggagatggacgagattttcctctgtagcttgcggatactggtcgagtattgcgacgtttactttccgagggtcgatgaatccagtatcgaaaaccccctgccgtcgggccctttgaatctccattctacaacgataaaaggaagtatatattatatatagtaaatgtaataagaaatctaactgaacgatacttacaaaatccagcaactcataatagagacgtcgagggcgtccagctggtatagttcgtaaatacccttgaaattgatccagagaatatcatctccttgcaagaagtccgtgtccctaatcctcgctccgatcatctctctaccggtggcgctcatctccatgtacagttgatggaacttgtacatttgtgtgggtagggactgcagctgctcaggcttgacaagcggtttaccgagttcgtacatgtatttcacttccgccctttcgattggtgcgcctcgtagcaattgatccgtagttagcccggtgtcattaataaattcttgtattccaaaatcttcaccggtcaccaacggctctatctcctggtttggttgctctccaagctgagggactggtttggactttccagaagatgctttcttaagtgttcgctcatagtccgatagctttatggcctccttggcaggtgtagacatacccctgaagaagttcctggcactcgggtctataggaatcttcttttctggacttcgaggcttcaattgtctcctgacttctgatgccacataagtgtcaagctcctcttgcgtgcaatcgtaccccgggtccttgttttttgcggcgtcaactttcgccttcttcgttgcccttgtgggggcaggcggtggagcttggagggcccttgacttggaaggtgccggtgcaggagcctgaggaggagtcggtgcaggagcctgaggaggagatggtggagccggaggagatggtgcacgagacaccgcttgtcgcccagggaggatgatgtaccacttgcgccatagtataatggcgtggcttgtgtctcgtagatgcgtctcaccgtctcctccagggtaatccaactcgaggtcctcgtacgcgccttccaccaactcaacttcgaccttggagtatcctgctggaatcagcctgcagtggtaagtacctgaacggtccgttgggatggccatgcccgatgccaccttcacatggtgagaggttatttattagtaatcaacatatgtaagcaacaacttgcggaatggacaagtctaaaatctataaatactacaagctttcctttattgataagttcttgaagggaatatgcagctcacatggtgtccgctgagtgatgtcatcaacggggcaggtggtttcgtcctgggtttgcatggcgtccatgctctgtgatcctacctgccccgttgaggcgcagctgctacaattgcctgaagggctcaccattgcaggaggaatggtcggctggggatcatgggactgatgtgcggccatgcgttcatcaaccttccttgccacctcctcttgcatgctgagctcgtagctcgataccctatacttaagatctgcaatcttcgcctcggtatctctctcgctcctcatccgactcctgtacatgtggatgtcctccttgaatccaatcttccaaggaatcacccctttccctcgtgttcgtcccagatgctctggagtctgcagggcgagtgatagctcgtccttctctctgtcggtcagaacgtgccctgagaagaggcttccacagctcgtccgttagtcgacgcgcagcctcgcgtatctgatcgctaaggaccagggagccatcaactaggttgagcgttccaccgtgagcatagtaccagaacttcgatcgatctggccatttagcggtggctggttcgatacccctctcaaacaatcttgcctccatctcctcccacttcggcatcgcgacgctatagccgcctgaccccacgtggtgatagtacttcttcttggcggcattttctttgttttttccatcatcgcctacccttgttgacctgtcttatatgcaacgaactcgtcccagtgatcccttagctttgagattgtgtcgaagttcggtgtctgtcccttcaggatatatttctggtacagatctcccttgaagctctgaaactgttctgccattttctttagagtccaccttttcactttgtcctctatacccgcgggaagggtgaatgtctcgagcattgtggtccacagcatctctttctccgaatctgggacaaagctctcatgatctccgcgtgcccttgttctgcgccagtacacagtactgacaggcacgttatcccgcacaacccaaccgttgtgtcgtacgtagttcttggctgcttccgccggggcactaggtcggccgtcttcgtccact

SEQ ID NO: 65530 - DNA, 1158 bp, Oryza sativa
aagagataagaggagacagggacgctttatatagacccacgggggtcgatcgtggccgggatggccgcgatttcgccggcggagtggggagaagtggggaggagagagagactggattcgaaattcgaatcccggctgtctcgagcgcggcacgggcgggagagagaggaagtgggcgcgggggacgcgggcgcgggtggcgacgtgggcgacttggcctagaagacgagggagcgagggtgtggcggcgccggctggaggttgggggaggacccgacaggtgggccccacctgtcggcgaccccgagagagaggaggggggcggccggctcagctgggcctcgtccttcggccggcctagcggggagggggaggaaggagagaatgggccggcggcccattccgaaaagaaaaagagggaaaaagaaagaaaaagaaggaaaagaatttccaaggaattaaatattgcttgtgctcatttttaattggttaaaattatttctagaactttgaaaattccactaaaaatcttgttagcttatttcaacatgtagaactcaggaaaaatcccacatgctagttccgattattatttgcattaattcctttagggtttctctcttgcttttacaccggtattttcttgagaccatttataacgtcaatttaggcttgagaaagaactttagggtgtgacaattaacataggaacttatgacaatacctgtctataagttcgaaagccttgtcaaacgtagactcttttttatccattgagtcatatacgttgacggtggaggcctccaagtcgaagagtaaaaggacccagtggaatctgcattgtgcgtcggatgcattacatatgaaacacttagcatgttcgtacgggaatgaaatttggtataggaagacagtaaaaactaacactgtgttgtacgacaatagtatgaatgtcttgtaatgctgcgccttcaggagatggacgagattttcctctgtagcttgcggatactggtcgagtattgcgacgtttactttccgagggtcgatgaatccagtatcgaaaaccccctgccgtcgggccctttgaatctccattctacaacgataaaaggaagtatatattatatatagtaaatgtaataagaaatctaactg

SEQ ID NO: 65531 - DNA, 865 bp, Oryza sativa
gaggccgcgctaccgccgccggctccgtgtcaccctcatcccccaccgccgccgcctcagcgtcacccgccggccaccgccgccgcagctccgtgtccgcctcccgcccgtgagagaggaatagtgagagagagagaagagaagagagaggaagagtgagagagaggaagagtatgacatgtaggtcccgttatttttttaatgaatagaatgctgactcagctgccacgcgtacgccacgtagaccaaaaccaccgtggattgggtcgagagggtaattcgtccggtttgcatagttgggggtgaagaatgtccggttttgtgattcaggggggtaattcagacgactgtgatagttcgggggaggtaattcgtactttttccttctaaatatcatccacaactggactcatgttgtgagtacgaccatataattaataatgtgaaataccatccacaactttagtattttgacagtgtatgtttctaaaacaataggtggttgacacaatttctaagtgttttcttttccagttttctaacttttttttgaccaagagttttctaaagaggagagcatatatccttgaggtttcatagcacacctcatttcggtgattgcattaatttctatccataaacgacacgacttgaaattcattgcttttaaacaatagtattaatcttcctattgtgcttcttcatcggcatgtcatcgcaaatcccaaagcaatttacataaaaatgtactatattatactccctcaatctacttttgatagacatatttccaaatctgaaaaatttagttttgatagacatatttcaatccaaccacctatcctcttattgactttctcggatt

SEQ ID NO: 65532 - DNA, 834 bp, Oryza sativa
  unsure (1)..(834): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnntcagctgtctgagggccagatcaaatctaatattgatcggctcgaggctcacaagattgagctcttggcacagcttgaagaatgcaacgccgagctggatatagaacacaaaaagctagccgacctcccaaagtctatcgaagagcagaaggcaagacttaaatcggctatcaagaatgttgctgatctgaccaagtctttgaaaatcatccctggaaccgatgctcaagacgcctaagccattgaagaagtagaacagattaggcaaagggctatatcggctatccagcactatttgtctcggtgactttttgtgcaatagatcttagaaatttttgtaatcggctaagatactctagtactttactgtcttgacaatcctttgtgccgactaatataacttctaaatttgctcaaaaatttgcaattttccgctcaaaaatttgcaattttcctgtatgtgcccccctaattttacaatgtcaaaacattgataaaattataaaaacaactaagggcgatataaccatatcggccattgtgcatcggcaaaccacaaccgattacaatatggaaacaactaagggtgatacaaccatatcggccattgtacatcggcaaaccacaaccgattacaatatagaaacaactaagggcgatataaccatatcagccatctcaaggcgatgtaaacacatcggctatcatgtatcagcaacatcagccgatcatgcattaacccaacacttggg

SEQ ID NO: 65533 - DNA, 2361 bp, Oryza sativa
  unsure (1)..(2361): unsure at all n locations
caagctgactctgaaatttaaattacaaaagcataaaaagacagaacaaaagaaaagaaaaggacagtatagagagaaaggagggggggggggggtacgaaacacactttaattctataagcctcagcaagctcctcttgcaaattttggttctctcttaaacatccacctaacttcttttgaagattttcaatatcctgctccaaagcagctgtcctgaacagttagaataaacatattgctttatttatgctactgttactgtaaacagcagtggaatatgaacagtaagatatggaagaacctttgagaaagcattcgagttgcaacagaaacatatccaggaccagcttgttgttgcatgcataattgctcaatatctttcctaagttcatctcgttctgtctaaccaagtatatattatgtaaccccgtagttcagtaccacaataaaacaggatgaaacaaagaactatttaataaagaaatccacatgagcaactttctgaaaacagattttaatgttccattcactcaacaaagctgcagtatgatatatgatagaataaccagtcatttgtcatcggaaattccacaaatctcaaactttaaatataaaaatacttgtgataatcaaatttaaggtattgtgtgcataattcacgcaagaaatacagccacctgaaaatatacacaaataaacaatgcagccatttacaaatggcactaaaaatagcacataactatcatccaccgaagaatgaggacaaaacagaaccaccatcaactcctaactataaggaataaagataagcttcttgagggtcaagttatccactccctaaactctagattttgccttccacatggccggctattttagatctatccttcacctactactgtttctacttcaagtcctcaccatccaacttcatttcaacagatgtttatccacacattatgatgtaagggtgtctggttgtaaaaattgttagcttgattcctagcatgcagaatcttttctcacgcgtgcatgctgggaatgtcacattccctgtgatcaaattcccacagttaggacatcagggaatgttaagataaccattgatctcattttcctataatcaaacacacccaaaggatcatcaggcaagggcaaaagtgtgagcagactgctatgcgtatgcgtggttgaaaccaaccaaaacactggggtgactatgcattggtggattctggaagatggggtgttacaaagggtaaaatcatctgtagtnggncaccatggttatgagtagtgtnttcgggcgcacaagatttggtttgctttataaggagtttttggggggggttcccccccccccccaagagacccacattggttnnaaggggggttannantnatttgnctnntnncnangntttgngnntttagncnntaatncctcanngacacgnangaccantgatcttaagggcagccnangctcaagtagtcttttgcactttgtttactaccatttttgttgcctgccgtatgtgtcaggtacctggcaagtggcaagtcaaaacagatggtgtaactagatgcagctacagtcgtgttcagtttaactcacagggtgtgctgagaaggccaggaacagtgttggcctttatgtgcagaggagagtcgcttcactgctgcaccatggagcaaggggctcatatgggattggtgaatgggtgacacacaggaggggagagaatccatgcagttgttactttcatggttttgaaaaatgccactactatttaactatttggaaccatatcattacaatttaacgggtatttgatatgtgccactgaacaccccttcgctgcactaaaaatttctagtggaccaaaatgcccatgtcttcttccttctttcccttctctttccactcctgacatctctctctagatctggttcctggtgcttctccggttaagaagcccagcaacacgacaaggtacgcagaggcggagccgtggaggctcacacaggcccaggtgcaagcggagctggtgcccacgctgtcaagctgggccacagggagcagcaacgctggagtaggtgacaacattgtgcaccaacatctggccaggcaggactggagggatccttgctttcgtgagcattttcacaaacagttggcgtgcagcagaactgtgaacagattgattgaaagaatagagaaggtgccaagatggcgtagtgggagatgggttcctcgtcagtggtgagaggaggcttcctcatttggtgcgcggctaccacagccaccgatggtttggtacatgatggtgtggtgggagatggtttccatcggcg

SEQ ID NO: 65534 - DNA, 1028 bp, Oryza sativa
agtcattaacgtgaacaatcttgaaggtaaatagatagttatttttatattgcaactctgcaaacatgcgtcttgtagcagatactcttcttttttaatctgagactgaatattaaatattcaatttttttgtctaaataattataatattattataatggtatttgatgatgacgattaggaacagtgtgtttattttcttctttctctatataaataattatatattatctaataacgatgacacggatataataaaaacgtctcaaaactcatttctacacatgagacgttccaaaacgtctcaatgttcttgtctaaacgatttaattttgtgctaacctgtaaaacgtcttaaactatgtcctcaactaataaagcgtctccaacatcgtccctatttcaattttacttataaaagagagatgacttttatagaatgacttaagtgaaacgtcttaaaacaatggttttgctgtagtgatacttacgtacaaagagccatggatcgagcggggcctaacaaatgtagctcacagtcatataacatctcaagacacatgcacgtacttagaagaaaaggatatggtatgactactatccgtccaaatccgatccgttttcacccctatccgtgggcacttggacttggatgaggggaacatgtgctagcacttctttttgtcaaaaaggtgcccaaatctacaaaatcaatattgagaggaaattaaacaattaatcacttgttgctacttattgattcatttgttattgtttatcaaattgaaaaatccataacgagtgcatgatatacctttatttctaaaccttttgccgatgatacttctaccactaggcatgccattcagactcaatggacttccgtgtccgcggctagcagcggcaacgtttgtaggctcgatcgttgaatgcaaaccggaaacacggccatgaccacacccatatccatcttgtccctgtcctggctgtccatctatatccatgtccttgttactccctgtgtttca

SEQ ID NO: 65535 - DNA, 4478 bp, Oryza sativa
tgtattatgtctgtaagaattttattctacactagcatcttaacctttactcaaggacgagtaaagagctaagtgtggggggtttgttggcagctgttaaatgccaattctatgctgcaaacacctacataatacatagttaataatacatccaacatagtggtaggacttaattctaacaaattccatgagtgttggtgtatatttggatgcaggtaataaactgccgaagttgggatgaaaatcagacttaagtgaaggaagaattctatccataccagagtgggccttaaacttcatctaaacgtcagaaaatgggcccaactagggtttggccgaaccccaatcttagtcattcaggctgaggtttggcatgggcgttccagacgctctactgatggcggttgcggggcatttcagacattttgcgttttccgaccatcatgacctacctatttaaggaccctctctccctcacttcacacacacactccaagcttgagctgaattataagaggctctattgtactttattgtatactagaattagggagaaagtagagtagaagaagtcggaggaatttcggagttgtcggtagtcctctcttatttcttatactttgttaattactatgctttaatagaattatcattctgagtaattaagatttactcggtgataattaattcctggttagttcctaattaacgtgcaggataattgatcactatagtccagcaaaatatagtggttgctttagtgtttagctagcgctaaagtagatattaattgcgtagacgtggttgtcgacgtttgagatcatgactacggtattttgcatagtatggggatcgttggtaccagggtatatgcgagattgaggtaaaagagatggagatagggatttttatacatgtttgggccccttatctaacaggtaatagccctacatcctgttggctgaagccggtgttgctctttattcatctggatcacacaagtacaatatttgggataacctatctagctgtcattgacttggcggctagataaccaactcatagtcgacgacaggtagtcttcctcctcgaatccgcactcggcgagatcaaagatagcactatatccctcttgccggcctccgtaggcgccgaatggggtatgtctaggctaatctctgatgtcgatatttggtggcgcattagtttgtattggtttgtggctttgtgggtttgtggctcgtctcctctcctcctagggggttgtatttatacctataggtgcccccttgtccaagtagaactagggagataaatatggatatgatctaagtagtcctcgtcgtttccatgtataactctattagtccttccttatctggaactccttctatatacaaggtttgtttccgtataagacatggtatgtggtgggccctaccaagcttagtcgattactattgggtatgtggtattcataaccctgacagtatccccccgacttcaatgtaaatgaacgagttaaggttctcgatcgaagactttggaacaactattgttgtgctcgcttgaccattctcggtgtgatcagaaataacgctagattcttcttatcggtctttgtaggcaccatattgggtttgtctaggtcaatcttcgatgttgaccgagaaggtacggagcatgtgactaagtctcccgtcttgccgtaatcgagaatttggattgaagtcaagaaatctcgtctcggcgggtacactatcgcttcattccatattccttgtcaagccccatcaaccgttctcgagtaatcgagtaggcgtagagtctgcgacaaagccgtgaaatctgacttgattgttctgatgtctgattttccctgaaatcaatactcagaacatttgtcgtactcgcttagtcgatgccggtgtagaaccgtagagacatggagtcttcgataatgttgaatagaactcccccgagcgagcgctcaagggtaacatgatataatatgtatggaaaaattgaaaataaattgaatctgcgtgtgacaataaaagagtactctcgctagagttgccctcagcaaacgaagtttggtactcttcctagcccacagctgtttttatggaaaagccattttccacaaagacagcttgaatcttataagagcatccctagcagatcatggaaccgatcctccatcccagttttggcgtgtaggggtgaaaaaacgcgctccagcggatgtgctaacccacacgccaaaattggcggatgcgccatagtaggagagagaagaggtaaaaatagcgtatgtctctcttcacgccatttcgcccaaacgactctagatcgagatcccaccaccatcgggacttcggcaagaacctcccctccggcgcgagctccccccctccagcgcgagctcagcaccggcgcgccttcccctccatcgtcgtcgtcccgatccggcgtacgtgagttccccgtgcccattttttgattttttttcagcgatttatggagcgagcttacaagatctggggcgccgtcgctgtgctcccgccgccttccacctccggcgtgcgcgtggccgccgccctgcgcctgccagccgctaccctgcgcctgccagccgccgccgctccgcgcccgtgagccgacgccacccctcgcttgccgccgttgccctgcgcccgcaatccgccaccggcacccctcaccagagccgctagtgccagccttgagcagccagccgctggcgcccctgaccagccgctgctgcccctgaccagccagccgccgccgccccttgccaaccggcgtcccagatccgccagcgccacccagcgccgccccttgccagccgctgccgccctgcggccgtgagccaccggcgcgcctcccttgccgccgctggtcgcccctgagcagcccgccgttgccgcccctcaccatctcccccatccctctgcctgccctgtttggtagagaagaggttttgagagcaaagaagagcagaaactatagtatgttaagtgaagataagagctcttttcagtatagacaccacacttgagcagagaaatatagtatgttgatttttgtgaatttatgttcattgagcatatatatataataggaattaagtacaaactagatttatgttgctatattgcttgcttttatcttcattttatttatgttgctacgatttttcttgctaggtgaatccatggacagctatgttaatttgttgggctcaaacattgatgtagaaacttgggatcctagtcaaaattttccccaaactggacagcaaccacaatatagtcctatggttggtgaacagccaagtgctgaagttgggggtcctctagacccaacaataagagatccaaaatttcagcattgcggaaggtaaaatgttggtgtagcttggctgaatacaactttagatgcaatcacaggagctgagcaacaccgtgactcctactaggcaaggattcatcaatacttccatgaaaacaaagatttcctctctaatcgtaaccaaaattcacttaacaaccgttggggtacaattcaataatacgttaataagttttgtgggtactatgagcagattcttaatagacctcaaaatggaatgactgttcaagattatgtatgcatctaattcagctcgcatcttgccaattaatgcaaatcactcaggctactactttgtacaagtcagaagagaagaagacattttctttaatgtactgttgggagattttgcatcatcatccaaagtggaatgataggttgtcccagaaaaaacagaaagcgaatgtcgatcctttggtgataccatctgcaaggacaaactccagggaatttcattgcagccctgacattagtatctctgatcctttggtgagaccacctgggaggaaggtggaaaaggcaaaacgcgctcgaggtgatacttcttcatgctcaagtgagagtagtcttgtagttattgcattaactaacatgtggtcggagaaaaaggagatgagtgcacaatctagggaggaaagaaatgaccggttgggtgaagttatttcactagagaaagagaggttgaaaatagaaaaatgaaagttagatttagaaacccatgaaagagaagagagaattatgaacatggatcttcgtgctatggatgggccaagaaaagcttattacttgcgtttgcaagaggagatcataaaggctcatatggattgagttcatgatgtatggatatgtgatacgtattgctatttcctaatgagttgtgaacttttatgttgtgtgccgtgtaggcatgtgtcaattatgtactgatgcttgtaagaactgtatgagttgtgaacttttaagttgtaggtatgtgacatttatgttgtatggaagaatggtatgattaattgtgagcacatacatgttgcatacatcattag

SEQ ID NO: 65536 - DNA, 1105 bp, Oryza sativa
cactagttggataacgcaagtactcgtctccaaaattctcaacaatagtggtactatcagcaatttgcagatattcatcttgagtgtcggctgcgactccattggttatcattctaagtgtggtggcaatctttaccaatggtaatatacccatagtacttgcagcatttctttttagcacaaaataatcatcatgggctaccacatcattaactatgcgcaagaaaagatgacaactcaatctaaacctgtgcaacaaaatgcgaattaataaagttgcctacaaaacagaatcaaccaaaatatgtaaattaattgcaaaccttcgccggaataagactgggccgtatgtaggattcggcgagaagtagtcgtgctgcaaccgttcatagctggctcgatgattacgtcgaacaacttgacgacaaggaacagaaccacctcaccgacaacgtcgagcattcgactgctcatattcatcttgcgcgactattgctgcagcagcgatgatggtctcatcgtcggatgatgatgattcatccaacaaaacacgtctcaaaagagagctcattgagtgatggaagaatcatgcacaataatttgcatggtgcaaaaagatagcaagcaatgtagtggtatatatagagatgatgcatgtctgtgctagccgttgcaatttgctagccgttgcacattttcaattagctagctagctgttggcaatgtagccgttgcaaatgtagtcattcaatgcacaaaaaaaatgcttcactcattttaaatatatcaattaaaaagatttctgttaaaatttaattgaaatattatcacgataaataacatctttaaaattaagtagttcaaaatatatctcttaaaatataaatgtaaggttagttgaaagatattactaaaatataggatgatgggatatggatgatctgttggagttggaagggatatggatgaggaatctttttttggatgatactccatatggacgtttcgaggccaatatagatgagctgctggggatgctctaacaaaccatgctgaagctgacaaatcctagcccccagccgtgaagttggaaaagtcaatttcc

SEQ ID NO: 65537 - DNA, 706 bp, Oryza sativa
gctgcaaaagagcactccagaacacctccagtgcacatccatcgcccacacgatcttgacgcgcgcgcgcgcgcacaaaacacacaaaaataaacgtcaatttgcaatcgtcaagagtagagagagtcgctagaaacatcaactgatggcaacatccacacggcgtcgaggaaaagaaaccatttctaattgctgcaagatgccaaaagatgccagcccgagaggcagagatcactagagacacatcaatagtagcaccagtagtgtaacaaattgggaatacactgtgggagtaggacagggacaatgacacaggaaggcagaagaggacgcatgatgaacacatcaacaagagagtgaaattcaggacgaaatgtcgacaagatattggaatctttggccacgcacgcaccaattcttgggtgacgcggccggaatcgaacggcacacccgacccaacccaacccagcgaactaaacggagtcaatcatctgatgacctaaaaaaaagggaaacaaattctgccaaattttattggtttttctttcccgtttgcttcctctcttcttctgcttgtctctcttttcatcacttagaggcgtgtgcacgtctcgtacaccggcgcgccggtcacctgcgcgactgcgccgggtagggcgcgacgcgcgtcctccgtgtgccgtccgacggcacgcggccaccgacg

SEQ ID NO: 65538 - DNA, 1291 bp, Oryza sativa
actctgtattaatagaaatatcttttctgagtaactaagatttacattgtgagaatatttcttagttaggtcctatagcatattggatgattattcactattgctcacttataaatagtgattactttggtgagttactattggtatttcttaacgtcacagataaaatccgaagcgcacggaagataccgatgtagcacttcacccaagagtattacaaggtattgatttccatagggaacatgtgtgttcagctcctcttcaggttcatccaaggacacgaagcaaatataggcaaaagggtagagaggatttcctattgagaaacaatgtctacggaaagctcagtttaaccctaacgcgatacttcaggcactagtcagcccgctctcccagatgtccttctaatgcgtacccggacaaggaagacttcagtgtaattgagggctgtcaccacctttacacccaccttaaacctcctgagcaatcaccggaaattaattacccagacaccaatatcagggttatagataccacatacccaatagtaatcgactaagctcgtcagggcccaccacataccatgtcttatacggaaacaaacctcgtatatagaaggagttccggataaggaaggactaatagagttatacatggaaacgacaaggactagtcagatcgtatccatatttatctccctagttctacttggacaagggggcacctatagctataaatacaagcccccctaggaggagaggggacgagccacaaagccacaaagccacaagccaatacaaactaatacaccgccaaaaatcgacatcagagattagcatagacataccccatccagtacctacggaggccggcaagagggatttagtgccatctctgatctcgttgagtacggattcaaggaggaagactaccctgtcgtcgactacgagttgattatttagccgccaagtcgacgacagctagataggttatcccaaatattgtacttgtgtgatcctgatgaataaagagcaacaccggcttcggccaacaggatgtagggctattacctgttagataaggggcccgaacttgtataaaaatctctatctccatctcttttacctcaatctcgcatataccctagtatcaaaaatccccatactatgcaaaataccgtagtcgtgatctcagacgtcgacagtggcacgccagagtaggggaattttggtgactttaaagtttttgaagagatgggttaaaaagatggattctccaacaacaagctact

SEQ ID NO: 65539 - DNA, 1260 bp, Oryza sativa
aaagaggagaggtatgactttaatatcaccaaggctgacaaaatttttgacttgctactccgagaaaagcagattcaacttcctaccggtcatacaattccatcggctgaagaaattgggcaagaaaaggtattgcaagtggcataattctgtgtctcatactactaatgattgcaaggtcttcaggtagcagatccaagcagctattgaaggaggcaaaatcatgtttgatgattctaagaggccgatgaaagttgatggcaatccttttcctatcaatatggtgcatacaactagccgaatagccgatgggggtcgtgcaagaggttttcaggcaaattcggctaagattatcaacaaatatcagaggaagtatgataaacagcaggtgaagtattatgaagaagatgatgatggctttgatccttgttggggttgcgagttctttagattttgttggaatgaaggtatgaggctgccatctattaaggactgtcctgggtacagtgatactgcggagagctcaagccgatcatatagtaggggcaatcggctaaggcagacaagggttcctgttcatcaaagattgggtccagtaaaccaagatcgtagccgggaggacaacgaaacaagaaaactcaatggtgtccttctagtatctttacaaagaatcagaagagaagggttcaaagattgaggaacagggagcgctttcaggaggtcgagtaggaaatcaatcattggctaaagaagacaaagccgaagcaggagtgacgtgttaagaatcaagttcttgtagacgatgaagccacagccgatgaagcaagaagattggctaaaggaaaaagtgttgtaactgcttcagtcaatatggttttcacgttgcctgccgagtttgggatcaatcaagccgatgacgatgaagttgaagaagaatcagccaaattaattttatcgccagagcaggcagttttcgagaagccagaggatacggagaatcggcatcttaagccattctatataaatggttatgttaatgggaagccgatgtccaaaatgatggtcgatggtgcagtaaacttgatgccttacactatgttcaggaagctgggtaggaacgccgaagatctcatcaagacaaacatggtgctcaaggactttggcggcaatccatcggaaaccgaaggagttttgaatgtggagctgacagtcggcaacaaaaccatccctacaacgttctttatcatcgatgggaagggt

SEQ ID NO: 65540 - DNA, 5663 bp, Oryza sativa
tgatgatttggaagaaattgatataggtccaggtgatcgactgaggccgacatttattagtacgaatttagaaccaagttgatagagctgttgaaagaattcagagattgcttcgcttgggagtattatgaaatgcctggactcagctgatcgattgttgaacatcgtctacccatcaaaccaggggttaggccacaccaacaaccaccgagaagatgtaaagccgatacgcttgaacctgtcaaggctgagatcaaacgattgtatgatgctagttttattcgtccttgccgatatgatgaatgggtttctagtatagttcctgttatcaagaaaaacggcaaggtcagggtgtgcattgatttccgaaacttgaataaagctaccccgaaggacgagtacccaatgccggtagccgatcagctggttgatgctgcgtcagggcacaaggttttttagttttatggatggaaatgcaggatacaatcagatctttatggctgaagaagatatccataagatagcttttaggtgtcctggtgcaatcggcttgtttgaatgggttgtgatgactttcggcttaaagagtgctggggctacatatcaaagagacatgaattatatatatcatgatctaatcgactggttggttgaagtctacattggtgatgtggttgttaaatctaaagagatagaggaccacatagccgatttgagaaagatttttgagagaaccaggaaatatggcctaaagatgaacccgacaaagtgtgctttcggtgtatcggctggccagtttttgggatttcttgttcacgagaggggaatcgaggtaactcaaaggagtgttaatgcaatcaagaagattcagcctccggagagcaagacagaattgcaagagattatcggcaagataaattttgttagaaggtttatttctaatttgtctggaagattagagccttttacaccattgttgagattgaaagccgatcaacagtttacttggggggcagagcaacagaaagcgttggactgtcacaccctaaaaatcctaaatatataaatttttgtttaattggaattattagaaatgattttaaaagccttgaaaagaagatctagttttaattaataaattccaatataaaatcgggccagataaaatttcattaaatactttgcttaactctataattcctagatttttctaggatttatttgagctaaggaagtatttttaataaatggaattgcatttaatgaataatttaaattgaaaaaggtttttaaaagtctcttttgcctttgggccgaaagtcggcccaaaaccttctctctctctccccggcccaagccggcctagtccgcagccgagccgtccgctggcgcgcgcgcgtccgcccgctgacaggtggggcccacctgtcaggcctgtcgtctacctccggccagccgccgcccgaaccctagccgagccgtgccgccgtctctttccaaattcggccgcgcctttccttctccggtgaaatcaattgaggggaaatgtttcccgagatctcctctaccttttctcttttggaatcgtcggctaatttcgtttggaaatccgtggattcgagttcgattcggatcgatccctctcctccgaaccctaaactttccttcgcgtcgccggtcgccgtgggccttcgccgccacctccttgcccctttaaaaggacccccaagcccgccgctacccgccgccacccttgctttcgcctctcgccgtcggtagcgccctagcaccgtgtagcctcgcgccgccgtcgtcgccgccgctccagccgtgcgtcgccgtcgctcgggaaggccgccgtagtggtcaccgtcgcgtcgccgtcctcgtccgcccctccatcgtttctgtagaccgccggagcaccgccgtcgtcgtcaagccgatcttctccgccgccttttcctcgacgccgtcgccgtccgttgatcttccgccgccgttttggtcaccggtgagttcgccgcgtcgctccctacgtgctggtgccctccgttcgtgccgtcgcgccgtcgttcgccgacgagcttgcgcgcccgagccgccgacggtggtgacgtcaccgctgacgttatcgtcgtcgtctctcgtggtccggccgtggaccggtcgatctcggccgtccgttttggatggaaagatctcggccgttcgtttctgtgagccgccgccgtgcacccggtccaccgcaaaccctagccgctgacgcaataaacccctttttccttttcaaaaataattcattattgtgtcataattcaattaaaacccatataattgatttaatccgatttaatctttgaaaattcataaataattcatcttagctcggatttagttggttcaagtctctaaatttttctaaaattgagatctacatgttaaaaatatccacatgtactattcatgcttgtttatgtgctgttttggtgtttttgctcttttctgtttagattccgacgtttccggagagtccgttttcgcaggagaagaatttgaggagttccaaggccagcaaggcaagtcacacagatcctaaatacaatcctttgagcatgttggtcctatatttaaattctctatttatttcaactgtgcatttattttcgaatgtcactgggtggtgtgaatctattcctttgttatggcctgtttgcattgattactttaatccttgataccttgggttattataactttactagttgagctttatatattggttcagctagatattagatatgattgcttagccatgcttagaaacattagcacactattgggataacttatgactcactattatttaatgatggcttaatgatagttcacgatggtcaatcgtgattggttaattaattacttgtcaactaaaacttgataatggtgggttagtgagcacatggttttgaagagtcagtgctcatgacaattaaggtccggttcacgagttttggttgtgaaacattaaccgtgccaaccacaagccagcgtgggcaacggctttaccttttgtatagcatggttcattgcggagcaccagactgagaagtggcggagataagcccacgagggtcgctggggagtccatgccttgttcataagggggtgattatgatccaggaaaggtgcgctgtggtggattgtgttgtgcgagaggtactgtcacagctcctttccgaggtaccgtggtggtattgaggcacatggtgacatgttgtggggctgtgtcttgtgggtacagtggtacacctctggccagagtaaaactattcgaatagccgtgcctgcggttaagggcgggtctaacaatgtctttcgtgattagtctcacacttctcatcataataaaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattattacttaactgttttattaaattctgaaatgtttattaaatgttgtttatgcaaatgaaaccctactatgccatcctttgttatcctatgcacttgcatatttgttgcgtggcttgctgagtatgtcatatactcaccttgcaatcattcatcagaggaggagttctacagtgatgctgatggtgtggaggattaggtgtagccctggtcaagctgcctgtggagtggagtcgtctgcgccgtttatcttatttttttccgctgcttagatttttattgaatgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaccattgttgagattagaaatttgtctggaagattagagccttttacaccattgttgagattgaaagccgatcaacagtttacttggggggcagagcaacagaaagcgttggacgatattaaggaatatcgtagctctcctccagttttgattcctccatagaaggggataccttttcagctatatctgtcagccggtaagaagtcaatcggttcgatcttgattcaggagcttgaagggaaagagagagttgtgttttatctaagtcattggctcttggatgcagaaactagatattcccccgtggagaagttatgcttgtgcttatatttttcatgtacaaggttaaggcattatctattgtccaatgaatgcactgtcatatgcaaggccgatgttgttaaatacatgttatcggctccaattttgaaaggaagggttggaaagtggatattttccttaactgagtttgatcttcagtatggatcgccgaaggcgattaaaggacaagctatagccgattttactgtagaacatcgtgatgattcaatcggctcggttgagattatgccatggactttattatttgatggatcagtatacactcatggttgtggcatcggcttggttataatttcccctcggggggcatgttttgagtttgcttatactattaaaccttatgcaaccaacaatcagctgagtatgaggcagttcttaaagggttgcagttattcaaggaagttgaagccgatgctattgaaattatgggggattctttgctagtgatcagtcaattgacacgagaatatgagtgcaagaatgatacattaatggtttataatgagaagtactgagagttgatgaaggagtttcggctagtaactctgaggcatgtatctcgagaacaaaatattgaagctaatgatttggcccaaggggcatcggggtataagccgatgatcaaagatatcagggttaaggttgctgcattaacagccgatgattggaggtatgatgtacatcaatatttacaaaatacatctcagtcggcttctcggaaattgagatataaagcgttgaagtatactttattggatgatgagctctattatcggacgattgatggaatgttgcttaagtgtttgagtgccgatcaggctaaagttgcgatcggcgaagttcatgaagggatttgtggtactcatcaatcggctcataaaatgaagtggttgcttcggcgtgcagggtatttttggccgacaatgctggaagattgtttcaggtattacaaaggatgtcaagattctcagaaatttggagcaattcagcgagcaccagcgtcggctatgaatcctttcattaaaccatggccattcagaggttggggaattgatatgatcgacatgattaatccaccatcgagtaaaggacataagtttatattggtggcgactgattatttcaccaaatgggtagaggcgattcatttgaataaggttgattctggggatgcgatacggtttgttcaagagcatataatctaccgatttggtattcctcaaaccattacaactgatcagggttcaattttcgtgcccgatgagtttgttcaatttgctgatagtatgggaatcaaactgttaaat

SEQ ID NO: 65541 - DNA, 1138 bp, Oryza sativa
cccggtaccaatgatccccgtactattcaaataccgtagtcgcgatctcaaacgtcgacggtattccaaggtatcatatttatttaatttcgaagggaagatttataagagagaactatgctaataatttatgtataccacttttatggtcagagtctaagtaggggttaatacattcataagggtagagtgacacgaaacaaataactcatatcttctcattaattaatcctaaactatgtggaagaagaaatagagaagcaatcaattcctttacttctagtatatactcaaccttagtttacatctgctagtatataattgtgcggccaaaaccccctaatagtgtcctcccggtgtttcaaaagaccacctggggttgccgagtttcttacaacaacctgtcgtggccgtccaaccgaggctaaatacggagtagtaccctccaaggaaagtgtcttaggaatatataataacgtggagggatacccgtactgagctgtcaccatcagcggcccactctgtcccgcagcatatatgaccagataatgatacttaataatctagataccaagcctacattattaaatactactctatattcccaggaatgacatagagcaaccaaataatcggatattaaacccacaccattgcacctctctggtatgctagctacacaactataatgatacagatataaagtaaagccgatactcagacaaattaaagtaccgagagtatataaagaataatatttcattaattctggaagtcttacaaaagaaaaaagaaaagctactagagccatacctgaattcctccgaagactccgagaactccgagagctattctattctactccacttagcactagaatactaaactaaagtatagagagatcttgagcttgcttaagtgtgtctttggagtgaatgaggtctcctccttttataggcaggtaaatgacggatacactatgcgaattgtccaactaccctgcaaccgtcattgaggagcgatcaggagcgtccacgtggaaggccaggatgagaggagcttgccagggtttggccgaacccctggttcagtcgacctggcccggcccagcaggcctccaaacttctctggggcactg

SEQ ID NO: 65542 - DNA, 6688 bp, Oryza sativa
tgcggagaggatgaaacgagggagccacctgctaaaatgggccgactcggcccagcccatgattcggtcgaacccgccgtcgcgccgtttgatccagggttttgatggacggctgagatttgctccctatgatggttggagggtattaccgaccattccaaccgtcggaaccgccattctcaactataaaaggccttcatgtcgtcactttctacacacacctcaagcaaaaagcttcatacatctctcaggtttagtatagtttctagagtacagtggaatagaaatagaatagaatcttcagtcctcggagtcttcagaagaattcgggtatggctctagtagcttttccttcttttgtaagacttgtactttatttagaatattcttcttaatactactctggtattgtattactttccgagtatatgaataccaactttactatatatccgagttatatttattatgatgctagcttatctgggaaatgcaatggtgtgggtataatgagcgtgtatacgatgactctatgtcatgacgatgatattagagtagtatttggtaatttaagcgtggtgtttagattaccggatatcattatttggcgttatatgctgcggaagcgatgtgggccgctaatggtgacagctcagtatgggtatttctccgcgcgtgtatatagtccaaagttaatttcctgtggagggtactcctccgtatttagcccccgttggatggtcatgacggattgtcgcaaggaactcgacaatcagggggtggcttctcgaagcaccagagggcattggaaagagggtaattatataactaggatgtatgtatattatatatgtatactagaagtataggaatatgatctttctactttctttccacttagcttagataattatgaatgagagtataaatgcttctgcttagtgtcgctctactcttttgattatattaacccctgcctagactttggttattgcaagtaacatataaattattagtatggctctctctcttataatcttcccacgggattaaaaaaaatacgataaacttgaaatactctcgggtaaaatgctacaatggtatatccgtgcgcttgcgaatgaactctgtaaccataatataccagaaatatttctgcgctattgctgtgaattatatttctagtaatatcattaagaaataccaacacaagcatagctagttctcctttatgttagttatatcaacggtcgaaattggtttataacgaccatcaacaaagcccccaagcttgaacctttgctcgtcccgagtgaaggactcacaaaaaataaacttggttgttgatcaggagttgctactatgttatatatctagaatgtacaggtgcaaagtttgagtactctctcgtattaagcaagtaggcacggtggcttatccatacacccaattataacacatgcttctctttgccttgggcggttggaagacacaacagatcatagagtaacattatctcttcctttgtctaattcttattccggaggttttcaaatggttttgcaaataaaaatcaagtttctcaaatgattctctcgatcactcaatgtgtataaatattattcctcaccaaaattatgcatttgtgactcctacactaaagccgaatatgtgtagtttggaaggatcaagaatgagcatacttacaatcacatttatcactaagtcaaaaatctagactaaaacagataacaaatcatccttaagatcaatcacatttatcttcgtgtgcggttggatagctcgcacgtgaagatggtgatcttcacaggcacatggggttagatgggtcggccaaccatacgtgaaaaccctcgtcggccgtctagaaaaaccctttctcattgaagtcttagggtctttttggttgattccttgaggaaaaattgcatggcctgagacaaccctgggattaacttgcaagttgtttggttgccacctgagacccatccaccctcgcctggcctgatactgataccatccggctcgagattagcatgcgtcgcctgagcttcaggcgcggggcggccatcataatctccatcgttgacaggctgcaagaagctaaccactgccatgctgacgccataacaagctgttgcgtaaagctgtgaagctgcctccgccaccatcgtgcgaagccaccgccgccgcagcgtgttgccgccttgtccgacccagcaagcgcgaagccgttccgaggattccgactcgatcgtcggatcccgtcgtttttgggatctatttccaatcctgatggacggatttgggatctatttccttctgttctttgcttttctgtccttgatggcttgatgcatgcgaacaatttgtctccagaaagctggacagatgaattttagttgtgcggcgaagcaattgtgctaatatttgtatctggacattaacatatgagttcgcagtaattatgtgaggactaattgcagttttttctcccaggccatagtagccaacgaatcaagtaaagtcgtaggatacctgtatagaccaaaaggcacacggggcctgacggcccagcccatggcatggggtttcggcccggcccaaacacaacacggtctgactggtgttgggcccatgctagcctgacatgtccttcgggccgtgtctgggcctctgcctcggcacgatggaccggcccggcacggcctggtccaacaattagggaggcaaaatagatgagggagacaaaatagacttgttacaaccatataaggcacaaccaaaagagatgaagaatgcaagatagacttattccatccatcttctcaaagagatgagggagaaaaaatatactttatctaagaaggagcaaacgagcttttgtgtcttctggccagcttggcccagcccggcgtataggttgggccatgctagtccgactgatctcgggcctaagcccaatcgtgctgggccaagtggcccatttggccatctatagctgcctgactagataaaattcatctactgcatatgtgcttagcatgcatgcaaatttctatttctcagatatggtgctcaggggcaccaaccaaatacacttgaactctttctgaattataatacaataagtaattaatcgcttcattccatattgatcatcgtatatagtttttatcaagacccaaaaaattttaactaccatatattttatttaatgtgagtatgtggtggaaaagaaccaagaaacatgtaaaatttaactccccgcatacacaataatcgagcctttgactaccttaaatgtgtacatgcatgcatgcgtaatcaatttgatgcacatatacaataaaccctacaattataatcatgcacattaaaggagggtgtgatcaattttttttttggctatatgatgatgaatattccctccgtttttaaatatttgacgccgttgacttttttaaatatgtttgactttttttcgtcttattcaaaaaaaattaaataattattaattcttttcctatcatttgattcattgttaaatatactcatatagttttacatatttcataaaagtttttgaataaaacgaaaggtcaaacatgtacttaaaaaatcaacgttgtcaaatactcctatttagaaacggagggagtatataatagatagagtataaaattatctctacatgtcacttaattattggatgtcttatatgtccatctataaattgattgatcctttaacttttgttacttaccattgatattttctattatttcgatatgcatcactaattagttaaaagccataatcgtagtcgaaagttgacggtgactgggtgacagcattaatcaaaatgctaagatctgccccaggtttcgcaacagcttttgcacacaggatttcatagcttttttgcatcaccccatcctctcgttcattcaataatctactgacacgatacaactagtgtaagattaaacacacatttgtaactatatactagtgcatacagccatagttactagtgctagtaccagttggttcgtgcaaaccggccagcggcgccggcgcccgcgccacccgcgggcgcgtttcggcgccgtacgcgacagcgacacgccctgcaggtaaccggcttataccaggccggcgcgcgccgccaaagctgttaagcggtaaaaattaagaaatatcttcttctaagctactcaagctagctaaactaaagcaaaggcaggcaaagactaattaatcacgacgagttagtaattaaccagcaatcttacatggactagaggcaaattaatttaaataagagtaaagacagcgtcacataccctttggtagtttggttacctcggaggactgtgacagctagggatgatcgatcgatcgacacatatgatactgacagcgaacgccggcgacgacaccgtctattgctagctatagctggtggtaataatatcaccatcttggttaactagtccaattattattactccctctgtctcataataagtgtagttttatactattcacattcaacgtttgaccgttcgttttatttaaaatatttttatgattagtatttttattgctattagatgataaaatataaatagtactttatatgtgactaaatattttcaatttttttataaatttttcaaataagacggacggtcaaacgttgggcgcagatatccacggctacacttattttgggacggaggtagtattaatctataatagtaactcaaaaccgacttgttaattaagaggagagtttcaatattgtgcgccacccaacacggtcgtggaaacggaagagtgttgagagaatcatgaaagcttgtattattctccataatatgatagttgaaaatgagagaggggggttaaaattcctattgatctgaatgtggaccctggagcatcggttgctcttcctcctgaagtaactactgggcacaatccatgctttgatcaggtgctgtgtaggaaaactgcaatacatgctcgtgcaccacattcccaactaaaaaaagatctagttgaacatatttggcaaaagtttagcaatacccgtcgtacttagttgtggtaggacattaagcatcttgttttcacattttcaattacaattgcaagcatcttaattcacttatcattttatttatttatttcagggacaatggaaaactttggtggtagctttttggtgctttctgctatggttttgggaggtatgtacatgtctacttgcactgtacagtccaaagaacaacataatcaaataagtcctttaatagtccttttgtttctacttaaaatagtagtactacttccttccagttgttttgccatccagattatatgctacaattgttctataatcatcagcctcctattttccatggaaataatgttgctttaatgacaggtagtgaagatgctcaatttggcaggctagcagcttgttttggctgcttgagaaagataatctagttataaagtaatttttagtaattcgctggtgtcatgtaagaacaattgtgttgttaccatctattggcagtatggatcgttgtaatggcctaatttcttttatcgaatgttgatgtatggatcattgcaacagactaagttattttgtcggtctatgaattagttatttgtcaatctgtgaatattctttcgatcaagtaacaatctgaatcactattgtactgtttagttcgaatgaattagttcgaatgaattaggaatattacaccattgttgttgataaatccgtctgctttgtgataaatcacatggtttatttttttattgattgaacatagtcttccgtctatggttgacatataagtggctactcaagtgatgtttacagttgatcctacataacttgaaagatacaattagagaattaaatgcagcttgctttgctagagacggcttagagcatgtactatcttattgtaaatgtcgtctgttaaaccatctatagatgatgtggaggatactaatagtaagatgtttactctattattacccttgccctaattagtagtagaacttaattaaccgtctttgtcagcgatcgattcgcacgtcgcgtcgcgggggcatgtggcccgcatgcggtgtgcggatagatgtgagtcgacgcccacgtcacccccgccccgcctgatgacccgcacgcagcgcaggctagctagagcttatccgtagtgcctgcctgcatcagtggcgacggcgagagagacagagatccaactgcgtgacttgtctcgtctcgtctcaccgccgctggagcgccaaaccgcggctctttgctctacgcatatgcgcccttttgtacggatatagatttcatcctggttgtttacatatcgtttaaatagttattaaaaaatcttaaaaaattgacaacatagattgatatgaaatatattactccacaaacatgcaagaccaaatttaacttctataagttgcaacaaaaataaaaaattaaactgtaaatagctatagtacatttgcatctatatttgttaattttattacaaattgtacaagtaaaattttagcttgcatgtttgtagagtgatatatttcatggtaacctatctttttatttttt

SEQ ID NO: 65543 - DNA, 13422 bp, Oryza sativa
ccccccccccccccggccgcgctgtggaatgaaagcatactgctcgactacctggtgaaatagctcttcaaatctacaagcaaaattacagacatgtgaatcaatgacaaattgtgcattatacttttacaaattgcaatgttttcacttatcatttgtcaaatactcaagaaatgttacacttttatgatgccaaagccttttctttcccctatctatccatttgtgctgaatcgtttcacttcaaaaaaatttgtgttgaatcgggctagttactttgctgccttgcccttgctaactcgttggtgttgctgcctgctcggcttagagctgggctgttgcgcgcaggcgcgcaaccgtgtaggccaggtggcactgcggcactaggagcatgcgagcaccgccgcgccggtctgcagtctgcagaggctcgccgcctagcctggacgccgcgcccacaccgtccacggctacactcaattcgacgcgattggggttttggaatggggaactttcgaccaatggccggcgttgtgggcggcgctgccggggtcgccgggggcggggagcagcggtggtggtgggcacgagtgcggcttcaagaacctgttcatcggggactccggcgtcggcaagagccgccgaccccgctccatcggccggagagagattagggagagagaggatagagagtatccacatgggcccaccattttttacttatttgtgtgtgaaactaacatgtgggtcccacgtattttatttttttccgatctaattgctacataagcaccacgtcaacgatacgttggacaaagacctggtcaaaaggagctatgtaggcgccatctcagccaaaaacgggtacaataccaccgagggactttatttaaacggtttcgttaggttgggggacccatcgtaccggttttgtgaataggggatgaaaatcggatttggcgacaaatagagggacccaaagtgaacttattcctcctttttattttcggaaggaataggtccattttgactcccttaactatagcttaaatctgattcatatccctaaaccgtaataccggatatcttgaccttaactgttaaaaccggtgcaatttgactcccttgatgattctagagagcagtttcgctgatgtgatgcttagacttgtctaacctgctaagtcattatgtagggcccacacatcagtgtcacagtctatcttttccattactttccctctcctttcagcacccaagatggcttcgtccacggtagaggtggccaaacgggcggcccggcccggcacggcacgggcacgggtccggcacggcccgtttcggcacggcctgttaggcacggctcatgaaacgggccgtgccgtcccgacccacgtgccgagccgccggcccaagcacggcccgtggatggccgggccgtgcccgtgccggcacggcatgcgtgtggcccgccgtgtcagttgtcacgcccggaaattcactagtaatttccgaactaatttgtgcataaaatcctcgtccaggaatcagccgaggtacacaaactgacaatttaatatacaaatccatcttaataataacgttacatacttacaaagaaaagaaaacaacagcggaattaacggtctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggattccaaaggatggcataatataggctcatttgcaaaagcagcatttagcaaaacatttaagagaagtaaaacagtgaagtgattaatcatcaattttaatcaacactgaacagcacacccatgctgcacaggcccaaccatcctgaacaaccatacccggctgtacagatctaactccaaaccaggagctaagcaaattattaccagttatagcatccataattattgtgagaggtgtgagactaatcacgaaaaacattgctcaactcgcccataaccgcgggcacggctattcgaatagttttactctgatcagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatcacccccttataaacaaggcatggactccccagcgacccccacggacttctcgccgcttctcagtctggtgccccgtaatgaatcatgctatacaaaaggtaaagccgttgcccatgctggcttgtggttggcacggtaaatgtttcacaacagtagctcgcgaaccggtccttaattgtcatgagcacaaccatcaaaaccatatgctcacaacccaccttaaccagattttaagtatcaattaattaacatcacacgattaaccatcgtgagctaccattaaatataaccataattaataagaataatataatataatttatatttaatcccctttaattagctaatgtttctaagcatggctaagcaaacatacatataacatttagctgaaccaaaccaatatataaggttcatgctaatcaaattataacccataggaaaataagatcatcttcggccattaattaacggggaaaggttcaccacccgatgacattcaaaaataatgcatagttgaaataaaataatagctttaaacgggttcaacatgctcaaaggattgtgtttaggatctgtgtgacttgccttgcaataatcgatcttcaattaatcttcttgatcacttccgacgcactcacgaaccttcgcaacgacggaaacgacaagctaacacgcaaaacgaagaaaaaaaactaataaaaaccaaataaacaatacatataaagtaaacaaacatgtagatcatgattttagatgaattatgagacttgaacagccttattctgacttcaaatgaatttattatgaattttacaagattaaatctaattaaagcccatttaaaaagaattaaataaatttaattcaatttatggacaattttaatatgtagatctttattttagaaaaatttagcaactggaaccacctgaaacggatctacagttatttagttatgattttccgaagatttaatctattagaaaaaaaggaaaaaaggaaggatgatgatgtcatgctgacatcatccaaggcagccacaggtcggccgacgacctcgccggcgctatggaccttggccgggcgattggagggcacctacgcgtagaggacgacgaggcgaacccaacggtactcaccaaaacgacaaacgacgcacgacgacggccggcgacgaagaggacggcggcggcggctcggcttgacggcgacggcggagctccggtggccggcggcgaaggggaaggtgcggccgaggttctcctcaccacggcgcacctaacggcagcggcggcaagcggcggcgacggctagggcgacggcgcggcgcgactggagatcgccggcgacggctagcggctagggcaacgtggcggcagcgctacgggcgacgagggagctcgggacttggggcaaacggaagaggacgactaggggatgctatttatagcattggattgaagagatcgaactccaaacgagaggaatcgatccgagaaaatcaaaactcggtttttgagataaactcgaaaacgaatttgattcggataaaatacacaacgatttgctccaaatattgagggaaaagatagaggagaacgagaggataaaatcccctcaaaaacctggaggaatcggggtcggattgaggcgaatttgagaggggaaagaaggcggctaggactcggctcgggcacggcttcggccggaggttgaagaaaggcctgacatgtgggccccacatgtcagtgtcccacgagagagagagcggcggcgacagctgggccgacttgggccggcttgcccgcgggagagagagagtattaggccgaaatcggcccaataacctaaaggaggggtttttgaactttttcaattaaaataatttatgaaatgttgtttcatttattaaaaatactttccttgctcaaacaattcccagaaaaatctagaaaatagaggaacaagcaaagtatttaataaaattttatctaacccaattttatattgagatttagcaaattaaaattagatcttctcttttaagcttttaaaattgtttctaataattccttttaaacaacaatttataatttaaggatttttaaacaagaaaaactcttaacaattataattagatcatttaatgattaatttaatattcaaataattgctgaacttctctttgtatgattaaaattaataattgagctccgaaaaatccgagaaaattccagagagtataattaaccatggagaatttaataaaaattaaatccatccatgctttatatttaggaaattttatttcctacatttaacttcacttgtaaattattgaacatttaatataaattctattaataatttattaaataatttataaatcctgaaacggaattcaggctgtgacatcagtacgggcccgtgaatgaaaaatgggccgtggacggggcacggttggcccaggaaccgaaatggcgcggagggatgcgatgcggacttgcggaggtggctggcgggctgggccatcagctaggaggggtgctcaacggacttgcggaggcggctagcgggctgggccgtcagttgggagggatgagatacggacttgcggaaggatgagatgcggacttactacagtagccgtgccgtgccgtgccggcccgcgggctcggccggcggcccaagcacggcacggctactcgtgccgtgccggcacggcccgttactgtagcaggccgtgccgggccgtgccggctacaggttccgccgtgcctcgggccgcccgttttggcccggcccgtttggccacctctagtccacggtgacatctctatctctactactgcaattctgcatttctactagtaatatataaagtactagtttcatcaacaatcctgcaatctgatccactttatcgtgtgggacccaaagtgaacttattcctcctttttattttcggaaggaacaggtccattttgactcccttaactaaacaccgaaaaaaatagcacgtcgccaccgctccgccctccccacgccaccgctcgccctccccaagccgtgtctccgccgcccgcccgcctcaccagccacgtcgccgcgccgcccgcctcacccgccgcactcccctctcccctctcccctctcgtcgtcccactcaactcaccgcagtcccctctcccctctccctcgcgtcgcctgcctcccctcaccgctgcctcaggatctcctccgcgccgcctcctcgctcctgtaacgccgctgcgcgtgacctctcgccgaagatcgcgtactcctgccgctgccggcgctgcgaacatcctccgtaagctccatcacccctgtcatcctcgctggtcgccatgcccaattcaatcgcgtatccaatacaatccctaatttcacatcgcaccatgtcccatcgtcgttcccatcgccattccgctcctccgatgcagccgtcgacctccgcgccccggtcgccctcacttgcaacacccgcccctgctgttgttgccgctgtcactgtagacgtctttgctccctggtggcgtcgtcgagccctgacgccacccgcaacagacgacgccactggcaacacagctgccgtggccggcaacgtagctgctgctggaaccgctcgcttccttgagacgctcatcgagagagccgactgccggtgcggcacttcgacattatgctctaccacaacgctacagagtaccgatcaggttcagcacattattaggtttcctcgcgtttaacttcacacgtgcttctgttccttctggtgtttgttcccacaaaatgcatgtggcatggatgatgctggatggaatgctcaattgattattcgatacagtatcatttgttgcaatttttagatcttctaattaactagcgcaacatcaacagattctggttcctctttctttattttctgcttcccatttatatttatgtttgttaaaagaaattcagcactaaagtattaaatgttcacccaagttatgtcagggtgattacccaaattaacttaccatttgtctgtgatatcaggcttgttaacgacattgtctttgtgcaggaatgcccgtttattgaaaagctatggtatgttagctacattttaaacgaacaggatatgattatctgagctttgtccagctccagtatctgaagatgggatgttcagtttgtaatcatagaactcacgcgcaacaatcttgcagtggaatccaatgattcacaggttagaatgagagagggatggaattggaattgtcaaagatttctcatacacctatgtcgaagccctttcctctttccttctttctatttaacaagggaatgatcttgtcacagaatactgcaacggtttgatcagcgataagcaggtgataaatgttggtgattgacttatgcccaggttacccaccttgattttgtgcctaccttgaaacatgaagcctcgctatgattgttcaccattccagcttaccagctatattgaaatatcaatctattctgtaagttgcctttaccaattaattattactctttgttgataatgttcagtgccactgagcttgttcttgctttcaaatatggtgctgctctcatgaatattgataaggtcttccatctcttcatggtagttttgtatgtttgtgcaggtcttccagattacacatagttcattatgcttgggacataataatacagtagttgatataaatgtgcagaaaaaactgaaagaaatttcggactgcttaatattttgatgtgagtggatcactggtgcatattggagtgactgaacaatgattctcattggtaatgtttttctcctaccttctacttcattcggtttctcatattcctttcttacgaattatatacctccgtatttaaacgacgttttatatattttttctgtaaatattaaatgataattgctcattttcattttttttcgtggtagtacactatgagaattttccgaaatactatgtcctgctacatggttgctgaatacattcaagggcattgcactgtcttttgatgaagctccaaatcaaattcacatcttaatgcaatcaattatcaggtaatcatgtagttccttggcaagatcacattggtaggtaagttaaggtttgcaactgtggttgatgtcagcaggtcttgctatttttcttttaatttagtttcagtcctctaatgtttttatcttgcacctgtcacttgctaaaattttattcagtttatatccctttagaattttcaaacttaatgtgcctttcagttttttaggcagaaatactaagttgtatttatataacaaaatttgatggaaaccatcattatggtgatttcgcatagtgcactatgaacatgtcagcatgtgatttcaggaaagtcagttgatgtgttttcctcagagaaatattcctgttctcaagtctttcataccaacatgtagtggtcattctctcatttgagagaatccattatataccactgactttgtcacacgtctacgatttgccactgactttatcatgttctacaatatgccatcgacttttggatctataatcaaacagtacattttcatcgttacctgaagatcatctgttacagctattatcccccaacaataaagaacatgcggttgtttgcgatgctatgttaggtgcaattttttagtgtctttaattaaaaaagaatgagtttacgtgtgtactgtgttcatcacataaatggtttctcaaattaatatctgcacttggcctctttgcataccaaactttatatttctctataagtactccagtagtctacaaacttttgttatcttggattaacttattttgtttcgatatgcaagtcatataattaatcttcttgtagcagtgaaatggtccaaccccttcctcttttgatatgggttttcagctgctacttttcttctttttgcaggaattttatttgcaaattaagcactcaattcacttccctcaaattgattcacaaacttacacccgcgcttttaaatctgtgcagttcattcatctatgcaaacataaattatttaatgttataatttactactgttattctctgtcccatgttaaaccaaaaaccatgtctaccattgaagcaattactgtaacaagttcattttgccagctgaatctacccagccacttttgctgtagctccaaccaaaataaggtggctttatggtctctgtgtgccatacaacttttatatattaatttaaatttagttttacatggtctgaacttggccttgcattgcttaagaacttggttgacaacagtctgaaattggcgttgcattatatgccaacctgtgtagtgtaatgtattgtttctattcagaacataaacatgcatattttccctgtgaaccattgattatgtactgagttaattcctgacagccttttgaaacgtggagtgttttttttaggttttgttgttgtttgattgccaaatgtttataatttcagtacaaatttcctgggagcaaaaaattgccaatcacatctcatgttatgtgctcaaaagaaacaaaacaatagatgtctgaacgtgcctctcattttctttatttggagtcttattttctgccgtgctgatgacaaattctttatatatacctctcattttctgtatttggagtcttatcttgtccttgcaatatgtgtgaaaaatagatgtctgaacatctgccagattagtgtttgaacatttcttatattattttctgagcatttgacatattagtttatgacttgttcttatgatgtacgagtatctgaatttagaatctgaacttgggcaagcatctaaatgttgttcaatgttttagtttgctgtgagctaattaatgttatgaatttcttatagctcaagtattggaagtttacaaattcaccggtcgatgtaaggtttttctgggtttagtgtaaacaatatactcatattaccattcaaggttatctgaacgtgaatatgtaatgtatctgaattcagtgtgcggacatactcttgccatgtttcttaagtcagtgtatgaatatgctcttgcaagcactatttttccctgtatttttattgttaaaatatatattataaaaacgtgctatgcacgtgcactattactagttagagaagacgaccacaatccgtggcgacgacgttgtcgccgccggcgccgatgcggcatggacagagcagcgacattgaaatcttctctcctggagggaggaagtgcggcgacggtggcgcgaagtggtgctgcgatcgcaagtacgagcttgtcagctacgagcctacgacgcgctcccggccttcctcaagcacaacgagttcatcatcgactactaccgcagcgagtggcccatcaagcaggcgctcctcagcgccttagtcgtccacaacgagaccatcttccagacgtaattaagcactcgatcgatcaaaagcacgtatattagctaaagacgatactctaccagtagagaaactatcttttatcggtcgaccaaattccataatagttcttgttgcaataaaaaccaggactaaaaaacatctttagtcccgattcaaaaggttagagctacttttaatctttaatcctagttcaaaaaaggtaggcggtgtcagacccctcctttacctttaatcccggttggactaaagagctatttctagttccggttgttaaacaaccaggaaaaaaaagatccgcatgcgcggagaggatgaggcgtgcgcgcaacatcgaggaggaggaggaggcgcacgggataagttaataagttctatctcctcctccctcacctttatctcctctcctcactcaccccatctcttcctcttcctcctctggatccgcccccctcccctctcctccccacttctcaggaagcggaggcggcctcgcgcagtggcggcggcctcgtgtggaggaccgcgcccggtggcggcttgcgcggaaggccacgcggcggcaggcggtggaggctggcgcggctgcacggattttttttttcttttttctttctttgtgttgaatgattcgatctgtgttgtctgtgttgaatgtatgattcgatctgtgttgagaatgaactatgttgttatgaatgttgttgtgaatgatttgggaggaactatgttgttgtgaatgatttgggatgacctatgttgctgtgaatgatttgggataatggacgtgaggtatacaaaatagcaaaaaaaaaagagaaaaaaaactttactaccaaccgggactaaagatctttagtcccgggtatttgaaccgggacaacgatctttagtccggatttgtactactagttggaaaaccgggactagggtaccaatcgggagtacaaatcatttcttcaccagtaacagtacaggttgtgtgttttgattgacaagtgtgcttttctttttgctgtatcttggcaggcgatcggcttcttcatgttcatcgcgctcaccgtgtgcaccgccacgatggttccatggaatcctccatgtctgctagcttggtgacgtccaagacgatggccaacaactccgccaacccaatggtatttgatgatgatgattgatgagctacggcagcaccggggcggtcgcggcggtgcaggctctaagcaacgtgcccgtcgaatcagagctcgcggcggcggcgtgccaccaggtcgcgcattggccggagcggtagatgcaggggaagttcgacctcaccggccaaagccaccagctaatccacgttattgtcatcgccggagtggtctacttcagctggagggacagggcactgggcagacgagcacacggtgacggttccgacgagaggatggttggggggggggggactgttagtgatatgtcctagaggtaatcatagagatgattgtatcacatactatgtttacatatttatccgacattgttccttgaaatagataactccttattggttaatgaatatgtgattctttcatgagactctttatcttgtttgttactatttctaaaggatccctgatcaaatatcataagtggaacaaatatgtttatatgatcagcacatgtattaattgatgatcatgtctcatggatcatggtatagagatatcaaattaataatgtggacacatgttggtgaacatgttgttggatagacccaacatgagacattgcaagagccatatgtgttgtgtcatcagtgatctcatttagtgttggtgttgaatccttagacctgatattatcatggttctcaacatgtgtagtagtttacttagggaccgctaaacgctactccgtaaatgggtagctataaaagtagttttcgggtatgctataaaacatgtagtgggatatgaataatcaagatgggatttgcccctcctatggagagatatcaataggttcgagtgaatgattgagctattagaggatggtacatatctagccttgagcttaatcgatatcgtgaggcaaatggcttcatacaagtatacactagaggttcagccgatatgatctttatgtatgcccggtgggtcaatacgttctactaggggccgctgttgacgcgtggaccgaaaaggagttttcgggttacagccgagtatatatgaacctacagggtcgcacgcttaatgggccggaataaggggattggatagagatccaatatgagcttaattcggatagggatccaaataggagtcctacgggccttggaggcccgagtgatggatcctatatattcgcgaggggtgtgaccagcgaaggcattgcatcacgtgagaaaccctagccgtcacttccctccccgagcaaaaccctagccgcgcgcgggtgctagcacatctgcgcgtggcgttccgtccctgtacgtgtgtataccggtagaggcgccactggtttgcggtgctgatcggcgtgggagtacaacgaggagaacgcacgaggaggagaaggtcgagccggtgcgatcgactacttcctctacatcgacgcgcgctacttcgcgagagttccttcgacttctcagcgtcttcttccgctgcgcagcgcgtcgagtggtaacgatctatgatctaatacttgcatggttcctggtttacgcgatagaaaattttgatttatgctatcgtagcctacgcgtatcacaacagggacggtcgacggcttccgcgggctagtgcacgccaccctgccctgacgtgccgcccgtgtcgcctccgctgcgtgttgtgtaggcacgacgctgacgggattggaggcgacgcacgtccttcgccggatccgcaagtgcctggctactctcggttccaagctgcgccctccggctactgccacctgtcgcttgcccctgcatcaacacccatcccccagccccctctcggacgccgatggcaacctccgccgcccagtaccatcgtccttctgccgcctcgccgccgctagaggaaatatagaggagaggagcagaggaaacaaccacttacatacgggccccacagattgtttggttctaaggggattgaagaggattggagagaatagagagggaataattccacacacaataggtgtggaataaatcccctccaatccctccctcacggggattaactgaacaaggtatggggagtcaaattacaccggctttaatagctgagggatgaagatatatggtactgtggtaaagggatatgaaggtatagttgagggagtaaaagtggacttatatcccttttcggaatcgctataaatcttttgtttttttgggctgttgatctatcccgagatttgtgcgtagatagattgggaaaaaattaactgagatggcatgggctggggtatctatcgatcccgcgtcctctgcttctccactgaaccctcatcattattgggctaactagttttatagttagtacaccatgtagctatataagttagtgtaattataccgtaactacaatgtaactatattctaatttttatataacttagatataaagttgtatatatttttaatacttatatataagtatatatagg

SEQ ID NO: 65544 - DNA, 1698 bp, Oryza sativa
gaacaaattaataattcagtacggtgctgtatgaatttttatttaataatggatacttcatactgcatgcaagataacagagttctccacatagtacatatatagtcctcatcgatttgtgattccagcattgtcttaatatgcacgtacggtatatggccgaggcgccccatttccagtcgcagttctggaccaaataacaaataacaacaggtatgaactagttaattcactctaacttgatagtatatattaatgatcgcaaacgaagaacacatctgatttaacatgcatatccatcgacaaacagccattttatatatcacatgcgaaataatataattaagcggcccagcttgctgaattaattccaagcggaaaaaaatcgatcgacaaaccgatcgatcgattggtacgtgaaaatgcatgcctagctacatgcatgcatggatgagagtgagagagagagagagagagcgctgatcgagcaaagtagcgtcttggcaagcagtacaccagcacaccaccgatcgatctcttgatcacctgcaaaatgttcagaatagtagctagttagtgtcagagtaacggttcaactgaacaattgaacatgtatgaatgcgtgcatccactggtgcatgcagcagtctagctagtgagcataataatgtagtatgtatactactaccactagacatatacaggatgcagctgcatgctaatctgccgcattatcgagtccaccactacatggacaattggacatgggttaattagctttcaccatatattgatgaagtaattgaactagcacaccggtgctgtcagctgatggtcgatcgagattaagtaagggttaatttggttggcggcagcggtcgatgtcgtggggtcgtgcatgcagttatcacatccatccattgatcctaagtgcgccccaagtcacgtatcagcgccgcctgcggtctccctcctagtacacagatactcctcctctgtaaacaaaaaaaaataaaaaaaaatcgacttcttgcagggcggtcggttacttgacggcgttggctggctggctggctggctgccaccacctactcctagactcgtgttgtagtgtgtgtatatatacgtgccactgccccgtcgagcgagctcggaaagctgaaagctagctgagactgagtgccagtatcaagcagaaggaagctaatttaagagaagatcagagtgaaccatcgtcatcaatggcgccggccgctcatcgggatggcgcggcggaggcggtggggcagagggtgttccacttcggcaagggccggagcgacggcaacaagaccatgaaagacctggtgcgtgcatatatgtactacttcattcatcatgtactggtaatttgtatatgaacatatatatgtaaattgcatggataaaattggatgtgcagctgggagggaagggggcgaacttggcggagatggcgagcatcgggctgtcggtgccgccggggttcacggtgtcgacggaggcgtgccagcagtaccaggcgcagaaagcgatgccggcggggctgtgggacgagatcctggcggcgctcacctgggtggagggcaacatgggcgccgtcctcggcgacccgcgccgcccgctcctcctctccgtccgctccggcgccgccgtctccatgcccggcatgatggacac

SEQ ID NO: 65545 - DNA, 3348 bp, Oryza sativa
aatatttgtagaagttgagaactctgtttttagagggaaacaaatataaaaagagtacgcccagtatttgtgggccaaaactaggtgatagccggcccagcccatcctggcccattaatttattgccttgtccagttctcctcccttctccagttgttcttgttcccttctccttttgctcggaaaatttccttctcattttctcttcatgtccgatttttttcgcggcctctcgattgccacaactccggcgagcgagccggccgcctggcgcgacctccttggctgtgtcaccggaggggcaatgtgtcgctctggaggaggaggggcggtcggggcagcagcaccttgtccatgggggtggcatccccggacatggcgaaccgcgtgcgctgaaccggcgtacggcggcggcgcgacgcatttggggccacgcccgaggtccttctgttctttcttagccagatctttctactgctgtaattctacatttctattttgggggtttgatttaattttcatgttggaaaactatgaaaaactggcataaataaataatctagtttagtttagttttcgataatgaaacattctgtacaatttgtgagttacttcgtatgctcgctaatatgaatattgataaaatttgtttcgcaattttattttgtaccaaattcaatattttgatactaaaaggttatcttattaggttatggacataccgcattcactatttgaggagaaaattgaagccatgaaagcagctttaggtttgaggaatgacaccgagttgactgccagggatttgaaagaacttgttgctcaatataagaatgtttatgtggaggccaaaggtgaagaatttccctcaggtacgtatattcatatatatacacaatcaaagttaaattttatcatccgttttatttggtgatgcttgtatcttgaaagcagatgtatctgattttctttttcttctaaataaatgtagatccaaagaagcagctgcatttatctgtgttggctgttttcaactcatgggacagcgcaagggcaaagaagtacagaagcattaaccagatcactgggttaaagggtactgctgtgaatgttcagtgcatggtctttggcaacatgggtgacacttcaggcactggtgttctctttactaggaaccctagtactggagagagaaaactttatggtgaattccttgtcaatgctcaggtacaaatatacagggtaactggtccgaccccttctctgttttgcttattccttgacccctatttctagcaaacattcagtttccaaaaaaaaaaaattctggcaaacactgaagtaacaagatgggttaatcagctatcacatgatcttttcatatttatgttgttacttttagtctgattcgtcatggttactgtaaaatagggagcacatattttagattttatcctttagaatcaaaggttgcaaaaggcaaaaatgtttcgactgaatcatcttatgtatttgctgggttgatagataaatggattatgagcaattaacacaaattatttctcttgtagggtgaggatgtggttgctggaatcagaactccacaagatcttgataccatgaaggattgcatgccagagccttatgcagaactagttgagaattgcaaaatcttggaaagccactacaaagaaatgatggtacagtacatgagaatacatagttcctcttcttggccatcgtatcctagtatcttttgtatgattagagcagaatcaaaataccatgtttttaaaagttatctataatgatggatagatttgattacaaatagtttttaaaataaaaatttaattacagggagttgcctgttgtcagaactgttttcaaaattacaatgaacttattggcaatgtaactaggaagactacagaattacaacgaacttatcagaactgttttctgtgctttccatgaaacaagattggttttcatgtgactgatattatagacaagcatttttataatgagttcactgtttctcttgtaactgatttttgcttgtgctcaaattaacttattttttcatgtcatgcaggatattgagttcactgttcaagaaaatagactttggatgctgcaatgcagaacagggaagcgcacaggcaaaggtgctgtgaagattgctgtagacatggtcaatgagggactgattgaccggcgttcagcaattaagatggtggaaccacggcacttggaccagcttcttcatccccaggtacaattaactatgcaacacttgtcttatctgttgcattgcaaactttgtacactgctattttcttgagggcactctgttgccaagctttatttcagatcccatcaacaagatcgaataggactttgcaaaaagtggtggtttatattttggatgatagatcataacctattattgaatgaatgtgtaacttgttagtctatcggtatatcatgttttcatgtccctaactagaaacttgacatagcacgtgctgttgtttttttgtttcacaaacatgaagcatgtagcgagtgtatgtttatatgttttcctctaaaccaatatgagcctgaaggttgttgcatagtacttttgttacgcttcggtacgatttgtaacgacaatcaaactgatggctatctaatctgtactctttgctctgcccttgttaaactagtttgagagcccgtcgtcatatggagacaaagttattgctacaggcttgcctgcatcaccaggagctgctgtaggccagattgtcttcacagctgacgatgctgaagcatggcatgcacaaggaaaatctgtcattctggtactcacctttgatattgaatttatctccagtctaactctctatagctcaatttggaagctataagatcaacatattctcctgtcctgatcataatataacattctcctgtgtaaaaattaaggtgaggacgggcatcgggctgtcggtgccgccggggttcacggtgtcgacggaggcgtgccagcagtggacccatgtggaccacacgtcatcctcactaacctcttctctctatcctctctctccctcttctctctctccagccgacggagcggggtgggcggcggccggagcgggcgatggcggggcggagccgaggagcgaagcggcgcgccggccggcgggggagaagtcgcggcgcggcggtggccggaggggcgtggggcgccgaccgttgggagcagaggagccgcccgtggcccgcggccgtctgcgggtgcgtgccggcgtccaccttgatgttggcgttgccgttggcggggctgcagga

SEQ ID NO: 65546 - DNA, 3495 bp, Oryza sativa
atgttccaggtcaaggctaatgctgatactcctgcggatgcactgactgcaagaaataacggtgcggaagggattgggttgtgcagaacagaacacatggttggtacactgctttatcttattattcaaggcatcttgatggattaattctgacagctgtctctgctacatttgttctttagttcttctcttctgatgaaaggataaaggccatgagacagatgataatggcggaaacaattgaacacaggcagatagcactagatcgcctcttgccatatcagagacttgactttgaaggaattttccgtgcaatggatggtatgtgataccattacatttagtcttaagcttcatccaactttctcaatatcattactggcttcatagttaagataatgtttagtgcttaatgcatatgctataatcatatgattttgtacattactttcacattttcgtgcaaacatgtaatatttgtagtctctgatcattaattattgcatcattgcttgtgtttcaggacttcctgtgactattcgactcttggatcctccactccacgaattccttccagagggtaacgttgaggatatggttcgtttgttgtcttctggaaacgtatatactcaggaggaaattcttacaagaatagaaaaactttctgaagtgaatccaatgcttggcttccgtgggtgcaggtcagctctttgtgttgtgctttcatcatgcatttgtttgaccgcaattaattattaaaaaggaggtaccacaccagtgattctgatttgcaatttgtttgacacttcaggcttgggatatcatacccagaattgacagcaatgcaagcccgtgctatctttgaagctgctatttctatgactgaacaaggtgttaaagttttcccagagataatggtgcctctcattggaacacctcaggtatacatgtatttattgtctggcattacatagctatgatatgcttcacctgctctatgccatctatattaagaatttgagttactacagtgctactgaactcccaatattaggatgtattgtattttctgtagatggataagaaagatttgcttattttgagaagaaattttccgtcgtcgcttattccaggttccatacattttataatttttgagcttgaacaactaatattattatgttactcttttaggaactcgcccaacaagtagatgtaattcgtgaagttgccgaaaaggtttttgcaaatgcagaaacaaccattagctacaaaattggatccatgattgaggttcccagggctgctcttatagctgatgaggttagttggtatcgactttgctgtttatttagcatgtatttctacctaatttgtgaatactgttctatgtttctctgaacttcaataatggatgacagatagcagcactagccgaattcttctcgtttgggacgaacgacctgactcagatgacatttggttatagcagggacgatgttggcaagtttctgccaacctacttgtcaaagggtatcctccagaatgaccccttcgaggtaatcttactcctgatcaagctcttaatctcaaattctcagttgggctacaaatacatgacagcacacctaagacagctccatatattattctatatttttctgttgatcaaaattgtctgctctgagattatctcatttagctaatccgtgtctccctgaacgcatgtatttgcaggtgtttgaccagaagggagtgggggagcttgttaaggttgccgtagagcggggccggaaggcaaggcctgatttagaggtataatcagctcctaaggcataagttatcgtgaaataattatgcattaccgtgtacctttcgaacatatatattgaagggcaaaacttgtttgattataatcaatcaaattgatgcttgtcattgaaaatatatattttttgtaataggtgggcatttgtggggaacatggtggtgagccttcttcagttgcatttttcgcgaaggttgggctgaactacgtttcttgctccccattcaggtcagctgccgctttcaaatttgattagttaacaaaatcaacatatactgataaatattgatcccaatattttcaaacaactgtgaaactactgctgattgatctggacttgacatacttaacgatttggattcagggttccaattgcaaggctagcagcagcgcaggtgatgctgtgatcggcgagtactaatgaagcaaaccgttggtgcatcttgtaaatatacgaagagtaaataatgcttaaataatttatgttacgatggacactcgcaacatgctttgcttgacgaaatgtatgatgacctgcaaatggaggtttgcatgtgtataaataatattttttgtttgtgtgcccacggtaattgctgccataaacatcaaacagctatcagaggttgcatgttaaggcacctgaaataattgtaatttatttcgagaattactcaaatgaaatgtcatgtttttttgtacctatttattgaggaaatgttttgcacattgtttgatccttgagatcgtcctagtaattctcgcttgacacaatattttatttaatttggttgtggtgcttttgctagtcatttccacagctgcttgtgttatgcaaatgttctagagcatgtgtggccgccgtgccaacgttatggtaggatgcccgacaagccgacagttttcgtaagcctttttaagatccaatttcaaaaagattgcttctctcttagacaataaattagtctttgttcttttccctttttgtgaaacgaagactaaaaagtcttgtactcttgtacatattgtttgcatgcaaccttattgattgcagcagacaccttatgatacccgagatcaattatttcttggcttcagccgagtcaatgggtaacaaagataactgaaccaatgccccgtagcccgtaggccatatggctaaagctccagcccaaccatttcgagcctccgatgtactccttatgtttcaaaatatcaaaatataataatttatagcatttaaatcttgtttcaaaatataaaaaattttagcatgatttagagtactccctccttccaaaaatctaagaaatatttcattatttggtttttccaaaaatcaagtttgtagttactatgtgttaaattaaattgttgatcggaaaccaagaagtcattctaatacttattggttatatgttcattagttttgtcatatggtgagtgagttaattactttttggttttgatgcaaaagaaataggtcttagatttttggaaagagggagtactatttatctctttaatcaccttctattgtaattcctttttatcttttcctttagcctacctcatccatctcatatctttttacaggataactccatctgatcccatattattttaaagggatatctctatctgatggagtgaaaaataagaggtca

SEQ ID NO: 65547 - DNA, 7507 bp, Oryza sativa
taatgaaaagaaaatcattgggtgtcacatcggatgtttaatcggatgtcggaagggcttttcagacataaataaaaaaaataatttcataactcgcttggaaaacgcgagacgaatcttttgagcataattaatccgtcattagcacatgtgggttactgtagcacttatggctaatcatggattaattaggctcaaaagattcgtctcgcgattttctccctaactgtgcaattagttttttcatttatctatatttaatgcttcatgcatgtgtctaaagattcgatgtgatgtttttggaaaaaaaaatttagggaactaaacggggcctaagtagataaggcaagtcatacacgatgacctaccgaaaacgttattaactgctctgttctcaacagggccggccctgggcctaggccggttgtgcaaccgcctagggcctaggccggagggggcccatcatttacccccccagcagcccactagatcaggtcatcaggtgatcagttaggaggcaaggagcacgtcgattcatctgccggcccacaccgcgagtcccgagaagaaacaaagcgccagagcatcacccgcgccgcgtcgcttcgttgtctcatcaccgcgccgatgccctagtccgcgaccagcgaccgcgagtccatcagtccgcctgtaggctccagcgcctgccgcggtgccgccgtgcatttcaaatgttataatgttacctaaaaaacatttatcgggtgctaaaaaagaaactgtcccaggaaagattgaatggattggctatgtgtagcattgagaaaaatatcttggacaacattgatcttcaaactgtcattgatgatttcgcttcaagaaatgctcgaagaagctcttttttataagggacacgggatatttgtattaaggtatttatactactttgtttctatggcattttttagttgttaattatattatagttattatttatcgagaataaattattatattgcagcttgcaaattgcttcatttattatttaccatgttaggaatgtttatttgtgttactatatggtatatggtatatgtgcttatagagtataaatattagaagtaaaaaaatagcattaattttttaagggtccatacactgtgtttagttcacactgaagtttagaagtttggttgaaattggtacgatgtgatagaaaagttgtgtgtgtatgaaagatttgatgtgatggaaagttagatgtttggaaaaaaaaaactttggaactaaacaaggccatagtgccccccaaatgtcaggaccagccctggttctcaaatggaagaatcaatttcagatgagttatatgtacacatgcttatgttattagtacttttgaagtattatatctattactccgtccgttttatattataagatattcttttggttttaactaaatttataaaagaacataacaaaatttttaatacaaaataaacttaatatcaacatatgttcagtgttagatgttgctaaacttttatagaaactttaatttcgaaaaaaaatatataaaactttgtgaaacggagtacaaaaccgaacgtcctcaacagagcagcccttctagaatctagactttcagtttcacggcatgttgtagtaatctcttttcacatgcatattctccgtctactggcgattttatgggctgtcgtttgctgcggttgtcaaattgtcaaaaagtccctttcacgaagaccttgcgttaaccggcagatacatgcttccatccaacccattaagttggtgtttaatgacctgccggtactgtgctgctgcgtcttctgatcggtggaatgcacggaaagcctgggcgccgcccgcgcaagaatggccgcgtacgccaatcctgacgacggtttggaattcttcttttccccgacgtactgtcaatttattagtatcgggttactatgatatttttctatttttaagtgtaatttaatattcatattaattatatatatagccatttcataaaaaatagaataataataatatacagcattaaaaagagagaacacaaatgtattaagatagttttgatttttgaatattgtctagtttgaaatagttagctaatatcccgatagtaacacgattttaacgatcctatgctcccgtattccgatactagggcgataccataaaaaacaatcttaggatcgatacagacaactttgcgtaggtccaagcaaattaggttggttagtattgagcatctagaacaattaacaaactggcagttcccatcaatattttttttcctagggccgcagtcatagaatttggcaattaagtaccgattaatcattgctgcttattctaaatgaagtgtagcgtatactttttacatccctaaaaaagcaaactgatcttttctttttacaagtggaagtataacttgctacagttacaaaatgatgagcagtagcttctagtatgatttaatgtactaacaggttagaatcatacaatcgacatatggattaaatattaaggtgactatacgcctttaattgaaggtatttggatgcaagctaatattatctacgtacctatatatccaatacaacttttttttaattttttagaggaatacaactctttccttataacaagtattatgcaccaaaacccttcctttcctcactctctccataagctatccataagctagaaggggcggagccacgtgtaaggtagcttggtgttcaacctcatcacacgtggtagaaaatcacgtgtaaggtggattacagccagggttggattgtccaggctcattcgtgaatggataatgcgattttagtacgtatagagattgaaaatagtgttccatagttagattagttacggctcaaaaaaattgctttagctgaggttcaacctgagattaaacattgttttagacctcaaggagagttggaggtgtagattatttatattataaaatgagtattagatgtgtacacctttgttggtatagattccgggttttaatccattatagaaaaaaaaacttacatatagatcggcaaccgatcacagtaattaagcaacaaccattaattgtactgcacacttcttcgattggttctcttcagggtagccacacatcgaaaggggctgatctgaccaatgcacattacaaaccaagttcaaaaagacaaaaaaaaaaaaacatcacattaacaaagctgaaaaagaaacaaaaggtgacctgaaacaaaaaattgaagatcccctttcttccagctaccccagtaattactactactccaattaattaagattccacataaacacacattactggcttactgcaactcacttcaggtgcccttctttgtgtggcctctcggcgagctcccaacctcgcgcgtgccgcggcggccggccaacttcttgccgctcgccggcggcggcgacttcctcggggagcccagagggcggcgcgccgcgtcctcgccgccggcgcctccgttgctcagcagggtgggcgcgaggtaccaccagatggaggtgcagcagatggcgaacaccctcccgaacacggcgaggcacaccagcatcagcaccatcaccgccggccagtagcacgccggccgccgcatccgcccccacgagaacgacgacaccctgctcgccgccggcgcaggtggtggagccctggtcgcgcgcgcggcggaggcgccctgctgctgggcggcggcggtcgacggagacgacggcctgggtttcttggcggcggcgtcgtccttggggcgccgctgctcgtcggggagcttgacgatgatgggctccaacgcgccgttggactggacgaagcggaccatgacgaggccgccgccggagccgacgcggcggaggatcttgtcccggcgggcctcgagctcggagagcacggtggagaacttgtccagcccgcgctcggcgtaggggttgatcttaccgccgccgcctccgccgtgcttccgcctcggctgcctgggcgacccgccgccggtgccgcgcgccgccgggtcgtcgtcgtcgacgacgtgcttgaagctggccgtgccgcataacattttctaacgaaacgagctggtcctggtcgcgtacgtctctcgattttatcgatctggagtgtctgtccatgtgatccattaaaccagacgcttttaagtgctcgagccagtggtcaaagttttttttttctgtaagaaaaaaactttttaatacacgccgggtcaaatagaatcttctgttcatggtgacgtacttcgaatgtgcaatgatgagggtataattttctcagcatcagtgcatctcgtaaaagtaagtttaaccgaataagatataattaaataagttaatctagtatggaattggttatgtagatatcctctcgttgattacgtgtcatctgaatagttataaaaaaaataaaaaaaatcgacaacatagattaatataaaatatatcactccacaaatatacaagaccaaattcaacttttacaagttgcaacaaaagaataaaataaattgaaaatagttatcgtacattcgcagctatacttgttatttttgttacaacttgtaaagttgaattttaacttgtgtatttgtggagtgatatatttcatattaatccatcttaccaatttttttcaaaatttttatgactatttaggtggcatgcatgaaacgagagatatctccttgagagatgaaatcactttccctatggaatgtaatatatcttacattttatttgagaagtttaagattcttacaatctgttggttggtagccattttctgcgaatcttaagaagttggattttctagcttttgggttttagagcctgtttggggagcttctagctgctatagcgttttccacagaatcttcagctcctccaaacaattcagattgacaccttgattttgagaattcgcagttatagaatctagaaaatcaagaaagcaaaagctggaaaacccaacttctctagattcttagaaactggctaccaactagcatattcttataatcttaagcttccccaacatggcctagttcattttttgggttctaggtgataatctagattgtttgggggctaagtagactgtagttgatagaggctccctaagcagactctaaaatatgccacatctcgtgtcgtattagattaacttattctgagacagatggagtagtagactaatgtggattctgagacaggggagtagactaatgtggaaataggaagagtattatgtaacagcccttcctccaaaaccccgcagcccagcccaaccaacaagcgggcccacttacacataccactccacttacactttcgtcttcacttcgtgtaaaagggttaacccggttgtaatatggttagagggaagatgtcttataagttggttccacccttgctaaactagcaaggtgatactaaatatgtgcacacagtttacatgggctacacatgtctcatcctaattgggccaagatgtcacatacaccccctcaaagaattcaatgtccccatcggcttaacttacccatgtagccacacatgcttaaacaccatgtagtccacacatggcataataggtaaatgtccataaacatgccccctctcagcgcacgtcccatgtgcctcacacagagcccacatgcgctatgcgtcatatgtccgtacactgactcgtacgtgcaaccgcgagggtcggctgggataccatttgtagcagccctccctccaaaaccgtgtagccagcccattcgatgagcgggcccacttatacatgctacttcacttacactttcgtcctcgcttcgtgtaaaagggttaacccaggagtgatatggttataagaaagagaccttataagttggttccgcccttgctaaactagcaatgatactaaaatatgcacacagctcacatgggccacacaggcctcatcctaactggaccaggatgtcacatattaagcatctacttatagactttgcaagtaattatataaggacactatgattgaggcaaccttatacatgaggcctcgccatatgcaataaaaatatcacttttctctcactgctactttgtctctctacaatacaggtacttgccaccatacaggaggggagagcctgccatgggaaaggagaagaagccaggggagtgccaggatagtcgttgaagatccgcccacgacagcctactaccatcgtcaccaaatccgcatgtgacagtcgccgccgccgttggatccgctcacgactgtgtaccacgccgacgcacccgccatcgccgaagccgcccgagtttatcatcgctgaagatggtgtgggggaaaaatagggtaaaaacgacatgaagtgacatcctggtctatactaaaatatgcacacagctcatatggaccacataggtctcatcctaatttattataatgtgggatacatcttaataccctcgcttttcatatatgaaggtaacaatatacctcagtggaacctgtttgggatccaccataagactaacttaggaatatatattgctgatgccctacgcgaacatatattagctctcacgcaaaagctgtttctagacatgctataatataatgcattaattatataaattagagaaagagaaagaagaaaaaagatagagataattttatagttaatccatattatatattagctctaatataaatttatagctagtagttacctctacaattaaacttgctctagtcatggttatgaggaaatacaggcttactagtgtttacatcctctattataatggcactaccattacatgcattgacgtatggggcaataggagggtgggaccaggggcagagctagagtattgtaggagggtgggaccaggggcagagctagagtattgagggaggtacctaggaatccggtaaagaaaaatttgtagatatacctgacctattttcaccatgtgtgcaccccctcgatataaatttagatacccatattagtttaaaattgatataaagcagagtaaattaaacaagtggcactcccctccatctcgctctatctccgcctctgggtgggacccacatcggccatatttggtcttgaggtatccacttcaaaagaaacttctctcaaactaccgataggtggaagagggcgcgttatcgatgtgaaatggatccagagggatctcctcggcataatggttcgtgtatatattttacaaaaacacgaaatcaaagttggggactttttagtccattttttccaagagtctccgctagttgaaccgcgtccagtagacgacctcttccgctcatctccttcgtcaactctttgatagggatactataacctaggtccctaaacttggaatggatggcggagcgtattattgtaatggtactgacattatgata

SEQ ID NO: 65548 - DNA, 777 bp, Oryza sativa
tcctaagtagcatatgggattattgttcactataaacaactaaaatatagtaattgctttggtgagttataaacactaaagtagatattgattgcttagaagtggtgtttaggtaattgtatacagtaattgctgtgtatcccacactagtttgaggtaggtgtagaggtggtgacagccctcaagatcacttaagtcctctctctctccgggtacgtagtagagcgacatctgggaacagcgggttgccagtgcctgaagtattgcattaggattaaagttaagctttccttagacactgtttctcgctagaaaatcctctctatcctagcctttcatctgcttggtgttcttggatgaactggaggaagatctgaccacacacgttcccttggattcgatacccttggaatactccgtaagggaagtgctacagcggtatatccgtgcgcttgcggaattttatctgtgatcgtaagaaataccaacaatatgctataagttggatatgtgagtcatgctggccacatgagatgcacatgtaataaccaactctagcgctcctataggtgattaagagatgcctactcctggttatcgactagacagttgtagtgacatctcgccacctatcaatttaaatttacttgtggaccgttgaactccatctatcgttgtcgaaaactccatgtctctacggtcttacaccgggatcgaccaagtgagtacgacaaatattgataaagggtgaggcggaaaacaaaacaagcttttgcg

SEQ ID NO: 65549 - DNA, 1261 bp, Oryza sativa
tcagctgataatgctagtataagcaactccgagaagcaggaacagaaaaaatcagtaccagaagatggtcgcatgaagaatagtaaaaatgatcatgcgacaacaacatcgccatcttctccatggtcagaaaatatggatcctattgcatcaacttccaaaactggtaaaggaaaaactcaaggagctgaggccacagaacgagaaggagatggcgctgtctctgttgctaattcaaagaaagaatcgagacccgtctttgaagacaacattgttctgggtttagctcttgagggatccaagaggacattaccaattgatgacggaatgaaccctcatctatcactttctgaaactgagcaagacacagttgaggctgcttcatcaccgaaggataagaaaggtcaagaaaaaggtgaccagaggaatcttgataggtgatctgagtttaaaccgattatttatgctatatttgtcaccaagcctaccttttttttgtgcttgtgcaaatgcaatctgtcaaacctgtctatgtcaaaggtattgatcgtcgctgatactattcaggagacgaacctcctcaaatgtacttctcagccatttgctatattaggcctgtaaaatcacaaggcctctcctctccgttcaacatattattgtacatatcctgcagcctctgtaacaatcctagataaagctgacctgacctgtgttgcctcttgcatgtgcatttgtgatgcgaccacgttatcatggttcctgactggaatcagttttaggtctgttttgaatgatgatggcagtgtcaaatggtccttgcagttgggggtgatctgcagaccgttgcttgatgtccgtatgggccagtgggtgaagggttaaatatataatcttcccctccaaggctgtctgagttgttgggttgcagctagtgggcaattatttgtgaccacagtagttgtcgccatgaagccatctcatctcagccgcccagattggcctgcatcgtgcatcatcgatgtaatcttgtgtcaacttagtgtcacccgaccagagtccagatattggtgcttggttggagttgaacacggccggccggcagacatggccgctggtacgtagtcaagtgtggagaagattcataattgcaggccagaaagaggagaaaaggtgatgattcggaaaggtgacatgtcaatgcacacaccctgcacctactacatgcatctacatatacatatagccaagatcaccgggttct

SEQ ID NO: 65550 - DNA, 2642 bp, Oryza sativa
ggttttggaaattctacaatttctactaaagtagttcgcatgcatctacggtgaagtactgaagtggtagtttttctttgctttggataagtgagcgtccaaacccttcacacgttgttttggccgttttttttacaaattgaccattttcaaaaacttattcgaaactaacccctgccaaaaacttcaactaaaaataggccgtttgctcagcgccaagcgcattggcgctgaggttgggcatgtcagcgccaacgggcgtggcgctgacctcgtgccaccgtggcggccgggctgatcccccagctgacgtggcagctacctcagcgccaaccgcttcgacgctgagatggccaatctcagcgccaaagggcctggcgccgagttttggtacttagaggccggccgaggccgcccccagccagcctttcctctattcttccccaccccgcgtgctagggttcgtcgcactctcttctcccctcaccaaatctcccccaaatccactcaaatcgaaggggattttgtcaggattgagttggagatcgattgagaaggtaaactcctctagaaaccctaatttcccccatgttttattggatatttcgcattgttttggttccaaccgtggtttgataattattggctcggattggatgttaattggataatgtgggtggggatgtagtgcggaagacacatattaatcttgctccatttggttcatgttgatttgtagaattgagaacatatattttggaaagatgtgtggtgatggttagggctttgttggattgatgtgtggtgattgaaatggatgcaaggggttgatgtgtggtgaggtctaggcactatgcaggagaagggaattttttttatgaataatgtgtagtattttagttgaaacaattaggtattgataggtttggaagttttgggattgctatggtatttagagactattttcaaattaattaatgtttatgtatgggttaaatattgtagatggatagattggttcggcttcattatggtggttgtgtggtagatgaaagtaccggtggaagcaaatttgagggaatgattgttagacagttagtgtttcatgcgaagccaacatttgaggagttaatgtctcgcattaagcatgaattggattggagtgatgagtcggttggtatgcaagggagatacgatgtgggcggcggtgtcatgtcgcataagtttatgttagacttgaatggaaagatcgaatggcaaacatatatagatatagtattggggtcacatttcaaagctcttgaggtgtttgcatggaagaaagaaggtaggaaagggaagaaagaacttgtagacttgaacgaaagtccactcatagaatcacccattagttctcacgaactgtcggagaggtgtagtaggaaggaagaattaattgaggaagacgtggaggtgggcgagggagtaaatgatatggcggatgtggaggtcagggaggaagtacatggggaggagaatgtcccggtaagggaggaagtacatgcagaggagaatgtgccgttaagggaggaagttaatgtggaggagaatgtgccggtaagagaggaaggagatattgaggatggtcgggaggtaggagatgatgtggagttgactgaggaagaagcgaatgctaagaatgtaagtatgggcctaagggagttggttaggctggaattctatacccgagaggagtgtgaggaggctatgatacgcagtggattgaactcaggctggttggagtatgatacagatgatgaattggatgagtccgcttccgactccgatgatgatcgtccagtgcgtaagatgtcggagcatgaaaggactgtgtttgagaaattggtgggtagaaactcggaaataacacaattctaggatcttaccagatctgggctagcaattgctgatggggatccacaatatgacggtgccttcgaaccaatgtgtgatgaaccaaggaaggggttggagtttcgatcgatggatgatctgaaaatatggctgcagagttattctatccgtgtccaccggccgtaccatgtgaaggaatctaatgcgtcagtaaagtatactgtggcttgtctcgatcgccattgcaaatggcagattaatgcaaggaagagtggaggagataggtggcgggtgactagggtgggcgaagaccacacatgctgtagtgcggaagtaaccggcaagcatttgcaacttacttcgaggtttattggaaataggttacaggcatttgtgcgagctgaaccaactttgtctccagcagcgattgtcgaggcagttgagcaaatatggtactatcggcctacgtatggcaaagcatggcgtgctaagcaagttgctatgaaggtcatttggggagattgggacgaggcgtatgttcgcttgcctacactgatgcatgccatcaaagaaaagaaccctaccatgcatttccgtgttgaggctcaccccgagaagtcaaggatggtggagggagtacaaaggtgagtatttggatgtgcatattggatatttggccagtccatagaagcattcaagcacttgaggccggtgctagcaattgatggcactttcttaaccggtaaata

SEQ ID NO: 65551 - DNA, 2281 bp, Oryza sativa
agttacggcggctggggtgcaatggggtggacgtcactacgtcgtggttgtgagagataacacatgcagttgtcagttccctcagctccatcacttgccatgctcccacatgataaccgtttgtaagttgcgaggtttggatgtggaggtggccccccgaatgtgttatgatgcttccaatagagctgtgcaggacacgtactcccctaggtttgaaccttacctagatccatcgcagtggccaagttatgatggagagttcttcgtttcggacttgtcattgaagaacaacactcggggaagaagaaggacaagaaggttcaagaacgacatggacaaagcgtacaaaggttcaggcaaccgctggtcacaaaagccaaacaatacaaattcagagccggtcatgcaaaatagatgttcgctgtgccacgaactaggccataagaaaactaggtgcccgaagcgagacaagtctaaggatcgaccgaaaaagtgccgtaggaccgggggaggtggtgagggtagcacacaggttggattggatcacattcatattttttaatgttgtaaatttagtttgtattacatttgttaagttgttattttggcttcaatgtttactttctattgttctcctttccgttctcattgtgatttttccatttaatttcattgcaattactgatgattccattttcatttacaggatggagcactttccggggttggaggatttctacgaggagaagcactgggctccccagattgtgagcggagaggttagcatcaacaatattccatttgttttcacaacccttgtatatgtcatattgtcgctaactatatgtaattatgtttgtctactgatgcagcgcctgaagacccttcgagtcagaggtcacacgacacacatactgttcgacgaccggtacgtcccgtacttatggtgggcgaagctcttggcgttcatgaccatggcgcagcgaccggtgcctctgtacaacaccgctgctctgacggccctcgtggaccggtggcgtccagagacacacaccgctgctctgacggtcactctaaagtacgtcgccatgatcttgggtcttcctatccggggtcaggcggtcacaggtgacacagcgtcagggaactagaggcagagggtcgatgagtaccttggcgtggagcctccagtggcacctgacggtcagaggcagatgaagacttcaggggttcctttaagttggttgcgtgccaacttcggtcagtgtcccaccgaggcagacgaggccacggtgcagcgatactgtagggcgtacatcctgtacatcttcggcaatattctgttccctgactccagtggagacatggcctcttggatgtggcttccgttactcgcggactgggacgaggctggtaccttcagctgggggtctgctgccctagcctggctgtaccggcaactatgtgatgcctgccgaaggcaaggcggggaagcgaacctagcaggctgtgtttggttgatacaggttagttcacgcatgttctgttttgtaacatttcaatttcttgcttaaaagttgtaaaataacgtatgtgacgcaggtttggatgtggacgaggcttcctgttggtcggcccatgtggaggacccatcaggtttggccgcatcaggatgccgaccgacatcccactgtagctcacatgtgggaattggtcccatctccagtactaggccgcaggaatttggcctattaccactacacaaatgagatggactacctacagccagaacttgtaaggaaatcaccgttctatcgcacatgaaaatattttcttactatatagtactaaatgtgattcaatgtttttttattgttgttgctgcaggtggtatggatgccatatgaggcacaagaagtgctcgagctggaactaaatcccatgtgccatatagaggatgcgttgaagaccctttggtgcccactgatctgcttctatgcagtggagttccagatgtgcaaccgcgtgatgcggcagttcgggaggcttcaaacaatcccgcaccgtttctccacaagtatcgacttacacaagttagtaattttggttaagaattttttttgcatgcagagttattttcatgtcaacatttctgacatattcgagattgatattttgcatatgtgtggggtggaccgtcggaagaacaagaaggtcactgattgggcctattaccatttagatcatatcacacaacgggagaagttcgaggagaatgcag

SEQ ID NO: 65552 - DNA, 812 bp, Oryza sativa
acgacgcaggcgggctccttcgcaggactggaggtacacccccgatgtgcctcgtgctcgcactagaggtaggaggaggtgagtgcatggttcgttggatggatggatggactttatgcatggttcgatcaatggactacgacttttgctcgttgtgtatggatggatggatggaatgtttttatttcttatatgtatggacttaatgtatgcatggattgatggattctctgaatgtatggaatgaggttggacttgatgtatggatgtatggatatagcctgtgatgtgaataaattactgcctggatgtgtggttgtgttaagcaggactgggcagagagctgtgctgcttattacagcaggtctagaacctcagcgctaggcaaaatggcgctgacatactccaggcctgcgccagatgccttggcgctgagctcctagcccagccatccagaaggcttgctgggctgggccatggccgagctggctaagtccaacctcagcgccaggtgccttggcgctgaggttcccagggccagcgccattatggctggcgctgacatcccagcccgcaagccatccagaaggcttgctgggctgggtcatggccgagccggctaagtccaacctcagcgccaggtgggcgccgaggtgcccagggccagcgccattatggctggcgctgacgtcccagcccgcaagccatccagaaggcttgctgggctgggctatggccgagcttgctaagtcccatctcagtgccagggtgcgtggcgctgatgtacctagtctcagtgccatttctgttgg

SEQ ID NO: 65553 - DNA, 1321 bp, Oryza sativa
atcactctaatatgctatgaagttgtgataatttttaggaactcctattcaccccccctctaggcgacatcaaggtcctttcaattgccacataggatcaaaacaggattgtattggcacagggggtttatttgtctagcttgagaagttgaggggagaaatgtctggtttgttgttcaagtgggtaattcggaccatcgcaatagtttagggggtaattaatttggactattttatagcataaagaggataatatatatataaaggtttagtttatccatagttttttttttagtaaacttcactttgggccccctttattacccaaagtttcaccatggacttttgacaagcctaattttccacataacaacacatacaattaccaatggttgctttggactaggtcacatggacttcatccctgcttaaagcccaagccaccaagcagcagctggtggagcatcaataagatcaatcggtatggcacagcaattgagtattgcatcgtgcgagataaaaaaatcagtgcaataatttgtttatgcaattggcaggtattggaagtgcgggttcaaaaataataatttcgtattttggtattcgatggcaagggcttcggtggtggaagcccttagatccattctcataatttgtggccgcaaattgcacaattttgtagcacaaaagccagcatggcagtccaagttgtctaaccccggcctgcaaagaatggtaaacatatgtgatgttaagggaaaaggttagcttatttttaagagaaaaggttgctcctggttcctagaattaaaaatagtatgcctagaatttccaatgaaatgattatcataatatcataaacttgttgcaacctattctaatataaaattgatggtcaaaattagattcaccaagggaaggttcgcacgtggcaacctgtggtggcagggacagccaaccatcatagaacctcggtggatcgttgtgacagccggtgagtatggaggcagtcggacaggctgcaagcggaagggccagcatgggcatcctcattcgttgcaatagaagggagtaaccgctttgggctatgccagcatcgaggctcaacaagttgatgcgggtgatggccgatgcttctttggtgtgccctgcctgcagagtggtttaatttcctacaatctgttgatggtggccttcttctcttcccatggagatgatggtctctctagcaggtacttctcacaacgaggcaaggacgtccagatctacctgtagaccaatgtcagtttggcttcgattcaaggtatcgcttacatcaact

SEQ ID NO: 65554 - DNA, 8877 bp, Oryza sativa
  unsure (1)..(8877): unsure at all n locations
ccttctgagtgcttaattcggccaggggtattacaagatggaatagacctcagagacccattcaatgttaaaattttgagccagtgacccatcctatgaacatcaagccatattgggcaaagtgatcaggactgttttttagtatacaaaaaggaccgttcagggcctgaatggcatccttttatccccttttggcagaatagttctgctcaaacatgtaaatatcaaatcttggatgataggggaaggagggagggagggaggaaaaagttgccaaaaaaaaaactgcggaaagagctgttataggcttatagcaacttgttttattggatccgtttattctaaaaaaagttaagtctccgtttttccacattactcacaaaatgctttgaatcatatttatttatgtggttctagttctcttagctttacatagtccccggattgctaatgctgcagttgtgaggaaaagggaccaatccattataagttcatagtttattgtagataaaatgacttgttgccataaggaattaatatatgatcaacctggtttttttttttggcaaaaaacacccccgtcaatttacctggttaccacaatctgaaacttacattttgtctttaacctaaatgacttttgtggactatattgcagccactaatatatatatgtttcattttttgcagaatgatcttatccacggatggggcattgattacaaatttgggtactgtgctcaggtttgatgttgcttttaaatagatgtggaattctttatagttaaactaggtgaaaccccgtgtgttactgcacgagtttagtatgataataagtagaaataatgtgtaagatagctagaccacataagcttatataagttaatgtgatttatgataatttaaatggtaatgatgatccaaatgtaaaagtaaggtgatatggctttatgagaggaaaaaggagggatataatttggaccatagaataatcatataagagctagaaacaattaaggtgatatggcttatgagcgaagagagaaataacattagctaagtgagggtgaggatgaactgtgtagatatataggatattgtaaaaaatgatggagatatatattgaaatattatgtgaattatgtgggatgatgatttaaatgtttgcattttagagctctagaatttaacaaattatatagataatataacatgcttgcatgaggtttaagatgtaataattgttagtggatgataatgtggcatctttgcatgttgagctttaggatgtaactttataaaaaggtaggatttctttggctacacgtgggcattggcaatgcagggttgtagttcatgtctcgaaatttcttttgtgaagttttattagaggaatagtcatatattttccttaattcttcatttccttaagtgatgtttcactgtaataatacttttaccttaaccttaccaccaaccatacttcctttttcatcatttttagggtgacagaacaaagaacattggagtagttgatagtgaatacatagttcatcgaggggtacagacattgggaggtccttcagtaaaggtttgtacagatctattatttttgtactgcacgacaatctctatcagaccatatattaatgcctttgggcacatataagaagataacacatcaactttttcgatgcactcattcactttcttgagttttaattgactgatattcctatccatatagctatagcttttatttttaaaaaaagaatttggggagttgaagtccttgttattgatattttactagctaagtcatagtgacatgaatacacagccacacaggactaataactgaaatgctgcatgtgatgattgactaatagttaccattgggtggaaagtgtactaagtgtgacaatagaaacatacttgtatataatttagggatgatgccattcttaattcttatatacactacattgcaccttaataactgtttcatatattaatttaatcagcgatcccatggcaaaacaatgatccacttcaccagaaaatngcagaagcgcaacaacagatgagagtatgctgtctttgccagatccttagaatacacattgtagttatatttctttatgcaacctctcaataatgcatatgacgttacttgtaaacaggtgaaggcaggccttgatatgcggacaaagtaagctaagaaactataatctggggaatgcttccatatggcattatttgaaatatgacccaagctaaaacagtagaaccaagagttgaaccgaaacaagctaaataatcactgatatttcacttgtaaactgaaaatttctctgggttaaaactacaagtcaaacattatttggcagtttaccataatttgattttttttttcaagaatacacaagttttacccatcaatgcagcattctattctcttgcattaagatgaccatggtttgtttggtcttgtaggtcaggagatattcacgatcggagcttcgggatttccagaagcgttgggagcgggccaccagggaagacagagcatgggtcgatccgtttgctcgcccacgaagaaaaaggaagagaactgatagacaataggttagcgagtgtttcgatcatgatttgtatttttttttcttttgcaacaccagttttggagcgtagagttttcggtcgccacattatgtgtagaaaatttatgaattctttacaggtggtatctacagtttttttaaggtaacacatgacgaaactcccgaaaagtttgagcaggaaaagtttggttgtatggacatgtttggttcatttccacatattaacacactatcttttgtcaaatcttgcttgaaattgtagctaacaaagtttggcaaagaaataggtctaggtctatgactggtgcggcaaaccacagttatggcagtgactcgcttaaggaattatagcgtgcctatgtaacaaagttttatcaaccaaccaaaaccaaacatgcccttcgtgtggtactgtggctggttccagacatggggattttgctagcgtggtctattacgtccaggttctgacaaaaatcggttgaattccgcgaaatttcgaggttttgttgaggctcgaaagcagaagccgtctgagatttctatgagtttcatccaaattcaaatttaaattgataaaaaagaaaaaatcaaataaaatcttataaatagtgtgatattcatagaatctattgggatataaattttcgaaaaaattgttgtattccatgtatttactgaaatttatagtaggaaaggaaaaaataatgaaataaaaaaggaaaagaatttcagtttacctccttttctagatacggattgaaatttcagtgatttcgctcagaatttcgccaaagccctcggttttcatgagcttatcggtaaactcagggaatttgtattcaaattttggtttataaaatttgtttggaatctatcggatttcgcgaaaaccgttatttcgccacagagttcaaaacggaagaccatttcgaaatcgtaaaccctgttacatcctctccaaagctgaaactgaatctgataggaccttcagctgctcaactccttccctgtcccacgacgctacacggctgctattcggatccgctgtcgttgggcctaatataagcggagacaagacgaaaaacgtgcgatgctgttagcatgtcagattagtagaattagttgctcgcttgtcgatcatgcagggtcatgtagtacaattgttgtgttggtttttcttctctctacagctacgcttgtcttgctgctttgaacttcccatgattccatttcaaaggaaaacagaaaatctttctataatcattttttttcttttttattgtgcactcgtggctttttaggtactatttttttttgtgaataaatatgtttcaacatgcttgaatgtatgcattgatagaaaaagaacggcagtgaaatggacagatttttaccaagcttgaatagtggtgcttgaatgtatgttccaacatttcctttctacatatgccatagcttttgctattgtgagttagctacatgagatatcaaggtcatctaccttccaactcactttgacttggtgtctttttgttgctaacttgtggatccataggtcatcaggtccacatgtcataacaaaagtcatgtgactttaaagatatatgatctttatctatctcgatcaatatgtgtttcgaggagcaactagcagactgggagagtagaagcctcaaatggcaactactgcaaatctgcaatgtaatattaaaaaaggtcagtgtagtaggagtttgagggataggggggagaggtggagggaataatagatgtagctttatggataatctcgattataacaaaaagataaaacaaccagtcgacaatgaaggagttagagggtgaggggggtgagggggatgagcatctttgaaaggcaacaaagaatcaaatttcatggataatcctgactaaaagttagaagttagttaatactaatacatgaaacttagatattacaacaaacgatatataggtatcagaggaattcaaggatgactatccttgaaaggtgacaataaataataagagcaagaagttaactaatacgcgaatgaatatgctagctttgttgaccatcacacgataaaaaaaacaatttatagaaaaacatggtgaaaacaaaaaaaaacacatgagtatacttatattgacatggttcacatgaacaaaactatgacataatatgcatgaaaacgtttcgccgaacgcaataagaaacactttatatgcacggtgccgatctaaaacattattgttttttttttctatcatgtcacgcattgcaaaagttatagaaaaatattacttcaaccgtttcacaatgtaagtcattctagcatttctccgtttcacaatgtaagtcattctagcattttccatattcatattgatgttaatgaatatagacatatacatctatctagattcattattatcaatataacgtgaaaagtgttagaatgagttacattgtgaaatgaaggaagtacgaggtggaatactatacgagagcccgcttgtcttctggcaggcccactggcccactcaccttccacccggattctgtaacaaaatttcgcaggtatccaccgcggggcagtcaactggcagcaaaacagtagcagaggagaagcgaagcgatccaccgttccaccgatcaaggcaggtatcaaatccggcgtggaaaagccaatttcgcaaaatggtcctcgcgatctgctgccgagcctgagcctgaagcgagacaaacagatccacccccctcgtcctcctcctccaacccccacaaagctcagatctcgcgccccatgagcgctccctctcctcggatctaaaaccattcccaccccctctctctcctctgccacccaccggaggagatctgcggccatggcgggcgccgcgggagggttcgtcacgcgggccttcgaggccatgctcaaggagtgcacagccaaccgcggcaagttcgccgcgctgcagcaatccatccagtcctacctcggtgcgtgcccgtgcccgtgccccatcctcctcctcctcttcctcttcgctgccgggcattgggtggggggatctccctgccgcgacgccgtggcgctcggtttggtgggggggtgagttgactgtgagctgtgcgtgtcgcagatgccatcaagggggcggcggcggcgggacaggaggagggcggcgacgcggcggcggcgcccatcacgcaggtgctggcgtcggcggggcgcgtgctggaggggactcaggccgagctggtgctgcagccgctccgcctcgccttcgagaccaagcacgtcaagctcgtcgagcccgcgctcgactgcctccatgtaactcatcttctccttgctagtacttgtttacccggcccgatgctcatgtagcagaaagtgtgttacattatcgcttagcgccgatcattgttgagatgcgtggggagatctctcaccttagcaccaaagctcctgtgaacggcattggtccatcgcgtgaggcaaccactttgtaccgtctaggattatagttcgttcataccggactggatcagtcctcatttcacatttaaagatgtgttgcacaatttctcgagttttttatatactccgtaattgtttaggttggaggtggggggctgcttaatttttctagtagtctatgggtcttgcagacgcatcatcgaagtatgcaatacagtaatgagctttctttgaagaggctgtgttaaagacttcaactgtatatagagtgcgatttagaaagtaaattaatgcatcagaattaatagttagcatctgaataacaattgagacagcactgcaagatccacatcaactaacttcactaaaatgctacatatagttcaaaatcaaaaaacgcaaacatggtggacacacatgcctacttaagtttaacactttttcatgggattttttttggttaatgtgccaattcattttgctagtagcgtttaatgaaaatcagagtttgactcatcatgctgctatacatatagatatacaggtatgccgtttattagttatcgtctttgtatgacgtgtaagattcatttccctgttcgtttggtcaggcagtgcttctcatcctggctgagttgcagaccatatgaattccctaattgccactacttttcattacatcaaattttggacctagaatcatgcccgtaatatatgtttaccacctttacgttgccaacaaggttttaccttttcttttacatgctacaattattgaaaaatgtcttttcttttttttttttgcgggaattgaaatgtattttctgattgacctgttccattttcaattaccagaaacttattgcttatgaccatctagaaggcgaccctggtttagagggtggtaaaaattcccctctatttactgacatcctgaacatggtctgcggttgtgttgataacacctcctctgacaggtacacatcactttaagatgatattatgttggatcacacttttgcacatgcactgaactgggtgacatctgtgttgcagcactgttctccaagtcttgaaagtgcttctcaatgctgttgcttcaaatagatttagaggtgacctacttaccttgctaagcttattttccatgttgctcaaactttccatttattaggaagtttaggagctaacacgatattgtatatggcatctttgaatcatgctggcatgctaggcaaatgctaatcttattatccattatgggttggtccctgtgggcagaccttctcctgaagttttacccactaaatagtgcctacgggaattagatgaacatatcaaacactttgtgtacatagcactgcaacagggattatctaattttcgatgctattttgtttcttacattttctttggtgaattcatgaagaaattgcagttgtcttttacaaaaatcctgtaagtgaacacagtggaagatattaatctagctatcgcctttacaaggcttgtgatgggactttcatgtatctcccttttccgtatccatatagaagaataacgggagacaccatacataattttgagctgtttgtttgagtgcagtacatggagaacctttgcttggagtgattagagtatgctataatattgctctcaacaggtacatgttatatagccacctcatgatctgctgtattttgacttggaaacctgtctgatactttacaatatttccatagcaagagccctgtgaaccaggctacctcaaaggccatgttaacccagatgatcagcatcgtattcaggcggatggaatctgagcaggcaaaaaattttccccataacttctattggcattatgcaaagggagatgatttactgaaggaacgaggtgtgtgccttgccttttttgtcaggtttctgtaccacctgccagctctgcaatgaaagaagaaccatcatctagcacagaggaatcagagaatggtgaagtatccactggtaaccaagctgatgaaaaaattactcttggagatgcgctatccttgaatcgagctacagaagcatctccagcatctgttgaagagcttcagagtcttgcaggaggagctgatattaaggtagtgaaattgctttgcttattgtttaatgttactatcaggacatttcacactaatttatatgtattctattagttctatctgatccaaaaaaatcattttgcaggggttggaggctgttcttgacaaggctgttgaacttgaggatggaaagaaagtatcagggttcgttaagctttaacctgtctttagtgctgtatctgtgatgctacttacctgtccttcataggttgtagttacggattacatatgacccctaaccctcctccttttccagtggaatagacctggacactgtgaacataatacagcgtgatgcactattgctcttccggactctctgcaaggtttgtattcttattgaatagcttacaatgtacataatgttactttgaccggagttgaatatcatttacatccttgtagatgagcatgaaggaagagagtgatgaggttgctacaaagacaaggctgctatcactcgaactgttaaggttcaatcacatctttgttcttcggatgttgctaatcctgtttgtttcgatggtctgtgctaactctttagccttcagggattgctagaaggagtcagtgattcatttaccaaaaatttccacttcatcgattcagttaaag

SEQ ID NO: 65555 - DNA, 4411 bp, Oryza sativa
agtttttgtgaactgtactttgcaggctatgattggtgaatatttgggacaacatgaggagttccctcttgctgtgatgcatgcttatgttgattcaatgaaattttcgggattgaagtttgatgctgcaattcgtgagttcttgaaagggtttcgccttcctggggaggcacaaaagattgatcgcataatggaaaagtttgctgagcggtatgtgtataaagtcttaatgctacttttatttgacatgtcaaccactggtctcaaatggtatattatgacttgcaggtactgtgctgataaccctggacttttcaaaaatgcagatactgcttatgttcttgcttatgctgttataatgttgaatactgacgcccacaacccaatggtgtggcctaaaatgtcaaaatcagatttcgtacgaatgaacactgcgagtgatgcagaggaatgtgccccaaaggagctcttggaggaaatttatgattccattgtccaggaagagataaagatgaaagacgatttccctgattcagcaaaaactaataaacccagacgagaaacagaagaaaggggtgttgtcaatatcctcaatttagctcttccaagactgaagtcagcaagtgataccaaagcagaaagtgagaaaatcattaagcagactcaagcacttttcaaaaatcagggacagaagagaggtgtttttcatgttgctcagcaggtcgagcttgttaggccaatgcttgaagctgtaggatggcctttgcttgcaacattttctgttaccatggaggaaggtgacagcaagcctagggttgtgctatgcatggaagggtttagggctggcatccatcttactcgtgttcttgggatggacaccatgcgctatgctttcttgacatccttagtgcggtaagcaaattattttttctatttatggatatacactggttgttcttgggcaaacttctatatgtaaattcatttattgtctttttaattttatgaatgtaatgcgctaagttatatgaatgcaatatcttatgtttctttcttaaccttttgcaggtttacatttttgcatgctcctaaggaaatgcgtagtaaaaatgttgaggctttacggaccctccttggcttagctgacacagatatggatgctttgcaagatacttggaatgctgttttagaatgtgtctccaggcttgaatatatcacttcaaatccttcaattgctgcaactgttatgcagggatcaaatcaaatatcgagagaatctgttgtccagtcactgaaagagttgtctgggaagcctgctgaacaagtctttgtaaacagtgtaaaactaccaagtgattccattgttgaattcttcactgctctttgtggtgtttctgcagaagaactgaaacagacacctgctcgtgtctttagcttacaaaagcttgtcgagataagctactataatatggctcggatacgtttggtatgtcctgtctcttattgtttgtttggtattcctgttacattggagttcgattcaccacatctttgcagaagtgcaaaactagttggtcaaatgtgtttccatgttcttaaagaaaacctagagtagtatacctgtacttctggagccattttgatttgtgtaactgaacaccagcctgtcatctgtttgaagtgcaagtgcaatgcaatcaacatcaggatctttttataactgggaggcatcccaatattaaattttagctgtgatatacaatgtcttgaactcatgactaaatattttgttttttcatctgagctagtaacttacatttatgcatgtgcatgtaggtgtgggcgagaatatggtctgtcttgtcacagcattttattgccgctgggagccaccacgaggagaaagttgccatgtatgcaattgactcattgaggcagcttggtatgaatacttggaacgtgcagaattgaacaaattcacatttcagaatgacatattgaagccttttgttattttaatgagaaatagtcacagtgaaaaaatccgtggtctaattgttgattgcattgttcaggtaggccttcataagtcttatcaaacaattgaaatctgatgatctggtgcttttatataaaatgatgttgtaatgaaaaatcttgccatatgaacatgcagttgatcaaatcaaaagttggcagcataaagtcaggttggcgttgtgtgttcatgatattcaccgcggcagctgatgatgagaatgaacatattgttgaaagtgcttttgaaaatgtagaacaaggtaagtttaaaggaatataattgctagcattagaagtgtttcttactttctccaaaaatgttagattccattatcatcattgttttttgattaaatggatgtgtttggcagttatcttggagcattttgatcaagttgttggtgattgcttcatggactgcgtcaactgtcttattggtttcgcaaataataaatgcacacctcgaattagtttaaaggctatcgctctcctacgcatatgtgaagaccgtttggcagaggttaggatggtgaccacccttatattcacatctggacacttgatctttttggcctgatctttttggcctcattcttttcatttgcagggttgcattcctggtggtgctgttaaacctgttgatgatgttccagaggcccattttgatgttactgagcattattggtttcctatgctagctggcctatcagatttaactttagaccccagaccagaagttagacactgtgcacttgaagtgttgtttgatcttctgaatgagagaggtcataaattctcctcacctttttgggagagcatttttcatcgtgtattatttcccatatttgatcatgtaaggcatgctggaagggatggcctttcttctggggatgactggcttcgtgataccagcattcattctctgcagttaatctgcaaccttttcaatactttctacaaggtaatgtatgttgttctcccctgctgattttagttgcttcctagaaattgtgtgggtctattagaatgtcaactgtgctgaaacattttattttctagttatttcctttatctttaaggcaatacaattcaatcgtcctgcacataaatcaagtgatccaattggaaagttgtttgttggttcttattgtggtctttgcaggaggtgtcatttatgcttccacctcttttgggcttgctgcttgagtgtgccaagaaaacagaccagactgttgtttcaattgctcttggagctttagttcatctcatagaggttggtggtcaccaattcagtgacagcgactgggaaacacttctaaagagcattaggtatctcctcaagttctattttcccattaaaattaattgtgcttttgttgttcacatattaatgttaatatcacttgtcagagatgcatcatacacaacccaacctctcgaactcctcaattcagtaggatttcagaaaccaaacaatcagcaatcactttcaagagaagcagagaccaacggtcttggtagtagttaccatgatagcagggaaggaggagcttcaataagtcatattgatgaacaggatggtcatcaggaaacaaatgcacagactagcctagacaattcagaaggtgtggtagtcctgaaatatccattaattgttttatacaatgacaagtgcttccatatgaactggaatactgataattaacctaattctgtctttctctaggtttgccatctccatcagggagagcacaacctgcagtttccccacggggtcagacctttggacaaagaattatggggaatatgatggacaatcttttggtcaggagtcttacttccaaatcaaaagtcgtacagacgatattgtgccaccctcacctgtgaaggtacatgttttttcctcttgcacatattgattaggtattgatgaatattatgatttgaacattagcagatcgtactgtcattggtacctttccttgctatatcaatacatatgcaattgcatatccttataaaaatcactagtaatatttttttcctgttttggttcctatatatctggcaaaaatatggaaccgtgcagtaatttctggacacctgagttcattgtgtgtgaacagagctagctggaatgtttgaaatcagtaaatctgtagacacagttataaacttttgaaatggtattacttcgttgatatgctagccaattttgtttgcatattataagtagtaatcaacgcataattttgaatatatgtattctcttctgacatgttggctgttgtccattgttaatactatactatttgctgaaagtcatgttctagctcatctggcgtgacattcatgcaccttggaacttaat

SEQ ID NO: 65556 - DNA, 934 bp, Oryza sativa
cggtgaagtcgtagacgcccaacagcggcggcataataggccacccgtgtaggcggaggcaccagtcggcggcgacggaggcaggccggcggtgaagacgtggacgcccaacagcggcggcataataggccaaccgtgtaggcggaggcaccactcggcggcgacggaggcaggccggcggtgaagacgtggacgcccaacagcggcggcataataggccaaccgtgtaggcggaggcaccactcggcggcgacggaggcaggccggcggtgaagtcgtagacgcccaacaacggcggcataataggccagccgtgtaggcggaggcaccagtcggcggcgacggaggcaggccggcggtgaagtcatagacgcccaacagcggcggcataataggccagccgtgtaggcggaggcaccaatcggcggcgacggaggcaggccggcggtgaagacgtggacgcccatgaacggtggtgtgaccaaccaaccgtataggcggaggcaccagtcggcggcgacggaggcaggccggcggtaaagtcatagacgcccaacagcggcggcataataggccagctgtgtaggcggaggcaccaatcggcggcgacggaggcaggccggcggtgaagacgtggacgcccatgaacggcggcgtaaccagccaaccgtgtaggcggaggcaccactcggcggcgacggaggtaggccggcggtgaagtcgtagacgcccaacagcggcggcataataggccagccgtgcaggcggaaacaccagtcggcggcggcgaaggctagccggtcgatgaagacgttgacgcccatgaacggtggtgtgaccgaccaaccatataggcgaggacaccagtcagcggcgacggaggcagccggttggtgaagacaatgtcgccaccagcaatggtggcagagtacac

SEQ ID NO: 65557 - DNA, 901 bp, Oryza sativa
caaagttacggactactaaaacccatctgtgtaactataggagttcctgcattcataggagccatctgtggaacttcttccagcttaaagatctccagtgtagccctggaggtttttctttacctttatagggaatatgcagaaagctttgcatgtcattcccattagatagaaaagagagtttacagcactaaacagtaagcaactgaggactaaagagactcaacagcggcacacagccctgaaaatcaagtttaaatcctgcaaacggatctgaaactttgatgaccctatgtcactccaatccctgagttcttagatggtctgaaaatgaaaagtttttcttcatgtgcatcagttttgctgttgggttttggtaatttcaacttgactggttcctggggaagttccggtatggaatacatgtttgttactcgtttctattactagtatataaaaatgtaaatcgattccattaccaatgctctgtattttgaagttccattaccagtttgtgcatacattgatcatgaaagtgggacatcctcattgactactttgctcacgtgtttcgcagatacctgtttacgccaaaggtgtctcagttttaatgccaggacacgatgtaccaacattcatcgctcatcctgccccagcaccctgccctccagaaagggtccagtggccctcacaccagcccactccttttgctggttcctcatcaaatccgagctagtagcattcaaatgctaaatgccatctgcatcacagcgatccgcaaagtaattcttctgttcttctctggctgtatttcctgcctctccagcagaattcaggcaggttctctccacatatgtacaggtcttgtatctttgttctaaagcaagttctgctgcccctg

SEQ ID NO: 65558 - DNA, 2927 bp, Oryza sativa
gtccggtggacggtgacagctagccttggtggcaacccggtgtcctcgcgcgcagacaacaaagcggcgctgtcacgatggtgagatggccaccaccaccaccaccacgacacccccccatgcatgcaacgcaaaatccactcgagaaaacttgtgcgattcatccgatgatgagttttttttctcctttttgtggtggctacggcgtcaacatcatgctgagccggcggcgtgtgtgtcattagctgccggatcagcggcggaatctggacgccggcggcgacggcgacaggaggaatccggcagctgttccgttcccaacctgtccgttctcgtgggcctctctctctttgctgcgtttcatgtgccctcatttactcggctcgtattgcacacgtacgctcttgtcgatcaggcgtttcatactttcatttgccttgcttttggacagttaatttattattagtaccactagtagatcaacttggatgatttcttttgctggtgtaccaccaagatgttcagttagtaacagtaccaaattaggcattcatgcacgtgaggacatcgtcgttgtcgatttattttatcagtttcgacatgcgttgctgaggctcagctcgaggtagattggtggcgacactggctgacacggcggcagctacaacggctacttaggcccctatttagtgctcctactaattgtttactcctttcaaaaggggcaccacgttacagtagccgttatcggttagtgctgttgattacttgattagtcaattagtgttgcgtttaacagttgcttaatggaataatggttggtgctcagtgtccagtgtgccgccagaaactgagaaaagcttcggcctttaggctctgttcgttctgaggagataataggggagattgattctcgttttccgcgtgcacgctttttaaactactaaacggtacgttttttgcaaaaaatttctataggaaagttgctttaaaaaatcataataatccatttttgaaatttaaaatagttaatactcaattaatcatgagttaatggctcacctcgttttacgtatctccccaatctcctcgatccccttctcctcgaacacacccttagtcatggaaacgggaggattgtgtgagccttcagcttgctggcatgccaatctcctgcaatgcaagtaggagaaaaaatggataataaattgcgtattgtccttctgttagtgtacaagtacagattactgaggcgacacgaggcagcgtatctgatgcgatgcctattgtagacgcagaaattttgggctctagatcctgggatgacatgatcggaatcataactctaggactaccaaagttcacccctttttttcatgattttatccatacgatgggctaaaaggatgggacaaattctacagcaaaaggcattccttggattccgccgtgaaacaggaataggagggatggagcagtcttgtaccagacgactcctcaacatcattttagtctccaatccatggtcatcagcgtcccaaaaatcaaagggttcatcattcttatacccatggtggtatctcagtaaattgagatgcttctttttttacacagattctatcatgataaatcgcaattcttgtcatttaaagcccaatcacaaaacagatctacagagtaattatgcaaagcgcatagtagtaacaaaaccaaattcaccaattctaaatttatctgtgactatgtctttttttgagggggagtggacatgcctttgcaaggcgcactcatgtttcattgtttcacatggacaaggttgtaaggttaaagggtgtaaaagaaaaagaaaaacaaagctatctgtaaccacgtctttagcaaaagccatggatgtatagtcacactttcattgcctcattcttgttagacagttattttataagttgttagactgtttgtaccatgaacttcacacagatcctaaatctaggcccccctttataacatgagagttcacttgtttttttttttttggaaatcaaataaaccactcaaaaaatgaaaaaaaacatgtgaaatttcttctctgtttttaaaaagaaaatcagagagctacgaagtgaccataacttgttaattccttttggtagaatctactcacttaggttcaagatctaaacttaacatgcgtgattatatatacgtctaattattttttcatcgatagacgatgtatctatcgacacgatatccatggtgactttgtaaatcaaagtgtatattcgcaaacgtcgacaacgagacgttcatagtcacttcgtcaatctcatagagtgtagtgttacgagtgcttacatagattatttttctttcgtttagagcaagtttaatagtatagcccactattggctccaattcgtctatagccgatctaatagccatttcatataatagttgcttactattctattaatatatggtcccacttgtcatacacatattacgtcttggagtccgtgctgcagctggctacagatctgtagcccactacttttttctctcatcttttatctcattaaaatatgtttacagctggctaatagtctgctactgtacctgctcttataccgtattaaaaaaaaaatcagagagctactactatcacaatcttttttgaaaaaaaaaatggtgctgtcacaatcattgctcattcttagcgctggctaagcaggtttaaaagcggctgctttgctgcacttgtctttttccccttccaccccatctccgcctacgcgcacacaagcgtaacagacgctctctcacactctcctcctcactcgccgctcgcttatctccccaatccaatcccctgccgcgcgacggctctgcgagattgcaaggctagtgtagatctgtctctttcctcc

SEQ ID NO: 65559 - DNA, 4199 bp, Oryza sativa
aagtgctcgtcaggtgatgcccgcattggaagatccttcatggatgttcgcatggtgaagagcaagtccctgcccatgattgcttctgccgccgtcttcttgctgctgctctccgccgcgctgccgctctcgcagtcttacacttatgagcaagatggtatgtactgtccttttggtggttttgactgttgcaaagattcagaattcatagctgtacatgatcatgaattgatgacatcattagggacccagattatttatggtttgatgacggagctgtcttgtactatcacattttactccaaaaatgtgttctgtggcaccttatttttgtgctttgtttgtgtttatcagtgtttgcaataaatggcttgtacactgcacttgggtcaccttcagtgcctggatggattacaaacggtggcgacccctgcaatgaaggcggcagggtgttgaatgcgtggtctcaaatattacctccatgtatgatctgctattacactttcgttttgttaatgttgtttgtttgattacctagttatctggttatctgaacaatgtgatatttctggtagaactctcaatgctgcaaatttgggcggacaactgggtaacacactggggaatttcacatcgctaatcaccgtgtaagctgatcattcgtgaagtttaagattattggtgatttcctctcgaattgacactgttattgacttggttcttaatgcttcttggtttacccaatgtagagatcttagcaacaataatatcggtggaaccataccagataatctgccaatcacattgcagcgtttgtatgcccatttgatcattttgttactcttccaaaccatctatgtggttattttaatcttttactatggttttgcttgtcaattacagtttcctttctggtaaccagctaagtggtagcattccaagtacattgtcgacacttacgcttttgacaggcttgtaagtatattgttgcctacacattcacaagacttcataaagttagtgctttcagtgataattcttgcatttgcaggtccctcaataacaatcatttatctggagagataccagatgcattttcaactctaactggacttgcaaatttgtaagagcaagtttaagtttgctctaagtgttattctatactagcatttgttgacaatgtgaagtttcttaccaaagtgatcaaccttcttgaatagagatttttcttccaacaacttgactggtcctttgccaccttcaatgggaaacttgacagcattgactagcctgtgagtattgaagtttattgcactgtctttcaagttgacttttcactagtgtcaagtacttaatgttatactatgatcacaggcatattcagaacaatcaaataattgggttgcttaatgtgctgcaagatctccctctccaagatttgtatgtacacaaaactacagttttttttacttaattcttttctccaagaagttcaggaaacctgctatttcagtaaagataatttctctctcttttttcacgccttgttttctgtggtgactaattcaacaggaacatagaaaacaatcttttctccggtcctgtgcctgtgaaactagagaacataccaaattttaagtaaggaacttccccttgattgagttgtttctgtcgatcgttgctctaactttaatgtttaaaaatcaattccattgctcgtatactcttttaatattaagaatcaactagtttttcatgtgcatatttgtgtttagcgaaagaagaaaagttcattcaaactaatgtaccacacaggaaggatgggaacccattcaataccagcatagccccatcagcattgcctcctgctgcaccgacaccattaccatcagtatcacctccagcagggcatgtccccacaaaagaaccttcaaattcttctattgcaccagcagggaatgccccatcaagaaaaaacaatgtttctgcaatgaaatttgttggatacattcttgttggggtggtatccgcggtggttctcgtgctaatggtgatgttttgtctatccaagtacaaagaaagaaaatcaagagatgatgtgtatacaaaaaaccagttaggaaggtctcctcaaaagcttggagaacctaaaatcaaggaagtttcagacatcaaggaaccaccagttaaactcaagaataatgctggaaaaggttgtcattgttctcttggcaaacaaatgacttccagtttttttactttattttttgcccattgactaaactgatctcttgggcggtgacagcttcaaatgtgatttctcatacaagggaggagcagaaattgaatgtgtcaacagcaggtgaacaattttatgcctaaaaaagtgcacatgccctttttttattcgtcactattctgcaagttttagtatggtaaagcttaatagaaacattggcatggcagctgctttcttcctctcttgattttgacattccaatatttctttgcagcagcttcagatgcagtttatgattcaagggaagagcggaagccaggttcatcaatgtcaggtaaatgactcgaaactaaattacatgcagaagtgctattttactgctctgcgagtttgagtatgtcaaagttaacatgagaacttacatggcagctgctcctagggtggttacaatggaacaaaaagagcatgtgattgatatggaaaaaaaagataattttgtggatgaacaactgcatcctccacagtctgctgtactgcgtactgaaaaggtcactgtacatcccagcgtgcgtactagaaagggaagagtaccttcagctgggaaattggatttaactactaccgtcaagtcattctctattgcgtcccttcagcaatataccaatagtttcaacgaagaaaatttgataagagatagcaggtttggtaaggtatatctggcagagcttccggatggagaggtacaaaactgttgggcagattttctagtagttactttagcaagaatttgttgattataccatcgtcacttctgaactgtgatatttgctttgcatcagctactggaagttttgaagattgatgctgctaactcaagaataccagcggatgcctttctagagctagttgtgaacatctccgaactgacgcatcctaacatactcgggcttgttggatattgtgctgagtttgatcagagattacttgtatatgagcactgtagcaagatgactctacatgatgaacttcattatgttgatgactcaaacaagggattatcatggaatgctcgcctccaagtcgctgtgggggcagcaaaagcattacagtaagcaaattataacttttctatttttttcttcccaattttgtgaagtgattctattgatttgtgaaaatgctatgtgtatttttttttttgtagatatcttcatgatggttgtcaacctccaattgtacaccaaaattttgaaccgtctattgttcttctcaacagcactttagttgtgcatatttctgaatgtggtcttgcagcactgtcatcaagatcagtatcccaggtacaataatgttaatgaaaatattttggcatcagactctttggtgatgctctggatgttcagtatttcggatgccctcatgcactgctatttaagtatttatagcatagctgtgcatttgtaattataatgaaggctagtgtaaatgaaagaattgtatttaggaatgggtattgctgattgctatgcattttcatcacattgcatcaattgagatgacagagtcttttgtttgtttgtttgcgaggagagatgaaagagtttgttatagaaaagtgatcttgttatatttcgcagggatgcttagctgacagcagctaacaaatttaggcttcagataatatttctttctagatctattctcaatctcattttttaattgccatccttgtattccagtatagacgccccccgtgtcaattgacattgctaacttgtgaagctgttcttcttttaatctgcttaggaattgctagtgtttccgaaacacatactgtcatgtttagcagtagttatatactttggaatttggatcgcaacagaataaggttgctagtttatttttgactttttgagtgaatgttactatttctttattgataaatagtgtactctttttt

SEQ ID NO: 65560 - DNA, 2395 bp, Oryza sativa
  unsure (1)..(2395): unsure at all n locations
tttggagttgtcatgttggaacttcttacagggcgtaaaccttatgacaggtaacattccaaaaggacaatatcccagacccacttccacttagctaagtatccttgtttgcttgaagatggtttctaatttttctcatggaaacggaactgcagttcacgtccacgtgctgagcaacacctggtgcggtgggccannnnnaggtttacgatatcgatgctatatcaaagatggtagatccctctattcgaggccaatgttctgaaaaggcgttgtcgcgttttgttgacattatcagcagttgtattcaggtaagatatttgatattaccatcaacaccaagatggatcggtgtggctgacctgattcctcttatgcagcatgagccagagtttaggccctcaatgtctgaagttgtccaagatttaactcgcatggtgagtgatgcaacaaaggcttccatgtaggcgcttccaaaaggagaaaaatcccagaatcctcaattagctcattgctgaaaattcaagagttatctagtcatattacctgcttgcaagttgatcgctcaagcattcgaccaggcgtaggcagatcaaggaaagttcaagcagcgaacttgtgaagtggcgatgtgcagattgctgcatccccccccccccccccctctttctccaagccattttatccctgataggttccccatccttagacaataatgctcctctgtgatctctctataatcctttagactgtactctgctatcaacacctcgaagtgcctggtttcagatcacatgacgtgatctccgtagttttttagacgatatgtaaatatactcagaagtcagaagtgaagaaacttttgtacgtcagtatgtcgagtttatgatgacggttaggcgcagatacatcagctctaggaaatctgaatattttcctgagcattcacaagtttgtgtactacatatgcattctagtcatacactatatatgcaacttctagcagatcatcataaaccctatgtaagcattctggtcatacacttcgtgatctcttctagcatgagaaaggtttgctttgcattgcacatcttatctgctctgttagcaccggggaatacaccagggttcataaaactgatgaaatacaatcggattttgtgaaaaaccgacgttcaacgtggctccgcagtggttctcctctgaaatttcaatgggtttcatccatgcgaaaaccgccgtaccgccaatgtccaacatggaagatggtatcggaattgtgaaccctggttagcacttaagtagattcttgtttgtctccaggaaaagaaacgagttagttccaaacttcttcttcaaactttcaacttttctatcacattaaaatttttttacacacataaacttttaacttttccatttcatagttacaattttaaccaaacttccaattttgacgtaaactaaacacacccctagtaagtttctagcatagcattgttaacttgattactctgtccgtttcatattgtaccgtttcatattgtaaaatgttttagtttttgtccgaactgattttttttttagtttaatcaaatttatgttaaacaatatagcagtattttcaaccaaaaataagtataataaaaaaatattcaatatattcaatggttgatttctaatgaaattaagttggtgttgtagatgaccctatacatttaaaatatttaatgaaatgttaaaaagttagttaggtggtgtttagatccagggacttaattttagtctctgtatttagacactaatttggagtattaaatatagactacttacaaaactaattacataaatgaaagctaatttgcaagacaaattttttaagcctaattaatccataattagagaatgtttactgtagcatcacatagtctaatcatagattaattaggctcaatagattcgtctcgcgaattagtccaagactatggatgggttttattaatagtctacgtttagacactcattctaatccaatgcccatagtacatttgcagtagcacacgagtattctgcgaggagtacgttttatcctctgcaggagtaaaaacgtgcgaagcgtgcaaaagcaaaagcactgcagtgctgcgtgggcccgcaccacctcacgttccccccctctccgagattagtaattttcattgctatcgagagagccagccagtagatagaatccgtccaaatccgaaaaccacgcgacccaacccaaaagattaacaaaaaaaaaaaaagacaaaaaaacagccggcgaaagtgaaacaagaaaccgccttcggacagagagaaaccaccgtgacgacgacctcctcccacacgcctatcgtcatcctcgcgatcg

SEQ ID NO: 65561 - DNA, 5022 bp, Oryza sativa
  unsure (1)..(5022): unsure at all n locations
agagttccatactaattatgagcttacccattcttgttcgcaggaatgtgaagctaaattttcagagatacaagcacgctactctgcatgcgagtaagtgttgcatcattctttctatgttgtactagcttgtccacatgaattcagtcttataacgtcttgcagtaagtatgtgacgataaattagtaaattgctaaccttgaactttaacctgtgttgagtctcctgtcttggcctattgtatttttcatgcgggaactggatgaactctgaaactgattacacaagatgcataatttgtgtctcatggcacataaaagctaaatagacacgatttataccttatattatttgccttctttaagttggcctatgatttctaggatctacaattagaattacagcaggtgatttttttcctactctctgatatagttttccaattaggacaagtttggtggtaaaatggtgttttgctgtctagcagtgaactggcttagattttagaaattgttgtatgagggcaagggcactggtggatctggggtagagccgtagaggtagggataatactttatgatcaattgatcattgttgagttagctttgggatcatcagcatgagattcaaagaaagaaacagcaagtctctcaagttgggcacagttcgaacagtgcgtattttacaaaaagaaaaaatcttgctatagagaagtattttttaaaaaacaaaataaatccatttttcaagattttaataattaatagtcaatcaatcatgtgctaatgactcgccacgtttcaaatgccaccgataagctcagcctaactcctgatttgaacgtagcctaaagcagtagttgaaatttgaacagtcgattcaactcttaaacatcttttaataagatgtgctgagtntaagttactctcctcatattcagcttttacctagagccaatatacccaagacatttcaactggctgtggtctagtatgcatagtgttttgttctgcagtaaaacaactcacctgttggccattgatagaacatatcatattcattcaacttgcttctttgcagtgcttggtttgaggagctccgtaagcggagagttgctgaattaagaaatgatctgaagaagtctgaaaattttattgggttagtgtttatgttgttacatttcagtatatgtctaattcttgatcttctttttagcatttcaaatttaatttcacaataatttagtttgaatataaggcctatgattattgatttcagaaaaatggtcattccatctggttttcatcttttgtacacttacataatgtgaaatctggtttcctttttcctgttccagatccctgcagtccatgatcaaaagcctcagcaatagcaagcatgatgatggcaactctgaatgtcacactagtcatactgagtcatgttcaaataatgaaaatacagctgataacaattcatcaagcaaagcattgtccaaagatagatcatctgctgctagttttacagaggaagcaagcaacagtcagaaatctgaaaaggtgcaacactgcgatactgattcaattcaagtgaacaatacttcagcagaggctttggtaaaaccccttgttgaaaaaaaggtttgtgctgaagatggtttgctttggggctctagaaagaaaagggccgtgagggataggaggacttttctgatggctgataatagttgcagagctggcgagaatacatctacatcacacatacagacagatggttcctctgaaggctatgcaaagaagggcttgaaaactccaaatctagaatctggtgtgtctgtcgttgagaaagcaaaaccaaacttggcagagattttgaaaactatatctactcaaagtgactgttatatgttgcaacgccgacttgatgtccaggtatgatggatagatcttgtaaattcagtcaagtcttgtacttatggaaaattgattagagttgcacgctgtttgttctgatagggtatcaagcaaatgaaacctttgtggatactaagagtttttagaacccattttagcgacttcaaaataaagtatacatgtttatataactgtttgtgctggaagaaactttcagtgcctttctgcagtttatgcatttcaagatgaaaaaatagcagacactggtatgtttacattctatcttatttgtcacttttgtcacacctgcagcggaagcggactagatacaagaagatgattcgccggcatatagacttccgtatccttcattcaaagatcaagagtggcgcaacatcttctaccaaggagcttctaagagacattctactgtttgtgaataatgtccttgccttctatccaaaggctacgttagagcacatggctgcaattgaacttcgaaatattgcattcagaacagtgcaagagagcgcaagcatgccctctaagagttgtggagtaacaggagcagcaactgcccctttagtgaagaagaacacccgacccgtgcagcctggaagtcatgggcctcatgatgcaaagagaagcaaagtttctttaaaggggactggaagtactgtcaagcagggtgaggccaagggatcgcgtggtggttcatcagtgacagctaatgtaaaaactatgcagagaaatccaccggccaagaagagaggcgttgggcggcctccaaagaatgggcagaagcgtgctgctgcacagcaagatagccctaacaaaggcaggaagaggacccgacgctgaacttcggctcaaaatgcccaaatatacaaaactgtgtacagacagcgtatagctagaccacatagtgtcgtctctttcagtgtttacttgttacctggcaaagactaggtcggaaatcagaatgttgtagcagggagtagtactgtatttcctgttgttgtcttaagaggacagataggaaagaacatttttataggcagaaactatcaacttagatatatatagtatatctcttgctttgtgcaatgctgatggtttcttgatcaaatgcatgctatgatactaacgcagaaagtttacctgcaaattttgaacttattaggggtatatattcagtacaatgtacagtggcttgtcattgctcaagaatcatgatctgtatagtacctgtcagtctccagtaactgcatgatctgcatctgtatagacgacagtcaatacttactcaaggcgtgtttaggattgatgccattttaaaccatactatattttttaagttgttaaatatgtggatccatttaatttcttgtcaatttttaataaatacataagaaataatgttaaaattttgacaatattgttaaaaatttggtaaggtttattttggctacaatctaaatggctcctcattcctgtttattttaggagggaggaaccggtgctttgattgatgatgttattgggccggtatgtcgttatgatgggccgcggcgggccggcccaaaagcagcgagcccgaggaggagccagccaacaaacaaaccgtgcggaaaacccggtcgccagcggctagcccaaaaaaaaagaaagaaaaggagaaaaaaaagccgccgaggcggctcgcacccgtcgccatcacggcaaatcaccgcgcggcgcgagtcatgggtgcagcgaatgcgaaggcgtgtgtgtgggagagagatggggtccgacgtggagccagccagccgtgggaggtggcggtggaggtggaggtggaggtgatctggggtttcatcattcgtgttccttgtccttttgtaagagaaaaaaaaaatagtacttacttacattgtgaaacggagggagcagtaacttttgctacattttctagtacatactccctccgtcctaaaaaaaactcaatttggaaggggaggggatgtggcaccagtccagattcattgtcctaggaggggtcacgtcccttctaggttgagttttttttggacggagggagtagtttctttttcttctaatttcgtatttacgcgagacacaccactgcacggattgagatcctctgcagtcagatgcacgctgcctttgtcacttacatgtgggcatagagaacatcgggtccacatatcagtgacaaagtcatataatcttgatccttactgcacatgcggaacgcgcgtacacacactaaatgactactatataccgttacacacgagcttatcaccgttacacatgcaggccatatagacatgccggtgagtgtaccatcaacccatcatggagaatgtatcgtaatatgcgactatacctttaacacgttctaaataatagatttgagacgcataaggatccggtgcagtcgtagtagagactgcaaaggcagttgggaccgttttccatcattagatcgagaggcaatcaacgatccagacatgtgctatatcagttttaagtagtactaactgctactacaatactacagggaaagaatttctgatccaatagtagctctaggacagctatagctactgcaggggatcccaatcctgtttgagatcaacaacaaattcatgacctcttttctatagtgaaataattagttgatgtcttacatcttgctagaaaaatacacggatgaatgtatacatattgtagaaatgatggataaatatgtattgaaataaagtggaaatgatatgggacatgcttatatattaagctctaggatgtattaaatagtaaatgatatgctatatttgtatgtgatttaaaatattttgatagatttgtatgttaagctttaaaagctagcgggattcaaatatataaatatattccattgtgagcgcacttctatctatcatgctctaggtgttgactagatgtagcacggtcatttgataaagtaccatactctacatcttattaaattttagcagaatatgtacacttgtttttgtttttgagaggatacctaggagggtgtaggtacacatgagttatatacaaagacaaagccta

SEQ ID NO: 65562 - DNA, 1080 bp, Oryza sativa
atgtgatccaggcctggctgaggagcagctcccatgcctgcgcctgtcacattaagaagcaattgctggagccagcgccttgttgtaggatcatcctgtggttgtcaaaagttggtgtttcaaacctttcatttagtattaatttatcaagtacaggaataagaaattggtggcagctgatgggttaatatcactcaccctaagacagttattgaacgtgccatccttcagcatgtcagggaggcaagtttgtagtgcagcacatgccctgcatagacgccgcgtagaaaaaaatagcctgttcagaatatttaagtaaaataatttgatagcacacaaatgtcagcacagacctggaattgtctgacagcctaaggtaacatcggataatgtgcttcagcaaccttgtggaaggctgctcagcaagtgaaactaccatgtttgctaaaacactgcctacagcaaagaaacgctcagcagtggcacaaatgtagcgcaatccaacatcatcgaggagaatcttctgaacaatgaaggtggccacctacaaaaatatttgactaaatcagtgaaataataatggttcattaggcctagcttggcaaatgagatttatttctggcctcatttgaactttgagctctcatcaacaaaagaagcttaagttcctcatgagctaccaacttaactatacctgtgtacctgtgtacaaacttaactatacctaccaagtttaaacagttaggtttgggtcataaaaaaatggaattaaaagtggcagcaccatatagttgccaaattgccaacctcctctcaatacatatagcacaatccaccttttaggcttataaaacgaaaggtggcatttgagcttaacaaagggaagcctggttgagaacaagaaaattccaaagatgagcggcagcctgtaataagaagattctaaagatgacaggtggcttacttcacactaacctggacaggctatcattattcatggtagcagaaattttaacctagccaagctacaattcatggtaacaaaaaaaaaaattacacacaaacttcagacagcatcat

SEQ ID NO: 65563 - DNA, 1245 bp, Oryza sativa
atgtcataaatccaacttgggtaactcaaaaggcaatttctactgtaaaatacatcatgaaatgcaagcaaccagaagacaacttttccagcattaccgccctatttcataagattatgtacctgaagaagtgcaagtgcattgcagactcggttcgatgcacctggtgacaatgttgggggtgaaagtgcagagtagattgacacaatttcctgtatgtgttggcaagtatggatacaccaagtgagtaagattgctgaaatttgagtaagtttggattctaagcaacaagtgctaatttgaacagcatacaatatttgacctcaacagcaaactgatgacttgagagtaggattaaaactataaattatttgtgagtttaatcttcaagcatgcaaattgtaaacatatacgaacaggggaatcatgcagacctgaagaagtgcagcaactgttccaaaagaatgccaaagaagtggggccagatcttgaaatatctctcttttctgaaaagaaaggattgaattttttttgaccaaataaactggcttatcatgttaatgactggaacatgaagtctacaattattttgatcaggaaaattacagaactaattaggtacaaaacaaaaatttctaaattagttactacaaagaacatagggttctaaaattttctttagcaaaacattgctgttgacaatgaagccatctgctctggaatatggtaaatctacaatccaggtctgtgtgtatgagcggtaatctgtataaacactttacagcgtaaaacgccttaaagagttaatggaactctcgaaggctacccataataaactgagtctaattcgctattgtgctacccaataataatggtaatctagcgggaagccgggaagtttcaccgaccacaataattagagatgttaatgttatcttgatcaaaacgtagtgtaatagcccatttcatgatagatgcgcatcaaccatacggtaaccctaacaccaaatcaccattcaccaaccctaaaaaaaccattgacattcacaatgctaaggcgaaaccttcccccacaggcagtgtgaattccacaaattaccaccagtgccccagatagggtaggctatagaaccctagaagaacgcgcgctggacctttgagagctcgaggagggcgttctcgcgaagctcggggtcgcagaggtcgagcaccagctgctccgccgacgccatcttcatatccttg

SEQ ID NO: 65564 - DNA, 5346 bp, Oryza sativa
atcaaaaaacacacaaactcgatcaattccacacatgtagcaaaataagggattcgactgctcacaggctatacagcacggagcgaactaggacgaaatggaagggatcacccgaattccgcgacggatcaccactctccgctcctctccggcggcgccgcggccgccgtgggctcgccgcgacgggaggagaacgacggcgaagtcggaataatgcgaaactgcagccgaggcgaaagccgaggggagagagatcccctctgtcgccccctatggcgccacacggacggccaggatcaaccgatcgccgagatcggacggtccacattgcaccgtccgcgacgaacgggcgtgatgaagcggaggttgcgtacacgggccgaggacccatgtagatccgtgatggcccggagtttgggccttattgggcttgaggttttgtggcccgtaaagggaggggtgtatctgcatatttgacacccgcggcgctgcgctataaagagtggctcactagggtttacctccgcgccgccgcatcctccttcgcaagcctcgcctccactccccgcgccgccgccgccgccgccgactcgccggtcgtcaccctcgccccgcagccatggctgagcaggtaaggcccggcacctcctgttcttccgtcgagcttctccgtcgcttgctataggagtcagttctaggtgggggcacgttgccatgtgatgcgcgtgttgcgatgtgagactcgatttctcagttctcgtgatttgggctggaacgctagcgatggaaagttagtgtgatagtgtcatgaatttgttgaggtcttcttgttagatgtggatttgttgaacggtgggtttgttatatccgcactcgtaattctctcgtgttaaattagcaatagaagttttgggttactggatcgaagttttgctgagatatagttactggatcgaagttttgctgagatgttccaatagattaacgcaaccgtggatgtattcgatgtttgggttcattaccgctgccgtgttcatggtaacgaatgataggtctgtgcttaatattcgtgatgctgcagttgtgtgtttgtcacgttttaacctcttttatggttgatgtggagcttatctgctactgaattagatacagatttgtattcttgtttcccatttgttcaatccaaataagtgatgcaagtggttctagctatgttgtgtagagtgttgatgtttttcatccatttctgttgtgcagactgagaaggctttcctgaagcagccaaaggttttcctcaggtagggttcttctgctctttcaatgctttatgtattctgtgagcagttcacatgtcttaacgatgtttttctgcttcattttagctcaaagaagtctggcaagggtaagaagccaggcaagggtggcaaccgcttctggaagagcattggccttggcttcaagacccccagggaagcaattgaaggtacaataggttatttgcctctttgtttagctgattctgtctaaaagttgtatgctgtacagaagaactttggtgttttcactgtagccactgaatgatttgtagtgcgttaactttaaaattgtcactgaaagaacagttgtttgtcatgcattgacagtatttgttaagttgtttttatacactactattgccggtatgtttgactagcaatttaaattcatctgaatattacagacctgagataaatgctactatttgttttaagtattgaacagttgattaactgcaattctttctagggacatacattgacaagaagtgcccattcactggaactgtttctatcagaggcagaatcattgctggaacatgccacagtgccaagatgaacagaactatcattgttcgcaggaactacctccattttgtcaagaaatatcagaggcaagtaaactaccatggattatatacttatgtttcctttccttttctccgttctaacatagggtgcaaacctcccaccttgcaggtatgagaagaggcattccaacattccggctcacgtctccccatgcttccgtgtcaaggaaggtgaccatgtcatcattggccagtgcaggtaaaacttaactcccataccttagtttttgactccttagaatcatcttaaataacagaggtgctattagttcaaacattgtcagttcacccagctagtactgtgagatttggttgctgaagtacaatttctgcattttcaacaggccgctgtcgaaaactgtgaggttcaacgtcctgaaggtcatcccagctggatccaccggcggcagcggcggcaagaaggccttcaccgcagcatgagcttgtactcgcattattcatgggtagtttatagacagatccttttgcttgaagtcctggcagggctggtgttttgaccctatcgatttggatattgttcccaacaaaacgaagtcttatcatcagaacgtgttttatggaatctactctatgcaaagttttgttaagatgcctgttaatgctcgatatgctgtgatccttgattttcctggctggctatgtgttgacgcttgtttgttgtgtttcttcgaaagagtattggtggatatgctgtgcctgtgcatgactgagattctgaataaggttttcccaaacccaaacctgacctaattcagtttttttgacaaggcttgaatcttataagtttatcaatggacctgacatcttcgccgcgaggcgaggggggtgtgggcggtggaatccggtggaatctgggcgaggcgccacccgtgccccctcctctgacccccgccgcgcgctgcctcgttgcgttgctccattccgcccgcgcccccgtgctcgtgccagtgtggtgtgcggtgtgccacccgcccccctttcccaatccctccggtctcccctggaaaaacattttttctcttcccaaccactaacacagcaccggcggccattaacgcgctccgccgcctccgccgatcctcggctccggctcctcctgcagacgcgtccgccgcagcggccacggcggtaagttcctcagttgtccccttctccgcacgaatcctagatcgttctgctgcgtggggttcggaggtatctgctatccgatcgcgtgctcgtgagatttgcctccgcttttgattgggagtaatcccagcgagcccccggcgacggcggcgagcgctcgcgaagctgcgagtggaggatcgaactgtcgaacgtcatttcgtcatcaagcatagcacgcttttttttcccctagtctagtcgccgatgcattatcattcccacccatgcttcatcgcgcatcttgtgcttgtgccatcctcaggctccagtaaagagcaactgcaaatcgtatcgcatcgcgaatcacgcatgacgcgtacattagatttttcagttttcccgtttatgtccgcttcctcgaatttccacccccccccccccccttttttttaccagcaatccacgggaaagcagatgctaaagctggagtatactacttttcttgttttcttccctccttttggttcgtgaggtatgcatccaaatttatgtacgcctcatgcctatgcatttctctgtgagggaccactagggatcatgcgggtcatgtttttaccccaaaagagaaaatctgacttttttttctctgcatacaggatgctatgaatttatcagacctttcttcttgatgtcatgagacagtccgcctttattccacatatttagaattttagatagtagtgccttgtggataaggtgagttcgcttgtgctgttttatttgttcatttctggtgaagtatatgcttgccgaactctctaagctggctcaatgcaaagtaatgaatgatgatactacccacttgattccacagaatggtagcgggagagatagctgttctaagatgagactgcggttgcatctgctgattctttgcttgatcattttatttctggtttataacatggcgagttaccaacataaacagacaaaggtaacactcatctacgaaatgtctccctgtagtttgcttgacagatatgactgaccttattatgggttgttgcagttggaagcaaaatcccgtccatttgatacaattacggtatgtaaaccaatcagctccactagaaggaaaagaactttgtgctatgttaatctggaagcatattttcatttgttgctgggacgctgattttgtcttctatgtaaatatttaggtgtctgacaaagtgtcttctaaggtgtctaaaagatctgccaatagggttggttttttaccccatggtatagtggaaccttactctgacatggagttgaagccattatggctcacaagaagtgcgcaatcaaaggtaatttgaaaaccaagcctattcttgtatacagtgtgttgctcagtacaatatatttgttggttctatttcagttttcatacataaagcaggctttagttgctccacctttctgagtacgaggcctgaatatctagttatctgacgctctgcgaattttggctccacaggattctagccagaaggatcggtgcttgcttgccatccctgctggtatagatcagaaaagaagtgtggatgctattatgaagaaggtacttaatttgctacctcaggaagtgatagtttcctcatgatggtaactcttgaatgttcagtttcttccagagaattttacagttatgttgttccactacgatggtaatgttgatgggtggaacgatctaccttggagcaaaagtgtgatacatatagctgcttctaaccagacaaaatggtatggcatctttctgcccttcctctgtgagaagagcctgactttgagtgctcttgctgttgaatatactttgcttcaccttgcgatttctactgatctggtgtcgtcttaattcaagataagataatgaggcatctattttttaggtggtttgcaaaaagattcctccatccttctgttgtctccatgtacgagtatatatttctttgggatgaagatctggaagtagataactttcacccaaggaggtatggtatttcataaatacttgatgttgattttgagcctcacattgcctagctgttgtataaatgatgttgaggttagacatactgaagtgctgaatcattcctagtacaatgtactgaatcccgtaatcctggttcaagaaactttgtataaaattatcagtgcatcttttaaatgtaagaatcaactactgactgactggtatgtgttaggctgcaaaagttaatcttggcaataatgtgatcttatgctaattttcttctcgagta

SEQ ID NO: 65565 - DNA, 2291 bp, Oryza sativa
ctttgggaggatgctaatatctggtacaacgtttacatttcacaatcaaacacaactctgaaatgtgcgaatatctgaaatgttagcctggtacaccatttacgtttcacaatcaaacacaactctgaaatgttcacctttgtccttcagagaattagagttcagatcaacgaaaaatgttcagtctcgtataactgctacagtcttgcactccaagacgatgcgatcgaccacaaattaacgagaaatcactgccatttttttttagcatagacgatccatcaaatgagtaatgcttgaagtttaattcgcacgaagtgcaggttggggtgatgattgttagtggtaaagctgcaagaacaccgctctgagcttcttcccggccggagtttgggccttcttgggccgatgtttacggcccatatagagaggggtgtatctgcatcgctagggtttgcctccgcgccgccacctccttcttagcaaagcctcgtctccactcccctgccctcccgcctctccggatcccccgcgcgccgccgccgccgcccgcccgccggtcgatacccctccgcggcagccatggctgagcaggtaaggctcctcccagtcttaccctcgagcttctccgtcgcttgcttagggtcagttctatggtgtccttgttatgtgactcggatcttcttgtcggtgttgctcagtggtattgcgtgatttggcctggaattgtagggagggaaaactggtttggtagccttgcacatcagtatgttggtcattattgtcgattatagatttgatttggggttctagcctagtctcatgagtttgttgaggttttcttgttagatgtgggagtagttgggcggtgggtttgcatagtaccattctcaactctcacttgatatgttgtgacttgtgagccatgttcatggtagcaaatgccaggtgcagttttgtggttagtgtggagcttatctgttagagagttagatataggtttgttatcttgtttcccatttgttcatgcaaacgagtgatgcaggtggttctagcagattttgtgtagtattgatgttttacatccattcctgttgtgcagactgagaaggcattcctgaagcagccaaaggttttcctcaggtagggttctgctgctccttcaatcaattatgtactattctgtgagcaattcacacgtcttgacaatgtttttctgcttgattttagctcaaagaagtctggcaagggtaagaagccaggtaagggtggcaaccgtttctggaagagcattggccttggcttcaagactcccagggaagcaattgaaggtacaatagagtcttgcttctttgtttagttgttaccagaattccaattcattacattttagattcttgcttactatcttttgtgtgctgtagagaagaattatggtttgttttactgttaccactgaagtgatttgtagtgcattatgaacattaaaaattgtttctgaaagaatcgttgcctgtcatcagttaacagtatttcttaaattcttttgatacactgttgctggtatgtttgactagtaatttaaatgcagctgaataatgctatttcttttatgctaattctttcaagtactgagcagttgattaattacaattccttgcagggacatacattgataagaagtgcccattcactggaactgtttctatcagaggcagaatcattgccggaacatgccatagtgctaagatgaacaggactatcattgttcgcaggaactacctccactttgtgaagaaatatcagaggcaagtaaacaattatggattctacttatgtttcttttcctttttctgacttgggttgcaggtatgagaagaggcattccaacattccggctcacgtctccccatgcttccgtgtcaaggaaggtgaccatgtcatcattggccagtgcaggtaaaacttaactcccataccttagtttttgactccttagaatcatcttaaataacagaggtgctattagttcaaacattatcagttcacccagctagtactatgagatttggttgctgaagtacaatttctgcattttcaacaggccgctgtcgaaaactgtgaggttcaacgtcctgaaggtcatcccagctggatccaccggcggcagcggcggcaagaaggccttcaccgcagcatgagcttgtactcgcattattcatgggtagtttatagacagatccttttgcttgaagtcctggcagggctggtgttttgaccctatcgatttg

SEQ ID NO: 65566 - DNA, 889 bp, Oryza sativa
acggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccgatcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtacaggcggaaacaccagtcggcagcggcgaaggcaagccggtcggtgaagacgtagacgcccaacaacggtggcataataggccagccgtgcaggcgaaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatgtgtatttctcctcttgtcaattttg

SEQ ID NO: 65567 - DNA, 2033 bp, Oryza sativa
  unsure (1)..(2033): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgcttcagatgatactgttcttaacttctctgttgttccaaaccaagattgagtgcactcattccaaacaactatattggaacagagagagacaaatagtttatacaattaggtacacatgtagaaagctttagcaatgggatgctgcgagtcatgccttcaaacattaaagttttacatgtgcagaagacgaatgattatcaggaccaggtatacaaaaataggaacaaaagagttcatgttggcagagttcatctctccaaaacagaagactaatggatcaatcagcaagaatgtgcacggaaggctagaactttctaaaagattatggctcgcaaaactgtagaagtatatcatggaatcgtacttgatttttaaaagaaaaactaatggatgggccagctaagaaagtgcaccaaaggctagaatgttctaaatattatggtttgcaaagctgtggaaacctatcatacaatcatatttgaattatgaaagaaatgtgttgaccaatcaataaatatgcccaggctccagggcatgtgcagaaatcttcagtcattaatagtatgagacatgccttccaacttagttttgcatgtgtgaaagaaggaaaattatgaggacaagtagaaaaatataggaatggacgagttcatgttgagagttgatctctccaaaacagaacaccaaaaataatcaatcagcaagaacgtgcatgaaaggctagaactttctaagtgaatatggcttgcaaaatgtggaagctatcatgcaatttgacttgaattctaaaagaaaggttgttgaccagtcaacagatatatccagaaccaaaagttcgctagagaaggaggcatgtaaaaactgaaaaatcaatcacaccttttttaataatcatctcatatcaattaatgtgtttgcacatgatacatttgtgatagtttcctatttataatatatgtaagaaaactcatctaaacaagctaaatcaaaggcacatggtaacaaaaaatatataatgagctaatggcatattaagcttcattttttttctgattgcctaaaaattctcagacagaaccatcaacttaagacataaagttaacatgattttggagtgctctggaaaatcatataaccaccaataaaattcaatgctaatgttatctaggatatggcaaaaaaattcactctctactctatagcatacaatatcccttctgaaaatgcagatgctctatgataggtacaatgcaaattaattgatcaagccatcacatttctcccaagatttaagaatttcacctcctttcgataccggttgcccatgaagaatagcaatgaaggccggctttcgactcccacatcgccttggaaggagttgattcggtgcgcgtagggcaggataacatccttgacgagagatgcctgctcactacgcaaccgcccgaagtcggagatcaggagcacagcattgctgatccgatccaccaccctgtagagcgcgttcggatcctggcagatgaacacgtgatccctcccctggtgccgtcgccagtacggctgccgctccagccacaccagcagctcctcctgcgtggactcgtcgctgtacgcgggctccgccgcgtcggacgcattggcggcggccgccgagggcggatcgggttgacgacgaggctgagggaggagaagaacggcacgtagaagaggtcggcgtcggccgggtcgtcgacgcgggcgacggggcggtcgagtggcccgcggcgcctgaggt

SEQ ID NO: 65568 - DNA, 3743 bp, Oryza sativa
tgggaggcggagggcgcggatggggagaggaggaggaagaggaaggcgagcgcgagcgcgaggaggaggaggagcaggggagacgggcggcgcgacggcatggcgcgggcggcgagcgagaggagggatctagggaggaggaaggcgaggaggcggggcgggggcggcggggacgccggcggcggcggcacgaggataggggacggtcgcggcttgcggggtagcctgccgcgctcccacatgtgggcggtggcggcgggcgggcgggacggcggcggcggcggaggaggaggagaacggcggggagtgagacgggggacggcggcgattttggggcgcacactgcggtagtggccttccgacgtgccgggctaggggtgggtcccattggtcggtgactcagcgcgtgtagcaaacatgtcccttgacttctccaaaaatgtatcctcagattccagcactagtgatttaacgtttgcctggaaaatgggttgtcaactaattatcggaaacttaggaaatgtatgcgtgcaggaattcaagccaataaaatccccgacgttcaaccatctagtacaaccaatttagtagtagtaaaaattagatatgtttactcggatgactgagaatttttatggtactagaaaaaaaatgcacgtgcgttgtaacgggtgaagtctattttaatcttattattgttatatggtttatttaagatgaaatttactgtggaagtttgcgtgcatatatattcttttagaaaatcatgagctacagataggagtccgattgtctcaagttaacatgtgagttttttaaacagattttttatatgattccttttgtattaccaaaagtgaactatcttaaaaaccaactgaaatacggatatgtatttccaaaagcaaacaaacttaaaaccgactcatacacgaataacgtaccaaaatactggcaaaacatcttcaatttttataatagtagagatgtataacatactccctctgtaaaaaaaaccttaatcctcgagatgaatcttatatatccaaatttatttttaggatttgactttttaagagggaatagatcttctataaaaaaatataggaatgactatttgcactgctcaacaagaactataaccacttaatcatgattcatttcatatggcttaatggttaggctttttcacagcacacaaaacaataagacctattagcataggattagttgagttgagcattagcattttgaaatatgtgcttacgaaaaatgaggtagtaggtacccaataaacactgaacaacacagtcttaagttggaagtggatttatttatgttaaaagtgaaagccagggcattattagaacttacaaattgtagcggttatactccctccgtactcgtaaaagaagtcgtttaggacaatgtttaaatcaaatcttggaaatataaatcgtgaatacctctaaaattattgagtttgaaaatgtaaaaattatatgaatagatttgtcttgaaaaataatttcataaaaatatacatatatcacttttcaataaatatttttatagaaacacaaagtcaaagttatgttttgaagaccgtgtcgctgttttaaacgacttcctttactagtacggagggagtatgtaaattaaatcctattgaaagtaagagtacagtaaataaggaacaccgaagatagtaaagaaacgtgttataaaagctatgaattgatataaatctcggtagttgaaacaagtaagaacatagtagaaaatccaagtgatgataatatcgagatgaaatatttgttaacgaagttatgccaaaacctgcacttctaggtgatgattatgagctagttaggatgtgatcagttcatatactagtcgtcatgtaggtacaaactgatggtacctattaatgatgataacgtttttttaaggactgatggtacctaggagtatttgtttaagaacagggactgggataagagctcggctctaccactatccttacaaccaacttatataaccaatgaataaccaacttaatttatacagagatggaaaatcatatttatgtaaattaatatacgtcatattaaattatagtccaagtctaatacagaattttgggccagtgcatgttctcatttaattaattgatattctaattacatataaacttactgtgttagtggttattctaattatatgtaaacctagtgtattactccatctatccttagaaatgtgtcttttgggtatcaatacagtcttgaaaatataattttaacaactaatttctgctccttcctttttaaaatataacatgttttggttttgtgctaagtcaaacatctttaagtttagaaaatatagcaacatatacaataccaagttggttttattaaatccaccgctaaatatatgtatataatctgtttgatgttctaagggcttaagggcttgttcagattgatgccattttaaatcataacatttgttgatagagttgccaaatatatgcgttcatttagtttattatcaaactttagtaaatacataatagccaaattaccaaaattttggcattaccaaaatttggtaaggtttattttggctgcaatataaacaacccctaaatgtttttatgctttttctataaatttggtcgaacttaaaattaaaaaatggttacgtgactgagtcaaattttggaacgaaggaattaccgtaacataattattttattaacttggtaatataacaatattattttctaaacaaatacacaaataagtttctcatgaatccaatgctagttttaaagccacgttcttttcttattctggatttgggattttcgtttgcatgtttcctaacttttcaactttatgctatttaattcaatcgtttatatcctcaaacagctatcacaaataccacataatccatcaatttaccaatttcaagtatcttcaatacgactaaaaggctattgagattcaaacatttttgaagtattcccttaaaacatatcaataacaatgtatttgcatgaacaaataaagtattcaacgtcggcttttttgaactacatcaatagacatggtgtacactcgtacacatatgtctactttctaggaacacacgtactcctaagtctttaattacactttgtctcttcctcatattaatttctggccaaacaagtcattatcaagcagattgcgtgccttcgactatatatcaaattaatttcacattcaaaaggaaacgattatcgaaattagaagtacacccgaaacccccaaaaattaatcttcgtggacttcatttcaactcgacgatggtgcggttaaagttcaccttttctttattattattattattattattattattattattattattattattattattattattattattattattattattattattattattattattatattgggactatctatacatctgttgacagaaaatcccacctcccatctttcaatttttgaaccattggatgtgctttatgattcatgaagatacattaaccctacaactcctcctcccgttccctcccatcacgctcgcgagctcctccgcagctccacccgatcccccgccgccaccaccccaccgcgtcgccgcccgcctcgccggctggctggagggcgtcaacggcgccggcgagactccctcccccctaccat

SEQ ID NO: 65569 - DNA, 14609 bp, Oryza sativa
taagattagaggtagcttttctattgactgtagtttagcaattccgtattttattacagcgaccgtaccggtggcgcagccagcccagcagcccgtggaacttttgaacgcatcaataagtcaaaccgtggggcagacacgtgagatgagagggggacagtccaacgtgtgacgtcatcactctcgcacgtcacccggcgatcgtacggctcccccctcctccgatcctcctcccgaccccaaacatcgttgcagtagtattcctgtcccattgattgctgcagttcagcgtagccccgtcgttcaagtatttgaatggttctcacctccacaaaatttctattcaatcttctgcacggagtgttttttgcctttggctgcacgctgcgcagagtctcgccaaaatactgcaaagatctgcaggtctaacgcaacgcgtgtgtgcacgctcgagcgaggaaaattcaaacttttgaaacgctcgagcgaagaaaatccagtaatgtatatgcttttgcttggagaggagagcttgaaaagtagcgaatcgctctttggattgtataatatttggtctgaattcatgcagaatatctgtttgttgtactatatataggggaccagaaaacataataattatatagtccgtcttagcataagccacggggtggattgacggtggactgacgacggtctgatctttggattgataatactactcaaagcgaaatctgactattaaaataacaaatttccccgcccggggactgtgcgcggataacttactcagtactttcatgtcataattaaaatgttcccatgcgcgcgcgatgcgaccatgaccaccccgaacccaatcctttataaacgcatgcatgccggcccatcccctcatccacatatcaggcatcacaattcacaaactaactcgtagcgatcgatctctattttgttggagtttttgctgcttccactcaaattgttcagagacgtttcgatcgatcaagatcaacttgatcgggatcgcggcagctcgatcagctaactagagaacgtcttggactcttggatttctccgcgctctcgcagtattctaggagacatttcttgatcgatatcactagctatatatcggtcgtttgatcatgtcgtccaccgggctttcccgcggccgccggtgcaccatcgcgtcgcggctaaacgcgtcggctgaggcggcggttgcggccaccagcagcagcaggggggagaagcagaaggcggcggtggcgagacgggtggagtactacgacgaggaggatgcgcggggggaggcgcgctacgacgttttcatcaaccacaggggcgtggacaccaagaggacggtggcgcggcttttctacgaccgcctcgtcgccgcgggcgtccgcgccttcctggacaaccagtcaatgcgccccggcgatcgcctcgacgagcggatcagcgaggccatcagccagtgcggcgtcgcggtggccatcttctcgccgcactactgcgactccgagtattgcctccgcgagctcgccctcctcgtcgagtcacggaaaaagatcatcccggtgttttacaacatcaaaccctcggatctcgtcctcccgcaggccgtcgtcgagtccgtcgctcaccatccccgcgacattgaacgcttcaaattcgcgctacgcgaggtcaagaacacagtcggcctcacctacgacacagccacagggtaggtttaaaatgctgcagccatttggcgccattatattctcatacttagtagctaagctcggttagcttctcgtttgatcgcaactgacgcatttgtaatggtgatctgcctctacagagatcttgcagagctcgtaacatcggcggctaccgcagttttggagaacatagacaagcatgaggtcacgcaaggaagacatatgatcatgtccaggctgtaatttgaatggttcatcgcggcttcaccatgtacaattcagaggacgagactaagaaaaaccgggggcaatttaacaaataacatttaacttgggatggattcattcattttttttctagttagttattttttgggtaaataaattaatctgcaggattgaattggtactatacgtaaaaataagcaatgcatgcagcactgagtgactagctagctaggcagtccatgccgatatgtgcatgagaatagggttttgcaaataattatgtgcatatgtgtatatgtatttacatgattacaccaataaattaaaaatacagtgcttttttaacagtctgccactctttgcatggcaggactggattcaaacttctgtctcccgcctttattaatgtcgtcgttgttttttgtctactggtatttattcaagcgttcatgcatggatatggtcgttttgaactagtattagtgttcacatttcaatttcttcagtttgattttcctgcacgtttcgttcaaaaataaattcctgcacgtagcaatactttcagcagcgttaattaggttaacctacagcctctactgcattgcagccattgctctagggcatgttcggcagccgaggacctgaacagtccggcaagccacaagatagcaggggctgcagcagcccagcttgccgaacaggcccctagcttcatatcttttgttagaaccatacttagtaatatactcgttccactcataaatagtattcaagacaattctggtttaattttttaagttaactttgatcaattttatattaaattaaatttataaaatctaatatattttgggaaaataagtatatatgatattatgatatagtttttttcttaaaaaaatataaaatgctcaaacgtttttaaatattttcaaagaaattatcgatagtcaaaatttcaaaagtattcgtacttatttaatttgtgtcggattaattctatctacgtatatgagaaaatatgcaaagctcttgaaaattcttatacacgcgtgcatgctctcaactctgtacggaatataattaagttcagttattaagtcaagtagcacaaggtgatatcctgagaatttaaccacgcattaatgtttcttctatgcaacttctgctagctacttgaccaggttttaccgtattaactaattaattaatgctgtttatccactggccggtagtacattatttctctcctttatttgcaaggagaattacatcaatatattccactttcactaaaaaacataaggcggtaataccagatcaattcaccggtatgagtcctattaagccgttgagtacttctaaaaaattcatctccaccatcagtagcaattaacgtacgatgcatgcatttccatatcatttctgcaaggggaaaaaaattagtgtacctaagctccaccctaaaaagaataattcctctctacccaaaaatatatcaacttttggttatgtttctggatcaaaagtaaagttactatataatcactatagagtagtacttatcatgtcaatcaccttaggccgagtttagttccaaactatttcttcaaacttctaacttttctatcacatcaaaacttttctacacacataaacttccaacttttccatcacatcgtttcaattttaaccaaacttctaattttagcgtgaactaaacacacccttaagttcaaatttctctacattctacctctccaccttcccactccccataaaacatcatttaataagaagcactatgttttcaaaaaaaaaaaaggagcgctaagtctattctcttctcaaacattaatctatgcaaaataacctaaaatgactttcttttagctaggaacagatcgatggagttgaatttacttaaagatatggcagtagtactcaagatttgtatataaagtactagataaaagaaacttactttagatataatgctgcttaaattagacgcgtgcatgaatcatgtcttgtaggagtacatgtatactccatccgtcccaaaagactcaacctcgtcctacgacgtgacacatcctagtacaatgaatctggacatactctatgtctagattcgttgtattagaatatgtcacattctaatactaggttgtctttttttttaaacgaagggagtacataccttggggtaaatgttaaaaactatatataatactcccttaaagacggtaaaatatctctagttttacattgatctgtaattgaacactaatacctattattccttccgtcccaaattatagggcaccctttttttataataaaaattaaactcggtaacttttaactgctaatcatactaatcatatagtatatgctaagtattatgcatgttatatcactagttttataatttaaattattttcgtgtgatgctaatttcatatttattggaatatagtatggaataaattaatgatcaaagtatatcattggagactatgtaaaaaaatatgtcttataatttgggatgaatggagtatttttaaatctaaatgttccaaagctgcctttaactacgtaaataccttacccctccacaaagggcacccctcatggtcatgcactcatggtgtcttttctctctcccttaattaattagttacttgtgtaattaaatgtaaagttgaggagagatggatcgtgtaagagggaaaaggacggcatagatacaatggaaaagaattgacccggccccctcttgtttccactccacgctataccacactgcacatggtttcataatacctctaatttggatcttaatttagaagaaaacaaattgtcgaaacatgaattcggcaataataaaagggggtagcgcacgagacctaaaagtggatggatgcagagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggagggcaggattacaagatagaaaccttaaccaacacggtatcggtttcctaaatctactttacaatcttatcaaaccaggactttaggccgttccataatatacagggaaacgtaatacccaagtcatgatctgttacatattccatagatataagctatcccctaagactagtcggataaccatgtcgtgtgggtatggggtacccataatctccacagtagcccctgagaccttcacagccgaaaagataaccttctctcgaactagattactccaaagccgagtgcttcaattatcttcgccatggtctcccgagtacttttaccaaatctgaagactgtggagggctgaaaaatatagtcaggtgcatcgaatagatgcacctaataggtgtagcccccgactatgtggttaattgaaccaaccaaacatatagtcaaggaataaataatctaaccaaccgagtggttttgataattgtaatcaaccaagtgacttgatatcaatgtatagcatatgcggtgtgaatccccgaataatatgatccaagtgatataccgactgcttggcaaaatatgatgcgtacaacctaaagttgacaacatctttgaaagttcacatagcaaaacaactataaagaagcttgaatgctgtgaataaagaaattttcaaagtattgggcatacgccatgcgcacactgctttaacagatgtgcttaagtccataaaagacacattgtttcaccacacctggaaatatatggcacatgtggtataacatccgagtaagtaaactcataaaggatttaccaaccgcctgaaaaatgaccataatatataatcagcctaagccataatattggtcaataaaaatgcacacttacgtggcaaaaagcaatgatattgtatccaatcaattgcttgataaacccaaacagcaccttgactatataaaaaagtcagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgaagaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgctccaaatcaaagatgaagataatgactcctggagttgactcgttggttgatgaattgatttcttcagcttgacataaaatttgtcaaattttgagccttgtatttgtgtagcccccgactctttgattagttgggaaacaactgaacatagagtcgagaactgtagcatcttgtcgtcgaatagttattgcttgattgaagatatgtgttgaagatgtccaagtagaaatcatgaatgttggagagccacttgttgtagtaaaataacacggcatcgcatgccgagatgtcgagattcacaacaacgtcatggttggtgatgtagtaaaacttgcgaagtagcaacaatagagtttgccggtgccgaagataataaagatgaagtcgctccaccatgatgacaaagttgtattgccgtaatgaagtgaacacaaatcggcggcaacagaagcaaaccggtagtgaagacgcgcagttgtgaagataaaagcaccagtcggaggcggcataatcagtcggcgacggaagatgatgatgtccatcagtagtggtagctgtataaaccagacgtagaggtaagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaaacaccagtcgacggcggtcgaggcggccggtcggtgaagacgtagacgcccaacaatgacggcataataagtcagccgtgcaggcggaagcaccagtcggcggcggcgaaggcaagctggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtacaggcggaaacaccagtcggcagcggcgaaggcaagccggtcggtgaagacgtagacgcccaacaacggtggcataataggccagccgtgcaggcggaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatgtgtatttctcctcttgtcaattttgatttccccgagcagatgattcattacgtttaaacgctctgtccgactagtcatagcccccaagcaccgggagtcggcctaggcacttcccagacatgcatatgagtgacatgagttcgccattaatggaacaaagtttcacgaatcagaatttactactcgggtacttttgcaattattaagagcagaaaataaatttatctcatctctatgcttttgatttattctgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtaatattccctcggtgacagcaaaagtagccgatgtgggaacgaagcagtccatcgatggtgacaaaaacaccagtcggcgccagtggaaccaagccagtggtgtagatgatgaagcccattaacggcggcgaagtctgccaaccgtataggcaaaaacaccagtcggcggcggcgaaggccagccggtcggcgaagacgtggacgcccatgaacggtggtgtgaccaaccaaccgtataggcgaggacaccagtcggcggcgacggaggcaggccggcggtgaagtcgtagacgcccaacagcagcggcataataggccagctgtgtaggcagaggcaccaatcggcggcgacggaggcaggccggcggtgaagacgtggacgcccatgaacggtggtgtgaccaaccaaccgtataggcggaggcaccactcggcggcgacggaggcaggccggcggtgaagacgtggacgcccaacagcggcggcataataggccaaccgtgtaggcggaggcaccactcggcggcgacggaggtaggccggcggtgaagtcgtagacgcccaacagcggcggcataataggccagccgtgcaggcggaaacaccagtcggcggcggcgaaggctagccggtcgatgaagacgttgacgcccatgaacggtggtgtgaccgaccaaccatataggcgaggacaccagtcagcggcgacggaggcagccggttggtgaagacaatgtcgccaccagcaatggtggcagagtacaccagccatgtacgcaaagaagccagccagcggcgacgacagcagccgacatacatgcataaacaataacagatcaaacaataattagtaatctgtgaattaatctaatttgcgaaagaatttaaaacgataaacctggcttgtaatccaagatttttaatgcatgtatgtcatcagcggtgtatggcttgcttgattgaatcagagactccagcaaaaaggtcgctgcgtgcatgtatctgtctaggtagatcatgcacctgcatgtatggcttggacagaagtggcttgatcgatgcccttgtgcgacaattgctccaatcagctgggttggagtccatatcgattccgaaattgaatctcgccaacaaattttgatgtcgacgaggaaagacgccgatgcttcagagctttgcatgcatgttttctgctgatgcttgatctgttgcttgacagcacatggcgacagatttgatctcattgcataaaatagaattgacaggaacaactacttatggaggctcataatagctgttggcttcaaatcttttgctgatcaagaacaaaactcggtgactgacgtccggtcttgccgatcaaagaaaagactcggcggcgacggtgattggatccatcgccgagattaatcttcccggctagattggatctgagttggagaagaaaagcttagggaattcgtcggcggcgaggaagttgcagctcccgaagtgaagacgaagccggcgactcgtaaagttgattccatcgcgcttcttgatagataactcgacgcaacccctacctggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggagggcaggattacaagatagaaaccttaaccaacatggtatcggtttcctaaatctactttacaatcttatcaaaccaggactttaggccgttccataatatacagggaaacgtaatacccaagtcatgatctgttacatattccatagatataagctatcccctaagactagtcggataaccatgtcgtgtgggtatggggtacccataatctccacacaaatgtttcacatttttaaatccatacattctttagaccatggaattaagaccaatgctttgaatttcactggagaattcttgccctagttataagattagattttgttcgatgcataactatggtcaccctctaggtgctttaattttagaataaccgtgcaaagactgttgaatggcctgtattagatttggaatagtccacgcatgccctgaatggttgacactattccaacatttccgtttgcacttggcagtcaaagaatgggctatataccctatactaacagtcgcatgcatcatatggaagttatcttcagaaaaacactcctgtttaatttgtagtgcatataagtaacatgcatgcataagcttgtatttcaaattaatttgatagttttttattgcaacctgatttaagtttagtgtggatttttacatgtacggattcacctaaatgtattttaatttttatgaatgcctttgcacattagcttttttatatctatactagcttgtagatatttgccaaattacaatactttgttttaagttggaataactttttttctctttcacctggcaaagcatgagtgagtgctgctacacatcgatactttctatatagtcttctatatagtcggtacccactaacaattattaaaagttaaaactcaacatgcaagtatgccacatcatcacccactagcaattactattctagcccatttaaaatcctatacaagcatgcaacatcttcactcactagaaagtactattctagcctattttaaatctcatgtaagtataacacatcatcaacaagcatgtgtcaaatcatcttactcacattattttttcaacatttcaactttcatcatttcgacaatatttaatatatacttatccataaatctcgcagcaaagcgcggggtatcacctagttaatatgttggttgacaaggcaatggcatatcatgtagataagaaaaaagtaagaagttacccacctaaatttctttatgttttcacttcgaaaacggtaattccacatgagtgatgacggttagagatgaaaaaaaggataggtaaacattaatcggaaaggcaatgacgcatagataaggaaaaactcagtcacctaattattttttgatttttttactttgaaaattacaatttccacataagtgacagtgatctgaaataatagggtacaaattaaaaacactcagctactttatttcttaatgctttcactctgaaattctaacttccacatgagtgacgatgatcgaagattaaaaaaaaagtagaaacaataatctcttggtcgaaaaggcaacggtacatggctaaaaatatcagccacctagtttcttaatgtttccactttgaaactgcaacctccatacgaacgacggtgataactttgataagatagtatgttttttataatatttttttagtttattgaagtagaagtggctaaagtttactaaatataaatggcattccgagactagcaatggaaaatggaagcacgtaattaatgaagccgtcacggtttgcgactgtatatggccgcctgaaactgagagcaaagtggcaccagttgtcgatcacgcgcggggcggccttgacgctatattggcaaaggttggtgtcgcatactggcacaggcacagcaatgcatgaccctacgcgaagcgacaggaggtcacgcacggcgctgtccctgcggccttgtcgcggtccacgcgacgtgcaccgatcgatctccaactcaccgtggaacgcgacgtcttccccttcctcccgacctagcttgttgctgctgacagagcgacaacgatataacgttgaaacaagcacagaattcgtcgctacgaacaaatcaatatcaattctcgggccaagaccaacaaaaactgtaaaaaggaaaaaaaaacggattggagaataacattcctcggctcctcgatcgctgattcctcgtaccgtcgtacgaatatatacgaccgagtcgcggtcgagaatcccggatcagattccacttaaccaaatcccgttcgacgccctatccgccgcgtcatctcttccgcatgcatgtccgtgcgtttcaccgccaaggcagggctgaggcagctaccggggtgaacggtcggaatcggtaaaccatatttatcattcaaactaccctgtatcgatattaatacgatagaaaaaaatttaaaaaataaaatttaaaaatagcagaaaatggtacggttataaacaataccccttatgcagaaacggcgctcagtcgataggaatttctgtgaccgttttcacccgctacatccactgctcgagctgttctcctgtttggcgcgtgcgcgctagcgagagcagagtattagtcgaataccacgaactgctacgtaccgcgcgtttatctcgtgctagatacagagcattgacgccttctgccggtctgcccccccggccccgtgcacgcgtgcgccgccccggtcagcgtccatctctgagactctgacgacgacgacgccgccggcgacggcaccggcgccaccgatccatccatccatccgtgcatcctactgtatacttacctgtctctcgctgccctgcactgcatacgtccgcgcctagctcgatccccgcaggatttctctgtaggtgacagacgccggtttgtctggacaccccctcgcggcgcgccggtgcgtgcgtcggtgcgtgcgtgcgggccgtctgcttgacgttttgaccattattcctctctgtcgatcgtgtggtcagtgcgcatgatctaagattaactgaggaaggactcatcttgtgcgttgacagcgttgtccgaagcccccggacagaacgggtctaagtttgcactgttattttgggaagttgtaaagcagcttctgcatgcgccacaactcaagcttgtcagagttagtgacggtggctgctttgatcttgtactgctccgtacttgaggctcaagaggccggcgaagtaccgtttcctgtttgcatatggaaatagcagttgcagtaggaaagggtaaaatttaactgtgcttctaaaaggactttttgcatgtcacagtttttctgtcttccatgatctagtctacgaatgttcagaacttcctccgtttcacaatgtaagttattctagcatttcccacattcatattgatgatagatagatctatctagatttattaacatcaatataaatatgggaaatgctagaatgatttacattgtgaaacg

SEQ ID NO: 65570 - DNA, 14625 bp, Oryza sativa
cttttttactgtgatgtatgcgacgagaacacacgccattgaaatttgtatgaacccattcacctgttccagtttaattccaagcatgctcgctctgacaattacaatctgatgtggctcagacaaagctcccgttcctccggcagtccagccacttgtacacggttattggctatctacacacaataatcaaactgagcagagcaaatcgaagaaagatataggaaacaggaaacaggaaactgttgcattaattaatatctgatataattaatccatacttcctccgttccaaaataagtgcagtttttcactatttatatttaatgtttgatcattcgttttatttaaaaaattgttatgattagtatttttattgctattagatgataaacatgaatattactttatatgtgattattttttaatttctttataaattgtttaaataaaacggacggtcaaatgttggacataaatatctacagctgcacttattttgggacagaggtagtacttgcttttattctacttctagttcccacttgtatactacgattccctgctcaatgggtaagtgtcgaatcctgaatttttctgaaatatcaaattatccgaattttctctgtaggttcagtccatctgttgtttctatttcccacggagcaacagaaatcgcaaagactggctgccgctgtctgaccctctgactaatccaatccagagagtgctagtactatctccttcaacattaattcgagtttaggatctgttcataggtcagacacggcgaacatttctattagccatggacaaaaaaaagaagcacgcagccatgttcaaggggaaattttgactaatctctcgacacaccatcaaattggccatcttattcttaattcgtgaggtccgtctcgatcaagaattgacaggatcaaaggtcaaccaaattaagggaagcatgcagcagttgctgaatcgctccaaacgcagccaagtcattaatgtgtgtacagcattctgcgttttttttttcatgatcagccaattattattcgttgcccgtgtaatagttgcaacgggcatcatcggcagtcaatttcaggtcacaaatctatgaattaatggggggtagctttgaatttccgattacgacggttcttgcatctagaactggtcttatccagcaatcagggactcatgacagtaatgttgcaataataattagtatcctacttagttaatttatttggaagaccaattaagcagaaatggacggaagaaattcaaaccttcaactcggcgacggcgagcaatttaggaataccaggaaagttttcatcagtttaattattttatatgcagatggatgaacttactctgaaacctgattttctgaaagggaaacagacaaaacagaagattaagaacgtacatatgtccagaaagcacacacattaaactactttgtgcatttgtcggtgtcgcttcgcaccgattagaccggagttcatcaatccgcaattatccgtgctcttactcctcctgcttatctagaaccaaaatccagaagcagcatttgtccgaaattcaaacccactcattacagtgtgtgaacctttagcatttggggtcatagttctattaaaccgtaccgtgtctcccgggtatatcgcagagatagaacattctattggtaatttggtatgcaaccagtcacagtaaaaaacaacggaagaaatgataataatcaaaggttacacgctgaattttcatgctaatcaacgtccaaaaggttgtgctttttctcagggaaaaaagttaccagtatacttttactcttcgactcgcggcccatggcctaaactgcttcgcgttgtccaaagcgagacagtgtcctaaacgggccaacacaaaaggaggcctagtaagccggtgcaaattgggccagaaaagacggtggaagaggttaccatacgctgggccgtgtgtagcccaggaaatgggtggacgttggcgcgcgaggggcgggcgggcgggtggcgaggtgatcgatcgacacgcggtgggggagcggcggccggcatacgtgtccagcggcgacgggcccgtggcggccgcgttcggtacaacggagccgtatttctcggggccaatgccttcggcgcctctccccacaccgcgcgccgcgcgcaccccccttgcctgccttgccactgccagcccgcacctcatccatcgcctcctcctcgatccctctcgctcgctagcttagcatcctgcatgcatgcagcgcagcggccgaaaccgcccaaaattcccagcgcagatcgctcgcctgccttgcctgcccgtccgcctaaccgacaccgcaacaaaccacagccacacagcttctctctgttgctcgctttactgtgcgtgctgtatatacacccggtggatgagggatctagctaactagcttagctagacagcgtgtgttggtggtggtggtggtgtgtgtgtgtgtgaggagggtgatcgatcgatcgagcgatggagagcccggactcgtcgtccggctcggcgccaccgcgagtactacggcggcaacagcagcagccgggctcggcgccggagctgccgccggggttccggttccacccgacggacgaggagctggtggtgcactacctcaagaagaaggccgcctccgttccgctccccgtcaccatcatcgccgaggtcgatctctacaagttcgatccctgggatctccccggtacgtaatttaatcacttacacccataccaatcataaattaagaatttattattacagcttatatatactattatcatgcatgtatattatctaaaaaaaatcagcccaaatctccatatgcatgtgagcatgctagcttggatgtgtagtgctcgatcgatcgatcgatcgatcgatctggtgtcgtttacttgtttgtgcgatttatgcgtgcatgcatcggtttgtatcagagaaggcgaacttcggggagcaggagtggtatttcttcagcccgagggaccgcaagtacccgaacggggcgcggccgaaccgggcggcgacgtcggggtactggaaggccaccggcaccgacaagcccatcatgtcgtcggggagcacccgcgagaaggtcggcgtgaagaaggcgctcgtgttctaccggggcaagccacccaagggcgtcaagactaactggatcatgcacgagtaccgtctcacggacacgtctagctccgccgccgccgtcgctacgaccaggcggccgccgccgcccatcaccggcggtagcaagggcgccgtctctctcagggtacgtacgtatatacgtttgtgcgtgacagtctcgcttggagtcttggactgattgatctgatcaagttgattagtgtctcagctggatgactgggtgctgtgccgcatatacaagaagacgaacaaggccggtgcgggcagaggagcatggagtcgaggactccgtggaggacgcggtggccgcgtacgcgccgtcgtcgcagcagcatgccacggctgctgctggcatggccggttcggacggcgccggaggagttgctgcagcgcacggcggcgactacagttcactgctccatcacgacagccacgaggacaccttcctcgtaaacggcctgctcaccgcggaggacgccgccggcctctcgaccggcgccagctctctcagccagctcgccgcggcggcgagggcggcggcgacaccgtgcgacgccaccaagcagcttcttgctccgtctccaaccccattcaactggttcgaggcattccttccacgggccaaggagtttcctagtgggctaagcaggagtagcagagacatcggcgacatgtcgctgtcatcgacggtggacaggagcctgtctgaggctggcgccgtggccattgacaccggcgacgccgccaatggcgcaaacactatgcctgcatttatcaatcctctcggcgtgcagggtgcaacctaccaacaacaccaagccatcatgggtgcctcgttgccatcggagtcagcagcagcagcagccgcctgcaatttccagcatccgttccaactctccagggtgaattgggattcctgaataaaaggtgccggcattatgcatacacatatatgcacatgcatacatgcatggcttttcaagtagtagcacaacattactagtaattaatcacactaatgtgtgtggcagtcgcattcagtgagcactgatcgagtagttgcatgaacacaacactaatgcatgcactacatatatatggccgcattgctcctagggcacgtacctgtacgaactaggtaagtgacctaaccagctagatcatgttcagaataaggagaagaagccgcatgcaaacacgtagatcatatggctttgccttcacatgcgtttgcatcatatatatcgcattcagaaagtagtgctgcagctaacacatagatatggtgttagcttcatgcgtttgtaccatatatagcggatgcagaaagtagctagttgcactgttcatcattatcccatgagatatgaactttatatacctttggggttgcccttctaaagtcatgcatctagagcccccctggtaatagcatgcattgatgtttcatgcgcacatatatataattgatatatatccttgtatatacgtaggagtaattcgctgatagaacggcacttacatagtacgctgtactgtacatgtaaacaaaaacttacatattataagaaaaaacgatattatagacacgctgcatagctagattaaccatctgggagaaataaagcatctatccacgatcactcaaaaacaaatgcatgatgcatgtgctagcaacagtatgtattatatatggattgaatcattgaagtgcatatatatatacgtagacgagtttttgtcaggctaaagctagactagttaccaagcccttgtcgatgccatgtgaccatgtcttcccccagcaacatggctgtaacaacagcactaatcctcccaacgatctccgtccaactcgtcgcgagaccttcccttttccgagcgtctaacagcgccacccccgtcgtccgcgcgacaaaccgcctcccagtttcgccgggacagccgtcgcggtcgcttactcgcctcgcgagcgatcgaaagctaaaggtgcatgtaagcgagcgcgtacacgtacgggcgatcggtcggtcgagacgtcggcacgcgcgcatgcatgcggctctcggcgcctttcggccttgtcgtctggctggttccccggttttggatggttgcggtgatggcacatgtagaagtagcgatcgatcgacgacgtggacgggacggggccgggcaaggctagcgagctaatcacatctcggctttggagcacgcacgataataaccccctgctggttcctagctataattcctaatcgatcttatctccagctgcagcgaattgaccgcctttaatcgcggggatagatggtaccgtcgtttttacgcggctcgagcgcgggtggctggctttggctcgtcgtcttgtgtacgcgcgtgacgccgggtgctacgcgtcgccccgcggttcgctggatcgcggagcggttttaacctccagcacgcggtttttgattggccgcgcgctacgtgttgcggcgtggtttgtgcgggggtaaatttgcatgtgcacctctgcgcagacggcgcgcgagattggccggtcaaggatgagtatgtgtatgtgtgataactgtggtaaagctttttattcacctaagacttaattaactcgacgttaaatcatttattgcatacaaactaaataattacaacaaaaaataaaaataaaaaatatattaatgtgtaaaaacatgtaaatctaaatccgactttaccaactgtaacaaaaaataataaattttatacgtgaatatttgttttatattataagttgtttgattttttctaagtgaaatttctttaagtttgatcacatatagaaaatatattaatattttcaatacaaaacaaacatattatcaaaatatatttaatgttatatttaataaaactaatttgttgttatcaatgtttttaattttttctataaatttgatcaaatctaaagaactttgactaataaaaaaatcaaacgactcatgatatgaaacggaaggagactcataatatgaaacggaaggagtataatttaatttgttgttttccttgtaaaagtcaaatttgaacatacatattttttatatttttaaactaatatattacatatcaatttatcttatcaattttctttattttttatagttatttagtctccccgttaagatgtctatatatatccgccgacaatgtgttttgctagcggcgtgtaccgagctcgatacatatggcagcagggactatggcggcgtacacaaagcagttgcccggcaaataaagggaattgatgccaattgtttttttttttaatcacaggatgctctaatctatccatcttttcgctccattttttaatagataacacgccgttaacttttagacacatgtttgatctttcgttttattaacttttttatgcaaatgcataagatataaattgtgtttaaaatacttttagtgataaaacaactcacagcaaaataaatgatagtaattagtaagtgtaggtgtagtatgtgggtgagggcacgagcgtctaatattgtactcaacagcctaagatagtttaacaaggaagatgtttttttttctcatttggtgcccccctcattcggttacattatggagtcattctatggttacattgtggtgccccctctctatttaagagatttgctaggttacaaagtccgattctaactctaaccctaaccatctattacaactccaaatccatccgtaactaaataggactaatatattcgacacatattataacaataaatttaatactgaattacacattctatttaaatttaaatttattattttatctttctaattgtataagttgaatttgaacctgcgtgtttatgaattgatatattaattatgttttagattataagtcattttgactttagttaaagttaaattactttgacaaattttgtagacaaatatattaatatatacaacaccaaattagtttcattaaatctatgattgaatatgtttttatagtatatttgtcttgtgttgaatatattactattctttcctacaaatttgattaaacttgaaacaatttaactttgatcaaagtcaaaacgattatagtctgaaagagagagtaccatatattgatatatcttttttttttcaaaatttcacagtaacattttggatgacatggacatgctataaaacgagaaaagtgtgtagtgcaaatcataaatatagtaaaagcctaaaaactatcatcattaagagtaaacaaatttattccaagtaaaacttttactcatgttgaatttggtagtaaaattttcatcctcggtgatgtgaataaaatattaggtgtccttttaatccaataatacttttcacgttttcactagatatatattgtgctacatattttcacataaaacgagaagacatgactaatatgtgcacattaattttccaacggagaggccttaagggcaggtttggttggtgactaaatttgccgcaccttataattaggcatgtcacagttttagtatgcggtgtttggttcatgccataaatctactttgcctaaccattagccttagttacgtggttcacatgtcatacattttattttgttgtctaacttggctataagcttagtttgttattttgtttgccataaaagtgggttttgctcatgccgtggctctttctgcgctccgtgcacctggcggtggcgaacggatcagcggaggcccaatgcaaaaactagctctgcacaagctcggacggccttgtctccttcctaataattctctgattcaggaatcactgaatcaggatacgatacttctccaagaaaaaaaagaatcagctacgataccgcgtgcactgacgtgaaccggacgatcgaggcgcgcgatcaccaaatcgtctttgacgctattaaacccgcggatcccagctaatcttatccccatctctcgcagtcgcagggcgctataaatcttatctccatcgaccgcgtgaaatgtagctaccggccaatcaacgtcgataaaagaagcgacaaaacaatttttactttgtacctctggtcgaaagcccgttctttttacatggatatcatacggtggatggtcaaagaatctaagccttttttccctgacaaaaattgtgactgatagataggaactgatccacctaaggttgcacctctccatccatgcactgcaactgatatgactggttggcattatctgtcttttgtttctgcttcacctgattcattgatgaggtttatgctccatatctaaaagctaatctcgagccaatggtatgtaaacatcaggggataaaattacactgttcgtaatcaggacaccagggcgggacaagaagggttacttcactgaagaatttgtcccgtatatggcacaatatcggaacgataactaattactctgtttgccttcgttttcagttttcaaatcgactgataaccttcctgcagaatcagggcattttagggcacatgacaagagatggcagattagagaggttgcaccgccggtctgccgaaaccgcaaaagcgagagcaaatcaactaatctctttttagcgcagctaatcagccaatgaagcacgcactagtatgctaatcgatcgattagtagcccactttgtcaagtgcaagtactgtttttcctgtaaaaagtactgttcgcaaagacttgacatgttttgtttggacattggagcaactgtatgggtctgaactctgaagaggattaattgttcagcacaattggtattttaagcttgaacatattttaaatctgcagttattctaataagtaaattacagctacggtgcacgaacttaggtgcaatagaaacaggtgtaacaacctatataaattgttcgcttcagacaacaatttgcttgcgtagtcacatgcaaaccaaagtcaaaatgatctatatacgcaatcaaaacatgcagccaaaatttactaccggatattctgatgttgtggttttagctttagacatgacaaaagttgatgcctagaaaagacactgtcaaaatatttatctccagttaaataggactataggttagaaatgcccctagctagccccaatgatcagactctcttcctcgatctcctttttctccctcttgcaagcgcacagcttggaagagggcaaacaacgcctcggtaccatactaggcaattcggctgtgatggtgtggtatcaatagttcctttattttatcggtgatatctattggtttgtttattcatatgcttatctgaatagattatgagcaaataaaaaatatttctaagtaaattttttatatatgcgtccttagcgataaaaaataaatgctataaaataaactacgatgaaaaactaaactttaaaattaaattcttaaatttaaattttgagttataagcataagcataaaagaaacaatgagccatacagtttgtacgttttgatgaaataatcatacgtgttatatataaaatttgggttctcacaatgataatgatttctgcatggcctctctctagctgccttcagtcattaaaaaataacaaagtttgctatacgggacacccgtaaaacatgtaattagttagggaccatctcactcacagtataattttatggattctctctctaattcctcaaaaataataaaattatcattttttacgatgcccctataacataaacaggttcttactgtatcgctcagctaatttcatgccttttgatatccttaagcaaatttttccttaaaaaagcggatcgcaacagtatttgagaagcttagttttttttaaaaaaaaaaactgagaagcttacttcacacggccataggaatacgctttgcatacacgagatgacgagaagactatttgtcacgttactcacgtactccttctgtaaaaataaaataaaaaaaaatcaacctaggagcgtagtctagattcgttcatctaggaggggtcagattcgttgttctaggaggatcacattacatccctttttaggttaagtttttttttttggacgaaaggagtatgacgtaagcttgccagtatctatgtaatggatttagagtacatctatgtatatatgtgtatttgaaatatcatatagtggtgttcttttcttttaatgatgaagattaagttttttacgcaaaacgatatagtattaacgtatgattgattgagttttaattattacaaacttaaaaaatagatcaatatgatattttaaagcaacttttatatagaaagttttcgcacgaaacacaccgtttagcagtttgaaaaacgtgccacgaaaatcttaatcttcatccaacttttgttggagaaaataacaggagtgctatgctagctgctcaaaggtccagctaacgtagcaagatcatatgactatgagactgttaagaagtaattttcaaaaagagagagagagagagagagactgttaagatgtgttgatacttgatgggcttttgaagtcggtccatacaaacaaggaataagtctattttgccaccctcaacacatgctcttggttaaatctcatccctcaaccgcaaaaccgggtataacccgtcctctaacttctaaaaccgctacaaatcagactcttaggatggttttggaggcggtttcgtcctacgtggtagttgacttgctgaatcatcaagcgggacccacttgtcagcggtctccacctcatctctcctcctctttctctttcatctttctcttctctcaccttctatcgacacagaggcatcgcgcagcaacaacgcattggggaggagctcgtcggctggccgcgttgcgccgcacgcgggggagcagcctggctcgagcacgcaaaggaggcgggagggcgtcggggcatcgtctgagaggggggaagaggggggtcgtggaggatgaggcagccaactacgcatggggaggtggtcatcagccggccgtgcgcaaggaagagctcgtccaccggccgcccgcagggaggatctcgtcggcctaccaagcgcggggaggggcacttcagcatggtggccacacagggaaattcgtcgatcttcacgtcggcccggctcgagcgcgcagaggaggtgggtgggcgccggggcattgtccaagagggggaaggagatggtcgtggaggacgaggcagaggccgcacaggcaaacccctccacgtcgacagcagcgacggtcggcgaggaggggaggcgtgaccctcgtgctccatcccgccgccgcctccgtcaacgccggtcggcgttatgcacctgagaggagagaaaagttatagagagaggagaaagggtaactaacgtgtgggccctgaacgtgcagagatgtagcctagagggggggtgaataggctttcctgaaattttctcaacaaacgcagcggttaaattgacagggcccgaaacctcctggtgatgaacaccggaacttcctggcagtgatgagcagcccgaaacttccggagttcttgagccagaaactttcgggcaacagacaaaaacgaaatatgagaagtataacaggtcctaactagtgaaaatcaggcacagggttgcacaagatgaaaatcacaagataccagcagattcaaacactgatcaagcacaagagagacataggcgatttttttttccaaagttcagatcacacggatcctactctccgttgaggtgctccaaagagccgggtctcgattaaccccttgcctcacttatgcaaagatcccagaagaggtccacagccttcaactcaacacttctaggtcgttttctagaattgagtgaccaccaagatccaactcataattccttctagaaaagaccacaagtgcaagttgctctacctaggacaacctctgaaaactcagcacaagaaacttcactcacttacctcgtttccttgcggaggtgaggaaaaccttcacaaactttctcgggacatccacaagatctttggaagctcatgggcgacgcctaaccgtctaggagaagatctccaagagtaataagcccaagtgacagcccacaaggtatccaaagtgctcaatcaaacctaatcttcaagccatctccaaaacactcctacactctcgtctaatctctcaatctcacaagataggctctagatttgagtggaggaagcaaaggaagcttgggagtggctagaaaaccctagaacatgaatgaacagaagtggaatggccaaaaggtgacctggggacgaaattcatatatataacggctaggtgatatcatctagccgttactcacaagtttgaactagaaacctgccaggaggttccggacaaaagtgccaggaacttccgggcagcacttaggaaattttttgcaaataaacggtgcccggaagttccggccagaacctccgggtagccctctctgtctcggggagaaaatcatttttcaaaaatgattccaaaaaatcttttgactcatggatatgactaagagcactttgtataccctagaaccacacttgaaacccctcttaatagtacggtttttcctaaactcaatttcgaaagtgaaaaacctagtctaaccaccttcgatgatttttgcacttaggaacatttgaattggggggggggtctccttgcattcttagccatcccaactcgctttgggactaaactcctgtgaataaacttgataaacacgttagtcccctttaaccaccttgtcattaatcaccaaaacccactagggggtttaagtgcatgttcaatctccccctttttggtgattgatgacaacatggttaaagcacacaaaaagataatagaatttaaattttgaatgatgagagaagtgtgaagctcctcctaaagatatgcatataatgaaatgagatgaatacaatatgcataaaaacaaaggaaagctcaaaagaaacttcacactaccctcaatcaaataagatgcagaagtgagtgcttgaatgatgagtgatatgcaagaagaaagactagatgacatggcaatcactcaaaaagatgaaaagaacacatcatcacatcaaaatgcaacatccatatggtctaacttactgataaaaaggataataaagcatctaacagtcattacatccaaccataatagaatacgattacatgtccatatagagagagataaaagagaggaaatctgcctggccggaacctccggatcacaggccccagaacttccggccaaatgaccagacaacagtcaaggcagcaaaaaggatttaaatgacccccttcaattcacaatttctccccctttggcatcaaggcaccaaaaaggcgagaaactatgaagagaagaagaggatcactcatctccatcagagggaacaatctcggtatcgccggagagatgagactcatcggactgagcagcggtgtcaccctcatcaacatcaatgggggcatcctcagcagctgcctcggtgtcaccctcatcaccatcatcatcatcatcatcatcatcatcatcatcatcagaatgggaagattcttcattgaagaaggtggatggaccttcaccggcaacgttgcgggctgcctcataagcctcaaatggatcaacatagacctcatcctcagaatcatctgacacttctttcctagcctctcttctatcttccttctgacgcctttcgatcttcttcactttcttggcagtcttagcacacatacagaaaattgcctgaagtgccttcttgatgggagaaaaactcgaggaacttggtgggccactagtagaaggaccagctgaagtagaaggaacagatcgagggaccactggagaagagaaaggtggagcacgagggcgaaaaggattatggtgcccatctttgatgtagaataccccggtgactgtctcaatcatcttcataatgaaaggagcatagatgcaaccccgcttaggctcaagaatggtgttggcgatctcataccaaatcaatttcatcacattgaagggaggctgattgtagcgcatgcgactgagaagatgagcatgcttggatggcaaagcagtagcatctccaacctttggaagcaaagaccaatgaaagatggagtacaacaccttgtagttgggatgcaatccatgagtagatcccatgcaagtcctaggagcatcctttgcatacatgaacttggtcttgatcatggggagagatgcttcactatgaatgttgggcctattgagatcctcatcatctaaccccaacatctcagcaaactatgccatggaaatcttgtgcctaacaccctcagtcaaccacttcacataagggg

SEQ ID NO: 65571 - DNA, 2263 bp, Oryza sativa
  unsure (1)..(2263): unsure at all n locations
caaaagagaagatcaaaagtgctaccttgagagaggaaactgcgaatcgatcacggaaagaacctcccagccatcaatgtagatgaatccacggagaataatcgaatttgattggagggaaaagaaaatcaccactcggggcactgtagtggcggctagggctggcgtcggggagggagaagaatgaggagagagactagggtttctaactccccctaagaatatatactccccgacacccggaggtttcggacagggaggcccggaacttccggcctgacagataaagggcagtcaggcccaaaaccatggtagagacaaggaatcaaaaggaggaatagatgtatataactagccaacaagcaatcaatacaaaactatggtcgatatacatcacaaggagaagataaaaaccaaattttcgcaataaaaggcacacaaaggaatttcgcaaagattttcaaaaaggtttttggataaaaagagggaatgtttgagctttattcctagtatcaagaccatcttctacacaagaagtgatctcaagacacaaaagctcatttttttttaatttacattttagtgacatatgtttggctataaattagcaaaccacccatcacctaatgttgcgagaatctaagatattgagctcactcctaagctcgcaaaatcttttctcatctaaaggtttggtgaaaatgtcggctaattggctctcggttctcacatgggtaaggcatatgtctcctttggtttcatgatctctcaagaagtggtggcgaatatctatgtgcttggttcttgagtgttgaacgggattgttggctattttgatggtactctcattatcacataggagtgggatcttggtgaagttgtagccaaaatcttttagggtttgtttcatccaaaggagttgggcacaacaagaaccggcggcgacatattcggcttcggcggtggatagggcaatggaattttgcttcttggaggaccaagaaacaagggaccgcccaaggaattgacaagtcccggttgtgctttttctatcaaccttacactcggcataatccgaatcggaatagcccaaaagctcaaagtcacaacccttaggataccacaagccaatattaggagtatgaactaaatatcttagaattctcttgacggcaatcaaatggcactctttaggctccgcttgaaagtgagcacacatgcaaacactaagcatgatatcgggacacacattgagcgatataccttttggagcgatataccttttggtccacacatttaccattgtcgtcgaggtctaggtggccattagtaggcataggaanntgatgggtttggcatcttccatcccaaacttcttgagaatgtccttcacgtacttggtttgagagatgaaagtgccctcttgtgcttgcttcacttgtagcccgaggaagaaggtcaactcacccatcatagacatctcgaaccttttagtcatgatactactaaattcttcacaaaaagaggcattagtagaaccaaatattatgtcatcgacataaatttggcatatgaataaatcactcttaaatttttttagtgaagagagtagtatccgcctttccaatttcaaaaccatttttcaaaagaaaatctcggagacattcataccaagctctaggggcttgtttgagcccgtagagcgccttgtggagcttgtacacatggtttggcaactttggatcctcgaaccccggtggttgctccacatagaccaactccgagataggtctattgagaaaggcactcttgacatccatttggaataacctgaaatcatggtgagcggcataggctaaaaggattcggattgactcaaggcgagcaacaggtgcgaaggtttcaccaaaatcgagaccctcgacttgggtgaacccttgcgcaactaaccggactttgttccttacaaccactctatgttcatcttgcttgttgcggaagatccacttggtgccgatgatattttggtcaggtctctccaacaacgtccatacttggttgcgagtgaagttattcaactcctcttgcatagccatcacccaatccgtatcaccaagtgcatcttcaaccctggttggttccaaagaagagacaaacgaatagtgttgacaaaagttagcgacacgagaacgagtagttatcccctttcttatgtcaccaagtatgttgtcgacgggatgatctctttggacagtgtgatgta

SEQ ID NO: 65572 - DNA, 1586 bp, Oryza sativa
aatgccatttttaggaggatcataaggggcggagaactcgtgcttgattcccacttcatcaaggaattcctccacttgtgtgttcttgaattctcctccattgtcacttcgtaccctcttgatggtgagatcatagaggttttgggcttgcttggcgaagcgcttgaagacatcttgagcctcactcttgtcatagagaaaatacacccaagtgaagcgggaaaaatcatcaacaatgacaaaaccatacttattacctccaatacttatgtaagccacgggcccaaataaatccatatgtaaaagctcaagaggacgtgttgtagttgatgttcttgataggatgtggattcccaacttgtttcccggcttggcaagcactacacacacgatctttctcaaatgtgacattagtgagcccgaggatgtgttccccctttagaagagttgccaaattccgcattccaacatgggctagtctacgatgccatagccaacccatggaggatttagcaatcaaacaagtttccggattcactctatccacatcgaaatcgacaagatagagatcaccctttaacttgcctttgaatgctacggaggagtcatcccttctaaagacggtcacatcctcatcggtaaacaagcaattgtaacccaacttacataattgagaaacagataataaattgtagcttaatgaattgacaagaagaatattagagagagattgattattggagatggcaattttacctagaccaattacctttcctttaccatcatctccaaacacaatattctcacgagttccgttctccttatcaagacttgtaaacatactcctctctccagtcatatgattggtgcaaccactgtccacaacccaacttgaaccaccggaggagtatgcctacaaaagaaatcaagcttgggatttaggaacccaaacctgtctaagtttgggtcccttgatgttagttaccaaagcctttggcacccacacacaagtgcggtactcatcattgtaattcacattaaaataagcaaccactttgccctctgaatttttggaaattacatatgaatcatagtaaagaccatctggctggaacctcctggcattatgcccggaacttccggtcatgtcttgtgcacggccattggcccgaaacttcctggcaaaccggccggaacttcccggtgggaatttttgagagacagagactcccacccagaggtttcgcccggtttgtccggatgttccgggtccctggcagctcacaagaccagtcacctcacttgcttgtggagctttaccttctcgcacaaacatcaagcattctttcccatttaccatcacacgcttaggcacaggacttccacccgaaaacccgagctcgtgtccatccttgttaggatgagcggtgatggtcttgtaaaggacatcttttgaatggtatgtcttcatgcatccatatttcaccaaagtgctcaacctttcattctctttcttaagagcttgcatagcgtcaatattagtagcataagagttcaaatcaatatcgtaacacctagcacaacca

SEQ ID NO: 65573 - DNA, 1682 bp, Oryza sativa
agcgggtttgctaaagctcttaagcacatcatctaattaattatcactttcctcatcactagaatcaacatcaagagaagtttgagagggcttttgagtcatcaccttgcggccttgggccatgaagcaagagtagtggtaggagtcgtcgtcatcatcactcaagttgttgaagagacactccttgcttgaagaggatgacttgaaggcgacggtagcaacaccaccttctccttcaaccttgtcttttgacttgggcttgggcttgacctcgggatcttcttcatctccggagtgccacacttccgccatgtgtgcctccgccacatgagcacgctccggcttcttcttgcctcccttagccttagcttcatttgacttgggacaatcggcaatgaagtggccatattcgccacaattgaagcacgctctctttgattgcctctttcccttgtcatcatccttcctccctttgtcatagccactcttgcgaagaaagtgcttgaatctcttgacaataaaagccatttcttcatcttcactttcttcacaacttgactcttcttcttgttttgccttcaaagcaacttcttgattttttatcatggcggcattattcaccatttgtctcacttcacgagcttcctcttcttgcatctcatgagacacaattcttccaagaatgtcacttggggtgagtctcttgaagtgtttcctttcccgtatcattgataaaaaagagtgggatttcttggaccaaatgcacgcagaagtctcttgaccacaaagtgatttgtcatgtcctcactcccaagtcctttaatcttgttgacaagaatcatcatcctatcatacatttcttgtggtgtctccttgacatccatcacaaatcttccaagccttccttccaataattcaatcttggcctcacgaacggcgggtgatccctcatgagccaattgcaaagtatcccatatctccttagcctcctctagtccatcaaccttgttgaactcctccggactcaaggcggagagaattgcattagaagcttgagcattgcggtggatgaattgttcttgccccgaagtgagctccatgtcatcatggggtatatcaatacctgtacaaacaactttccaaatacttggatgcaaagagattagatgcaacttcaccttgtgcttccaagcgtcataatatgtcccatcaaattgaggagtatgcccggaaggcatggagacgaagtagtgagagggaatagtaagtttgctgtaatcaaaaggtatagtagctcccttgggtggtggagttcccttgctgcttgcttcatcttcatttccattttccccattctttccccctaagtccaacatcgtggatcactcaaagcggtgaagcttgaatcaagagcacctcgctctgataccaattgaacgtgcagagatgtagcctagagggggggatgaataggctttcctgaaattttctcaacaaacgcagcggttaaattgacagggcccgaaacctcctggtgatgaacaccggaacttcctggcagtgatgagcagcccgaaacttccggagttcttgagccagaaactttcgggcaacagacaaaaacgaaatatgagaagtataacaggtcctaactagtgaaaatcaggcacagggttgcacaa

SEQ ID NO: 65574 - DNA, 7359 bp, Oryza sativa
  unsure (1)..(7359): unsure at all n locations
tttcaaaaatgattccaaaaaatcttttgactcatagatatgactaagagcactttgtataccctagaaccacacttgaaacccctcttaatagtacggtttttcctaaactcaatttcgaaagtgaaaaacctagtctaatcaccttcgatgatttttgcacttaggaacatttgaattgggggggtctccttgcattcttagccatcacaactcgctttgggactaaactcctgtgaataaacttgataaacacgttagtcccctttaaccaccttgtcattaatcaccaaaaccccctagggggtttaagtgcatcttcagggccgatatgtatttttattgttttattcactgacaggtgggtcccgtttatgtttgttttatttgagtaccatgtaagcgccacgttgatgccacataggatgaagaccaagtcaactcgccacgtaagtgccaccgtagaacaaaatcgcctccaaaaccgctcgaggagttgatttgcaactgtttcgggagttaggggacgtgttatacatgattttgtggttgaggggtgtgattcaaccgggtcatgagttgagggaggcaaaatggacttattcctaaaaaatacaaggcctgagcccatgcggaattatctatgattgccacttcaagttgggacctactagtatgcaacagccagaaaaagagaaagaagataattagataaacatgacgttgacagatggattcaaatagttttttctttgctgattcagcactgatattgctgatgtgacaccgtgttatgttagcatacgacttgcagagtttgcaatactccaaaaaccagtttagcatcaataggattattagttgcaaggatttaatctggcttttacggccgaaatagacatttgaggtttagttcgggaaactgagctcgcacagtatcatcctccaaataatacagcaaggtacagcgaacggcttggtgcagtgatgctgtcagtcttgcgtgtgctgcgccgtgcgagcatgggctgcctgaggttgcaaacgcgagccaggcagccagcacagcaccatcagccgcgtcactccagctacagaaaaatatcgtactccgtcagaatcttggcccgctgcgttattatttataatctgctaattaagaaacaagtggtactaaccattcaaaccccatcatccattgttgcccccctaatgatcccatccacgcccatcatccaagcgtgcaagccagaaacggtaggcagcagttgggccaatgcattaaacaaaggagccatccgctgtggacgtgatcatgccgtggatcatcctagcaccagcaagcaaacgccttttttttctagattctccttggaatgaaggccggaatccgagccgtccatccctcgatccaacggcgcanaatcgatggctaccaacaaacagctcacgttagctgcctcccctgggaacccccctgggaatgggatcgatccggcgacccggaaaaggcgccgattctgacgccgaaaggcgggcggccctgcagctgagccgaaacgaggctcggctacgccgtgcgccgcctcgccgccgtcgccgcgagcggaatttctttccggtcgatcgcgtttgggatttggggatctctttacgcgaagtcttgtggtaggctcatcggcggttgattggagctggagtcgccgagcccttttgggtccaatccagatatatatacttgcctttctgaaaaggcacgggccgtgaccaatgcggttgtgtggatgtttctttacctcctggggccgggcagattgatcgatcgatgttctctcacgtccggaccacaggttttgcgatggaaaatggtcactctctcggtgctttacttcgctacttcaagggtttttaattggtagtgatggtggttggtttacgtatgtttcatgtgatggtcttgtacagttgtgcataccttcaacactatctttatatactttgagcacacatcaacgctcactccttatagcaatatgtataatatgtatgtactttctaacggaccatactgatataattaagaattgagtggatgaattgaagataaagtattgattcctatcacgattacttacagcggacgccggacgaactcctacacatggcgaaaaggggatataaagaggatgactacgcttttaagtacatagtgcctgttttgatcccctgataaaattttacattctgtcacatcgaatgtttggacacatgtatggagtattaaatataaaaaaaataactaattacacagtttgtgtgtaaattgcgagacgaatcttttaagcctaattgcgctatgatttgacaatgcagtgctacattaaactaccttgtgggaacattttcgcactgcatggtaagaagtcgcgaacagtgggaaagcaacaggatggaagggattgagagccctcggacacccctacaagtcgagaacgacaaatatgaagaaggaaactttaaatttttaatataaaaggtgatctgttggagctgatttttaaccatttatccaaaaatcttgtacatgtattatcttattgggaaaaaaaggtaatacagtttagcataagaagaagaaattaggaatgattatagtgttgccaggtagggcaatggataataacaagagggagaaaagtatagaagcttactccctccggttttattttaattgacgttttggacaatgacacggtctacaaaatatacctttgacattatttttctattataatatacacaagaaataaatgcatgtttatttttattatagtgttttgaaagacaaatctatatatgttgttctagtttctttaaactaaatatttttgaagttattgatggtcatagttattgaagtttgactttaactttatccaaaacgttaattattatagaaccggagggagtaggttttactccctctgtcccatagtataagggattttggaggatgtgatatttctgtccggatttatagttctatggaatatcacatccctttaaaatctcttatattataaaacggagagagtaggagggatcaaaattgcagcagaccagcactattacatagagtctctctaacaacagtacaattaagtccgctacaaactaatgaacgatagttactgtgaagctccttttgaactgtcatatgttactgtagcaatatagtccgaataattagagtcgagagcttttgccacctctcgcatccgactgttctccgttgcattttcatgtagaagatctcattccggtttaggaagaaaaaaaagccatagttggaaaaaagtgcattttagatccgggtcatagatttgttctttcttttttatagaatagtaagggcatgtttggattgatgccctacaaaaattttggtagtgctaaatcttggacaagttttggtactactaaaatttttggtagggtagagttgaaaatgtttatttggattgaagtcaaaatttacccataagagataagtttataggcaaagccaaatttatagcataggtagagttttagcagaggtgtttggtttgcaatcctaccaaaattttgataggacaaattttggtagggtagcaatttaaattggccctaactctcggcgacagctacaaagaggccatatacaaattttcgagatacgcaatacggcgattttccattgcaagggggcgcaactctagcataatccggacgaacacttgcctccacacagagcgaaccaaatgcacgggttaagtagtaccagtacgacgtgtccatcccgttcaacacttgccccccgctctgaccgccgctgccgccaaggcgacccggtcggcggtctcccctgctcgccgcttgtttattcctcgcagtccgcgctccctcctcccggtaaacaaacgactcctgcagcctgcaggctactcctaccgctacatcaaccgaggaaaaacgtctgtcgcatgtggtgtgtgtgcattaataaaaaaaaatactatttataatattcgtaagtaaattgtactccctccgtctcaaaataagtacagttttacactattcatgttcaacgtttgaccgtccatcttatttgaaaattttttatgattagtatttttattgctattagataataaaacatgaatagtactttatgtgtgactaaatgtttttaattttttcacaaattttttaaataagacggacggtcaaacgttgaacgtgaatagtgcaaaactgcacttattataggacggaggtagtaacataaatttattaaacctaattaattttttattagcacatgtttactatagcatcatattgtcaaatcatgatgctctcctaattgatagggcaaaacaccatccctgcatgtatgtaattggagtaattacttccttcaccccacaatacatatctatgtaccnnccaaagtcggccgaaaacattatcacttgaaagtactacttgccacatttaaccacttcaaattcaaatttcttctgattatactcccaaacaccatcttacattcaactatactctctccgcctttaaaaaaaagtaacgtttgctatgtctttttatacggagggagcacattagttactaaaggatattataatctttttctcttattcttagtatatgctaaacaacctagaattatatgtattttgctacggagggggtatattttttaacttatgggtgtatttagttcacgccaaaattgtaagtttgattgaaatttgaacgatgtgacgggaaagttggaaggtgtgtgtaggaaagttttgatgtgatggaaaagttggaagtttaaaaaaaaagtttggaactaaactcagcctatatttaatactccctctgtcccataatataagggactttgagttttttttcattgtttgaccactcgtcttattcaaaaatttgtgcaaatataaaaaacgaaaagttgtgcttaagtgctttggataataaagtaagtcaaaaaaaataattctaaatttttttgaataagacgagtggtcaaacagcaccagcaaaaacttaaaatcccttgtattatgaaacggagggagtactttggtatatgtgttcagacgttcgatgtgacgggatgtaaaattttaacgtggatctaaacagacgatcaaacaacatcgacgaggagtaaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgatttagcttttatttatgtaattagttttgtaagtagtctatatttaatactctaaattagtgtttaaagacagggagacagggactagtccctgatgtaaacaccacctgaaacaacgaccgctacgctaggtccatggtcgtggcaacggcagcgcgtcgggagacgagctgagcaagcgagacacgagaccatcggcggccacgctcttacacgccatcaaccgcgagacacgactcacacgagactccccacccatcctcctccgtgcgcgctggaggaggtggaggtggaggtggtggtgtccgctgccccccgcaataaataagcctacctccatgttcccacccccctctctctctcttctccgtctcgcctcgtcacctcacctcggcatcacccaggtgggagggggtccgccttgacttttcgtgttcgggtttgggtttgagtgccgcatctgcaagcttgtgcgaggggggaatctctcttccttgctgtggtggcggcgggcgggagggcggcgttgatttcgttggggtttgcgttgcgtgcggaggacggggttgtgtttgtgtgtgtgtttgtgctgatttgggcattggtgttggtggtggaggaggatggggaactgcgtggcgaggagcgggacggcggtggatgcgggtggtgatggaggggaggatgggaagaggcggaggaggaggtggaaggcgccgcgggaagatcagctcgggatggtgcccggccggatcttctccaacgacggccgcagccggacggcgacggtgtacacgcagcaagggcgcaaggggatcaaccaggacgccatgctcgtctgggatgtaagtggaaggtttctcggctctctctctctatctctctccccctatctaattcccgcttttctcggcgcgattggctgacttctcgtttgattgatcgtgaatggcaggggttcggcggcgaggacgacggcgtgctgtgcggggtgttcgacgggcacgggccgcacgggcacgtggtggcgcggagggtccgcgactcgctgccgctgaggctcatgtccgcggcgcgcgacagcggggcggacatgccggccgccgcatggaggaaggccttcgcgcgcgcctacaaggccatggacaaggacctccggtcgcacccttccctcgattgcttctgcagcggaagcactgccgtcaccgtcctcaagctcgtacgtgccgtggacaccggacatgacacgcatctcctgtccatcacccccccgtcctctcaaaaatgtcaaatcgaatctgcctactatgcgtctacgcacggcggctcacggggcgatttctgcatgcagggctcggatctctacatggccaacattggggactcgcgcgccgtgctcggctccagggaggccaccggcggcggcatggtcgccgtgcagctcaccgttgatctcaagccggatgtccccagtatgccactcccctgcttccactcacccgctaatcgtgttaggaggtcgtgctcttgcgcttatggtgctggttgtgatttcaggcgaagcggagaggatcaagaagtgcaggggcagggtgttcgcgctgcaggacgagccggaggtgccaagggtctggctgccgttcgacgacgcgccgggcctcgcgatggcgcgagcgttcggggacttctgcctgaaagattacggggtcatctcggtgccggaattcttccactggtctctcacagaaaaggaccagttcgtcattcttgcatcggatggggtaatttgctcgaacctatcacttgaacagataattcattgttctctgtttggttgttggatatttgcccgtgcagcgaatgagtatctctgtccctgcaaaat

SEQ ID NO: 65575 - DNA, 8141 bp, Oryza sativa
cttctttgctgcatgcctgcatcgtcacccactttttgttatcagctgtactcaaactgttaaatcttatccttattcaacttgactcggttgattgatttaattgttgttgatgagatcatgtgcacctttcaactgtagcagttagaagtgagcacattaagctaatggcatatggagtagccaataaaattaggaagtcctaatggtcaataacttgttttcctgtcaatagtctacccatctgaataatgtgggtattctaccagacaaacccaaactactttgggggaaattacacgatagatcccagttcacttcaattccacgaaaatgtcataatacctagaatataccacactgttgactttcacttaactccatcatcttcacctctcctcttgttcatccacatgttgtcatctttcttcatcgatgcatcatgtgcctgctgactggtccacaccgcctcaccctgcggataaaacgtgacccaaccagtaatgctcctttccttatcgtgatcgcatactagtacctcgtgtcaccaatcatgactgcgctagggcattgacaggccacaccgctgtgaccatgactgttcacaatattgccaacacctttgtctagtgtctacgtgcagccacctgcatccacaacaatcttttgctacagttcaagaaaaaagtgcactgaaaatgcagcgtgttggaagatggggttttttttgggggggggggggggggggtggggcgcagagcagcaacataaaaggggagcatgggcgatgcagggctggcagtgctcattttgtttagtggttgtggtagcgtcattgctaagaacagatgagatgataacatagggtgctggtcagcaacaatagtaatggagggtggacacaattagctgctatccattaaattcagcaccaatagtaatggagtatcttttttttctggtattaaaatgaactgggttttttttttgtgatatataccaaaactgaatcattcagtggtatagtaggacatcctacttttgcttaaatgtttcaccaattaatttctgccactttgtaatggagtggctttaagcttgtcatttgtcaatcacttgaagtggatggttttcctttcttttttgagcattaggtgggaatcacgtatgttcaatttttttactattagggggattgaatttggtgacactcaataggtagtaccaaattaaggcctatatgtattgactttataaactagcggtgtcatgcatgatcatatagcatgaagactggttagtgtatcttaaaggtcactgctatagagtggcaatctgtcagtatgaaagagctgtgcagactattgcattgtggtttaatatagtttaggtagtccatatctaatcaaacagagccttattctgttacacatattactttacttcagctgcaacttcttggtcttttccctcctagtctcctgggctgacaacttctattgacaagtgaatgtgtgcactgtgcaaatcaactttccttttcatttttatgtcaattttaatactgttgttatgtgtgttatgtacttgtcaaggttatattctgagaaaacttataattagtaaccatctatcaaaagtttctatccttgaatgtactatctaatgtatactgccaaaaagtgatgtttgaactttttaacctattatgaaatggttgcaattggcgaggaaagatgtccattttacccatgtaataatggtatctagtatcacgcaaaatgattttataagaagaaaatagttaggtcgatgtcaatcactgtctaccaagttgatattgcagctgtgccagaggagagcaagcttctttagttcctttttgtattgaatgtagtttgaaaagtcgaaagactttagtttggaatctggaaaagaacagataagttacttggtctgcttattcatgccatagaagctctcaatttgtcattgtcttttcatgtatgtcatatatcccttgtttgcatgtatagttcttactgaagttacacaagctatgcacatacttggctgcctttgtagagtttgcactaacaaaaatcttgcaggtatgggatgtcctcagcaatcaagaggctgttgatatagtgtccgcgtccccaagcagatcaaaggctgcaaaatcccttgttgaggcagccactcgtgaatggaaaaccaaatatccaacatccaaaatcgatgattgcgcggttgtttgcttatatttggatggaaaaatggaccatgagcgtgactcaactgcctcattggacaacatcagtattgaagagggttcagttgcagatcctaatgaacctcaggagcaggagcccaccttaactcggaatttcacagttaggacagttgcaggcagcacgcaagagaagaccttagcaggggtggatgcgaggattgctggtgtagcgaacgaccaaaattggtcaggtctcgatggagtgacacgggtaaactcacttgttcagcttcctaggttttctgaagagagggcaattggctgagctgcccatcttatatttacccccgttattttcacctattgttctgaattttagcgtagttgttctagagaaaggtagatgtgggacgatcttgtgatttggtgcggtacttggcaagcgtttcagccactatgcatagaagtcgagttgcacgttttagcccaacaaaactgcacattgcataggacagaggctctcttttcacccatcttgaggcatgtcaactccatacctcgaagatgaagcacaaaagagcaggccattgctccaaatctgcaattttgctgggttaaaactaacaaaagacgacgccaaacacagtggctaaacgcacgccaggccccagtcacccctgggatgatattgtcgggtgacctgtaaattctccaccggcgcttgctttgcttttgtagagaggtgatgtccagaccattttctccgctgcatgcttagcttttgttgacacagggcggtgcgctctgtcgatgtcggattgccaatctttgccccctttgtttgttcgcggtctgtgcccttgcttttactctcctggagccatcatgccaccgagaaaaatggcagtctcaatacttttaggccccctttgattccaagggaattcataaattttagatgattttatttctataggaattttttctacaaagccctttaaatgaaagaaatgaaccctatggaatcctatgaaattcctatggaatgtctcttcctatacaagtttttcctatacaagttttgggggaattttaacaagaggtagaacctcatggaaaaaattctttgagtctttatctcttcttaaattcctgtgttttttctgtggtccaatcaaacgatcattcctacgtttttcctatgttttgcaattctctgttttacacttacattcctatcagaatcatatgtttttcctattcctacgattcaaagaggcccttagccttaatggtggtgaactggtgactgatggtgcatccgtacaccaccgtacatggcacacgctgcatcttgtctgaaatggcatgtgaccggccgagcgttgctgcgctgtaggcgtgcgctggtgagcaaaatttgtccggcgacggtggccggccgacgcacgggcgggtgcaccgtgcaagagagatgcagggggagacaggcatccggcagaccggcaccgtaccactaccgacgggctgcacgggcacctatcacgtgaagtagatttgccgtccatcctgtggctgaccatttaacgaatcttacagcttttattgggctttcacacgcacattcacgcgcacagtctcacgcacgcgcgcgctgttcatacgtggttcgttgctgttgcctgtctcggtgcgccagccatgggtggacgcgaagtgaccgctcggtgactgggcggtagcgtgaggcataacccaaaaaagatgaggtgatcgaaggaataagatttttcaccacaaccgtagtttcagcggtcgagcggccgcgcacgcaacaaggtaccttcggtccttcaccgatcactggccgctgagcactatttgcatgacgcggttgtggtttgagatcagaggtgcaattgtaataaggagttgcggttcgactgaggtcctgtttagtttcaaagtttttttttccaaacttccaactttccattgcatcaaacatttcatacacacacaacttttctatcacatcgtactaatttcaaccaaacttccaaacttcagtgtgaactaaacacagcctgattgatacaaaacgaacggctcagatagctagaaaacactattcacgaattacatgtgaagaatctatactgtagtgattattgtagagtgttagaggtacaagagggtagcagagcaaatctgagactctattgtagcgattactgtagagtgtcaaaggtgtaacatggtaccagagcaaatctgagcccttggctttatcgatccaacggtcaaaacgtgttgtgactgctaaagtagtagtagtagtaacgactgcatcggatctcaattccgcggttataggggatcgtgaacgtttgtggtctgcgaaagcaaaatgaaagctcacccctcccccagcaagtgacacggcgaggagagaagacgtggacgagcagccgtcgttcgatgacgaacttccttcagctagccccttcctctgactgagaagagaagatgtagtcgagccccttctttctccggttagcttcccttaacaagatcgatccgggaaccaggccagctcttttctccaccccccccccaacacacacaccacaccctgccccgaaaccctaacaaaagaattcaggcgcacattcaaaaaataggattttcagttggcggaaccagccattgaagcccacgaaatcctagcaagtggcagcaaaaacgtgcctgccaccaccatcgccagggagtggcatcatgttcgagctccgctagtccatcttcagtcttcccttgaggacaagactacagcggcggtgcaacaacagtagcagttggaggtaagcatcacaaggtgttcctcactgtgtttatgcaagaaacctaatcgaattcatacgttgtgcaggggcatgctaatcttctctgtatcgttccaattgtatcggctgttataaaaaaaaaagaattcatacgttgcttgctgcacggtcaaatcaaatgcatgctttgcttgctgcttattgtaattgtgctatgctactacctggtcttggtgcatccatattacccaagtttcacaagcagcaagcatatgctgaatagttgcgattgttgtacccaatactagcaggaagatggaccgacggagtttgagaactgcgcccaaggtggcagcgaggaagcaacgtttctcggcggcgcatcctaccgaacgagctcagggtcattccccgccgccgacgatggcggcggggtgaacgcatgtcatcaaactctggagatgtgtttgctatcactagtgagcttgagctttcatgggttggttctattagccagtactctcttcatctcaaaatataaggaattttaaacgaatggaaatgtaacacttcctagtactataaatttggatatggagcctgtttagactcgtagtactagaaaatatcccatccattcaaaatcacttatattttaggatggaggtagtattattaagggcacacgtcatgtgagagatgttatatggtttggacagtggatgagtactgattgcacgctcgtttcagtcacccccatgaaggcagacaatcctggttccaacgggagacatataagagatgagggaggctcgagagtgtgggagcatctcactggagttataggaggacgattgacttcaaacataaaacaatttggcagttggagaagtggtagggaggagatggctagtagggttcaccaggaacagtggtgacgctatggatgcaggggtgacagaatgaagagggtgggatagcggcgatgcacaactagtgagaacaatactactactaggactctaggagacaaggaggacgagtgtgattgagggataaggtgtcttgcacaaatcttaaagagatttcatccattgaaaatcggttgattttccccatgaaacaattcaatgataggtagacggtctctataatttagtgcttttcacaaacaaacttgtagctcagtgctatgtcgaagttaatcattttccgcatcaactcgaaatttggcactgtggaagcgatactacactagacattgaaatggcaagaagttggtgccaatctctttggtgcacacctccaaacaaagtcacatttcccctctatccctcttcatatatgggcttgttcattttgctacaactttcaactctaccaattttatttggcaataaactggacaagtcgcatctttatttggcacaccttcattgaaaaattgacaaaccaggatatgatgttagattttccaagtttttttcaatcttataattaatttatgatattgggatttaagtgtggtagagaggggacaaactctcttttctgctccatcccgctcttcaaacaatggtgtggtgagttggtattagactttcaagggaattgataaagcagggtacactgattcacttctcataatatatttttacttttataatgccaatttggttgacggtcagtttgccgcatttaatattaagcaagaccaatttatacaactatttggttgaagccacagttgtgataatattctcttccaacaaattaggtctgatgcatcaataacttagaaaaatgtgccaaaattcttttagacttattaaggtttggtaaagattttgagcatctaaccttagagaagtttgacaactactattgacaaacgatggcgacttgtaaggctctgactagcaactaaacaaacactaattcttgagattgagatgagggtgcgggaggtcaacgctaacgagggtggtgccaaccttcgacaacccaagagaatgggcagcaaccccattcatgacactagttgtaatggactctataccataagtaccacggagttatatggctgtgctgtaaattgtagctggacaacccataatcgttaacactaagatgtttatcctccatgtctagaactctatagttaaattctaggtttaattttcgaaaaatggctaggaagtaaaaggcccaaatttgtaagatttaacaaaaattaaccaatctcgaaagaaattagatgctcgtacaaaccaaagctgatcaagggagctccaaaatctgaggatattcgacgaaattcgagcggaaaggtgaactcgtacttgttcactgtccatgtaacattgcgtgaaggaagacagctggagtattattgtactaccatccaaccagcagccggaagaccgatcatttttaacggaccaattgcgagaatacgccacaagttagcgtggtcaaatctcaggaaaagcactgcaagtgcgagacagagcagagaacagttcagcattttcaggctgctagctagcaggtgcagtcttccaaatggagcaaaaaaaaaaaagagaaaaaaatgccagttgcgcccagctgtccggagcacgtctccacgtgagaatcgccgaacgacccgccaccgacactgacatgcgggcccaatcccccgtacgcactcgctgtcctgtcacccaaacctcttcttcccgaagcctctctgaccgcgttgcattcttgcggctcacgagtcacgaccacccaacccaacccacccacgaagacgtcaacacgaacgcgaacgcgcgcgcgacggcgcgagccgtatgtaaggttcgctgcggcttcttcttccgctcgcccgcgcgctcatggccgcactccgccacgcgacgcggcgcgcgtaggaggcaggcggctcgtgcgtataagaggcgacgagacgagacgacgacaagaagacgccggaagcagaggcaggtagcgtagcggcggcagtgaagcgagggacgactagcgacgatgagttctcgctcggcggc

SEQ ID NO: 65576 - DNA, 3167 bp, Oryza sativa
actgtcctttgtaattaggagtagtagtttgtaacgtttaatttttagatgatgatcctctgtaattagtagttccagattaattcttttgacatgatacacgtacactgggaaaatgaattttgagaattacacagtacaatgcatatactcacaacgcacgcgcactcacccctatgagcatttttgaagaggcgcctcgctgtcgacgggtacatcgcatgccactgaagaacccagtacctcagatgctactgaggctcttgtaaccattaggctacaggtcctttcacactgagaaaatgaattttgatcaggttaagttacacttgcgctgtgtgtagttccaaaataattcttcaaacttctaactttttcatcacatcaaaattttcctacacacaaacttctaactttttcgtcacattgttccaattttagagtgaactaaacacataaacaaagccttgatgaaaaatgcactgttgtataggcgagaaatttcagtatatgccattcaagcggccgaagcatctccccgtaagctcaagctccgccgttgccaccttcactgtggattcgccgttggagtataaaaagatcggtagatcaccgagaaacaccatagccgccggactcgatcgatggcgtcgctgactccaccactgtgctactcgattcataacacttttcagaacttgttgccgagggcacgaagtgttgcattccgtgccatccgatccatccagtacaaaaacggttttccaaacagccaataatcattttcccggacgaggggaaggcctgcctacacgcataagcctgtgaaaatgaggcgccatagctacccacctgcgaaaatattttgggcgaaaaaaaaaatcaccacaccccccctacccaatccagccacgccgccgccgcaatcctcgcaccttcggccagatctagggttaaggttttggggggagagggagagggagagggagaggaggtgaggggaggttgttgcaggggcgacgccgccacccttccctccccccttcagccagatctgggagggagggagggtaaccgtcgccaccgcctggagccgcgtcgacgctgccaggagggagggaggggagggaaggaaagccgccaccgccgccctgtcccctccggccagatttaggagagaagccgccgccacccccctcccccttccctccggccagagctgggaggaaggaggggagtcaccggccaacacgccctcccccatgcccccttcagccggatctgggaagggaggggaggggaggggatccgggctgagggtggtgcgacgccgcctccgcttagagccgttggcgccgtcgccatcgcctatcccctccctctggccgaatctgggaggagggacggaagccgccgtcgccgccctctctcctccccccttcggctggatctgggagggagggaaggggagccgccaccgccaccgccgctagccactgctgtcgccgaggagagagggaagaagaggtgggagggaaggggaggggagcaccggggagagaggcaaggagaggtgggaggggagggagagggacttaggatttttgactgcatgtgacagtttttatgatgcttaaggtattttcgtaggcagatctattaagagatcccaggtagacgacgaactcacccacggttgtcatttttttaggtggtcatttaactccgagaggcctactcgtctggaaaaacatgccatcgtctagaaaaatggttttcctggtagtgatcgggaagtcacgtcgtacgattattagcattgcctgtcgtagtcgttgtagccacggaggtcgggcacgatggcatggaatccctggcccttctcatcaccatcggttagcttctcctcgtgttgctactctactctcccactccaacacactttttgaatagaaaacagcactatagtgccttttcattgaatagagcagcagaaaatacaacccctagagacaaaatgaaacaagtagaaacactatagctatacattatacagagtgcgggattaactcacgcaaccgtttagcccctactaaagcgcaaaggctagcctcttttttaatttttgatagaaaaaaactcgttgtcacctctttgtggttaaagatccgccgattcctctcctttcagcacactgggaggaccttaattagtggcaagcggcacataaggaatagctcgtcgacggaggcccgatgcgtgtgccggtaagaccttggtggctaacggcgtgagcgaggagctcgccaatggtgcccggatgcgcgcgccgggatgaccttgctggctggctggcagcgtgtgccgaaaggaccttggcggttgacggcgtgcacgaggacgagctcgtcgtgcttggacctcagcggctggcgacgcttgacagtggccagatgcacgcgaggaggacatcgacagccgacggcatgtgcgaggaggagctcgccgacggcgatcagatccattactaaattttggtaagttgtggtaagttttgaaagtgccgttaattgagtggcattactaaattttttccgttatatgcatattatacctacttgtacacctgggctgtgtttagttcacacttggttgaaattgaaagtttggttgaaattggaacgatgtgacggaaaagttagaagtttacgtgagtagaaaagtttgatgtgatggaaaaggttggaagtttgaagaaaaaattgggatctatacacggtgcaatttcagtactacctccgtcaaaaaagagtatagttttgcattgtttatgtccaacgttcgactgttcatactatttttttaaaaaaatatgattagtattattattattattagatcataaaacatgaatagtactttatgtgtgactatttttttatattttctcataaattttgaaacaagacgtacgatcaaacgttgaacacggaaacccacaactacatttaaattgggacggaggtagtatcaaacatcaaaattgagttgaaaaggcaaccttctctctctcactggtcgtggcagggcgacctcagactatagatggccaaaaggcccgcccggcacggcccggcccaggcacggcccaccagccatcgggccgg

SEQ ID NO: 65577 - DNA, 13128 bp, Oryza sativa
tatgacatatatatatatagtgaaaataagtctatttttcgtccctcctctttgggctgacatatatataggtaaaataagtctattttacgtccctattctttcgaccgtggcatataatatgtctatttttactccctattgtttatgtgtcgggcttagcatgcggcccatcgtgccgtgccggcggagaggcccaggcacggcccggtggtcgggccgggccggcacgggcccgacccttgacgggccgggccgtgcttgggctgggccaaaacgccgtgccgtgggccgggccgtcgggcctcgagccttttggccatctatacctcagacgcccctccagatcccctccttggctagggctgtggtctttgctccatgttcccaacccctctccctcgtattccgcgcgcactctttttaaattgataaacggtgtgttttttgcaaaaattttctatacaaaaattgcttaaaaaaattaaattaatccattttttttaaaaaattgttaatacttaattagtcacgcgctaatgggctgctccgtttttcgtgcggggagatgggttccaaaccatgtgttaacagtgaaatttggtaatcggcaaagacgtcatcagcttagaatcattattggctgcagcatctcggaatcagccgatgggagttatcaagtcgccaatagtcggattcctgctatattcagttaaggaaatcaatctactaaaggaagcttatccctaagtgaccgagtttaaagaggatgcggcatggcagtttatctattaattaggaatagtttgttagtttccttttatctttaggaaagtgtgtttagtgtccaataaggactttatattttccttttatctttaggttagtttctttcttgtccgacaaggaattgtatcaacccatgggtataaatatgtacacccggggtctatgtaatctatcctcacgatcaatacaattcggcgcatcgccaccttttaccttttctatttaattttatcgttcggcgggacttggcacccgacgcggggctgcatcggtgttcgatctccggcgaaggggtaagtccaatgttctgccggcccgggcaattgtctcatctacatcggcgtcgttcaaggctgcatcaagacattcgacctcttggattactctggtttggatgatatatttgcctacctatttatcatatgtctctgttaatctagtcttagcatatcaatttagctctattggctgcttctcgttttagggtttctgccggtatcggctaaatcgtgttgctagattagattagcttagacatctaccaccctgaaaactcaatcaacgacttgattgtctagatattatgtttcttttcatacttagtgccgcatcagttaagtttgatctaataagtcatgcttagaaccataatctctagcctgcttcttgattgccaataagggtttcatcggggtttcaaccggtgagttatctggacgttgcatcggctcataaggattgcatatacatataagtttgatttagccgatgacaacaaaggtttcactgtttaatctaatctgtggatttattgacatcggtcttccagccgatgtgtgcttgaaccttcggatcaatgtttattctatcatattattgttagccgattgatttatactggattatattgctatattatattatcatcagccgattgccttcatatcattatctacattggacatatagccgattgcttacaccctatcgctatcggctggtatcagcatcggctattatcggctatcggctggaactactccatcggcttgttagccgatcggctgttttgatctactatttgcatatcttgtcagttgcaggatcaaactaactggcacgcccgcatctcatcaatctttggacctgcactggagctaagcagatctcccaggccggtgtgttcgatttttttcgtcaacaccatgacatgcgaacacaccctaggtttaagaaaaccggtcggttatcatgaaactgtcgatggtcgttttctggtattggatcaattttcgtgcaacgttggttgaaagtcattgattttacaggttatcgatcggttttcgataaaccggtgagaagcggttttaaattccaaaataaaaggttaaaccatttccacgctgtcgacgggggatacccgtagaccggatatagagggtattggggtacgctggtatgaggatctacataatacgacatcaagtaggcagaaaacaaagaatatactggttcaggccccttgataggtaatagccctaatccagttaatatgggattatatgatggaaaccacatgttacaaagggaatagcggaactcgatgagatcgtagtcgagttgattcgactagatcacccggcgacttggctcctgtaggctccggcttcgtaggctgtggtggatgtgttggcggtaagattcgatgccttaggtcctcccgggggggtcccttttataccgtaggtcaactggtctccaagtaggacccggagacatcggacccggtacgatacaatgacgacccagttctatccgagtaggactctttccgtctgtgaactccataatgaatttccttaacgtatgctgaaaacgtccgtatgcacgcaagtataccatatcgatatgtaacgtatatcgaagggtagagggtataccttacccgtaaccctgacagtagcccccgatttctgtttaaatgaactcgtgaaaccgatcgcgacttccgatgtcgaggttgtcgtcgttctcagtgtgaggactgacagacaaggagtgatcgacaacaccaggtgaagctcaacggtcatgagtgaatttaaattgatgtccgaaaaactgccgcgcataacggacccagaaattttcggcggccatctctctcctttccttggaattctcaacatcggaagtgcgtctatttaagagagttttggggatccaatttgaagtccgcctattgtgaaaaaactctccagcctccaagcgtccctcgtcttctccgctcccgcaaaaaccctagctagctcatctcggtcctttctctggcgatctccggcggcaatggatctcgacaagtctacctgcaccagcgcgtcgctgaagaagctgcaggaggatggcgcccttcctagtcacgggaccatggagagagaagcaggaggtactgaaccccaacctgtcctgggtcgcatggttgcgatcgaggattatattctctgtggctttcttcctccgccttctgaatttcttctcttggtcttgaatttctacggcctttccttgctctatttgagccccaattccatcgccttcctgagtatcttttcgcatctttgtgaggcctacattggggtagagccgtttcttgacctcttctgcttttactatgagttgtgctggatggaacccaaaaaggtgtccggatgtgtcggtttttgacttcgggatggcctgaagtcacgatacatccccttccagtgcccctcatcttgcaacaaatggtgggggaggtggttctatcttcatatatcatcttggaccgccagacccgccttgaccccatccttccaatctttcatcgatatcattgatgacctccgagtacgggggttgtcggggtatgaaatcgctgccgacttcattggtaggcggatccagccactccaggcttgagcccacccagcctttgattattctaggccggaggacgcgacccaggtttctcctcggggtatttttctttttagttaaattgactcccttatgtgcgtgttcttcccgacttattgaattctggtcttgatctataggcttggacagcgcaaccgtggagcgccgcgtcggccaactgatgatcagtggcccgacaacggcgagcaacgtccccgtccccctttgcgagaaaggggcagccgagcgcgaagctgccatcaatgtaagtgtactcagcggtccttttgcattattcttccgggatcgcattatgatttcatgaagcgtaagctctccctctgactgatatcatcgggccactcgtggaccatcaggtggcggcgtcgctgaaggagaaagtcgccaaggaggcgtctgacgctgctgccgctgctaccacaacgagtggcgacaacgttccgaaaaaggagaggaaattctcctctgtgatcggacatcgttggaagacgcccaccccctcggtaagctctcctggtccttcatcacgtagtcaagaaacttccacctcacctcatatacgttatactccaggcctcggatgcgtctcccccgcttccgcgacggtagcggcttgtgacgctcggcgagaagtaagtgaatgaatttgaggtttcgtgacttcgtcaaactcttgcagtctgtctcaattgcagcctttcgcagggcggcgcgggcgaaggcggcgcaggacgggtctggggggacctccagcgcgtctcctgttgtggcctcgacggatgtcgtggtcgtgcccaagagccgcgaggcgacacctagcggcccagccagcgatctcgtggctggtcgtggtccgccggctgtcgtcctcacctgggagcagctccaggttgagatggggtgccttctcaaggctggtactcgcggcattagccgcgagatcacggaggcgagggcggtggcggcgtcgtcggcgaatgagcgtgccgaccggctggcgcgcgatatggaggttcgcgaggacctccagaagatgagggaactggtggccggcaacgagcgacaacggtagggactagagcaccgcatgtcggagctcgagaacaacttgtcggaaatctgtggctcgttgcgggtcacctatattggtctgcaccagctcgccggggagtgcggtatcaagtctaccatcccggcgaatcccgatgaattctcgctgacgtcttttcttgcggagctggcgacggcgatggaggagatcccctccaagcacgcggccaggatcggagaggagacgtccaacgggatctataccggggcgtgccatgtccttgcgtgtgtgaggctggcgcaccctgaactcgatctgcggaagatcttggatcagggggtggctagcgacgcgcacaaggatgtgatggaagaagtcggcgatctgggggagtctgttttcccactttttgtagagtaggattttgactctcttgtactctttagtcatgctttgtaaaactttcattggttccaaccgcctttgtgtgtgtagtcatcgccttagctttctttagcattttgatcttgagtactttgttgtcattcgtagagatgttgatgtcgaggatgtccagcagcgcgggcagcctgagttgccagtggtcgttccgttgcttgcgttcgagccacatgttccggagggcgatgtagctcaaaattcgcatgtggaaacgggcatggcgacgactcccttaggttggttatctctgttttcatctcctttactcttccgtctggatcgatttgatttgttgtattctcgggagagaagagcagtttgacttagtcgtttccatgctgagcagacctcgagagtgcgcttgctgaccaggatcgtcgcatccagtattggaggacgaagtttgaggtcgcggaactcgagaggactatgctagaagtgaagaacgaccaagccgtggagacactccggggtcgcgaggtgtggttcaactcgtatctgaagagttgctgcacctccatgtcaagggtctgtagagagctccgagtaccccgtggggataccgaggaatcggcggctggatacatctcgtggctaaatggggactgcgcccagctcgagggcatcggccagcgtatcgacgaagccccgaagcaggagtgtcgtcgatcgagccgatatgctgggggggcatgtattggcttgtatacgagatcatcgtccgcaactgcacctcgagttcctccacgaagggttttctcgttctcggagaactcctacggagatagatggcctggcgaagtcgatggcgccgctggcggaaaaggtcttccagtctatggactggcgttggccttcctggtagtctccgtgtcctgtgacaaatgtcttaggggaaaagtgtaatataattttggatttttatagaattgtaagaagtacttgtgaaatagaaaagaaatctatctaactaagctttcttactctggatgtagcgtgtatgagtgtcttctcacttcgcgacttcgatcagtcgtttgagttatacactctccctagcccccagccttgtcatcggagaattcttctcgggagataaggctcttgtacctttgacctgcctcgattgaacaagcactaatcctagcccccagctgtgaagttggaaagtttatttttgattacacggcttggttaatacgcacggcgagaactcttacacgaccagatcttacatggtctttcgtctctacaggatccgacaaggccttatcggctctgggcatccccagccgaagttcccttaggttcctcggaggccttgtcaagacggcgtaaagggacatgaggataggtttcaacgctaggtgtcatctgggtaagggatcatcgggaaggaacactttgattgtagtctgtacctaaaaataggctttattgaagctgtaagatgtcttacaagcatggatactattaacttatacatagaatttacgtaattgatcaatgttccaggaatttgacaactcgcgaccatcgccgtctgcaattttgaatgcgcctggccgcagaacttgtgtgatcgtgtacggtccttcccatttgggtgagagcttgtttcgccctgcttgactttgaacccgtcggaggacgtagtcgccgatcgaaagtgtgcatgctcggatgcacttctcatggtaacggcgatgggcctgttggtagctggctgctcgaacggcaactcgttcgcgatgttcctctagtagattcacatcatcgtttcgttgctcctcctgatcctcatcggaatacttctgtactcgtgtactttaatgccgtagcttggtggggagcatggcctctgagccgtacacgaggaagaagggtgtctccttattggacgttgtcggtgtggtacgcacggcccatagtactgatggaagttcttcgacccacttcttgtcatgtgacatgaacctgtcgtagacgcgggtcttgattccttatagtactatgccgtttgccctctcgacttgtccattgctctgagggtgagaaaccgaggcgaagcagatcttgactcccagcctgatgcagtaatcctggaaatcagcactaatgaactgggagctgttgtccgttatgatacggtggggcaatccgaacctacagaatatccctttgatgaatttgatggcgttgtcggccttgatttccctcatgggtgtcgcttcaatccacttcgtgaatttgtcgatcgccacgaataggaacctgtagccgccctgtcctcgtgggaatggcccgagtatatctagcccccaacacgagaacggccaagtgagagggatagtctggagtgcttgcgctggtagccttgtgtgtttactgtggaattgacaggcttcacactgctgaaccatgtcataggcgtctttgagggcggttggccagaagaacccttgtcgaaaagcttttccgactaatgtccgaccggcggcatgtgacccacagatcccttcatgtatgttgaggaggaggtgtctgccgtttggtgccttcttgtatagatcgttgccgatcatacagtagacttttgctttacggaatattttctcggcttctgcgtcgtcctcgggcaactcttcactgcctatgaatttaatgagtggggtgcgccagtcgtctgtggtcccgatatcggcaacggcgcgctctgcctctgtagcccccgagctgatgttgagggcgaccgggctaccttcgccgcttgcctctttcactgatggcctggtcaggacgtccagaaaggtgccaggttcaagtggctctcgtctggatgcacgccgtgctagatcatccggttcgatgttgtctttgcggtatacatgttggacctcgatcccatcgaaccttttttccagcttcctgacttctgcgagatacttggataactcggggctagagcacttgtaatctttatgcacctggttcgcgactagttcggaatcccctttcacgatcagtagcctgactccgagtgcagctgcagcacttatcccggcgattagtccttcgtactctgctgtgttattagtcgccctgaagttgaggtgaattgcatgcttgaattgatctcccagaggtgatgtcaagatgaatcttgcccctgctccttggctgttgagtgcgccgtcgaacgctattgtccacgttttgttgtcgatttggttgtctgacctgttatcaggcatagtccaatcggctacgaagtcggcaagtacctgggacttgatggttgttcgtggcacaaatcggacatcaaactggcttagctcgactacccatttcgcaatgcggccgacaacgtctatgtttctcactacttcaccgagagggaaggaggatacaactgtgaccctgtgggcttgaaagtagtggcgtagctttcttgatgtcatgattaccgcgtaaagcagtttttggatctgtggatatcttgtctttgcgtcgtggagagcttcgctgacatagtagactggtcgttgcaccttctctctctcgacaacaatgacagtgctaacggaatatggcgtggcggcaatatagagaaataattcttcattaggttgggggcaacaagtacaggtggatttgataggtagcgcttgagtgcaatgaatgcctcttcggcttcctgtgtccatacaaatttgtcttgctttttcagtagaacgaagaaaggttgtcctcgctctcccatcctagcgacgaacctgcttagtgccgccatgcatccggttagcttctgtacttccttgagtcttgtaggcgacttcatgttctcgattgccttgatcttctcgggatttgcttctattcctctgccagagacggggaagccgagtagcttgcccgatggtactccgaacgtgcacttcattggattgagcatgaggcgatatcatcggaggttgtcaaacgtttcccgcagatcgtcaattaatgagtcgcttgtcttggtcttgacaacaatgttgtcgacgtaggcctcgacattgtttccgagttggtcgctaagtgcgccctggaccgtgcgctggaaagtgtttcctgcggttattagtccgaacggcatcttaacgtagcagaataccccgaacggcgtgatgaatgttgtcttctcctcgtcctcttttgccatgctgatttggtggtagccggagtaagcgttgaggaagctcaacaactcacaaccggctgttgagtccaccagttggtctatccgaggaagagggaagtgattcttgggacacgccttgttgaggtcggtgaaatcgacacacattctccatttcccgttggccttccgcaccatgactgggttggctagccactctggatggagtacctctttgatgaaaccagctttgagaagcttgtcgagctcttctcgtatggcttgttttcgatctggtgcaaatctccgcagtttttgctttactggcttggcgtcgggtcgcaccatgagtttgtgctcaatcacctccctgggtacccccggcatgtcggacggctgccaagcgaacacgtcagcattgtcgcggaggaaggtgatgagcgcgagttcctatttctcgcctagtgatgccccaatcttgacggtcttgtcagggttggcactggagagtggaacgatcttgattgcgccgtccggtttcggcgtcttgtttgttttgctcagtttcttgggtggctcggctgtgtcgggtgggctgggcgtgtgctcgaccatgtcgacgctccgcttgtcgcattgcactaccagcttagcattcccttgaatagtgattgttcccttcggtcccagcatcttgagcacttgatacgcgtagtgagatgcggccattaacttcgcgagtgcagttctcccaatgatggcattgtatgctgtatcgaattcagcgacatcaaaggtgatctgttccgttcggaagttatttgcttggccaaaagtcacaggcaacgtaattttgcccaatggtttagacgatgactgaggagtgattccatagaagggttgatcggtgggtatcaactcgctttgtgggatccccatcgcgtccaaggtgctagcgaagagaaggttgattgagctaccgccgtcgatcagaactcgtgcgaccttgatattccgaaaagtgggttcgaccacgatcggatatcgccctgggatgacagcagtcttggggtggtcctcttctgagaattctatcttctgctcagaccacttcatcttgggcgcagccccctgccacgtcgaacagacttcacgttccaccttcttgtattctcgctttgagtatgccgcggaacctccgaagatgtgcgagacatggagatctgagtttgggtatgctgagtccgattcctgagtagccgcctcagcgtccttctcgaccacacgtactcgcttgcctttttccaatgccatgtgttttgcgagcgactttttgaagacgaggcaatcttctagagagtgtatgtctgacttgtgtatagggcaccatgttttcttcatgtcgctgccttgtgggtctgggcgcttgggagagtccgcgtattctgttgcgagaacatccgcttgagctttccttttcccactcttgcgatttttcttcttgctcgactcaggtgcgtctttgactggtttcttctctcctccggtcttcgaattgtcgttcttgtgtctcagtgcgtcgtccacgtgagcgcatcgatcgacaatttcgaataatctccgagtagtcgtgatgcgcctcgttgccaatgcctgggtagtatagcgatctctgacaccggacttgaaggcgcggattacataagcgtcggtgatctcggggattgtattcctgcactcattaaagcgccgaacataatccctcaaggattcatccgggttctgtgtcaacgcatgtaggtcgtcttcgatcgcgtggcgcttgtaagttccttggaagttggcgacgaactgctgtcacaggtttgcccacgaagaaatcgagtaggggggagatgcatcagccatgaacgcgcagagcctttcaatgcggttggcaaataattcgccaacacgttgtcgtccgctccggcagcgtagagtaccgtggagtaaacctgaaggaattcttctgggtcagtactcccattgtatttctctattgctcctggtcggaatctttcaggccatcggacatctcgaagtgaacgaccgaaagctctacacctagcgttgggggcggtgggttgtcggcgatcgtacgtccttcgtggatgtctatctgatgatgaggatgaggaagatgacgacgatgacgatgggtcgcttggttccggcatacgattacgaggacgtcggccgggttctcgagaatcctgtcgtcgtctcccgttgttatctcggcgtcgatctccatcatcatcgtcattatggcgacgtcctagaccagtatcgcccggcacccgccgttcgcgatcgtcgtgatcgtggcggttgtggcggttatcacggtctcggtcttcgctcgaacggcctcctcgttcttcgttatcgtgacgccgtgaagagacgcgatgtcgggaacggttctcattgtctcgtgtgtgtcgcgcctctcggcggccattcgggtgatcgcggagatcgccggtgccacgaggtggaggggtggctcgatgaggcgattcccgctgttcagggttttcaccatttgcatcgccagttggtggctgttccgggtgcgctgcagcagcggcctcttcgaacgcgttgctgaggttggtcactgattcctgtaaccgttctgtccatcgtgcgagatcgtcgttcagaacgggatcgtagggggtttccctcagtattgcgttgacggccctgatgtgctgggtcggtgtagtcacttgattctccgcttccgcattggcgcacgctgacgtgccggtctcgtcgatagccagtacctcgcacggcgtactcgttgacgatgagccatagtcttcgagcaggtgcaagactgatggttcgtgaggatcgatgtcgattaccccaacaaatcgatctgaaatcggcgtcgctccttgttccttgtcctcatccctgagggggatgtgtgactgctggaccttaggaggtgacgttttcatggcgctgagaaaggccttgcagcttgagaggtcgtgattctttgtcttgtgaataggacaatagacatcacgagttggagaagtacgctgaattccacgctctttgcagtcacgaatttcagcgtggatgttgagaaaaacccagcaggcttgcaaggtatgttttttagttttgtggataggacaccaggaccttgtcacctcggaagtcatcctcgtcggctcgtgattcttgtcgaaaagacaaggtttggccgcactaggatccttctcgggctcggatgtcgtcgacgttccgatctccgcttcggcgggaggatccttcgacatggagtcgtcctgggttgcagccactgcgttctcgtttccagccattgatagaccagccgagattggcaccgtggtataaaccgggaagactatttcgccgacttgtgtccacaccagcattgttgaagtaggaactccttggttaaggttggtgttggcgctgttgtcgacgaagttggatgacatagtagtagaaccttgagcaccaagtccccctacctggcgcgccactgtcgacaggggatacccgtagaccggatatagagggtattggggtacgctggtacgaggatctacgtaatacgacatcgagttgg

SEQ ID NO: 65578 - DNA, 2631 bp, Oryza sativa
gttacaaagggaatagcggaactcgacgataccgacgagatcgtagtcgagttgattcgactagatcacccggcgacttggctcctgtaggctccggcttcgtaggttgtggtggatgtgttggcggtaagattcgatgccttaggtcctcccggggggtcccttttataccgcaggtcaactggtctccaagtaggacccggagacatcggacccagtacgatacaatgacgacccaattctatccgagtaggactccttccgtctgtgaactccataatgaatttccttaacgtatgccgaaaacgtccgtatacacgcaagtataccatatcgatatgtaacgtatatcgaagggtggagggtataccttacccgtaaccctgacacacgcccttgccacttgaataaagatttttcgatttatttgttgaattatttttttccttctagctttcgagaggggattgtctacagttttttcctacctctttgaaaaaaaattgggtttacttttttttatatatttcatgaaaaagttgactctaaaaaaatctaatccagtttgaatttttttaaatgattttaaaaccgagcggcttgtgtcctccagccagtccgaaagaccgagaattttttttttcgattttgtaaaccctggtcatagctacttcaaggacgtgtctacaacgagaccgttctttgtatggtcataaccagctatctcaatctcatatctaattgctactagtatactcaaaagtgcatgtatttttttcttcttatggaattttctcttagattacccatccgatttacgatccgattacactattgtgttcataacaattaaatctttataacaagatctcacatcactatatttttatgaaaaaatagaaatcaattttataatatatctaaattacttttagattccattaaattacttcttagtcataaaagtaatttaataaagcttgatagtaatttacctatattatagaagtaacttaaaacaaaagtgaagtaacttgttacggcattaaaagaaatcttacattcatgttgtgagttgtttattttataatcatgtttagtcaatgatgtaatttgtgctgattaaatttaatttttatatagactcatgtttttacctccataacggatttacttttaatgtcgtgataaggttactttctttttgttctaagttacttctataatatatgtaaattacttttaggctttattgaatttacttttatgggtctaagaagtaatttagtgaaatctaaaagtaatttagatatattataaaagtaatttctaatttttcatcaaaatataatcatgtgagatcttgttataaagattcaattcttacgaacacaccggtgtaatcggatcgtagatcggatgattagtttaagataaaatcatttttcaagccggcgtagcgtagagcatcacatggcttccaatttggattcctctggatgatgccacgtccgtgaatcaccaggccatgtacagacgcaccagcgcttgtgggatcagacagccgatgagcgtgtcgcgtgataaggcaaaacagagagcgtgcgcgaattagatttcgccctacttcaatcatgtgatctttgatgaagttatagggattcttgtttgccgggttgtcaatgattcaattgatagcacctacttacagcgcggatcgtcaattttattattgtgccggcttgtatatttgtcaaaaggagcaaagatggtatccgatgctcgttcaaatagttttgtgcgtgtggggagctcagtattgtggttgtgctcgcctgctcacaaaaataaagtatctttgttcttggttgacatgtttaacgttctttctgcacaataagattgtatgggtctcttaactctccgttggttatacccaacaacggtatttgtagagtattattatcgttagtaccagggtatatgtgatgagataaaagagccagtggacaaagatttatcttttatacagcttcgagtctcctatttacgaataatagctccactcctatactgaaaccggtgttgccattatatactaccaccgtttcatattataaatttttttgacttttttattgattaaactttttaggtttgactaagtttataaaaaatattataaaactatattaaatattagttttaatgaaactaattcagtgttgtagatattgctaatttttttctacaaatttgataaaacttacagaagtttgacttaaaaaatcaaaactacttataatataaaacggagggagtatcaacatcacactagtacaatatacaggatgggctaatctagtctctatcagcctagagacgcaaagctctcatatttggttgacagctagaggttaaggtagtcaactttcttgaataagaactcagtgatattggaagtagctctagattccttttatcggtttttatgactccgtattgaggttatatagttttgtgttgatctgtattgggttgccttggattgtcccctctttttctttgtgtcttgtatttttatcttcggatgttcccttgtccaaatataactagggaaccatgtatgga

SEQ ID NO: 65579 - DNA, 13895 bp, Oryza sativa
cgaaatccaacaagtagtctacaaggattggtccctagctcgcactaaattccgcaccgccgggaaggtaacccacagtcatacaccgccgtgagactgtgccgtactggtccagaagatcacaaaacttcacatgcacttcgatctatctgctacagggaattgcagcttgtagcattgcgattttcaagctgatcttgtactgatgtactgaactctagctctgaatttttctagtctttcctccagttctccacccgattcggggaggcatatggcacgggccagcgagcagcgcaattacggtacagaaacccacctccattgatcatgacatggccgcgtttcttgttgcacatctcgttttctagttacgtcctcgtcaaaatgatggaaatgagcaactggtcgtggctgtctctccgttacggtgtacttaaatatataattaccgttcaatcaatcacttgtaattatagctgcaccatatcgtcctgtgcattgcgtgtttgtgttcacagcgtggccatcatcaatcatcataattaattcatgagtaagagaatgatggtgccagcgaaaatagttttctttaaacaaccctcataaaaattatactataactgtaagcttatagctaaaaaaacaaaaagacaaccacacgacacatctatgattagaaccctctactgaaaacagagggacacgacatctcaaagagaatggatctctacataacgtcttcaagaagaatatgacacttgagattatcgttgctgctcaccccgagacctaggacatggttttcactctaagaaatccatcagggagggtaggaaaaatcaaacaacaacaccccaagagaaaacgatgcccacaagcgtggccgttgcccacacaaagaagtcgggttttcgcctgttatttttctgccaacccttaccgaggtctcctcctggaaaaagaagccatcaccaactgtaaacctttcaacaagtagccccgcgctagcgcctccccaccagtcgcccatcaagtaggagttctaacatctgacgcgctccaaaaccatccatgtagttgagctaaacgagagggtgagagataagaacggatcccctctacccaacactagcccgccaacgtgtccatcttgtggcggcaaggcgccaccgcaagacgactagtgtgtagatcggagcccatggcaggactacacgcccacatcagggcaccatcgttgccgccacctcggctggactgcccactctcaatccacccgtctgcattgctatcgccttatcaagttgctccttgtcgccgccaacactgcctgccacgagccgtgacctctttttcccccggtcgcgccttgccgctccgatcccaccactatcaccatgttggagtcacatcacatctgcttgcgccgtgccagcctcctgccatcatcggctgtgccagccctcccgcgccacgctgtcgtttgccccgtagtgttaattgcagcccccgctaaattcgacgtctgtgagaggggggaatccagttgcgggggactagatccggtggagttagcgtcgaatccgttgccgcgctcaccgaggtgtgtagccgctgccggtttcgctcttttcccccacgccggagaccgagcctagctgggttttggccccaccatcgccttctcagcatgtcactcggcttttctagtagtgtgctccgacggcgacgtggcggagagggaaggagcgggcggcagctaggatttcgcccagtgttgcctgcacgtggacgatgcgggaagtgctcacaccaacgaaaataattgagtagatttcacaaaactatagatgttttgatccaactactataaaattacatatttaaaatattgtattgtaaaactacatgtttgatagtagatttgatgcatgctaattttttatacatcgatttagatttttaattttgtagcaaattactcaaagtatatatagttttaaaacttttataatccaacagtgcgcttaattagcatcgaatcgaacaggccatgattgttctaaaggaaaacccagcagtccattatgcgtgccagatcaagattgaggtagtgcaagtgtagaatatgcatgtgagtatctgtatacatgttaactagtggtctaacaattgaaaaagacgtatgtgtaccaattaaatggggggcaagatcgatcatgcataattaagctctctccggcatggattaatcaatggcacaatcattagtggcatgtcctagtaccaagccaccaaaattagttggaagctgcgtctagactactctagtgtttagcttgtttcatgtccaaccggccaaaagggacaatttggagccaacatatcatagtaccttaataagttttttcttttccgacaaataaattggcccaaattaatttgttgatcaatcaacatctctgttgtgaagaactagcactagtgtctatatcaaattatcaattcatgcggattttgatggaacaattaatagtgcaggctttttgaaaaaaaacaattcttttttatagtagcctaatattcctaggattgttttttaagagccgggttacccatggtgagctgtttcgtagttagtgaccaaaatcagaccaggaacatatatagccgagaaaacaaatgcagacctatcacttatactattattttgccttttccaaacctcaacggttgcaagtagcgatttaagtcatatgaaattgcagcttcttacaaaatcttctgttaccttaaatagtttagatttttcacctaaaattctgagtatacgtaattgtggaatctagaaaataaataagaaatcagaaggtaagaaacccagttttttcaaattatcagtatctactaattataagttgttccttagaatcttaattaagttcccaaaatggccttgattctgttttgcatcatcccgattccgatccattcaacgttcaacgggaaaacatttagtacgtttcgtgtgacagcgtgtcaagtaaacaccagccttgttagagcaagtctaataagtagacgattagccagcagatgatgtctcgagctgacgtggaagagaaaaagcgatgtgagagaaggaagccggcgcttctgcagccgcccgctaggcacgagcgcctagacgtgctgacagtttggacccatatcaagagaaagaaggtatttgacatgtcggtcccaccaaacatataaaaatacttatttatttgtagtagagtatgtgtacagagcatgctattatatgcactggctataacatcttgcataagcccatagcaggctcctctattatccctgctcttatactacagtactaattaatcagctagcagtagatgacagtagctagacaggattcgcaagtaagagatctatctcgagacaatggagcctcgaggaaataattggccgctccatgccatgatcgcggccggccggcgccggcgctataacgcgcatgccaaggtagttggaagaaccccctggccggcataactgccagctgaataacttggcagcgcgcgatcgagggcccctcccaaatctcccatggttccatccatccccatcgagtgggtaaccggcctagctgtacgtagtaggagtcagtagtaccccgacgacgacaaccacacgcgcgacgcatgcacgcacgctcccccgccttgtcagtgagacgtcgcgcgcggtggtaacaaaccgcgccaagccgaggggtatcgtgttgtcgcgcacggcagctcgcgcaccgtgcgatccaggaattaaacgcgccgccttttccctctcggtttctctccccggccgatcgaatcaccgaactgccccgtcccgtacgtacgtgcatgcgcgttgcgttgacgtggtctatataaggtcgccgcggcgtcaccaacttcccacacacatcagcatccatcgcagcgagcgaccgtcggcatcacaagccatctccctctctcttgtcttgtgatctagctcccgtcgcgatcattgtgatataggcatggccaggtcatcgtcgtcgctgctcgtcctcacggtcctggtggtggccgcggcggcgtgctccactacggcggcggcgcgcagcgtcccggcggaggagaagaagacggctgcgccggtggcggcggcggacgtgaagcagccggagacgttccacgaggggacggtgttgatccctgggctcgggcggttcgagctcggcagcacctacgtgccggacatcaccggagtcgaccacagcgtcccggcagccgagcacgggcagttcctccccggcgccgacgacacatgggtccccaaccccggcttcgaggtgcccaaccccttccagcccggctcgtcttctccctgaatcacccgccggctcgccgtcgtcgccgagctagctagctaggcggcggtttgccggagtaataatgtgtgtgatcccacgtgtccccgtcggtgcacggctgccgtagtggagtcgtttagtttttcaattgtgtgtggatgcgtaggatgcattcagatgtttggcttgatcgatcgcgtgcttttgttagctttgaactcgtaataatgtattaattggtgagtgattatgcaagagctcggtaaagtaattactgttcacgtactaaattaagatgcaattggaagctatacgtctgtgtgtattcatcgtgcaggcaggacggtatatccaaaacactgtgcaagtgtgcattggaggcaggaccatgcaagtacagaatgaaggcagctaggctacgtaccgcatactccatgttgtactcatcggacggtccgtcatcggatcggacgccttttcaccggcttaatttcttcgcaattttgctatatatttgtcgacaaattttcccctaaaaatttgacagatgtaattacagtacaaccgtaatgtaattacactgtaatttgcatgtaattacactgtaactataatataacttgtatgtaactttcaaaaaatctctccataacatattattttggtaaaataaaggttgtgggaacaattttttttcagatatgtgtgtactgtgattttttttcttcctcaccaaaacaaatctttataatagatctaataatttaaaattacgtgaaacttacataaaagttacactgtagttacatgcaagttacagtgtaattacatacaagttacagtgtaattacattacgattatactgtaattacatctgtcaaatttttaggagaaaatttgtcgacaaatgtataggtggtccccttcttcgagttgaaaaggagtaaagagagtagatggcccatgagagctgaggcccatgacagcaggattcgccggtacaaacaaaagggttggtatgtgggccatacggctcaggttttcggtaaacttagcggtccaaagaatgactctggtgaaaagtgatattttgataggatggcaatattaccaaaattttaatatgatttattatgtgtttatcaaagtttagcaaaaaaacctaaatgaaggcacatttttagcaactttgaaaaaaaaatggtatggttgaaaatatcatcaatctgaacagcccctaaattttggttccaaatttgttttgaaaaaaagttaaattggctccaattcaaaccaagacccctatattggaagtttataagcagctcatcttagagcctccagctctcctcatacagcctacattcttattcagattttaaggattgtattatatatttatatatatttatatatatatattctcccaacttctattctctcgtttttcatgcacatattatttataatgtgtattttacaaataattttataggaaaattgctttaaaaatcatattaatgtatttttcaatttttttactataaattcttactaacactaattcgtcgtgctatgagtatctagattttttttataactttcatctatctaaatcaaacagttgagaagatttgtcagtaaaagtttagtttgaaaattttagtccgtgtaacagtgctctcttttcagaaagcccaacattgtcgataatttcgctatcgcattaacgggcctgttagaccggaggcacgagcagttccacccaaccccaaaaccgaaacgccgaacgaaacgaatcgtaaactcccctgctgctacgcaacgactccccaactctccggccaccaccaccaccacctgttccccatccgcacgccacgcaccggcccaaccgattccccaccatgccggacggcgagcggcatgaggaggccccggatgtgaacttctggggcgagcagccggcgacggaggctgagtactacgcggcgcacggcgcggatggcgagtcgtcctacttcaccccgccgggcgggcgccgcctcttcacgcgggcgtggcggccccgtggcgacggcgcgccgcgggcgctcgtgttcatggtgcacggctacggcaacgacatcagctggacgttccagtccacggccgtcttcctcgcccgctccggcttcgcctgcttcgccgccgacctccccggccatggccgctcccacggcctccgcgcgttcgtccccgacctcgattccgccatcgccgacctgctcgccttcttccgctccgtccggcggcgggaggagcacgccgggctgccgtgcttcctgttcggggagtccatgggcggggccatctgcctcctcatccacctccgcacgccgccggaggagtgggccggcgccgtgctggtggcgcccatgtgcaagatctccgaccggatccgcccgccatggccgctgccgcagatcctcaccttcgtcgcccgcttcgcgcccacgctcgccatcgtccccaccgccgacctcatcgagaagtccgtcaaggtgccggccaagcgcctcatcgccgcgcgcaaccccatgcgctatagcggccggccgaggctcggcaccgtcgtcgagctgctgcgcgccaccgacgagctcggcgcccgcctcggcgaagtcaccgtcccgttcctcgtcgtgcacggcagcgccgacgaggtgaccgacccggacatcagccgcgcgctgtacgacgccgccgccagcaaggacaagaccatcaagatatacgacgggatgatgcactccatgctcttcggggagcctgacgagaacatcgagcgcgtccgcgctgacattctcgcgtggctcaacgagagatgcacgccgagggaggagggcagcttcctgacaatacaagattagtatccaggattcactccactctattcagattattgtgaagtagcaaatgcacaaaaagaatgattaaatgtgcaaatttgcagtgattctatatataaatttgatgaacatttgcagtgattctatatataaatttgatgaactgctcagtcaggtttacatgatttatggtataaaatatgctaagtctcctgaccaatgaaagaatgtttccagtttgcgaagcttgccgttgtatcagctctctgccggcgcttctggaggcagtacaaggcgctctctaccttgtacaagcttggcagaacgaattatatctccagttttaatctgcgacagaacttctcttccatctgtggtatacctgcagatgtttgatcgacacagttctctgttgttaatccacaaaataaaccaagtttgctgtctagtggtcacagttctgtaatggcaatcactacttacccgaatactgagaattgcccttcatcaaaagatattcctcctaaaccagactgcacaagataaaggaaaataatcacaaattaaaatatttacgcaattagttcttatacatagggcacgctatgggtctagaaaagcagaagcattcagaaatatggttcacaacacaagaggtagacgggtgcactgttgaggtacatgcacttatgcaatctgaatttaaaatactgtgctagcgaatatgtctagttctaaagatatatccatttactcacatttctcttgtcatacagatagaagaagaattggcttggtgacgagtattcatcagaatccacactatgggccatagcaacggcaccatatacagacatcggaaggactggcaattctccatcctgtattggatcaagtaacaaaggaactgggttatgacttacgaaagacggtaactctcagatttcactggcatttacagggtagtccagatgagtgggctttctttaatatcctttttacatacacttccagtttgaactaaatcgtaaggattttgattgatgatttagatccaaataccccttcagaacagacctaacagtgtggaatactgacctgaatacttagcggagttctgtataacggttcaaactgcccagcaggcatgacctctaatggaacagtgtaacctttctttccattctcgttgtctgcaataattgcctgacttgcacatttcagttttatcccatcatatgccccatccaacacctgaagaaaagttcatttcattggatcagatgatgtaacctaactactgaaaagaaaatcaagagctagtaaaggaaatttttttagcacatcgcagaaacatgaaatcttaaattgatgttctcgaagatgttatgtcgatgaacacaatcatttcgatgatctttatcatatatgtcagaaggcagagctattggcaggaaataatcaatagtgagatgaggttggagttaagctaccttaccaatttcgcaaagtttccagcagtcagtggggcagaatatccatcaatcactacctggaaattagtaaagaaatcaatagctgacacgtggaattttataactgcaactgtatacagaaccatactcttgcacaccatggtatgacaaaagataacaaccaaggataaggttcttatttctcaatgtcaaaagactgcagtttatgataccagacaattacacagccattcaaagccacctgaattgtagcaacactttttggttcaccaccagcagttggaaagaatgttgaaccatcacctttctccactgagaattcaacaactcctcttcctgctagcctattaaaagcgagctgtttaaattaaatgtacaaatgaacatttcgttacagactggaggaatgattgcatgcttaatataagtgccacagggatggaatgttcaaagcaccattacacttagggcctgtttgggatgggagggacttattttagtccccctcccatccaaacaccaccttacataatctgctaatcagctacacatactgagtgtattgcttgtcagcgatccccctgggattgaaggaacactcacaagaacaaagaacagagacgcgaatgaatttggcgctgcgcaatctcactgtagcttttctcagttttctccactgttgtttatacggattacaggaggcccaaagtagtttccattgaggccttcatgcacatgacacgttccaccgtgtcgtgtgccatcccacatgatcagaatgtgccgggcgcgacaaggacacgactcgctctggcgcaaaagtgcgcacctaaaatggacaacttggacaacaacctgggcccatacttcaccgaccccaaagacccaaaacagaagaaaaacaggggacctaaaggacgactaagtaaactaaaaacatgcgctcaaatttaccgacattgctgctgaagcgatcagccaatcagaacccaagaaaaattcaccattcctcaagagttcgaaaagaaaaatgcttgtgaggttttcttgccaccctgtaccaatctggccttaatgattttataatactatgtgatgatatatgttataaataaaaataagttcccacttggaattaactagaaagtactttttattcgacagtttctactccatgaaatatatgaagggtgacaccagcaataaatagtgagtttgcaaatatgataaaatggcaagtttgtcaaaaccaattaatttgcaacaatggaaaaactggtaagttttctattgaattcattttgaaaacctactaatagcggcagctttgattattaccatcaagaacttgggggcagagacctggttatcttaaaacttatactgacatagagcttatacttgtttgcaggacatagaaccatgcatgtcagtaactcagtataatcaaatgtcaccttcaatcttcggacctatctctgcccttccctcacaataattctagagacaaagaaacatttagattttaagctttggagagatcaacaaaagttaccttggatattccaaatattgttgtggtaagaggaaggataaacctggagcctgttgaaagaaatttccccctttaagtaatccgatcatcgccggagtataatcatcctcctttaaacataatgaaacttctattcagtttagtacagttacctgtaacagctccaattcagcaacagtatcaagagaagaagcaagtgcaaccgaaagtctgtcaggatcattttcctttatatatttcaagagagtttgcaaaccaccctgcagttgattccaaagtagctcaggtataatttataaataagtacaagtgaaaaccagaatttgatctgtttcataaactgcaattcaccatgagcacatcctagaacctactgaccttctcttcaagcaaggaggtatataacttcgagcccttttccttgagttctacaggtatacttgccaagatcgcatccttgttgtccattgctatctgcatccagagcgcatttgttctatatatcagcattcaggacaacagctcagcaagttcaataagaagttcacaatgcatagaagaagcaaaacattgttgctagaaaaatgcttatgaagaagacacagagtcaacttattaccttcatggccttttttacgtctccttccatggagccatacggcttcctctgcggtatcctcagcaaatacgaaatgtcctccagcgattcctggcaaatgggctcgcacaatctaagaacaacgcccagccaaccgtactaagcgatatgcatcgccgccgattctgatgcagtttacctgtatggtcttcatgtttgggttcgcggggatggccctcctcagcgccagctcccccgtcctcggcacgttcgtgtccggcgagtagaggatcgcgtccgccgggagcgacacggaaatctgggcgatgacggcgagcgccgcgaccgcgcccttgagcagctccaccactcctccctcctgcaccaaaccagacaaccacacgattaaactgaagcgaacgctacagctttggaagccatttggatgaggagagaccagcaaccagcgcgtgctcacctcagccgcgcaggagggatggtccgagcgacggtgggaggagcaggagaccctcccgcgaatgccgccgtcgcagcacctggcgccggctgcgaccaggggacggccgggaaacacaggaagggcaccggcgagcaccatcgcggccgccgctcgcgacgccatggcgtgcggtggattggtgcgggagcgcgggtgcttttgaatggatttccggtgggttgagacgcggggaggggaggaaccggagatgggggtggtggtggggatgccgttgctgccgtcgccgtcgtcgtcgtcatcgtcatcgtcgtggtcgccgtctcgtctatccccagccagtgagctgtgatccggttccgaaccgcctagttttgggccagcggtgaacggcccagggacgatacaagagcccaaagcccaatactgtcccgtaaagagacaaggctgaaatgccttttgcggccctgttacgtcaacgaggcctgagatggtaataggactgcattaatcacaggttttcagactctatcccaaaagaaagcacacacacatatactgccatacccagattcagtgtactttccactaaaaaatcgaagtgtattttttctcttaaaaaagactcacggtgtaaatgcttaatgatcggcaggtgatgtagtcacaatcatccctctcttaaataatattactgctaggtgctgtagctaaattaaagactgaaataactcagaccacggaagtagctggagagatctattgacatgcacgcatgtcatgatcaccgcacgagcgtacagccgcaacccgcagacatgccatcatcccgcaatcctattccaaccagcatccgagcagcccacccggcaccgcacgctcacgtacgcgacacggtcacgttcgcgccacgctggacgccgccgccggcccgccgccacatccccgagccccagaccaagtgccaacacctcacaccgctccgctcccgcaccgcacggccccaaagaaaccgtttccatcaaaccgccttgcggttgcagctgccacctcgccttgccggcttgcccccacccgcccctctgtccaccgcgccgtctcgccgaggttgctcacgtagcgcgcgctttgctagtactagtatcgaccataacttgcgtaaaatccaggacggtttcatcagtcacactaccacccacggaccacagtagtattcggcgcacgctagctatgacctcgcgcgcattgacagcgtcgtcgttggggtatgctgcgtgtgttaggtgctctcgacagcgcgggattcatggagcggtggcgctgatcggggcacgaggggtgctccccgtcctgcatgccgcctcccttaaactactagtactactactgctcgatcggcacgagcggtttttttcattcggatgatgacgacgacttcagtttcttctcgttgataggttaagttagatcaacgcgacctgattattgttttggccgcgcagcgctataagaatggtggtggcaccgtaccactcgagggaagttagcttgcacgcaaagatacgtttaagatggcacgaagctagcgtactagtagtgactgtagtagtacttactgtttcaataattgttttggataagtactaatgtagtggtagctcgtatgtgaatagtttagtagcaagattagtacgctgtgattgcgttcggtgaacgaggacggccaatgcaaagggcactaacatttgtcttgacaacgaataggtggcccatcattgattgctttgttgacctcgatcatccggaaccgtgctatgtcgtgacggtaacaagcagaaacggacaaaagctcttagctgatatgctacctagcttcctcgagccctgcctccgtccgagctccagctgttacgacttgcgagtactccgaacaaggcatgtgtttgttgggactatggggttgattggttggcatactcacattactaaaacttgctatacttcatttagctaatatgtctaacatgtggccaataaaattaaagccacacttcagtcataggagaataaacttgccacacttttatatgccaatgatatgtgggacccacatcatggtgaatgaatcttgctaaacgtatggcaccaaccaaatgaatgactaattcaaacatggctaacttgagttgtggcatgatgaggcaaattgtggtagtgaaccaaacaaccccatatatattctagtctcttttaaactacagtattcaggagcaacgaggaagagtacttctcggtaggaacggccgtatctatactttctgtttactactctctccatttctagatgtaggtaaccattttcggtgtaaatgagcacaagatcgaggaaatagcccatatctgttagaacgtactcgtactgtacaataatagaaataagcaatgctgtagtactgtgtaagggg

SEQ ID NO: 65580 - DNA, 2448 bp, Oryza sativa
gtggtggggtcggcagcggcgctggcggcgcaggaggagatgcggtgcgcagctggacagcggcgtcagcgcggtgtcgttcgggttcgtggccaccgccatcctcgtctccatgttcctcgccatggccatcctcgagcacttcctccgctccccggcccaccgcggccacgctgggatggggccgccgcccccgcacccgccgccgccgggagggatcctctctcgcctccgcctactcctccaccgccgcggcgccggcgaggccgccttccctggcggctcggatctcgaggcggccaggaagctcgacggcggcgcgtcccccgaggtatggccgcaccggcgcactgctcccgcacgctctcccccccttcccatccatcgctttaatgattccgtcatctcgcccttttcgcagctttcgcttttcgcatcgcatcgtattgccttttcacgcattgtgtctgctcatttgatgacccggttgcgaaacttgtcccgccaccttccttccacatcttccactctctcactaggaagaagcagaagcagggagtgagaagtcaaaccctgacatttttagatttcttgacttgaatatcggttgtgaattcgtagtctctaaactcttttgacgattaggatgatcttgaaagatttgacgattcctcacatataaaagcgaggtgcagcatttgagagcttaagttagatctttccaattccgttcataggtgtacggtcattctgaagaaataggtgttgcagcattgttccaagacaactcattaattagtttggacggcgtgtctgatcacaacaagccatatccatatgtcatgtacgatgagcccgaccagctgcatatgggattcgtcccaatgttactgtagtacattagtatcgatttgtcatctaagatcctgtctggaagcttgggatttggatcctaatccttaggattgcttccaggcgggtctgaagtgttttgctgctttcaataggctatgttggtttgttgtgttgtgaaaagaacgggttaaaagcgttattgttcaagagaggctagattatcaatatcatgcgtaatggacctgagaggggaatatgggagacagcagcaagcagacaagggcccatccctgtctgcagccaccccaaggtctgaatcatcctctggcttgcaatgttagctgtccacagccagaggtctcattcattgctgtttgagaattattagcatttgtggaacatcttgttaagatagatcagcagcagaatttgattgagttataatggtccacatcatagggatcaaaagcactcagtaacttcaattagatgtgaaatgtgcattgtatactcatataattttgtagacttgtagtgattgctttccttctcttagggacgttaaactttgttgttcaactgctggcatcaactttgctagtttgaagttcattccttgcttgtgcagaatccacacttatgaattccttgctggtgcagaatccacacttatgacctagtactagtgattaggactatgctctattctgtatgctaagttacttcactgtgttgtctacattgagctgatctttttcctatcataggaaactataataatggcttccttctggcatatgcttctgtttttggtagtctagtggtagaaagagcaataggtataatgaaattggtgcactcatagttggcaatcactcccctgaagtggattgccctgctgcatgttgttttctactctattcacaattttttttgtttcctgcttattaagatgctagtgcaaatttgaaatgtttaaatttggactgtgttagaagagggctggcttgtattgtagtgatagaacactagactgaattgcaaaagtccatggtttcgaatccccatacttattcaaaatatagatgtgtattactccctccatttttaatagataacgtcgttcacttttgatcattcaccttagtcaaaaaatttgtatgtgtcatttattttgttgtgacttgttttatcattaggtaaactttaagcatgattcatattttttgtgtatttatatttaataagacgaatggccaaacattatgccaaaagtcaatatcgtcatttattacaaaatggaggtagtacttcctgtgtgctctgttataacaaaggattgccatggaagagataaggtttactatacaattgaatgggcatcaccaatgttaaaaattcactattgccatttaatctgttagcctaccaataaatcattcttgtcactgtattattaaaaaaattacccgagcaactgttacccaatctattccacaaaaagattacctgatctagctgtttagtgtaactgcagtaggagccaccacatacttgaaggatcacctgctaaaaatcatctctctcactacg

SEQ ID NO: 65581 - DNA, 3302 bp, Oryza sativa
gaaggatatatttcttttactccattcaatgtatgttggcacgtacacgctaactagtctagagaagatagagcagcgcatgcagcaaactgttgcacgcggcacatgcatgttccgccatgcacgcgcgcactaatctctgtagaaacaaaaacaccgtaccggatattgattctatgcataatcccattcggccattcccatgcccatatatctccaatccagccaaatactcgatgtcgatcggtttctgtatcgtcgtagttagaattaattgtttatcctttgcgacttgctatatttagagcaaggataataatatagctaactttctactattagctcatcttaaaagccaacatatataataaattagttataaggttggctacaattttcttctcctctctctatctctcacttatacatttaatgtatttgtcttgaaccttgtgataagttagctcttgcatgagagccaacatccttaatttttcactacctctctcctccacctaagcttatagtatgcttatagctcactattatacttgctcttatgctactagtacgtactactgtagtttgcaatttgcagtgttttctttcttctttttctttgaacgaacaatgtgcagtgttttcctttctttcatcgtatgcaccagcaatcgatattagcattgtatcggttgttctgggatgatgaattgtggcaaccgtccagatctggccggaagatccgcgctattccgaccatatctggcggggcttagtgattgcggcggcgacagcggcgtggatcgccggatatgacaggatggtggctagtgacgacggttgtctgtggaggggttcaatggtggtggcggcggtggagcccccgccatacgtgacggggcgtgaggccagctggaacaacgtcggcgtcgagactggcacacgggaggaggtggagcagacgtggtgggccggtgcgtcaacgacggcggcagctggagatggaggcaaggaagaaggagaccggcggcgagtaaggaggagcccggcgaggggatgcgggcgacagtgatggtgctaggaggcacaagcggttgcgacaggaaacatgggtggctggttagcatgaggcgtgggcgacgactgcggttggccggcgcggtcgggggaggagccggtgtgagtatgtgacgcggatgaggaggcatggccgtaggccgacacggccagcggcgacggaggctgacgcggcgcgaggaggagcagttggcgggtggcggaggccggcatgacacgagagatgcaactgaaagtgcattaatccccctagtgggttttggtgattaattacaaatgtggttaagagactaatgagttcattgagtgactttcaggtgcattagtccaaggtgtggaagatagatgcttggagaccccaaaaagtataaaaacaaagcggaccggaactcgagaagtgcataggatagtttatcttttgaaatcgagtttttaggaaaaatcgtactattaagaggggttccaggtgatgctctgagatatatcaagtgctcttagtgtgaaccaagtgtcaagtttctctaggagtcatttttgcaaatactccatctgtccaaaaatgcaagtccggaacttcctgtcttctaggtccggaagttccggtcttgtgaaaaagattttcctaagtgtagtccggaagttccggtcttccaggtccagaacttcctgtctagtttccagttcaaatttgtgagtaacggctagatgacgtcacctagccgttatacatatacagctcgtttccagctcgttccttggccattccactttcacttttcaaacctagagctattgctagcctctcccaagtgtttcttaccttctccactcaatctagagcctaattcttgtgagaaagagagattgagagggagagaagaagatttggagatgtgtgaagactaggatcttgggtgagcacttggaatatctcgtggctgtcatctcggtgcttattactcttggagatgatctcctagacggttaggtgtcactcgcgagaatccgttgcatattgtggatgtcccgggtaagtttgtgaatgatttcctctcctccgaaagggaacgaggtaagttaatgaagttcttgtgctgagattctagaggctttccaagtagagcaacccacacttgtggtggatttctagaagtaggttgagttggatcttggtggtcactcaattctagaaatttgcctaggggtgtttggtgttgaaggctgtggattttctctggggtttttgcacaagtgaggcaaggggttaatcgagacccagctctttggagctcctcaacggagagtaggatcgcaagattcgaacttcgggaaaaaatcgctcttgtctctttctgtggatgattctgtgatatatcctctgcttagaatacctgtgcaccatcttgtgaagattggcttagtctcttgtttcgaaatttgattttcatctctgttctgttactcggaagttcctgtcttagaacatcggaagttccgggcctgggaggccggaagttccggagtttcttaccaggaatttccgggtctgtttgaattttaccgcttcgatttgtttttaagttttcagggacagcctattcaccccccctctaggcttcatcagcgcattcagcaactagtagcaatctaggccgccgtggcgcgagaaggtgcgaccggtggtgacggaggccatcgtggcacgaggaggcgcggtcagcaggtggcggagggcgatgcagcgctggaggcatgctgagactaaccgacgaggggctttgacagcattggagcatcgtgcatcaactgtggactagcaagcggtgggcggcaggtgaaaacctagcttagccttgaccgggcccggcaacaatggcgtttgagtgtctcttccgatcccttcttgagagtgttgtcgtgtcatcccatctcctctcgtggggctgccaagtgaaaacccagtctcgattctctttgagaccttgacggatggtggcggcgacgtcttcaccgctcttctccctggagatgtcgtctagtcagccccttgccgaatccctctagacaactagtgcaagctcgctctctagatgcatgtatgtcggtgacacggggccgggggtatcgtgactagagattgggtagccgcggtcacccacgtggcctgaccccctcgggggggggggggtcgggcccgaggtgacatgccacccctccctctgtct

SEQ ID NO: 65582 - DNA, 1414 bp, Oryza sativa
tgagcacaccggggctcacttaccgcatttatagcggggtggacgagcgcgccacgccgcatttaatgcggcgcagcgcacgcttatccggtccgtgaccggtcgtggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcgagcatggcaaggaagtcgctggccattgaatgaaggttgaaatgggcgtccaccgggaaagctggcgagcggggcaggaggcgtgtgctctgcttgtcagaggtcacttcctgctgtagactagccctcattgtaaaaagcatgtttcctttcttaggcagctgaaggcccatgtggtgacccctgaccagataaaaaggaggcccaggcctaggagaggaggaaaaggggagaaaaggaggaaggggttctagagcctgaactttctctcgctctccgcctctctgtattccttcacacacagatccaccagaacacaggagtagggtgttacgcttctcagcggcccgaacctgtctacgtagcccgtgtctcgtgcacttcctctctcgctgacgttcctcggatcgagggcgaagaacctcacttagcgcccccggccgaaccggcaaaggggggcctgcgcggtctcccggtgaggagccccacgctccatcaatgtatttttgtgtcggggccctaacttatgcaagttggccacgtctgagggcctagggggagagcggttccattctactctctcaccctcaattctaaagaggtcgctagagtggggcttggtgtcgggtttttaggattaagttttgggtgatcttggctgtagttcctttgttggcctagcggtggccggttcggtgttggccttctcccgagtatgtatattggtgttgtcagtgcgtgggtggtgttttcttcattttcctatttaagtcctcctaggattgtgattttgtaattttttttactgctctatcaatattaacttcgcatgtttggtgcgagtcatttcaaaaaaaatggatgagctagcgtggtgtgcggatatcgtcattacaaattcttttaggactatctatacatttgtcaataaatgttctcctaaaaagttgtcaaattaaatatgaatatatgataaattagtagtgtaattacattacaacttacatgtaatttgtatgtaactttcaaattcaatcgaagtaatacaccacacaaacttcttcacataaacaagatatgctcacgcatagtactcgattaaatttaaactgcacaaaaaa

SEQ ID NO: 65583 - DNA, 1371 bp, Oryza sativa
tgctgttatgctgatgaactcaaggaggggttcttcccatggattgatcaggtttgatatcataccagcatgttaaatgtctaatttctcaattgccactcagtgtcatatgttggtggtcaaattccacgtaggttgctcctacattggttccactccttaaattttactttcatgaggaagtgaggagagctgctgttgcaggtatttgatgttttagtatgattttatcttttgccttatggatttgcattttaaaagtatagttccaacaacaatgcagctatgcctgaactactacgttctgcaaaattggctgttgagaaggggctggctcaaggacgcgatgaatcttatgttaaacaattatctgactacataattccagctcttgttgaagcgctgcacaaggtctatgcaaaatcttctctatacatgtggatggtttttctattcaacgctaacagctgttttcttttgaattactatacaggaaccagaaactgagatgtgttcatccatgcttgattcattaaatgagtgcatgcaggtttgttctccttttcatatttttatttgaatgggatggtatttttctatgaaattgtaatgcttctggagcatattgaggcagtgcactggtgtatacagctaactgggttatgtttgttgtctgcctatgcatcttagagagatcattcagctgtagaaacgtatacctggtgtcttttcttgttgagtttttagttatctattggatgaagctgaaatatcttcagttggatgaaccatgtatgaccagtttgttcaccatgaattttgtttggttggaatattgtttggtccaaaattgccatcaatagatagtggtttcaagagttagcttctgtcgaggaacagttggataatcgcagtaccttcatatatgacatggaagaaactaagaccacattagagttagatccaacaaatcactttccaaaggtcatggtggacttatttgctattagtgttgaaagtttattgcagtcattactgtgcaaaaagattactaattttcatcattgattgggctatgttagtggacttataccaaagccagaatgattttgcttggaagttgacactggcaccttttgcacattgaatgcatttttcattgacactattacaccaaaaagattgctgaattgataaatcaatgcagtatagctgagtgatattcactgatggtttataatctatttattcaactttctacactgcgataatatacttggccgttcctcaattttgaaaggcctgggtttttttatcgctcactattctttttaattgagcagctctctggtcgactccttgatgaaaacc

SEQ ID NO: 65584 - DNA, 2080 bp, Oryza sativa
acatagtcacattcagtcagttaaaacaactgtcattgttttgttatatatattctgtcttctgttttctatccaaccatattaacatgtgggctaccaagtgaatggaaagggggaaaactactttcctttattgagggaggatgaaatcctgctagaaaatctgtgcaaacttagtaggaaaaatgaattgaaatattcttgacagatattttctgtttgtggagcaaactttacaaacttaaatgattacggagtaggtcctaaaatttgtatatgcttttcaagattcaaaaaaggtccaaatcttgtttgcttgtatggatgaactgacaccttaatagatctaaactgttctttcatgccgttcatcaagtgaaatcaagcctttggatatagaaggaagatttatgtctttcgtcagaatgtactacccttcaatatttcctagcaaacacacagtcaagcttttagttatatgcaatcaatattccttggtccttgccatcaattactaatagctaagttggttttggatctgattttgcattcatacaacttggcatccttaaaactgcaaaacaaatccaaagttctactgaaaatatgctttgcgtaaactgttgaagaacttggcactttattgtgtctgaatgtttttcaaaatgaaactgctctgttcctgctagtgttgtgtgtcctaatggagttatggttgtttagtaaaaaaagtagtagtgattttccaaaggaatagttgagaaacctgctgcagagtatggagttcaagctgaaactgaaccaattaaataaccagtgtaaaaccagtagttgtgcttgtccctagatttagtctgaaccttgttttcagctcccgtaagaccatatattgctaaaaagatacatgttgtattatcctcatccaatgtattcatgctctttaggtcattcctgcctggctggttgcttgcctataaaagatgacaagattgaagcaaaagttgtacacgatcagctctcctcaatggttgaaaggtatctgctctctatggatgacatgccaacaatcataactttttgttgcagtttataatgaccttgtctgtgtgcagatcggatgcagatattcttggtcctcatagccaatatcttccaaaaattgtttcaatttttgcggaggtaatttctgacttgtttcctatattatggtgtggggcccttttcccaaaggaaaacagagacatcaagacggattcctgtgttcctggtttagtttggttctctgtgataatttgtcttggaccttttgtgtactattagcatggcaatttcaggctgttactgctatagcagcaacatagctgatcctaggatcaaaactactatttattactatgtgcattttgtttttcatttctttgactcagatgctgtaaaattcataaatgaatgctgtcttgggatttctactgcaggttttatgcaacggaacagagcttgctacagatgaaacaaccaagcggatggcaatctcttgaggcgtttccagcagacattgccaccagattttcttgcctcaacattttccagcttgcaaccacagcagcagcttctgctgcagtccattttgtcgacataggttttttttttttgttgctgcaagttcaaatcttgctccttttttgatatatttcatcattgttaccgtcaaccaattctttgtgttgaatcatttgtgggtgagttcatttgtgaatgcgcattgctggcttcaaggaattggaggttgccatttcatatggttttgatgtagagtgtgtatattatcttgtactcagatatggttttgggatgtgctgcatcagaggttgtaagtgaaatggtgatattgttgtcagtttgagctgaacagatgctgcgccagttttggtaatgaagttatcatatttttgtggatgcttccctgcagtttttaataattattgctctctatttgtgctgagcatgtttcttcgctgatgaataccgtgccaaatattttacaccacagggtggcatttttttcgctttgtcttcatac

SEQ ID NO: 65585 - DNA, 10492 bp, Oryza sativa
aacacaagttcattgggaagaacctcttggagtcatcccgagtagaaaacaacaaaacatccatgagtgctctagcagtgtagcctattgctcatttgaacaagcaagcacaagattgaaaactgtaggcacggcaggtgatgacaatttgacaaaactcgcctttttgatagctgaggttggcatggcttttaaaattgagaggactaacatgccgctccatcacgcttaccttttctcaggtgatgatgaatgaaatgcctagcggcaaccaacatttacacaattttattaatcctctctagagtgtctttccgttcttgggttcaaaagaaaagacttgttctgtttaagtagtagtggtgtcgcttttgctttcaagattatcattattattgttttgataacttcgcttccaaggttagagaaagcttctaacatcacggttgctttagcttttgagtgattttacagtcattgagtaagtttttttagataatggaaaaaagctttacattttcagcctctatactatgtgcatacatactacttcggataaagtaagaaacataataatagggaaaaaaattaagtcccccctctcataaatctaaggaaaagaccagcataaccttctactagtgtgtcatctcaagagttgaaatagaaatagttcgttggtgaccgactccaagtgtgtagctctgatcataaatgcatgctgaattgctgatcctaaagtaagtaccactatatatatcaagacttgctaaattttacataaaaataagatacctctcggttccttattcctttgtagatactcaaaagttagctttcgaactagagaccttttacggtgtttgcgaggtacttagaggtacctagaggtgaaacaacgtgtaccattgatcaagagaggggcaaggtatggaacaaaattactgtaacattatagcagtggagtaattaactagtaaaacatgggcattatacgtgaattgaatacttacaccaatctatcagtaaatcgttgtgcagatcggtataccatgaggaaaaaaaaagtaaatcacagatacgctgttgatttagcaacgaattgttctgtatcaaaataaacagaaagatcgcatctcctttcttctctcccttcgcttcgttcttgatttagggtttgaacggttccccagaaggagacagaggaaaaagcgtctgcatggttgagggatgaagaggagatgagatcgcccggtcgacgactaggcgcaagctagcgcatctataagttatcctatgtttatttacacaattgattagttatttatgtagctcataaatttcttatataagggactggaatttttgtgggatagtaaacgagatctactcctctggtgttcttctagtgtttgaacgggtgcatctagtgtttgaacgggtgcacccacaaggagatacggtcgaggaagaagatctggcatggtcgagcgtttgaacaggaggcaagatctgattgacatgtatgggttacaagaacacaatgtaaatctagagaaaaccacgtaaaaaagaacatcaaagaacagagtaactctagataaaatgatgcgacttaagaacctgtaacgctggtgccaactaaatgacttaactcagatacaacgtaaatttagaggaaaccatacaaaagagaaaatacgcaaataagaacctataaagctggtaccggagaaatgttaactcatacggtagtacctacgcagtactgattctaatttgggagataattctaccctttttctgtactagtaaaattatatttttatccttagtacttaagtatctataccaatacttaaataccttttacatgatacctgtgattgagtagcgttggatctatacctttttttggaatgcaaacatcgtaaaagttctcttcgaactattgttcccgtaagctctagaagtacagaagtactggttttcgtagttcgtacagatatagtactaaaaacacactgggacggctgctgtcacagttttccttaatccttatgtctgtagaaaagatgctccggaaattgaaaggtatccaacattgaactagcagagaacgactgcctcatccagtgaaggagaaagacttggctgatggggaagttgtcaaatgacctgacaatacaaaaacacaagttgagcggcgttgatgaaaagttgatgtttagtagtttgtattttcattgtttgtaatcattctctcaaattctgccaaatggcacattttcatgcaatggaagacttggtctcatgttagtggttttggttagattaattgattaaatacatacccaccaattagggaagaactagtctaactagtggcccaaatgcttcagttaagctaatgctttccggtttagaccttgtaaaagaacattaagaaatgcaaactccttgacttttgcttccaggttaatttgggagcatgttcgttctaattcctattgattaccataacttattgctcgcatgcatgtaaagtttaggagatactgggaaaaaaactggccatattgactaaaagcaaaaataaatatactttttatattttcaaataattgactaaactcggtagagatatcttcagatatattggataagttcatccaatcactgaacagatcaaatgaatcatgatattatcttaaagaatcagaatcacagaaaatacaaaggtcaaatttagtggtgatgcactacaagcctacaagcatcccaaattgttgattcaattacagagacagggaggccactacctttgccatagtttctgacagacaatacatgaaacagaacaaattgacaagacaaaaacatcccaacaaaatttgccttatgttactatgtgcaaatacatacttcattttccatggacacacagtaacatacaaaaatgacaggatcatatgattgataataattcataagtagacaggccatgatttgattaaacccattttttagataatgtataaaatcgaacatttgcttcaacagaaactacaacataatttgaccaaacctggaagactgaaactgatactctgaaagtaaccccacaggggcactaccattggcatgatgcccttacaatatttctcacaaatcctctataaattctcacctttgccaaatgccaaccatcaagccatcaagcagagagcaagcagttggcacacagacacctgtgtctcctaccctaactctctcaaaccaaaacatcaaaaaaaccaagaaaaaagcacaagctcacacacaaacacatggagctcaacttccaagtgcaacctccagtgttccagctgcaagactactgctactactacagccaagaggtggcggcggcggcgtcgccggcggcgaagccgacgaagccgcgggggaggaagaagggcagcacgagccacagcaagttcgtcggcgtccggcagcggccgtcggggcggtgggtggcggagatcaaggacacgacgcagaagatccgcatgtggctcggcaccttcgagaccgccgacgccgccgcgcgcgcctacgacgaggccgcgcgcctcctccgcggcgccgaggcgcgcaccaacttcgcgccacgcatctcgccggactgcccgctcgccgtccgcatccgcggaatcctccaccacaagaagctcaagaaggccaggtccgccgccgcggccacggccggctcccccggcgccgcatccaagaagaggtccaccacggcggcggcggcggcggccactccgacgatcacaaccacaagcaatagcaatagcgatggtgcgggtagtgcttgtggtggctcgagcagcagcagcagcagcacggacagctgcgacggcgccgtgaagcaaggcggcggcggcggcggcgcaccaacggacgccagcgaggtgtaccggccggacttcgtccacgcgggcgccgaggagttcgattcttggatgttcgacacggcgttcggcccgttcccagagctggacagcttcgccgccgtcgacgccgtcacgccaccgccagcaacggcgtcgccggaggagtcaagcgccggcacgccgccggtcgagatggcggagttcgagcggataaaggtggagcggcggatctcggcgtccctgtacgccatgaacggcctgcaggagtacttcgacaaggtgttcgacgcgtccgcctgcgacccgttctgggatttctcgccactgtgccattagcgcgtgtgtgtctcacctccggccgccgtcgccgccggcggcagccggcgtatgtgcttccttcgccgactcgccgtcgtcgttcttgctcttttgttgcctcctggatcagctgtacccatgcatgtccatgtaagctcaattggttttttgctgcagccaggcagtgcagtttcaaagaggaagatgattctacttgtttcgagttggacaattggttattttttctgtgcaatttgctttagtttttcacttcaggatagattagagattctatgcagtaagttcaagtcgtttgttatgtatgtaaaaccaaattcagatgtagagtagttcatatatatgttcaagtgtttgagattggattctgatgagcaaaatggcaagctctaatcttttccatgagcatggattttaagtgcaatgcagataataaatactgttgcattgctataaaaaaaaccctgaaacttgtgcaagtttattgtgcactgacaagttaaaacatttgaaatattttaccgcccacaaaaataaaagggccgatttgaaaggttttccctatcaaaatttttacaagaactaaaatgcaccggtagtttctcgtttgaaatccgaccaaatcttttggctgttcctgaaattctataaccaatatcttcaattccaactggggggaaattactgataaattatgaggtcagtccaaaagttcagtttaacctgaattattaacgatttatctgcaacttgcagctccaaatggctgagctccacgagagcagaagaaatactgctgttgcttacgacactggaacatacaaacgcacgcaccatgacaagaagaggagagattttctattgcaatggtcaggaaaaggccacagaactccgggacgagcctaatatattcagtaaagaatgcaaagcaggtgagaactgaaaagagcaggtgacaacctcatcttaggaaaaagaaaaggtgctcagctactaataaacttgctcagatatgactcgaatcaattgttagttatttgaagcatttccgtttgttttgcttttgatttatatccttcgacaagacgggactcgaaagacagaatcagggtttgcaaatgcaatcggacaatcggtagtcgaaaactgctccatactggtttcgtcgataaccatgataaccaaacggttactggcaagaatcagacaaattttatcaataatttaattctcgctttgggttttattgaaattgtaggcttaccaagcaatttctaaatctaaacaggtcaaataagactagtaaccatgataaccaaacaattatcgtcgcattttggaagtgcgcacgtttcctaaattgctaaacggtgtattttttaaaacttttctataagaaagttgctttaagaaatcatataatttatttttcaagttttctttaactaatacttaattaatcatgtgttaatctaccactccattctaagtgttgaggggaaaaggttccttacacgcttacacgcttgttcggtacagaaaactccatgttgaacagttctaaaatgtctccagcctcctgttttgggtgaagagagcaggacaaagaattagctgcttcagccttcaaccaccgcaagtttgagcctttgatttgaatatttgatccgccgtgtcagccagtaatctcggttgctgcgtgcgtacgcgcgggaaatagccggccgaatgtttgcggcccagcccagaatgttctcatttcgactcgtgggccgtggcttggacacgtggttaggcggcccaaagaacacgtagatatatatgactttgggcttgggccatgacgcactgcctgcctgccgagtggcgactcgcgagggaaaaagatagttataattaactgtcaaaaccaaaaatactccatccgttctaggaggttgttttctttggacttattccatccgtcctataaaaaaaccaatctaatactggatcaggactacctatatatttatcgataaattttcttctgaaaatttgacaaatgtaattatagtacaatcgtagtataattgcactgtaacttgcatgtaactacagtgtaacttgtatgtaagtttccgtaattttgaattgttagatctattataagatttgttttggcgaagaagaaaaaaaatcacaacacacacatatgtgaaaggatttgttcccgcgatctctattttaccgaaataacatgttacgaagagatttttgaaagttatatacaagttatattatagctacagtgtaattacatgcaagttacagtgtaattacactacgattgtactgtaattacatctgtcaaatttttggaggaaaatttgtcgacaaatatatagcaaaattgcatcctaatacaacaagtttagacatacatctgtccagattcgttgtactagaatgtgttatatctagtcctagatttaaatttttttaggactaagggagtactaactatcagaacaatactgaaaatggtattcgcgacgtgatagcccggtcatagaaaaattaaaaatataaagtgaggcccatctgtcatcctacactatttctctccttccttctctaccggacttccgcggcgccgcaaaagtacgaaggcaatgagtagcggatgtacgcgtgcgccgtcactggcctctacatcctccaaccactccgtcggcttccacggcaacggtgaccaccgaccaccgcctcccgcttcatgcccaagtacccaatctggagactggagccactggacctcaggctcatctgtgacgaggagccagtcgagagagttggagtccgggagagcccccatgagaaggtattcgagcggctaagccgggatggtgccatctccaccgtcgccgccaccgtcaccgtcaccgtcaccgccgctgccagtgttagcctcgacgttgcctgggtgtccgacctcatcaactgaggctgtatgtctgatgtcactattggagcagctccaatgtgtgcagaaatcgaactgagtatatcggagacagcacactgggagagtcgattgttgtgtgtcagatagcaaaatcgatctccaaaattgagttagtgttagacaattaaagtattatttgttgctgatggggttgaacatattcgagcccaatcaaataatttacattttccccttaacttttcttgctgtatgtgagtcctataaatcgatgtgcacactgcagccaccgaaccaaagttgcattcgttgttcacgaactacagtaatcgaacatacactggagctgcccttggaagctccttttgaagtagtactaaatagcaaggattgtcatggaaaagtggcggtaagaaggtgagtatgaataaaatcgtttcagacctacggaaaaacggtacggctaaaaaaaatgatctccatcaccgtcctttaatgaaatagttaaacccatgctcgttcccggagacgaaagtgaggagacacagttaatctactttaggttcgcatcacccaccgataattcacctcacttgatcctatgacagctaaactacacagcgacaatggctaagcataattggtaccatgtgatcgtgactacagaaaaacgggaacaggccggccttgggaggcttgaatatgtgacaacctgtttcaggtatctcgaggctactacctgaccaaccaaagtcccgtactcccgtcccaaccagcagatatccactggcgctgcggtgcaccagccagccgccagatcgcttggttccaatcttctgtagtgcagatcaaggacaccctattaaacatgtaacggtgatacaggcatatggagacaccacattgggacaaagggaataccaccagctatcttcctgcatttgcttgctaattaccccttgaaccgagctcagattggtcctgtgaacgtatggatccaagttgctgatctctttactcgagctcagatttgtagctcagagtatcagatatttaggacctagaagcagtagatgctgccatccttgtgtttcttcagcatctcatgtttcacaattcacatgcaactaaggagtaaacgcgcagagagattaatagaagaaagcatccatagctccattggaccatgcatagagagcatacagttttgcaattcagctcagaatggcatatgtaccaagcttgggggggagtagcaagcaatgcacagcaaaatgggaagatatgaacaatcatggccaacgaggggctaacaacagtttagcacagtacaaaaagtaaacacacataacaggaatatgcaatgcaacggaaccggagtatactgacaaaccaatcattaaccagagaactacttattaaccagctactaatagtcttctccatcgtcgttctcgtcgtctgcaccctcggcgccgacttcctcatagtccttctcaagggcagccaagtcctcacgggcttctgagaattcaccttcttccattccctcaccaacgtaccagtgcacaaacgcacgcttagcatacatcaagtcgaacttgtggtcgatgcgcgagaaaacctcagcaacagcagtgttgttgctgatcatgcacactgcacgctgaaccttagccaggtcaccaccagggacaacagagggtggctggtagttgatgccacacttgaatccagtagggcacctttgtggaggaagagaagcaataaacagttggttagccaatcaggtgttgataaacaagtggataggttgcctgtgattaaaataagcgcaactaaaatagtgatgaagacagcttaccagtcaacaaactggacagttctcttcgtcttgatggttgcaactgcggcattgacgtccttgggaacaacatcaccacggtacatcaagcagcaagccatgtatttcccgtgcctagggtcacacttagccatcatgcttgagggctcaaaaacagcattggtgatttcaggcacagaaagctgctcatggtaagccttctcagcagagataacaggggcataggatgaaagcatgaaatggatgcgagggtatgggacaaggttggtctggaactcagtgacatccacattgatagcgccatcaaacctcagagaggtggtgagtgaagatatgatctgtgagatgagcctgttcaagttggtgtaggttggcctctcgatgtcaagggatctccggcatatgtcatagatagcctcattgtctaggagaactgccacatcagtgtgctcaagcaaggagtgggtggagaggacactgttgtatggttctacaacagctgttgagacctgcaaaccagagtggcataagacgagaagataatgatatgatgaactttaaataattgtacaacaactctacccaaattgtccccacaacagctaagacaaagcaaacccactcatcacatgaacaagctgaaaggcccacatcacatggaaagttggtacagtacactaggataatgctggctcatacaatgcatggtattacagacttcgcgaagaagactaatagtccataaaagttcactaaagagtctacataagatagggatattgtatagccatataggtagatccccaccagccaggcagccaggccagcagtttattagtccacatactaattagagaatggttggcagatccaataatcaatatattgccatgcacaactcacaacaacaagaaaaagaagtggctgataacatggcccatatctaagcaggtgtccaaataaattaattctacaccagcctgaaaatttcaagtttctggtatagagcattttatttaattttttccctcagagtacaactaacatggatcagattaagttatacctggggggaagggtaaattgtgaagccaagcttggacttctttccataatcaacagagagacgctccaacagaagagaaccaagtcctgatccagttccaccaccaacagcattgaacaccaagaatccctgcagcccagtgcagttgtctgccaacttgcgcacacggtccaggcatagatctacgatctcctttccaactgcattccacaaacaatgagaacaagacacatgcacagttgcaatagaataacacttgtatgaactctaagctgaattaccagtgtaatggccacgggcaaagttgttagcggcatcct

SEQ ID NO: 65586 - DNA, 2509 bp, Oryza sativa
acgcaactcaaccggggctaccagatcaaacgaagccggggaacgcggggccgcctcccgagatcaggaacaggaatgcatctacggatcaaagaagaagaggttgggggagggggaggggggattcatcgtcacctgggcatggtgccatcgggctcgatgccgtgctcgaggcagtagagctcccagcacgcgttgccgacctggatcccggcctggccgatgtggatgctgatgatctctctcatcttctcctccctcctcctcctcctctcctctcctctcctctcctcgcctcgcctctcggttggtttccttcctttggtctagactagagaagcggcctctctctctctctctttctctctctcttctttccaaaatgtgagagatcgggagataaaagggcggaggagagagaaagagagagggggagggtgggaggagtggtggaccgggaccacggcccgtgggctgggctgggctggctgagcggtttgcttttttacgtggaccggcgctctctggacccggttcacggtgagccctcgtgagcgaaacggccatggacgctcttgccaggctgccacatgaacttgacgtttggagtaacggcaaatggagccgccgttttttgtcaccttcttttgcgatttaaagaagtttccataaattgttttaagcaggtgtcatggctataaatgtaaacatgcttttgaaaattatatagggcatgtacagtttattatcataccaatcacatcccaccatgccataaaacatatttaagaaagtaacgaactaaacagcacctgaatttttttaccttgccaattcctgggtattaccaaattgtgctgaaatttactaattgttagaatttggtagcgttgaaaatgatagtaaaatgaacatgccaaatagactacacggttgattagttttttttagaaatttcaccggggggagagcttccccacctgaatttcattaagcaaaataggggggaggtacagtcattacatattgtgagaccttacagcggaggataggagagacttccaggcataaacaaccggcctatcgtctctacgaatacgctcggcccatagagaagcatcttcaatacatttcttaactacacggggaaaagaaacagagagagaacggaatacaacatcatgacgatgattccacagaccccataagcaaagaatgtaaaaaatttggaaatgctgctgaggtagacggcttggagggcggagggctgaaatatcttgcactgaagcgacggcaggggtgacatcaatggacccccaaaaatgttgagcaaactgacagccaaataacagatgcatcgttgtttcatccgcagcatcacagagggcgcatcgcggggattgaacaatctgcttcttgtgagccttagtagggaggcgttctttgatgaggagccagagaaagaattggactcggggaggggcacggttgtgccaaatgaatttccaatggcggcattcatcagtcagggcttgggagtctgagtaaattatcttggttgtgagaattccggttatagctaaacactatgcgtgcgcttgaaaacgtaaagtacacaaataggaaaacgatggactcactgggatcaatttcgatactaccagcaagctagcactacagtgtaggctagccaaccctagataatgtgttgggaatatgcctttaatattttacatgtgttggcatatatttttctgagtgaacagctctttaatattccttaccaaataaaggaaaaccatactccttcatagaaagtttaatgtttattatctccttcagaaaacaatgcacatcagagatgcgatcttggtatatttttgggctttgcttcatgtaccacattttcttctccttaggcttaggacatgtgaccaagataatcaaagataattttacgaatagacttttgtacatccatcctaggctgcgctctattctattcggtgtattttacaaagagtttcaatatataagtttctttttaaaacataaaataaatatattttatttttttaatagttaataatcatttaatcatgtgttaataacacgtcttattttgtgtgcaacaaaaaaaacaaaacctaacaaataaatcgaactaagcccttacggtctgttataaaatgagatggatcattagtgaatgattaattaactagtattaattattacaagctaaataatatatttattttatttttgagataaacttttatatataacttttttacaaaacgcaccatttaataattttcaataggtgctaacgaacaacgaggaagtgaatgtttagagttgttcaaaataaatcagccttaggctacattctactatttaacttttggctttagctactttatcgtttgagtaaacacacattccggactattaataatgtgttggttgcaaaaaaatcctatataaaagtttttttaacaagtca

SEQ ID NO: 65587 - DNA, 5473 bp, Oryza sativa
gtgtgtgtcagtcacactgtgcagggcacgtgggggcagccgctcaagtgagctgtccctctcatctcatgtggcctctcgcgttcccatgccactgccagcctgcaaaaccacagcacaagtagtagtagtagctgcctccctcccccgcgatcttacggtgaattgctggtaaaacccgtgagccgtgacggttgtgtcgggtgctaggacgagaccgtgctgtatcgcgattttgtactgtagcccggttccactccgacacaggagccgctgatgcgagttgcgaggatacataaccgcgaggttatttcctttttagagcttttaaatcatgacgtatcccacgataatcacacgattttcacagtaatcgtactgttaccatgataaccaccaaacgtgaggcgataattttatctaaacgatttggtgaatactgtgatgccgagagaagccggggacttttttttttacgaccggtacggatggcgaggcaacaccaaccacggcggcggcggggtccctgcccccgcggagcttacctgttaccggacaccacaccaccatcaatcatcgtcatcgtcacgccaatgaaaattaatcatggccgccggtagacggtcgccagcacgtccagctgcgatccagccgagctcgatcgatcggtcgatcaaacggcaaacctcatcgttgcaccacaagcatcagccgcctgaccgatcaatgatccagcagaaacagtggagtagaaggatgatcaggaccggtctacatcgatcgtacgcacacgtacacaaactaggacgaatttgaatgaacacgtcgttgattgcatcctgtcgttgagtacattttgtgcgctagcaacataatactgatattacctcgactactatatactactagtaatcatactgatggttaagctttcgcctatctctatctaggtagccatctatctacagggtctgaagctttcgcgatggcagtaggagtattgaattgggatggctactactcctactttgaattaaggacacgttttaaactagatttgagctgaactaatatctcatttatcgtgaatatgtttatcaaattgttaaacagtatgttttattataaaactagtatgtttatcaaattatatttattctgaattttagttagtattaaattcctatatggactctatactctacttctaatattccttattttttaattctgattttctattttttttcttaattgtatttaatattccttattttttaattctgattttcttttttttcttaattgtatttctatatggactttatactctacttctaatattccttatttttaattccgaatttctattatttcctaattgtatttctatatagactctatactctacttctaatattccttatttttaattctgaatttcatttattcctaattgtatttcaatatggactctactctcctcttctaatattccttattttttaattccgaatttcaactatttctaaattgtatttctatatggactctagtctactcttctaatatttcttattttttaatttcgaatttcagctatttctaaattgtatttctatatggactctgttttttctttttcttcgattaatatgagaatttctaggccatgagagcgaacgtggagactcttttttctattactttaataatataatagatttatatatatatgtattttcaaaaaaaacaaataaatttatttataaaatttacaatggataatagttcattaattatatgctaacgatttatatctttttcgtgcatctaattagctagtcgtctttaagtgcttatacagaacacgccctgagccagcatagtgtggccgatctgctcacgcatgcagtacagctgacagtgaggctgccacgagtgactggcagacagacagctccagaggcttcatctccaagcctgctctgcaatgaaacctcgattattcttctcctccttccctgaccccgtccaactccaacctaccgctttcttattttttccccaaaggttctccaaccaaatggatcgattattgcagcatcagaccagagtctagtagagtacttaacgctgcgaattgccagggatgcagtagctacaaacaaacaatctggttatcgtctggtggccatgattagcatcgctaatcaaaacaaagcatctgagaggggcctaattgatcaggaggagatgagatgagatgagattccttgcccttgtttaagcaggggagagggagcagtgtaggggccacgccgtcgtcgtctccactgtccagtgtccactcgcatcgcatctggctctctggctggcaggttgtgatctggtcgagtactggatttttagccggttttgctttgctcctgtagcttgctcgctgctgcgctgctttcatgtgcgcaccgttgatcgatcggtggagttactgagagagacgagccgtcttggcatcttgcaggcttgcagctatgggcaaatcgtggagaccatgccggtgtaccgcaggagatggctacttgttgccttgtgcccttgttggcaatggcaatacctggctctgtactgggtctgggactcatcagtctatgattagttctcttccaaaagttaaaatcagcaacttgctcgtttttcatttgcacgtatttcgaacagttaaataacgtgttttgtgtaaaagttttgtatacaattttttaaaagatcgatttaaaccatttttaaatataataattaatacttaattaattatacattaatgatttatttcttttcgaattgctctaccaaaaatctaaaatgctatacatggaatctgcgttggacttcattctactgggcattttttttggtaaggcctatttaccggactattaaaaatattttcgccggactgtaaggcctatttatgaatgagttcagttttgggttcggtttgggcttaccgtgtgcactgggcctcaaagttgtctagtccaataatcaagcccttaattatctggccggggttgtacggttcgtgcggcctaattatcctccctgtgcgtgtgccggtgtgccctcacgtccctcacgtgacacgagtacacgacgacggcccgcgcacgagtaacctatatactctctccatactctctccatactcgtaacgtaaaggaagtcgtttagaacagtgacacggtctccaaaatacaactttgacttcttatatctataaaaatatttattgaaaagtgatatatatttttataaaaatattttttaagacaaatctatacatatattttttacactttcaaactcaacaatttaaaagttatttatgatttatattttaaggtttgacttaaacattgttcttgcaccgaaagaaagctttggcgtcagattcgtcatctgttcatctctacgcaacggcgatgacgatggcggagacagacgccgccgacaaattcgtgctcgtcaccgccgccgccgccgccgacgacgacgaaatcacccacgagccgcgggtgcgcgttcttgccggtggctacagcgagaagtccctcaacgcgaactacttcgccgccgccgccgccgtcgcaagtcggcgcgacgcttttgacaacgacgacgaggtggacgatgctgtcgcgaacgccagcgagggatcgggtgatgcagataacgacgaggaggtggagatggtgcttgtggaggatgagcaagggggaggaggtgatcacaggtggcagcagcatgtcgtcggcgtgctctgctccgttgggctcacggcggccaccgccgccggcctagccctgctgctcggctgcgccgcgcggcggcggtgccgccagaaaccggcggttgctgtcaacttccgggcatccgccgattacaaggtgcagatgagatcatcataccatgaatcgtcaatgaccgtaacaaaactgcgtgcatttgacaatgtcattcgctagcttttcacgtatttttcccccttttttaccgcaggcggcgaaggttgcggcgaggagagacttgcaagctccggcgccggcggtcatctcatttgggggttgcaagacttgcaacgagggctgccatgccttttcgcaatgagaaaattcgtcgacttgatgcaatcagagtaaagtcgtattgttaggaagcagagactttctttcgagcaagtgtaaccaatcaagtttttgaaattcagttcagaacacagagtactccctccgtgctaaaaaaagacaaagcttggtttccgtatccaacgtttgaccgtccgtctttttcgaaaaaattataaaaaaaattaaaaatataagtcatgcataaagtattaatcatattttatcatctaacaacaatgaaaatattaattataaaaaaatttcatataagacggatagtcaaacgttggcacggaaactcagggtttgtctttttttttttaaggacgaagggagtagctcgcaggcagattatcaatgagctcaaaattagtgacaagactaaatcaaacattgtagccggaggttcttcattaacgattcacttgcaaagtcgctcaagtagcctgcattaaggacaacgaattctttttttttttcgatattggaagttgaaagacgcatcatcacatctccggcctttgcacaaatgcacccggggcacatctgcggcaccaataccccaattaaacaacgatataggagtgctactactttaacaacagttttagcaggtagttcttgattttctttttcgaaagatccatttgatgaaagcacaaacatagtgagatgcagtaacaattgctggaaactgaagcagagaaaaaacttcagctgtcaaacaacaaacatgcaaccaccaactaataacatgttagatcgatcatatccacatcctcctgcgcgagatcatccggagtttgtgagccaagaacaaaacggccgtcgaacaagaagcgacatccatgcttgtacctacttggcatcatactcgagcataaatccatcaagccctgcagcttgtcagtccttcgtagggtgtgtgcgtgctcgatgttcttccccaagcttacgaacccgacggtgacggtcacgaacatgctcgacatccgtttgatctgatcgccgtcctccatctcgcaatccgccggcgtcttctcgccttcgaccgtcttcccgccgtacacgacctgacactcgccgtcgcaatacttatcgcgggaaccatgggtcgtagaaatcgatcaggtcttgcagcttgtccgtcctgtgcatggtgcgggtgacgctagctgcggccaaccctgcccttcatcttgagggtgacgagcatgcttggcttgctgatcgggacgaacgtgatctcgtcgccgtcctccatgtcgtaggggctgcaggaa

SEQ ID NO: 65588 - DNA, 2001 bp, Oryza sativa
  unsure (1)..(2001): unsure at all n locations
caaaaactcaacccttccacccaatactccatgtcagcttcccgatccgccatcaccatgtcgaagagatctcgatcagccatgtcgtcgaaggccaccggagaggacgacgcggacgacagctcgtcgccggaggtcgaggcgagctcgctcatcaccctcagggtgaaggacagcgaaggcgtcaggatcacccgcacgatgcgcacgacggacgcgctggacgacctgatggacttctacctcggcatggtgccggccgacatggacgccgccgagggtgtcttcatgcactacggccgtcgtgtgaccggcgaccgtacgccggcggactacgacatggaggacggcgacgaggtcagcttcttccccgacggaacctggaccacgcccgtcaccctcaccgtgacggacaacaatggccgccgggtcacgcataccatgcgtaggttgcacatcctggacatcctgttcgatctctacttcgccatgctgccgtcgaccgcgcccagggagggtgctttcatctaccattgcagggagctcagccctaagcagacgccggaggaatgcaacatgaaggacggcgacgagatcgccttctctccgttcagcaagccgagtgccttcgtcacccttacgatcaggggcaacaacaacaatgcggcgcagcgtcgtcgtcacccgcaccatgctcaggacccaagaacgactgcaggacttgatcgatctctacttcgccatggtgcccactgacgatgagcgcgccgaattcgacgtcacgtactgtggcaggaaggtcgacatcgagaagacgccggcggattacgggatggaggacggcgaccagctccgccttgctccggcgaccgaacggagcaggttcgtgacgatcaatctggtgaccatggtgggagtcaagcgcgcatacaccctgcgaaggacagacgagctgcagggtctgatggatttatgcttaagcagggagcctgcaagcatgtaccaaaatggttgtattttcctttacaacggcctgtgttcaaggctcggaaactccggatgatctcgagctgaaggatggtgatacgatcgacgttttagctcatctggtcggataatctcaagcgggagggttggggataccatccacgttttagctaatctggtcggataatctcaagctggagggttcgtcgtttggttctatgggacatgctgtcacttttttatgggctgggggcctggggctagttacttttattgccgagtgtaatacaattatttcctggattaggtaagggtcggtggttatctggtttgcaatgttctattgctgtttcggttttgcaccatttatatatcattatactcctttgtttctatgcttacatcgaaataatatctatctatctatctatctatctatctatctatctatctatctatctatctatctatctatctatctatctattatctatctattatattattaaaacagctttgaaaagaggcatcacgttcgctgtggggctagaaattgccacattaatcggaaaaaaagaaaagaagaaaagaagagtccaggtagaaaaacaatttaaaaatagctgaattcggaattaaaaataagcaatattgaaggaagtttccatataagaacccaatacgagattaattaaaattcgaaataaaaataaaataaaatctaaaattagaaaaaaaaaagagagtccaagtagaaataaaatttaaaaatagctgaaattcggaattaaaaataaggaatattgaaaaaagttttcatataagaacccaatacaagnattaataaaattcgaaataaaaataaaataaaatccaaaattagaaaagaaaaggatagtccaagtaggaatacaattttaaaatagttgaaattcagaattaaaaataaggaatattaaaagaagagtccgtataaaaacctaatacgagattaaataaaattgggaataaaaa

SEQ ID NO: 65589 - DNA, 738 bp, Oryza sativa
cgctccgcctcaccgccgctcgacgccatgggccgcatgcacagcagcgggaaggggatgtcctgctcggtgctcccctacaggcgcgccgctcccgcctgggtcaagacgtccgcgtcggaggtggaggagatgatcgtgcgcgtcgccaagaagggccagctgccgtcgcagatcggggcgatcctccgcgacgcccacgccgtcccgctcgcccagggcgtcaccggcggcaagatcctccgcgtgctcaagtcccgcggcctcgcgcccgaggtgcccgaggacctctacttcctcatcaagaaggccgtcgcgatgaggaagcacctcgagaggaacaggaaggacaaggacaccaagttccgcctcatcctcgtcgagagcagggtgcaccgcctcacccgctactaccgcctcgccaagaagatccccgccttcttcaagtacgactccaccaccgcgagcactctcgtggcctgaagtggaactgaaggtttcgttcgttttcagcttcttttttgggcgacttgaattctcttgacagccatggagttttgtttaatcttaagtaagtaggaatgcttttgttggtgtaatgtgttaaatctacctcctgcacctgaagagaagttgcttactgagactcgatctaggaatgcttttgttggtgtaatgtgttaaatctacctcctgcacctgaagagaagttgcttactgagactcggatcagatttt

SEQ ID NO: 65590 - DNA, 13367 bp, Oryza sativa
cctttgctaatattccaatagatatgcttgctcatgattcatgtttgagaaacagagctcatatctcttgtcacttgaagttctgaatgaattcttgtgaaaattgtcctttttttgagaaatctgtgccataacatttgggagcggaaacattattgtgacagtatcacatttttgtcttttgaagttatgaagtatccagttatgagtactagttgtccttttgactttcagattgagctttggacatctgttttgattagatttaagatctccgtaagcaaatttagcgatatttcagtgttaggtcagtgcacaatgtgaaactagcattcatattttcattttggaaccaacagtattgcctagcaaggttttttattgacacttctttgatttgctactatactttgtgctaaatccactgttctgactggagcaggtcttgttcctggattatttacataacaaatgatccagctaacatgctgcggccactgtatcatgtttagaaagtagagctccaattgcaggtgaattccaactgtcagtgcaatagggtctattgggagcagtctccttttgggtattttaggtcaatatgatccaagatcttgattagtggtttgtgaatatattccaagatctggtaacctgatatcatgtctttttggtccaacaggtagatttcgcctcacatgaatcaatcggacctattgtcagtttgtcactaggtgtttgtacatgttgtctttgtagcataattagtactgatgaccaattagcagcagctaactccattcatgctttacaatgattgatgaaataaagcatctgcactttatcatctggacgacttgttggctggtgctcgcggcgctgggaatacctgtcgtatgtgcgccgctgatctgaataatgttgtgtgattttaatcaagttggatacttgatttgaatatattgcagatatcgtacctacttgctctgtttgtttgtttgttttttggttatatttctaggcaatgcattgtaagttgaaggccaccatcacagtatcagctaagggtgtgcatttgatctttaccttgtagaggtcatcaaactctaatcgtacctgaaactttgtgtattttagtctttacctgccatggtgaaagatttgttgactcagtttgataggtcgttttactatattactgtcattgtgatcgtgctcggtatgtagatttatttatgcgggatgcatatgctgcccaacatcattaggccactaacttactggtattgtcccacactaattaagtattctgactctacaaaaaacgacttcaactaaggcaccctatgctagcatgctacaccttgtttttatctcactagtcactaagataattttaggcaaaagatcaagtagataaccccctatgctagcatgctacaccctgttttgatctcactagttactaagataattttaggcaaaagatcaagtagataaccaataatttactttggtatccttggctacttcaggttgttgccttgttggattgagatgccatcaaggcatatggtacggataattagcactgacagtaattacatactcaattcaatcagcaacacagatctgagtgtgaggaacaacaccaaccaggcaaccacgttctggtcaaagccaggcaagaattccttgatgcctccaagctcaggataaaacaatgacgcttccggtacacttgctatccagttgaatacattatgcgaacatcttgccatttctttaacgatctttgatctgaataaacaactcgtcttcagacatggcgccatccgggcggacagttcatcgccctcgttttatatatctagatctgaacacaacctgctgcactgcattaccatccatctcttcttcttcctcttctacttgagctgaagctgaagctgccattgtcttgctgagctcgtttggatctctttggtctagcttgcaatggctagcgtcgtgcagtaccaggcggcggcggcggcgacggcgatggcgtgcgaggaggagttcattccgcaggggctgatctcctgcttcgggcggtcgctgtcgagggcgtcgtcggggcgacacctggagtactgcagcagggacgtgagcggcggcggcgaggatagccggcgcatggcgcaggagcgatcggcgagggcgaagctgcggtggaaggccgtggcgcaggagatcatggcgaggaggagcggcggcggcggcggcggatcagggcggcggaggaagacggcgttcagctacgactccaagagctacgcgctcaacttcgacgaccaggccgccggcgccgagtaagagctccagcctccagctgctacgtcgccggtgagctagagctagctgcagagacgggacagacgagcgcgtgcaatatcgcgctcgcgcgcgacggccggccggccggcgaggggacggagtgctcgccggtagctcctccggtgacctacccggtggtgtgcattgcatgcatggatggcgggatccatgtgaagacagagagagatcaagcttgaagaatgaagagcctgaagggcggtggttcttgttcgagttttgtttctttggctgttttttttttcatttttgagattgtaaacgtatgcatcctgacatcttgaattgttgatgtggtgcagtaagtaataaaaaactgaggcatttattcagaaagtattcactgcgttttatggctttttatcttataccttccaaattccaatggcggcttcaaacagcagatggtttcagcaattgttttgcctggttttggagcagtggtaattctgttatgtgggggggcacttgaatgttgaaacttcaagccttgtttcttttattttctgaaggcttcaagccatgttagtgtatcggtatagctgtttagtaaatcagcaagtggtttccgtactccactaatcttcacaaacatgaaccaagagggtacagcaacgtgctgttgttatgtctcgtcatgtgctgcatagcggtgccggtgcagtagtgtcatttggtttgtggaagatattgaccggcaaattaatacgtcgacgactacatgccagttttccattctctggatgatgcacacgccaaggacccaaagcatgcatgaatggcttcctaccatgatagttagtcgttgccactcatttataccggtggcgaacgcatgatttattggtcggttattcacttgataattacatgcaccttggatttgatgtttgatagactagtgttaagagatttgagatagttgactactagactattagtacctcctctaaactaataatacttgtcgttttagataagggtaagatcaaactttaaaatatttgattgtaaattatttttaaaacacttgttttcaaatataatgactacatgcatatgttagtcttgaaaagtactttaatacaaccatatatttattaatacttttacacgaattataatgaaaaataatggtcaaagttgtttttggagaccgtactcttgtccaaaataataagtattatcaacctggagggatgaagtgttgtgagctagaagtgcataaggagtgaatttgttgagaaaaaaagtattaggcacattcgagtataaatacatataatatactacatatattatgcttttaatgaaaaatttgggtatttccaggaatacaagaatacccattgatttcgccattgaattatattgcccccatctttcacttgcagacgacgcaactatttatagcaaggcatctatagtaattttaccaattttattagaattcaggttttgaagatgtttgtaggggtagatgtgcttataagagtgcgtgcgcctttactgtaggtgttttttttaaaaaaaaaataaatccaaacatcggtgaatcaagaggcttttcaggttggggtacagaatatgtcccagtcctcccattgcttctcatctcttccataacacatactccctctgtaaaaaaaaatcaacctagaacaggatgtgacatctcttagtacaacgaacctgaacaaccctcttcttggttgcgttttttttatggaggaagtagacaggtagaacaatgtgtctacttatcatgccattttgtttgggtattgtgcaaactgcaaaactttcccttgctacaactctcaatgctaaaatctctataaccgatttcagggactaaactctacttcttattggaccacgtggagctccgtaaatttggaattgtctcctccaagaatctgccatgtgtccatgtggagaaaactagcctagacgtttcattgtgaaatgaaaaaaaaaaatatattggcgtgtacagcccagtcacggatgcctgcctgggcctggtcgtccggtgccgttgctacagcatttgcattgtttccttctcaagctaattgtgcacacaggaccaggcataaatgagataaacgaaagtaaaaaaaaaacaaagaaaaaatatatatattttttcaaaaattatctaaataaataaaatacattatggttaaacccgaaaattgatttacgtacctaaccatactgatatcccatatttatatgaaataaataaaaaaactaaattacaaaaataagtcgaaacattggatgaaaatttgcaatattaacaaccaatatttcttcgaatgtgcatttcactattgatactgtatgcacaattttttgcttaaaaattgccacaattttgaggaaacataactttacgtttttttaatagcatctctaatcatgtgtctaattattggcaatcactaattacaatccaactttgttttttttttcattctaacataaaattaaattccatctttctgagacaaatacaaaattatattccattaattaatatttcctttttgaaagattattttgtgggtgttaaactaacttgtgtaaaaatatattactacaccagtttcaaattaccggtcattctcacatttcaatttctagatcaggatcccctatcttcacctttcatcaatgccacatatatctggtaatcaaggttaacattactcttaaaaccactagaatgtattaaatgagcataacaatgtaatttgctgcataatttgctagagtgataaataattcaaaataaaggctggtaaattttccaaaacaataggtctagataagatatacatgctataaatttaccgacgcgctaacagacgcacagattttctagtataatctaaatttagattagacacgatctagctagtactagaaacatagacataatctcatcgagcattacgaatctagatatgtagatgtatcaaatccaatatatgtagtagtatattttagaacaggataatagctaatgttaacctaccatatatatccaaattcgtaataatacttttctcctataaaacaacaatctaagatatatctcaatattacaatagtagtatattattcgatactagattattactatatccgtttcaggttataagactttctaacatatatgtgtgactagatttattagcatctaatatgaaacggataaaatatattgtaagataaagaaaacattaagtcgtgtctattccagtattagttgctatatttagcacggggcaagcctaatatcctagtcgagctctctcgctggggcctgggggagagtagtagtaacaacaggaaaagggaaccgcgtggcctccattcgcggttaaccccattcgcggggcctccatcgatggaggcctctctcccgtttcaccaccaccaccccgctgcctcctccaccgcggcgcatcacgcggcccgcctcactcctcctcctcctccgcgagacccgcgtgccactgcccgctgggtgccccccgcggccgcgcccgtgcggagccggagcccggcaaatctagggttgccgccccatcctccccgacgcctccgcctccgcctcgcgccgccgaggataaccgctgcagtcacgggagggccgcgtcgcccccgccgccgagccccgcctcccttggaatgcgccggcggcagcagcagcagcctacgacgaccgcgtgaggaggaggaggaggaggaggaggaggagcgctcttcgacggcgcacgcgggggtgagcctaggtaacgtgccctaccaaccccgcgtgtcctctcctccctctcggtaatttgtttacacgatgagttgatgcaatgcggttgatctcctgttgaccggggagaccatggcccgcgtggtggaattggggcggcggaagaattcggttgcgtttgtatgcattgcatcactgcggaatcgtgtggccgtggcttgtctcctcgtcgtccaggaaattccagtcacttgaatcttcccaactgcttcatttattagtattgttttgggcttgtatcctaagtattgggtactgatcttcttttttaatccgtttacctattatactagtggtcactggtttgcagcagcgattgttctgatacttgatgtgatcttttatttttcccctaaaattttgaccaacggattagactacaattaaatagacagccaagttctttgcttatgtcaccaattagttagcttgttttgttacgctttgtggacataaggaaagagatctgttgtttaggagataagtctatcttatcaatgagttctgaagttatacaatgattaactggattggaagaaatttctgctttcgtgtagccctttttctcactgtgatctgagtaattgtgattttacacagtgggcgagaacaaagttttgcaaatgtcatcaattgtgccgaaggcgtccaatatcttctggcatgattgtgcagttggccaggctgatcggcagaagctactgaagcagaaaggttgcgttgtttggatcacaggacttagtggttcaggtaaataaagctaatttctttgaaactttgtgttgtgcttcttgggatgttggcacatctgctgagctgttcaagcataagataatttcaacagcaatttgtgtctatgtggaatgatatatctttactaacaaataaaacgttcttaaagtgcatcctacaatattttgggctaaaggatgtaatattgggtgaatcttgttacattctacgcaatgcaaaaaatactactgccttatttctttagttcttgaatgatttatatacttattggtttggtaactactgaaatattttgtactttatcttcatcgtctctactgaagcaatttgatcaacaacattacacgagtaggaaaataatattgatgcatcagtgacatgttcagtgctcccaggtcctgctattgatcctcacactggatgttgctgttcaatttttacatttttacaatgctacttagcaactttcccttaaaatattcaggcgattattgtaagttttgctcacaaaccatgatgagttcaactgtgtttaagaggtggtgatctgttcaaaatgatcaactacatttcagagtgtcatgtcaatatatgatatattgtacctattttttgctgtccatgaatccagggaaatagctttcaggttattgacgggcaaatctgtagagtttgtactgtaagctgacatgtcgtcatctacatgaatgatgctttagtttctcactattgatttgttctatcttcatgatttaacatttattgtcagaacaaaacttcttaactttccaagtgatgatttacttttttttaagtaagttcattctcttaccttccattgtcaaggtaaaagtaccctggcatgcacattagatcgagagctccatacaagagggaagctttcttatgttcttgatggtgataatttaagacatggtttgaacaaggatcttggctttaaggcggaagaccgtgctgaaaatatacgcagagttggtaagtatcccctgacacagaactttcatgtggcaattgaatgaagttctgatttaggtaaaaatatgataatgcttttgttgttattttacatttttgacacatctgtgcttgacatttatatccaactattctgagcaggtgaggtagcaaagctattcgcagatgcaggcctagtatgcattgcaagtttcatatctccgtataggagagaccgtgagtcttgtcgtgcattattgtcagatggtagctttattgaagtaagcaattcttagtttatcttctgtttaagtgcacctagctttgttatggactttaattttgaatattcacaaacatccctgaaaccccttttgtaggttttcttgaacatgcccttggaattgtgtgagtcaagggatcctaagggcctttataagcttgctcgtgcaggaaaaataaagggtgagatactcatatagtgcttgatttccaaaatcgaaagatttaagagtccttattacgaaagtgaattgtttaaaaattcgccttactttttaagatttgttcctaatatctgcatgattgcctacttgaataattactcttgccaagttgaagtacattacgcatatcttggtctcttggggaagcaacaccagaaaccaaactagagaaaacttaatagatggccgttctccaaaattgtcgatttctttaagcaccaagagtctgtagttttttttgcctcatgctcttgtgcaagtccagacatcttagaaaggaagtttcgttgtgtgccactgccaactcgtcctcactttgtcagctctaacctttatcgctgccaataatctccatagtagtttttgaatcatgtatacatcactcatgcttcaagctttaattttgtcctgttgcaggttttactggaattgatgacccttatgaatcaccattaaactctgaggtacatctccattagatttgctatcatctccacatggtcaaagtgtgcattattaactgtgttagtatatggctgttctttctggttcatattaaatcagtggccttaatgaaactcaagatattaaaagttttcatttgtgattggattagattgcagagcgatccattttataagcatgttactcctacataataatcttgtaggattaaatgcattctcagaagaggcaatgataaaatatatgcattggtggtcggctgatgggaatggcagttgtgggtagcaaatgttacattatgattattgccacactagacgtctatatcgctagctgaatatagtttgtgatccttattgtattttatcctcaattttaaattacatatgtagcagtctggaagacacctttaatcaattcggtagttgtctatttgtacatctatgtctttgtcattgtatcatttattgtgccccacatgaagttgccactgtttgtcctttacccagtatcacgaactcttccttttgttacagattgagatcaaagaagtggatggtgtatgcccttcaccatcggacatggcaggacaagtagtcacttatctagaggagaaagggtttctgcatgattagatgggatgcatcgatcagccggtagagttttctcctccatattagactagttcagaataagtcaagctttggcatgttttctgtacttgtttttgtttagattggttacatgctttgatctacccatattccttcttcactgcacagctaatggagctgtgcaatgacattcaggtaagttggagtagatttgtttttttgggatccaaaatcatcccagttattaacaggccgtagaagatatccatttacttctgttcttacattgtggactttatactgttactgttcttctaccagaatcagtgcctgggctgcgtacatccatcgtggatgaagaggctggattccaatccattttctaaaaagaaaagaatcagtgcctgtattatctgaaaccaatccgaacttcaaggctgttggtcgtaagaatataaatgtcgtgaccttgactttagataatacggatgcctggtgagggtaatgtctcgtccacggaaatcattggaagttcccacttccgtgatcatcggcaactatgttgtcgttatatgatctgaagttacgagggggaaaaacaaacatatctactccctccgtcccacaacaaacatactaggtgatgtcgtatctagtcttagattactatattaggactagattactatattgtgagacggagacggagggagtagcagaccgagaagggtaggaagatgggggaatgctagaattggcgtcaaccaaacacggaggacgcggacggtacagggagggaagacggacttatgtgagctcctatgccatggtgtgtgggaaggagaaaagggatgtggtgatgtgataagattattgcgttgcacgaatcttggcgtgatctaaatagtctaaaatgaagttgtgtgttttcaggtgcttagaaactactcccttcgtccaaaaaaaaatttagaattgaataggatttttgttagcacaacgaatctggataggagcttgtccaaatttgctgtactaggaaatgtctaatgcaatactaggttgtttttttaagggtggtgagagtacactcttatccaaacggtagtgcaggctgcaagcttgcggtttcttacagagtcgacgtcgtctctgtcaaacaacagacatggtccacccaagagggatacggcacctttgcgagctgcgtcgaccgctccgccgcggagacgaccagtcgagatcaccacacacctgccggcccatctgcgtacgcgtcctgtacacttgcacacgcccctccagcccctcgcggcacggtcaaaaccgccctgccgctcccgacaaaaaccgcgcgccccccgcgcccccaccggccggacgatgcgacgaccggccgccccgcacgaacgcagcagctgcctcctcctcctcgtctttccctcccgcacgccaccacctcacccacctatccacgtcaactccctccgtccctcgcccgcgcgagctacgtactacgtttacccttctccctttctccgcgactccaccccaccgcgcgcgcgcacacagagcgcttcacgcaaacgaggaaaaacccccccacccacaaacaaaaaaccgcacgcaacgcaacaacgtaccacgagtctacgaggcagatggtgttcagcgtcgcgtgggtggcggcggcggcgcgggtgccggcggagctgtgccagggacagggcggggcgcgcgggcggcggcggcggctgcgggccgacgaggtgctgcgcgcgctgctcgtggcgcccgtgcgggagctcgagcgcctcgccgactggctcttcgtgttcttctgcctccccctgccggactactacgtgccgggctccggccgcggcgggctgctggtggcgcgggcgccgtcgtcgccgtcgggcggcgcgctcctgcactacggcggtaggtaccggaggcccctctcgctcttgttgccgtcgtcgtcgtcctcctcctcctcctcgtccatgtcctcgtcagaggagtactactattactccgacgattaggaggacgcatcgaatcaagctgaggtgtaccgaatgcaattgtgttgtggtttattcatctatctagccatggccatgggcttttgtgtgctaaattctttgtgatttgtacatatgtgtcattgaaccgacaaattcaaatgatggtttttgttgattttgttggttaaagattgtttcgattctgaaatttcaggcgtttttgatggttttgcggtagcttctttgattaagaaatgaatatcaaaatgatgtcttttaatttgttcttgacatgagtgtacgtaacaactaacaaccatatatataggtggacggcgattaattatttcgaagaaaaaatatactaagtttgtactatttggtggccggacaataattgggccattgcaacaagagcaatgaagaacaaatcgattgtttactaattgtccctttcgatctcgatctatcatatattcttaggggacccttttctcatcttcaatacatctcgagcagtggttgacaaagtagtgggggattgtctaacataaatcgtctgaaaaagagaaaatggtacgggtagtctttgttatgaagatccttccctaagttgcaatattacacttctaaacattttaaggtaccttccaattattagtaagaagttcgatcacattagggcatgtacaaagttagagtctaatataagctctctatattaatttgcgtcactaaagagctctctatattaatttacatcactagagatcatcctcatacaatagtagagacaataagatctcttaatcattaatgcactaactattttttttattatacttctttccttttttttccatcctcatgcaacaaactttccgttaataaatactaagagtggattctaagccattgttatgcgtaacaatgatgtttctcttttattccctctctttctttcacatcatcaaatttacatgacaacaaagagagcccattaagggcatgcacaaaggtaaaatcaaatatgagctctctatattaattaatgtcgctagagactatcctcttacgatagttcactctccggattcattttaattgacgttttagacaatgacacggtctgcaaaatatatatttgaccttatttttctattataatatatatgcaataaataaatgcatgtttacttttattataatgctttgaaagacaaatctatatatgttgttatagtttctttaaactaaatatttttaaaattattgatggtcaaagttataaaagtttgacctaaacatcagttattataaaaccagagggagtagagactaaaccattaatgcactatttttttatacttctttccttttctccacccccatgcaataaatttttcgttaataaatgctaatagtcgactctgagccgttatcatacgtagcaacgatgtttctccttcctcccatctctttcttccatgtcaccaaatttacttgtatgagaacgaaaagagactcttattagacatgattatacatgcccttatttcccaataacaattccatttttaagacaactataacctacaacattattccagcatacaagtgtatcgaagacacacacatcagggtttacctttctaatgaactgtttggatctcgacgcaacgggttttgccaaattccaatcgaatttactgtttcagatttcaatttcttaggaactattttaattttgcctccaaatctgctttcatcctatgtc

SEQ ID NO: 65591 - DNA, 4236 bp, Oryza sativa
aacattttcaagtttgaccaaatttataaaaaattatggtaacattttcaacataaaacaaacgtattatcaaaatatgtttaatgaaactaatttagtgttaaaaatgttactaaatatttttataattttgatcaaatttaaagaaatctaactataaaaaaacaaaaatacttataatataaaatggaagcaatattaattattgaaaatttgaaaataaatgaatctatttgatttttaaaaaacttgtatatataaggttttatcacaacatgcattattgagccgtttgtgaagtgtgtccatacaaaaggaaaatactcggccaggtaacccaatcaaactcagccttaagttatttgagaaaaccgtgcactttattttgataggtatcggtttctaacttttggtaccttcgtcccaaaatataaaaacctatactagatataacatttgctagtaaaatgtatctggacagaggaaacgtctcatccagtcttagatttttatatttttgagatggagggagcagtaagatatttgcacaaacacactatgtttttcagtgccttgctatatacattgatttgtacagaagtaaacgatcaaatgattcagtacctattgctactatcttcattccaaaataagtttatttttcactcatccacacataccaatacaaatattaaagagtaggatattcctactttatccaaacacaacacaactattcatcactttatctactcccgatataattattcaacattcgcaaattcccacgtaatgattacttttagaaaataaacatatttaataacagctataaattaacttattttttttagatcagaacacattttgccccgactatacataagttcacatgtcctctggccctctggccgtcgatttatgtaccactttaatactcccgtctatctagattcattgtactaagattcattgaacggagggagggagtacttcataacacaataatccttgagacataaattaattaaataatatatgggccaattcttacggagcttcaattctttaggcctttaatcgatggcccattaatatcccggcctttcacacacggcggcccatgcaaagcccaatttgaccggccgcgtgacccgcgtttagacttttgactagccaactcacacaaacgagtataaacgaccaaaccgaaaaccaacgcgggtgctatcccagccgtccgttcccacctgacaaccgaccgaatcgaacggccaccatagccccctcacctcaccacctaatccaacttctaatcgagcgactcctcatcatcgtcgagtcgatctccctcacgaagcaaccccagccttctttacctttcccgggccgtgtcgcccacgcgattcccttccctccaatcgaatcacgtcgccgtcctcctccgcctccgccgccgccaacctcgtcggcgccgccctcggatccacgccgcgcgatgcagcacggagactacgcctcctcggcccccccggctgcgggccactactacccgcaccagttcgcgccgaatccgcctccgcacccggcctcctccgccgccgacgccgcgccgccgacgatcccggcgagctacgcctccgcgccgccctactcgggggagggtactccgatcagccgccgtcggccccgtcctacgcgccgccgccccagtacgccgggtacgcgccgccctacaacaatcccaaccccgcgccctacccaccggagtcgtccccggcgccggcgccgtactacagctacccgccgacggcggcgggggtggccacgcagcatgctccggcggcggagcccagccccgcgccgctgccctacgacgccccgtactacggaggctaccagccgcctcctaccgcggggtacggcgacgatgattacctgaacgagggcgcctacgcgtatagcggcgacggcggctccgagccgtacggggcgcgcggcacggcgccgacgcggtcgggtgccgcgatgtttgatgactacggccggtcgattgggccctcgtcgggaggggcggaccagtggcccaccggtggcggcggcggtgtgggtgggagctttgggaaaattgcgagggctgttccaaaagcagagtctcatgaggatgctaacggtggtgcgcagaagtttcgggttaaactgctgcctgagggtgccgggagccctaccgatgtgctttgtcaggtatgataggattggtcaaattatacatcacacatgcaaaatttagagtaatgatgtttgaaactttttagattatgcgctagagtgaccttggtagttccaatatgcctttaacatgtttatttttgctgttgcagattggtctggatggaattcgcatgcttgatcccagcacaagcaggacactaaggatttatccccttgatacactgacaagatgggatgtaagtgcgacatccttttgcagaggattatgtgtatatcttcttactacaaaatacaatggcaatgttgtttttctaatggacggttcatggttgtggtgcttggttaggttttagattcaaccgtatttgcattttgggcgaagactccagttgattttgaagcaaagcgaataaggttgaagtcaaacagctatacctccaatactttgcttgacactgtgactgcagcaacagtgcaggtgatcatcttcctccattatcaatcgctatttaccctcattttaagattcttaggtttagacttgctttgctctgtaacacactaacaccactactaatagctgcttttggtgaaaaagtgttaattagaaaaaccaaagcgatgaatatttgaatttgaaccaatacttaggaaacagcaaaatatgacttatatcatgaatgtctctcttctccaaaatattactagaaatcaatatgtcatactgcggcgagtatgatgccatataagttggctaacttggataccaccttattactctgtttgaattatattccaatattctgtgtttgaattactctcttgtatattgatgaatggaatataagttgctaacttggattccacattgattggcagtatcctttcacaatatttgtagaaactagttttttttttaaagaaaaggttttgctccaacatatttttcttgatagattttgttcacggagttgctcatacattcagcatatttaatgcttcttcttttttttttacaaaacattcacattttttaactttgtgaaactacttacagtttaaggagattggtggagatgcaagaggcagaggaactgtagacagtagcaaacccatgtcacaatcaaatgagaagaagaaaggttttgattggatgtttgcaaaacctgttgacgaagtgaaagaccattgggtaagttgaattgctgcgacacacatttactacttgatcttagttacaagaatgctggaacctttttagtttattatttgtttacttgcattgttccacttcttatttttgataattttcttgcaatatctgctcttccctgcgaatgcatgtagtttggccccttttttgaagtgtatatagtttaccctttgattagtcctttacatgacgatacactctgtaaccattttggttgagcatttcagcatataatgaagaccacttcagttcacttagcagtactgttgctctagccactgactgttttgccatcttgtaccaccattttgttaatcttatgatcgtgtttcttctctttatcccctttctaggttccagatgaggctgcgaagaagtgctactcatgtgctgttgattttagtccttttaaccgcagggtaatttgaatactctttgttcggatatacttatttgttacttttatgatgatattttgataaattaagatgatgttttctttgcagcatcattgtaggaactgtggtgaaatattctgtgacaaatgcagtcaaggaagaactgctctgactgctgaagataatgccccgcttgtccgagtttgtgatagatgcatggtacgttctgcttcttgtttcttaattatatattctttcttttgcttgatgttatcttaggtatagttacttagctcattttaagcatagcttgactgtgttacttcttggttgtatttctcttgttttccaaagcgagcacagctcgcataacctctgcagcaactcacctat

SEQ ID NO: 65592 - DNA, 1699 bp, Oryza sativa
aatgtaagagttgtaaatgtttgttggcacatgttttgccgccaaaattttagtccctaacatcttaggtgccatcaggaaatttcagcatgttctatgagtctgtgatcttaacaaatttatgctttgatcaacaggaggaaatggagagaaatcgcaagtcctcgggttctgcatctggaggttcatctgggaccagaatgagggaagttgcatgtcctacttgcactgtccatcttcaggtcggtctgactttaggcactcaaatgtgaatgctcttacagtaatgacttcgtttggcgcttacatactaacagtggatgtgcaattgcaggttcaggttccaacctctggctcagaaacagtggaatgtggggtatgccagcatgctttccgtgtcagcgccaattgataaaccgggagacagagcatgtctatagcaattattctgtttataactcacttattttgctgttccatacataataagcgtgtgtgcagcctgtagatatttcctggttgtgttggtgaccatgacaggatatactaggtttttcttgtacatgggttaatcctaaaatatatgctctaatactgctgaaattgaaacatgcttggatgtctctggagaatatcaaagaaacattcgtttctatgcttcaaacatatatatctcaacataagttcttaaaaacagctttgggtgtgctttcagatacaaaatggaatgccttttgcagcaaatgtgtagaactgcatctaactatgagtgttttaagatgctttgcatcttcctgtcagcatggtcggctcgcttccggttgcaaatatgtcttctctggattatctaggcaaatgtacttattgcctaaaagtctaaaacacttgttattgcttgctacttcctctgtttcacaatggaagtctttctagtattgtctatatttatataggtgttagtgaatctagatatatatgtgtttagattcattaacatttatataaatatgagtaatgctagaaagtcttacattatgaaacggagtgagtagttgctagtactacttattagacaagaactgaatgtggggcaaagatcaaactgcgcctagttgaagcacgcaagagcctaaacccaacctcactacaagtcactatagcagcttcttgtatcaacattcatcatacctctcgaaaagcaacattcttgaccaaaatttatggccatcaagtgaccccccatggccatggcccaactgaagcagcatccgcatctgtagttctgcacacgctccacagcagtgtcatctagctccaggcaaagagtgtgcagggaatcaggatagcacgtcgcaggccaggccacaggccagcagcaacgcaggcagcatccatgcacgcatgtgcccggtgtccatcgggacggatctagaaattttctgcagtttgagcaagacactacaacaatggctaggtcaatgttattgtaaaatgttggtgatatactatcgagattgatccggttcctagtacaatgttgttgtaaaatgttggtaattgctatcgagattggtgtataaattttcttaattttcttgaggtcttgttcgacttagaggggattgaaaagtattgaaggggattgaggaagaataatcacactataataggtgtgtaataaatcctctccaatctctcg

SEQ ID NO: 65593 - DNA, 18957 bp, Oryza sativa
ttcctgcagcccggctatcaatgatctgccttttgggtcttcttcttcatcttcttcttcgcgagcggattaaccgagcctgcaatggatggcaggtttctgttcctaatccggatggccaatgctgtcttttgaccgtcgctttggggcagagccgtactgtatgattactctgtaactgacagtgtcgaacgtgttcatctccgtgaaatttgatggatacacatcctgtgcgtttgtgtttcttgctcttgtgtttgtaccatccgatgtggtcacctaatttcttcaatcttgaaatagcatttgatcccacaattaatagtagtatgacatcccaacttctaaattgtctttaagcagtttcttgattgcttctgggtagctagctgagttgtccttgcatatttgtatgttacagtacattgcaagggaaaaacatactaggttgctttcattaactccattctttcagaaagattaaccgttttcagttcatgaactaattgctccactccatatattccctagtccctaccttccttctttctctttgagaatcttcagcgtactgagaataatcaagacagagaagaaagcgaagagcaccaagtcattcttatctgtagtactttctgaagttaacactgcacccatcatgtacagtaccaaactcagtttggtggattggatcaatgcattctccaagttgttcgattaggacttcagatcccatctttcatttgctaatccacttgactacgttcaaaacgataatctgcatgtctttccaaaatacctaaggactaaaaaaaagctatatgcattgcaaacaggccatgctattcagacatgcattttggcactatctctgtccattatgcggccatttgaacatgtttccatgttctatgatctctccaaccatgtcctcttcatgatatcattgcatgtatggactcactcaaccatgtactcgcgacctcaccatattctagtagctcagactcagccatcaggcttggcatgcttgtagacagccaccagcagcatgctacgatacagttgataactgcattggacctcgattggactgcatatgatagaacatagataatgcttacaggttgttttgacagtgacatggcatacagttgagtggacaaccgataattgggtccaatagtgattaagcgagtaatcttcggtccttagctatgaaatggacttgttggtcacgaccgtcactcaaaacagaagaacgaaagagattgcttgtttctgttctctgaaaaattaacggtgtgtcgtactgtccacctattggaattctcccttgagggaagctctgaattagcccaattgtctgtcctacaaattaaccgagtactctacaaatttatgttctctattcgagtgattaagtatggctttagctatggttgttaagaactgaaatggacatggtcgcttctgtcactcaaaacagaagaacgcaagagatcgcgtgtttctgttctctgaagaattaacggtgggtgatgctgcccactcacacgagcaactctgaattaaaattaagatggtcagctgtattcttccacaaattcctactatattaatgcctaatttaagcaagatttgatggactgcgtgattcactaaacacaatgcagaacatgcacgtaagcactcgcgaattcagagaaaatgtatgggagggagcagatgacatcgggccgtgctacaggttgcctcggtgtctcctgcgctcctgctctctaggctgcgtcctgcgtgcgtgcgtgcgtggcgtggctgcccgtttcaggcttcgactagtggtaggtgagggcgacctgcggcgcaactttgaaatgcggccgtattgtggctctcaaattggccgaaaaacggatggttttttttgcagaggattccctgctgatttgtgattttcgtcgtgggttttggggggcacgaccagcgtccacacgtaccggaacaaagttgttctgctacagtgtttcactatgtcggcactcagcattcatacagtgaattactgaatcgtacgtttttactttttacctagtacgtgagactattttacggtagtttcagctggtaggaaaaaacgtagcataggagttggactcatagcaggtttttaaaataccatagattaccgctggattatcgcggttatagggtacgtcgacgtggtctaatatgcaaaaccacttgttatattagttaggtaaagaaaagaaaagaaaagaaaatttgagttcttttgttacttttctatcttaaaatatataatacttatacttcatttctcctataatatagcaagatataactgaatgagacatttcatagtaaattaaatatagactggtatctccttttaggttagcttttttgagacagatagagtacttgattcattttatactctatatatcctaaaataaatacacgtagtacgtaatgtggttccataaaaaaagtacgtaatgtgatttattctagtactatgaatctagactacttgtctagtactccactacgaatctagattcacagtcctaaaatactgcttgtccagatttgtagtatattctaatactgaccaaagtgcacctggtatataacatgacatattatagtattacgaattctggattgttacatgtctaaattcataataccaggatatatcaaatcacaaattaggtatatttattttgaaacaaagaaaatagaatgaatcgtatatatgtccagatttatactattaatatccatcctgagacagatatggaatcctacgaaatgttttatccgattatatcataccagtatattacatcatggcgcctcctctctctctctccaacccgggccgagcctctcgctccgtactcacgcacacacgcagcggcgcagcgagagaggaaagagagagagagagaggcaaaaacgacaccaacgggcggatttttaagtgcggccacctccatcctccccgtgtccgctagccccctcctccctccgttggtctccgcccacccagaggaaaccacccgcccccggtccccggaggaaagcttcggccatggcggcggcggcggcggctcggaggggatgcctggtcgcgcttctggcggtgctcttcttggcctgcgccgctgaggggggtgcggcggcggcgtcggcggcgcagcagcagcagcagctacggcggcggaggcatctgctgcggcggcagcggcaggtgcacagccacctcaggcggctcaacaaggcgcccctcgccagcatcgaggtagcggcccgtctcctcctctcctctcctctcccaccaacatggcgcgcattcaatgcacgccgccttgctcgccatcgatttcccgtttcgttttttcttttcttttcttgctctggtcgctcgctggtatggaggggcgaaggaatgaatccatggaggtgaaaaaaaaagaaaaggcggtggtgcatttggtatggaagtcgcaaaaaaagttttgcgcttttgattgatgggtcgacttgctcgtgcttggtgatgagctcgctttggaagtgtggattgactgttcctcctcctctcatggaccatgcattggggtttcttccgttgatggaggaaaaggctcgcttttggaggaacattttatgggtgcccgtgcttctttgggttctctccacttcaagggaggaaagatatggttgctttcctttctttggaggagaacagactacagagtgtcttcttccttttctttctttcttttttttcctctgaaccattaacaaattttgcttttgttgctcaaagatttcttctttggagtatggttgatagtctacttcatggatgttttggattatctgaagttgcattggtttgatatatggaattctagaactttcttttcctattttttttacactacttttgctaaaatgagatttttccctgtctctctcaaatcattcatgtcctgaatttaggataatgttttctctttttttttcttgctttgattgcataattgacagtgtgaattcaacagagtcctgatggagacatcatagactgtgtgcacatctccaaccagcctgcctttgatcaccctttcctcaagaaccacactatccaggttcctctctctccagaacacaccactgcccctttttttacagttggggtaatgcttccccacatatcatgataacactcaatggtgcactatcaccacctttcagatgaggcctgattaccacccagaaggcctgtatgatgagtccaaggttgcatcacagcagaacacccagacaatcacccaaatgtggcacaagaacggcgtgtgcccggagaacaccataccaatcaggaggaccaagaaggaggatgtcctaagggccagctccatcaggagatatggcaagaagaagcacaagagcaccccaaaccccatgtctgtcgaccctgatatgctcaatgagagtggccaccaggtagggtagagtgtgtaatgtgttccattcaagaaccaatctccctaatagtacttaacatgttattgggattgttcatttaaatcttgtttctgctccatggtgcagcatgcaatagcatatgtggaaggtgataagtactatggagctaaggctaccatcaatgtgtggcagccaagaattgagcaggccaatgagttcagcctgtcccagctctggatcttgggtggttcctttgggcaggaccttaacagcattgaagcaggatggcaggtgagagggagaagaaaaacccacttaggtcaaaagttctattaaatgctttgttgcagcttccatttttgttcttccatgcgcccaattatgaagctcattcctccccttgcatgcgtcaataattcctgttttgcaataatgatatggtacactacgactggagaggcctttcattttaggagccagactagattatattcgtttacgaagattctttctttcatgagcaactgttttaggagctaagaatgctgtgatggccgattaaagctatatgcagtactctcttgcattgtggcttatgtctttattctctctacattattgcaggttagcccagatctgtatggggacaacaacactagactcttcacctactggactgtaagataaacatcacattcctttcaatcttcacgataattgttttttagcttctttttgtctcttgtttagatctacattcctatcttgctgttattaaactacagattagcctaatgatactgatttttgtattgcctctgtactctctgtagagcgatgcgtatcaggcaacaggatgctacaacctgctgtgctcggggttcatacagataaacaatcagatagccatgggcgctagcatctccccactctccaactatggtggttcccagtatgatatcaatattttggtctggaaggtaaaatacaagaaaccttcacatgcgtgtgtatacacacagacgaaattcatgaacggtgccagcgaatctatgcccacctgtttcttgttctttcctgaggcacctccagggcttaaggtcaaggctacaactgtggccctggcctgttttgtggacgcattcacagttgtcccccacacacgtactgtatttatgcatgctaatgcaaacactaatgatttgagttttaaacaaattttcacaggaatattctcctagagctcatgtttcttctgttaaaattttccatgtcattaccatgtgacattatgttggcatgccaccacttgcataaccaacaagatctcgctccacgtataattccgaaagtgggctatcaagctaaaataatttaaaactcgttttcatcaaagggtagatccttttcatagtgcatataatgaacacaaaaaggaaaactttatttttgcgcgtgcatgataacactaaaaggtacctacaatattcccttatcattatcctatcttctaactatgccccatggattgtggtttgcaggacccaaaggagggcaattggtggttgcagttcggtaatgactatgtgttaggctactggccatccttcctcttctcctacttggcagacagtgcctccatgatagagtggggtggtgaggtggtgaactcggagcctgatggcagccacacctccacacagatgggcagtggccacttccctgaggaaggatttggcaagtccagctacttcaagaacatacaagtggtggattcatcaaacaatcttagggcaccaagtggtattgggtcattcactgagcaatccaactgctatgatgtgcagaatggcaacaatggtgactggggcacatacttctactatggagggccagggaaaaacccaaactgtccatagtagaaatggaaaaattctatccatgcccctaacaaacccttgacacctctgtattatgcagtaaattagtttacacctcttctctttttctcctcttggtttttgttttggtttcaccattttcccaccaggttattaacttctaggtaagtgtttgacatgtgaaatttgttctcttcctcagagatgttggtctggctcttgggaggagtgcggtcaagtttctgaagagaaacaggcctgtttggttggttggtttgtgcacttgtgcctcatgttttgtcaaatattttttgttttctcccatgcatgccttcaacttgattgttggagccttggaggtactgcacttgttaagttgaattcaattaattaagctgttggtgcatgtgtgtggcctttggttaatacctgtaccagtatgggtttttctatcctgaaaaaagttgctaatcaagtgcttagctattggaatatgtgcaaagatgccaactttttgtgtgctacgtttggtggccacacttgggtcttctggaaagcggcattaaagttggttaagcatatggttagacctgggacttgcattctgtgaaggcaggtggagttcacattgcaagcaacagtgcaagcaccgcaccattgcttcagcaatcttcaagctcctgactattggtggccactgattgatttggttgtgagctgcctaactgaattgacatttttactggtctacggtttgattctgactactgcttctagtgtaaggcttttggatttcagtgctctagttgtggcatccagttcacaaatcacttgttcaagtcttcaagatgtaaggtttgattctgtccagctataacgcacaaggtgagatggaattcgggacgattgattttctggctggtcatttgatatgtttcatgccaaataacggtggaatgcagagcatgtctggataaaaataggagtactaaccagatccgttgacggctgcaattttgatattttagtccttttataaaactattttacaaactagtaacatgtccaagggccaaagtcatataattgagaattggttgggtggatggtgagaaaaaaatactggatcggtggttatgcttgtatgttttaatgggcagaccaatataagtgggatgggataggagaataattaggaatataacattggattcggtggttactctagcgaagcttactaaatgaggggaggggaggtttttaaagtagtaaagataaacctctaagaactagtaaatcgcaggaatggatcttctgctccacaaccgacactgaacacgagctcagtgctattgttaatggctttcaaggttagcgccgagtcgagggtcaaatagtttttttagtgcctagttctgaaataagttgtatcaaaggtccaaacggcaaacttgctgactgagggaataccaccaaatgagcttctgaaacatgtgagctgcatgattgtgcgaggaaagatggttaagaaaacaaaccacaccagaaagtaaccaaagcagcatgaggcttttttatttaccatgtaatccgggcaacatctcctctccagcgtttagctcgacagtagtacagtacagcacagccatggccgtagtagctcacgagcactcaccaagctgtctcaaaagggctatagaaagaaaacaagctgccttcacatgccacacaggggcccctgcttttcttttggttggattcgatggaaaataattacaccaacaaaatccagtcccaaatttttttcccaaaaacatcatatcgaatctttagacacatacatgtagcattaaatatagataaaatgaaaaactaattgtacagtttgcatggaaatagcgagatgaaacttttaagcctaattagtctataattaactataagtgctatagtaacccacatgtactaatgacggattaattagataattaattagacttaataaattcgtcttgtggtttccaggtgagttatgaaattagtttttttattcgtatccgaaaaccctcattcgtatcaaaaacttcttccgatatccggtcaaacgtctgatgtaacacctaaaaattttctttttgcgaactaaaccaggccgcaatgcaatgcaattcactgcaactgcaatactgcatccatccatgcatgcatgcagctagtagcagggctctcatcacaatctttctcactggctctgctgctgactccagtagtactgggctactagctgtagtagccagctgtgacagtggtgagcatggatggtttcgtgtgtttgcccagaggacaagaggccactgtggtattcatcaacctcttgacgcctctcttgtttgcaatcgcagagctcgtcgtttttcatccacatgcatagtgagattcttccatggtgattgtgcctttccaacttgtcaactctctctctctctctccctaccagcgtgcattggatgctgaattgctgatgtgttcttttgtttcgcccatttcaggctaattctcgatgtcttaggggacctgtgtgttcatgtgaattatagttaggccttgtttagggaagcttttagtagctgcggtttcttttagaatctcatgctccttcaaacaatacaaattctcgcatatattctccagttacttggaatctcaagccccctccaatagagccttaaccttagaaacttttcacaaatgtgtatactacatgaattgaactgtttttttaaaaaaaatgctccaaaagattaatgcttgcaagatgcctgaaaagtttgaggctccaaatgccagtttggtactctgaactctgcagggtaaccttcccctgtagcctgtataggcaatggtagcaactagcaaggcaccagctttccagagaggttgcaatgcaattgcaatgggacgaacaagaacacgacgtactcgctaaggagaagtatacgctggttgtctagtactgtactacttggcatacggcagagagaaagctcaccatctttctacttggcacaatcttcttgtacttttccgttttcactttcaccgagtaaattatcagggctaggaggaacacagccttttcatcattaaaagaggcagcaggagcagatcagagcagacatttagatctgtaaagcaatgcaactgtgtggatagcctgaattgttcagcagtagtagtaatagtagtatttgcgctgaatttttcagtagtatttgcagtgaaaaccatacgtgtttacggtgaaaatgccaggaacgggccggcattgaagacgatgggccaggaggcaacggcggacggggcggcgcttgttttcttcttgcattgacgcccattgcctgaaaatttcaactccatgttcctgaattcagagacaatttgcacctttcctgcttcatatgctcttgacttttggtagtagtacagtttttgataattcggtgaacctttctatttcaattgaatcacataagaacataacaggaagaggaatacacataaagttaactgattcttcagaaataggctgtctctcaatgttccaacgctaccaaatggacaggtgattaatactatcactgaagacaaataagtcataagccacaacattttctgatactgcaagtttatcattcttgaacatcatcatgattgatgagtggcacatgacgctcacaagtcacatcacacacaactatactaaaccatagactatctaaagaaaaactataaaccatagacaagcgttggtatcttttcaatggtgcacacacaggaattgtggggtagagtgatctttcatgttggcttctcgtagctgttttggtctctgaactctgaaatcttacttctgatcatctccgccacatgaggctgcacaaacatgtgtgtcgggtcaagcatgtgcaggatgaacttgtccgaagcgggcattgaagcattcagattaacaatgaactgtgccatcggtacatcgctgaaaaaaaggatttatgagttgattgtgcaaactagatagaggtgaagaaaaatgagctaaattttatcaattgtaaaaggagcttaccaggagatgaacaacccctttattgcattaaccatgttttctgctctttggagaacagaatgccacctgatcatttaatcagcaaaccacacagccatgtcagtggaaaatcagaagtactggaaaccttccccaacaatcagactctaaaacagtgatgcagtgatcttttaaagcacggtaaaagattgcaagtgaggagataccgagatagtggagatagagaccttactgccttctaacaaggataattatgagatcatataatgacaagcacccaacctataacttatgcttaaattgcttactgctaccactcaggtacataatagcaaggtgtgagctatgcttgaagaggcaataagttcaaagcaatactactggaagttgggtaactaacagaaatatgcaaaacactggagtggacagtgatttgtgctcccgtgccaatgatacttgcgatacaaacacagaaagtgaaccagcagtatctttcttatcttttctgtgcaacacatgccctcactgtgtgtatacaatgagacgacgacaaatttattactccatcttaggtacaaagctacaaaattccattagttaaagaaacagttaacgctagcaaattagttttacaggacgatttagcacgttgcgattttcgacctcggggaactatctcaatagggcaggcgaaaaaaaatcaacaggctcaaattgcatattgattgttgagataaagtagggttgcatcgggcagggtaatccaatggaagaaatacaccacactggtcgtaaaccttgcaatatatttcacgagcaagcataaatcagtagctcagtacgaatcctccctagagatctagaagttcatcttacctttgtcgcctccctgtgctgttgtcttctctagcaccggtgcgtcgttgtacggagcgatacgagcaaaccggcgaggaacaaggagcctgcagcggcggcggcggcggcgcgcggctcagggcggaggatcggaggcggaggtcaggcatagggttccgaccaacctgctggtcttgtttggatgaatcgggccaaggttaccccgtctaaactaggcccagatgtaagtggcctttcggcccggcccaaactatcaaaaaatcttaacaagcaaaatgccatcaacaaacacaacatttaaaaaaatgctattctactagtcaacttattgctattagtattagggttccatccaatccccgccgttaaaatgtgatagggttaacagagtgacatggttggaatcataacggattaacggtgatagcatttctaggataagttggcgcatgataacattttctaaaagttgagttcgtcggtcgatggtattttttgaaatacggttcttgtaatggcaattcatggatttttctcaaaaattaatatagatgaattcaccctatgggccggtccacaccactgtgatgatgtttctgaatcccacccctttgggctcaaataatgacaagaacagtggccagagaagctgccgcaagttgggtgaatcatcctttcgtatttgtacaaactacagataatgctccaaagaactacagataatgatatgacatacttgtttgtcagaaaatgtttgctacgtggtagcacatacgctcttcgctatagtaggctgaaatgaattaggagtaagaaataaatggcaagcatctggggacgggcaaaagagagcttcaaatcatcagtcaagcggtcaaaacttcagtagatctgcattgatcgtcggctggttggctcggcttggaggtaaagtccgaaatccatcaagaagttggctcaagactcaagagtagtcagatggtcaagaatgaatctcttctccggcattctgcagtagtaccaacggtgccacccaaaaatcattctatgctgccacttgccgatacttcaaaagatgaagccatgaaagtaaagctcatttctgcggttgtggtttcccaactgaatgcagatatacggagacagaaacaaccctgaaaattatagcatgagctgattactatcatgggttacaggggctccaatcaagagaatatgttgttcacttcaataagcacttacgtagatccgaggaagaaagcaagggatagatggaagccaaacaaaaagacagatacaactgctgtaagaagcatggcaactgaagttgagtacacctgcattacagttatatgtcagacaaatgtctgatgaaaagatgcgtaaacattacagtgttatcaaaatattttcagcagacagtaattggtgtgtaaatcaagtcagtctttgaagctgcatcaataattatacaagaatcttcagttgacattttatgaaatttagttatacatgtgcctcacgtatcacaaggttttgaatccaaaagagaggcttgtgcattatagttatcttttttcaacaggatacaatcaaccatccaatgtcctgtttagaggcctggatgatctgttcactaaaatagctcctcagacaggtatggaatatggaatggcatagtttctcatatatcagaatgtagaaaatgtaagtataaagaataattcaccagacaggcatgcgcatggacacaacacaatagaagatgttgttaaggtgttattaaggaatacagagatgtataaaacaaaatgtgctttgaggtgtaatgtatagtagactgtaagcgattcaggtaaggcaaaacagccgtagtgttgaataaaatgtaagatgtatttcacagtccagaattacttaaactcgtaacaggacattcacaataggaagatgcaaaatatctctattgggcataatccgctgagaaaagaatatacaaatgcaacatggttgaattctaagaccatataaatgcaacatggttgaattctaaggccatacaaatgcaacatggttgaattctaagccagctttagaagttcagcatttgtaccttgacaatattgtcagcatatttcatcaccattgatacagcaatgccactgcaaagcaaaaaaaaagtaaaacaatacaatgtggtatataaacctcaaaagagagcagacaaaacaggatccagctattagtacctgagtgcatgattaagaatcatcaaaacagtaatgaatgagtagccatgaaaaaaacctctgcattagattgcacaatcaagttaaaatggctgatagaatgaaacatatcaaaatattagcatgagtagatagattttgtcagaacaaacttattcatgacagcatcgaagtcctgaacacaaattgcaactaaattgaagagcattccaaaaatgtacagccaaaaattctgcacattgatgtttcttgaaggacgtttcttgatgattgcctgcattggtcaaacacgaacaatccacatcaaataaatcttcgtaaagtcaggtaaatataaaaggggcaaataacagtgtagtaaagtcacttacttctgtgtatacccccgcaaaaccacttagaagagccatcacctgcagaagaaagcacttccattaattccattggtggagtaaaaaacacatcgtgtaacatttgtaaataactgactgattatttccaatcctagtgactcacaattgccatcacccaaccttgaataggggtttgcagaacatgatctgacctggaaaataacaaattattttagtaattgaccatgatgttttgaagaaatatgaatattgttaagaatgaacacagacgaatcataacatattttgcttacgaggggttcagctgggctgtagtgcaaccggcacataaaagaataaatgcagcccactgaatttcacttaacctggaaagaacacaatacattcagcacatcgtgaagaggaaattgaagtaatttagattttaaagcacatcgtgattatgaaggtcaggtaagaaggctaagtaaactaccggaacatttagcatgccaaaataaaatgttctaagtaatattaatatctcaccacatctgctaaacacaaaacagcacaaagaaatcaagcagtttttttatgatatgtttgtgtggctctacttacaatgatgaaatttatagtgtgcaattgaactttagtacatgacttttgtgatataaatatagcacctttctggcagatttatatccagctatatattcccaacttcaaggttgatgttgataaagaataatgcaacattttccagttggtgagcaggtaaattaacattttttttcagagttgccgatatgttaggttataaccttgaatattctggagagtggaaagcttactttttctttagaatgatgcggtataacacacccgtgctaataatgttcaggttcttcaggatttgataagctggtgcatccacatatgcaaagatgtaatactgacaggtagcaggaagtggagaaatgtatcaaacactttctattgtgaacagaaaaatacttttagcatgaaagaactggacaactgaacatacctgcagtaaattctttaccatgtaaagtatggcaggaataggataaacactaacttcatcaaacgatgtacttaacctgaaaacttgacaacaaattgctaaagagtaggataaagacaacaaacactagcatgaaattaaacagcagcttatgatagaatcatcacctattatcttctgtaacaccctgactgttccatgttctgtacagggctatgagagataacagacattttaaagcttccacctatacatatatacaaaggaatacattcttataccaatagaaacaaaagaatggtcctggaggttggaggtactgtcaccagtcaccaagcggaatttgtgaaattttcctcaccgaaaaatttgccgtagtgacactatattcatattttccagctcttttcgaccacacaattagtattgcctgagaacttgttagtaatgtcaatgcaagtgtaacaatggacctgccacaacgcattactaataaatcaattgattttcacaagtatgctatttgatgacaaagattgcaataattaagtcttactttaacttccaactattcttgccctttgaagctcctgctgtgctaagactggaggttgctgaagctgtaaatggtaagatcataaggatattggagtcctggttatggatatcaaaagaaaaagtttctatgaggaatcgacaacttactgctagaaagagacctctcaccagggctttctatgtctttctgagatacaacatcatagctctcctttagacagtacagcagatacataacttgttagcaaacagaacaacagctgaagtacaagcttaattgcaatgctcatgactccaaacatatatggttgaatatatttgccagattgatgattatcagcacctgcttgccaaacatcaacagaactaaaaagaccaggcaaatttaagtcgaatttcaagtttaaaccacagagcatctgccaggtttggccactgacaggtgattgaaagcaccaccagtttcccaaatcacaatcaccaaacttgccgttatctatatcttcagtttactatttacaatacaggaattaagcattggtcactttactacttactacttcctccgtcccataatataagggattttgagtttttgcttatactgtttgatcactcgtattattaaaaaaatttgtgcaaatataaaaaacgaaaagttgtgattaaagtactttggataataaaataagtcacaaaaaataaataataatttcaaaaacttttgaataagacgagtggccaaacagcgcaaacaaaaactcaaaatcccttatattatgggacggagggagtaccagtaatcagataaattgtcttaaatctaaaaatgcggttgaatgaccgctacattgttaataacaatatgaactagtagtcactatcctgtttcatttgctacatttttttcagagttcaaaacgattggattacaaaagccaccgtctcactgacatcaagagccgcaaaacgcccgaaaatccggaaattctagaaccctaagtgaggaacagaaaagggccagcgaaaatcgcaaaaagggaacacccgttgcagcgatctaatctggaggcgcggacgcatcagcgcgagtggcattcctctctctctctctccattagggttgggcgggacttggggttggtgcttacctggtccttcactctcctgtactccatctcttcctctcgactccccacctcgtccccgccgccgacgccgctgccgtcgccgccgctgcgggttgcttccacggggaggaaggaatcggcgggaggcggagccggtgacgtgacggaggctgaaaggtgggccctcctgcgcgagcagagagcagtaaaggagcacgcggcgaggccgcgagggtggcgactggcgagtgagggaaaggagcacggcgtggctgaggagagaggtagcagatgggacccacaagaggtactttttttcacataagcccctgttgtatataatttatttacgtaaatcccattttgcttgtaagatgatgataaaattccttcagctcttgatcttgggccttgaggtgaaggagaaagaaaaagcttgtgttagaccttaagcataagatactccctccttccctaaatatttgccgtcgttgacttttttaaacatgtttgaccattcgtcttattcaaaaacttttgtgaaatatgcaaaactatatgtatacataaaagtatatttaacaataaatcaaatgataggaaaagaattaataattacttaaattttttgaataagacgaacggccaaacatgtttaaaaaagttaatagcgttaaatattttgggatggagggagtatatattaagttaatacaagtgtaatcattgttttaaggttacatttttcatatacgtggctgttctaatggtagcggtactgctgtttctcacataatctcctgttttgggttgaaaaaattggtagagatccaaatatgttacaaatcagtccttgatccggtcgggggtttcggctccacggctgcgctctgttcgctgacaccgacggccgctgctcgtatcatcgtctgatttgcaccttctcttgcatgcaaaaatttcgggctgctattgataattgagtattagaggctgctgaaacatatgttatctttgtctgcgctccaatggaattcatagtatgtaattgtaagctctatcctgtcgtttgagttgaagaaaagttttttgacatgttatatgcagtagtcatgttccatgtttctttgtgattattgccctgttaagatcccactctaaaattttacacattgtcacatcgaacgtttgaacacctgcgtgaattattaaatatagtctaaaaaataattaaatgcatatattgcgactaatttgcgagacgaatcttttaagcttaatttctccatgatttaacaatatggtgctacagtaaaacatttgctaatgacgaattaattaggcttaataaatttgtcttgcggtttactaacggattctacaattagtttttttattagtatccgaacatcccatgcaacaccctatataatatccgatgtgacacgtcagaaactttacactcatggatctaaacatcctctatggggctttttctacctatgaggcctcatatctacatcttgctgatttattggaaatttcttactgtcatttttatattaaatgctggatcatgaatatgatcacttcgatgaatcctttgtgacagtttcatttcttttcagtctcttcatggcatcacttgtagcaacactcgcatttctgttgtatgaatatgattgttgccttgttaagagagagtactagttgtaaacatcgttgccggctaggggtgaaaacggtatgaaaatttcccaaccatatcgatatagtttccacaaaactaatataataataacatttttaccaatggttaccgtttttaaaatttagtttttttaatttctatcagcgtggcattgaagttggcactaaatagataaattcataaatatgaaaatttcccgaccgtttccgttcgttttcgagaaaataataaaataatgataccatttctgaccgttttcattcctagctgccgcggaataccagcaagcaacaaagcaacaattccgtgatgggaggagcgatgtgggtgagtagagcagtagagatccagcaaggcagcaatcactcaaactcgagaaaatggacatttggccatgttcaaaaagtagttttgctgaaatgctatcccaaaaacacatttcgctagcatttatgagagatgatgg

SEQ ID NO: 65594 - DNA, 3739 bp, Oryza sativa
agcatgtaagcaaagtccacctgagatggtttatctttttcaacacagtacatagaaaaaaaaagaacattctgtctaatatataaggtataatagtgtataaactaaaaagacaacagataagagtaacataaagcataaataggtgtgttttgggggggaaaataagacaggctcctgttccactactccacactattgtgatctggatatggttcaagagtactggcaaagtgatgtttacaggccttgctggcaaaagtgtgcacatcatgtgcatgctatagaattatagttcttgttgctaacactaaactggatacacaaaaatatcagctaggctacaaaataaatggtataaatttgttggacccaaactacagaactgggtaatcaaccccctcaactctcaacgcctccctggcttccattcccatgaaaaattgagagcatctagttgtgtggctatgcattgctaaatctgatcattgcgcaacaccaggataggtgatagggtgtggtcgtgtgggttcaggacatcaggtcatcaggtcgcgcttaacttgaggaacttctgggtgaggttatagacagcactcttgtgaatccatcctacatcagctagccatggtttctcagttacggagtaggtcttccctaaaaaaaacagcaacagtatgtttgaacccaagagtgttttccttttcccaaactaaacacaccaagatgactgaatacatgccattcagtaataacttaaatagttagttgcggaacaatagctcagcaaatgtgatttgcctaaaattttatgccaaataacatttgcgactaaaaactgtacataaattttcttgtttacttgccttgacagtggttgagtattgcacaatgagctttgtatcatcagaatgatccttattcatgtggctctgcatggaattaaaatttaacataattacactaacgattggcatatctacggtgatgccccttattgatggaaaaaggaaacagaatgtggacacaccgtaataggggttgagaattgagatattgggtccacttttgcctccttgaactcagcagcactgaattctggggatgtttcacaatagcattaaaatcaggcaccattatcatcaaaccatttgtcatggtttctattcttgtacaaatactagaagtggaaacacaatagaggagcatggctactcagcattcacaaataaatgagcaaataaaaggttgattagatatcgaaccctgaaacctggttcttataaaggataaccttcacttttcaaacagtggctcaactagggcaatgaagaaggcaacatacctccagaaccaaggatggcagttgcaaccccagacacatatcgcacggcttttggcttgatgtgcagaaaacggaagtcaccaaaatcaaccttatttggcattttttttcatcagaaatcagtacttcataaaacaacatgtgcttccaaaataataaaattgtccacatagcatacccaaaatgcctcaggatgtcttcgtaagtatgcacttcgtactgcatctttttcttggtctgaaacctttcaaacataatacaaagaccaacagatctatatttgttacgtaacatgaacaatatgatataggaaagtgtcatacagaaaagaatcaagggtataggcaggccagtatctggagcattacaggtgtggcatcaccatatacagtaatcacagtatctgttctgtcctcagggtctttggcaaccagaagcgagcatttaggattttcagagagattctgcaaaaaaaaaaaaaagtatcagaatccaagaagcttgcatcaaaggaaaaacatgacaatgaaaaattttccagctggactggtggtgaatgtagagttgcagtactattttcatatcactgctagtggtcatgcattttacatctgtatgcatatttagttatttactttgcatgtccaaacatctatgccaatgtagtaatagcgttattgtgtgtatgtacagggatatccatgcatgggaaacagtgagtatatagttttatcatgtattcaagatcataaaagcgaattatatcttacctttgagtgaattgctaaactactaactgctaatatgggggaaccatcctgatcacatgcaaaatcaaccattgaaccagacggatagccaacatgaccctgtaacaaaatagcatgttattccatgctcttgaggattgccctgtacatggcaatacaaccactactcattagtctacagaatacctgagaatgggtggcaaggacacccctaacactttggtccagaatggtccgtatttcttcaaccggaggaagtcgagcagctttttcctacgataacaaaaatcttgtttgagtatggaccatcgagaaatgataatgataaaaactaaaagatagatcattgaagttgaaggtttcccttctgacagttccacacttgttccgcaagttgattgctcagactcttgcaggaattgacaagggaaaggtttgcaaaagctcagttggtggtgttgtggctagtaaacaattggttctctgtaggtctaattcttgttatggaaacttcttcatgtaattgttaattattgatgcgatgcctacttgttgcaacattaatttgttgaaacattcacacacagcagagtagcagacagcctccaaccctgtttcacaataccataactaatccttcctgggaatatatttgacgtttgacttcttaaaaagaaactgactgtattacatttgtacatttaccaggcacgttgtcctaaatttgtggaatctccgggacactactgacccagaacaagtcaatttgtgttttttgtatgttgcatataggggtgaaaacggtcacagaaattaccgatcgaccgggcgccgtttccgtttaagggtactgtttccgaccgtaccgtttttggctatttttaaattttattttttcctaatttctttctgcatcatattaatgtcgatactgtgtagtttaaatgataaatatggtcaattacccggccgatcaagcatcgtttccgaagagatgctagcgattccaaccgtttccaatcgttttcacccctagttgcataagctactgcctggttaggttcctcgctcctcggggacatcacaaacaaggagtgaggtgtccaaggaataaaagggcgatcacgatgctaagggcgcacctggtgagcgcggatcacctcgaacgcgtccgcggatccgcccggtgcatcggcaggcgccgccatctgcaacgcagggaaaaagcggcatcagccagagtcacagccatattcacctcgggggcattccgtcgaacacctggtccgcaaccacccccacaagacaggccaaacaagagctggggcgcgcaagccagacctgagaggaggaggaggaggaggaggcgatgaggcggccgccgcggaaaccgtcgcgaggaggacggaggagagggggcaataggcggttggaggaggaggaggcgtgcgcatggtggcgaccgctttgtttgcggagcatccgcgagagcgttgacggcgccgcggtcgctagccgcgcggccggcgtgagcagcaagggctttttctgcgttcgcgtgcacgcgtttctctatcctatgccatcaatccaggcgttgcctgccccctgctggcgtgcgtgc

SEQ ID NO: 65595 - DNA, 2685 bp, Oryza sativa
caggatgaaggcgctcgcggtcgccgccatcgccgcgtccctcgtcgcgtcagcggcagccgaccacgcgccggcaccggcgcccgtctccgacgccgcccccgcggtgcccctcgcggccgcctccctcgcagccgccgcgttcggctacctcttctgctagatcgatccccttcgatctgcctcgggctgatccgtttcgtcgtcgtcgtgtgcgtgtctccgtcgtcgtgtggtcgtcgcgtgggggggatttgtgtatgtaattaatgagtcggcggtggtgtgagggagggagggtgtggtttcgcgccatttctctgtggcggcggccatgtacttactcttcttttttttttatttgtatgaattgagatgatttatttgattcttttcagtttaaagaacatgagtatcgcgtactacatggtgacacttgtatgatgttgattgtcatctattggcctatcgtttaaaatatatcatacgggaactaacgagagattaacaattcagaccataaatataaaatctctcctgcacaaacgttcaccactccaaactgtgctatgttaatgaacgacagggtagtacaatcatcttcaagattgtaattacctcgtagttacgattaaaaaaaacagtagcatacaatgttcagtgctccaatttgtgctctgaatgaccaaagaactccaatttgtggtcatagcgctccaatttgtgttctgaatgaccaaagagtagcgagtggcagtaaggctggacgcaaattattgcattcaaagtttcaaactgcgagctgttaaatcgtaatgctggcctggagagatgttcgtgattcggtgatggatccaaaggccgaaatcattgaagcatgtttgcccatgtgcatcttgttgagtagtggtccacatatgagttgtcttagtggtagcgcagctgtaccggctaccaactgtacgattccatggtaaacacagtttaacttcgttgatttttttttacttagcctaactgttctctaggcttaatgcatcgtgcacagtaaaaaaaggaactgttgttgcagatatggccatgcaaaaggccaaacaaagattcagactcctcatctttcacgagtacagttaaatgctcgagagttttgcagctgtatgcaattgcgagctagtaccgccgtaaagcacgggcgaccagtaacgtttttcagtgacaagtgatttttatacgtgtcgacggctaaccgcaatgaagatggcagcggcagaaccggggcggctggccgacctgcccgggaattgcagtgtgttctgtttctcggtaaaatttctgaagagcctagtactggcgtgatgtagctgaactctgaagattgatggtaacttctaatgtggttctttgaagctagccgaatgggtcaggttcactgcaattgaccgtaccgtacaggcaagtaggcaacgtgtggcgtactggcgtggaaccgtggatggttcattgaaccacagccagcgctgcttttccgtcgggtcatcgcctcttctgaattttcccgtcttcctcgtaggctcgtggcatctaccctataattcaccaacccattttactcatctctcatcttacactctaacattcttacgccttacagatccaacagctcatatttatctgcattgaatccaacggccccacgacgctcgcaccccctccgtcgctcccccaagagcgcgcccctcccgcacccccaaatcacgctcgctcccctaccgcccatcgcacccatcccctccgcgcatcccggccctaaccgccgcacccatcactcccctcaccatcgccggctgtctccctttccaaccttgccggccgccgattcccctaaccgtcaccatcgcgccgccaccgatctggagtcgcctgggtcattgtcgcccccaagccgcataggcacgacccggcgtggtccttgtcgccagcgtcgccaccaatctccgcctcgtcccctgcctcgccggtcttctccgagaacccacgacctcgcgtccgctgtctcctctgtcgctagatcgctatcctcttacgtaccacccgcctctccggctccggttcgctgcgagtgccgtggcctatccccccactccgccgcatatcgcgtcggccgggaagaagggggagtagtcgtgttgcagttgtcggcccctggcacgagcgcaaatgatttagtcggcgtgcgatggtggtggtctgacaagttcagccgaccgatgcatccactgggagcccaagccgacactgaagaagaagccctctgccgttggccgtcggtagtgccggcattgtccagccacttgtggctgcgccggacgtccacacagggacgctgagccatccatacaggagcagacgtggacgcactgacggtggcagtttgacaggctcagcctatttgacgcatggggctctcatctctatggtgtaggtaatgtgaatcaacattcaaaagtactatgtgctcatttggtaaaggagatgctcgagaatagtaaggccccgtttaattccctaaaagtttttccaaaagcatcacatcgaatctttgtacgcatgtatgtagtattaaatatagattaaaagaaaaactaattgcacagttaagggggaaatcgtgagacgaatcttttg

SEQ ID NO: 65596 - DNA, 9138 bp, Oryza sativa
catgcgagttatgaaattagttttttcattcgtgtccgaaaactccttccgacatccggtcaaacaaccgatgtgacactcaaaaattttcatttcacgaactaaacatgccctaactgattcctttatattaacaagttctcacttcctttttaatatattaatgattttaccacctctttttaaatatattatattatgtgttgtgcaatgcagaagtatatttataaatgagtaacccgaaacacttgcaaaaatactctatctgagttgctgttgttgtcacttgaagaaaacaatgagttcttttagagagaagaaatatattcatgtggttatttgagcagtcggtacagtattttgaagatgaatgatgacttgtttcatatcatgacatgaacaactgattggtttgtgaaacaatgttacgcattgctggtttatttggtctgaatgtaccagttccaattggttgtagcttgcgaattcattttctttttcttaccatgcttatataggcaacaagtttcctctatgcagtgcgcatgaagggttgtagctgctggactataccatgatgataatctgaagggaaaagaaagagccaagggatgttacgtgtttgaattagaggtaaataaaccacttaaaatgctagatatacatatgctgacctgttaattttatgatgaaggttgacaatatatttgtttgcaccaataaaaattacaacagttgatcatctttggatagtggtcaggattggcacatgaatttagttctcatcttttcatactacaattattttggttcaacatatagtgctgctttgattctgagaaataacatcttctctaattaagtggaacattctatttaacagggaacactcattggctttatcatttaaaagcattttgcaaggcatgttcttctcaattgataaaagtgagcagtgcaaatattttggttgagtccctcgcgccgccaaggatcctgtgccatctgctccattgcaccgccaccggaaccctctccaccgtgctgcgaacaaggaaatcattgcttgattccgttccttcaaccattacagttcaaatgcaaaattatgaaattagtggatgtgattgtgaatgatagtgtcacgtctcttatgtatgtgcatcccaatatcaatggctattatgcatctcttcgaaagttactgaaatagagagaaattataaaataaaaatgaatatatacttgctgtttaattttcctccctcgcactatagcatacactactcagaaaattgaaaataaaaatgaatgccaagttattgtttcacactgattttagactcaatctatatgtttctctaactcaagtgattattttctggataacctgggagaaaacaatttattatgtgaatgtgtgtgagaaaattattgtctgcatatttttctctaatttagatagcaggcctaatcttttctcaagctaggataaggcctgagtcaggaaatgactgatgatggggcaccatgaaggatttgtcgccatgttcttcctctccgtccacggccgcaagctctccgaccaagtcactggaacccctatttgtagggttgtttaaatgagttgcttccatgttcttcttcagtagcatataatcatttccaagggcaacaattcgatggcggcagattttaaatgaaccaactgcatataaacccaagtttgcattgctttctgtattgtacatatttgatatttgatagccgctgcatataaacgctgcatctgaccacctgacataaagctagctggagatgaccatgattcatccgtagctttgcacattagtttgcacctaacattgtctttagtgtgatgcagctgtcagaatcgtcaacaccaacgggacgagcatgatggatgaactcaggaagaccctggatagaagaggccctgggtaattgccatctttgctgcaaatgcatgctttagattctgctttgttcagagttcagcgatgtgatgcagttgtcggaagcatcaacaccagcaagatgagtgatgctaaagtgtttacttttgtttcgtttcctgtttgaatggcaatttcaatgaagcttgattatttattcttctatacatgcaaatggattgcattgtgtatagagtttgcaaatgttagcaagcaatatatattgtgggaaacatgcatttatacatggctatataattattaatatattaaaccattctttttattgtctgaaatcatatattagatttgtattattaaatatagccgtagcgttagcacggacaaattactagtatgttctggtttctaaaccttgcttagtaggcgcacagcccagtgaacccagcagagtgagacctgcaaagctatgggccgggccactaccaaatcaaatggttctcaacccaaacttgggctgctagaaggaaaactctcaagtcattgcctgttagtttttctttttggggatgctatataatgaaatgtcattcggacggaatgatataggagtaggttagttatcagatcatgacgtatctgaatatttgactcttctttgatctttgagatcagacttgttgccgataggttttctttttttgacgcgaacattagggaatgactcgaacccaggttgtttagcccaccatcttgtaaagccagctggaagaccccagctggaagacccctgagtgtttctccttttcttttctttttttttcttttttttgtctgaacgcttgcagatttcgctctttccaaatctgatatcaggaagataaaggctactgggtactgggtactgtgctactgataatctttatcgtagcttgcactgcagatctgcagtgcagctgattaacgagaaatacatgagatttatccccaacagattaagcagtttgcgctacaatttccccaaacatcttgcacgcgtacatgctgttcttgcactcaataaggatttttttttctctcattgcacttcttctgttaatgctagcaaagctaaagactcagttacatgctagtaactgattgtgcagctgcttcacttcacatgaactcgcccatcatggcgagcacctgcgccatcctgggcctctcctccggcgcctcggcggtgcacagcatgccgatcttgacccaccccatcgtctcatcctccccgccatcgccgccgccgccgccgttgccgtccccggcattgtcggcggtcaccacctccaggagcaccatcccgaagctgtacacgtcggactcctgcgtcgcgcgcgcgcccgcggcgccggcgccggacgccagctccggcgccgcgtacccgtgccagcctcctccgcccgccgccgccgccgcccggtccaggaacagccccggcgggcaccgcggcggctgcgggatggactgctggatgttggcggcgtagcgcatgaccccgcactcggagacgcacgccgcgccgtgctcgtccaggaggatgttggacggcttcacgttcgcgtgcaccagcgccggcctcgccgggaacgtgtggatgtagttcagcccctgcgccgcgccgaacaggatggccttcctcgccgcccagtccaggctcctcccgccgcggccgcctcctgcaacaaacaccagcaacaaatcaagaacacctctcgcatcgcgtcaatggcgaccgatcgagtcggcgcggcgccggcacgcaccgttgctgccgtgcaggagggactggaggctgccgttggggaggtagtcgtagacgagcagccgctcgccgttggagttgcagtagcccctgaggctgacgacgtggcggtggcggagccggccggcgagccgcatgtggcggtcgaacgccttgctccggccggggaactgcagcgcgctgaggcgcttgacggccaccacgatgccgtcctccagcaccgccttgtacgtgctcccggacacgcccttgccgagcacctccgccgacgccttgagcaggctctccagcctcagctcctcgccgccatcgaagcagacgagtccaccaccattgctcttctgccccttctcctcccgattcctcaccttgtcttcctcctcaaagctcagcgccgcatcggaagcacccttccatgaccggagcttccttctcatgtagacgaacatggctacagagatagccacagagatcaccatgagcgccgcgttgccaatgccggtcgccatgagcgccgtcacactgagcttactcaagcctccattactaccaccactactagcctcctccattgccgcactaggagattgtccgacactatctcctaacgcattgtaagcatgaacacatctcggaagaggcaggccacagaggccaagattcccgccaaaagacgagctcgggaacctggaaagatcgccggagatctccccatccagcatgttccgtgaaacattgaagctcctcaccatcgggacgctgagagctcgcaggtcgccatggaagccgttgtgctccgctctcagggtgaccagagaaggcagcgagacgcggaggcctccggtgagctggttgtgtgagacgagcaggtgcctcagcctcgggctggtggagttgtcgagaggagggagacgaccggacagcgagttcctcctgacggcgagcacgccgaggcgggcgagcccgaggaggggggccaagccgccgacgagcgaggcgttgtcgaggaacaccccgaccaccctgcccctgctgcacctcaccccgatccatgcgccggagcacgggtcgccgccgacccagctctccagcgcggcggcggctgggttgtaggatttgaaggagaggagcggagggagatcctggtggccgccattggcgacctcggcctctccgcgcacgcaccacgcggcgaggagcaggagcagcagcaagaaccagcagcaatggtgggaatctgccatcgttggcagctgctgtttgagagagagcagtggttgattgatccagtattcgagtgagtgagtttttatagcagaggtgaggaggagaaggagaagaagaaatgcgcggggaaagtaaagagatttttgaaaggcaacacgggtggaagtggtgacaagaagagagctccaaaaaggaaagctagagaggagagcggcgtgtgcagtggcagtgaggagagtgtgggcacgatcacacgacacgaggagaggaacaagcagatgaggcgaagcgaaagcgaacaaggcttggctgctttttctccatcgggggcacaaggaattttggacgcttttggtgaggcaactaaatgcgtgagctatactgaactgagcactgcgtgtatccgtgatggtcgcagtgagattgtgtatttgtgcggtaatgcgttttactttatggaaatgaccaaaaggaagagaaaggttgcaaggctcttggttccatagaggcgtcgatgctgttggtttcactggctgtgggagaaaaccgacagggaattgggttcaggggggatttgccaagtgccagcgcgaacagtggtcaagattccatcttgtgttcagctgctgcctcgtccatgggcaaagggagtggacattcgtgtctcttcacagcgtgcatgctgctccgggtcaagcagctgcgggtcagccaagccacgacacgaatgcacgactcactcgacccggcccacaggctacaagcttctcggtactgtgctgttcaagagctaagcactagtagtgcactactacattttcagatttcagaacaaacacaagtataacttcaggttttagatttcagaacaagcactactatatttttcagacttaaaagctaaagtttaacatttcagagcaaacacaattacaacttaagattttagatttcggaacaagtattactacattttcgtatttcaaagctaaagtttaaaatttcagaacaaacacaagtacaacttcagattttggatttcagaacaagccctactactgtattatcaaattgtagaacaaacacaagtacaacttcagatttgagatttcagaacaagcactactgcatttttagatttcagaactaaagtttaaaatttcaaaacaaacaagtacaacttcagattttagatttcagaacaagcactactatattatcagagaactaaagttcaatttttcagaacaaacacaagtacaacttcagatttgagattttggaacaagcactaccgcattttcaaatttcagaattaaagttcaaaaattcagaacaagcactagtgctaaagctcgaaaaattgtttttgacaatatactaagactgatttcagaacttaaatcagaactgagttctaaaaaccatttgcacttgagtttaaaaaataaattaagaatttcagttttcagaaggcaatatcagatttcaggacattgccaaaattcacatggacaacaacatcatatctagggatgaaaacggtcggaaatgatcggaaacaatatcattattttattgttttttcaaaaacgaacggaaatggttggaaaatttccatatttataaattcatttattaagtgtcaacttcaatgccacgctaacagaaatttaaaaaaaactaaatttagaaacagtaaccatcgtaaaagtattattattatattagttttgcggaaacggtatcggtatggtcggaaaatttccataccgttttcaccgttcgtatcttgataacttaacttcaggcacttgacagaagttaaaaagtttgactagagtactcctacagtcaatgcaactgctgtcattgtagtttccgtacttagggcaatactcaaaccttgaggacttaacttcaggcacttgaatttcagtatgttaaacttacattcaggagctgttcgttaaccggattatgtactgaactagtgcttagcttcagatctcaatgaaagaaaagtcaggaattgtgacccacgacttcatattcagaacttcgaattctcaaataacattgtgcatttacacgtgctcaattaaaatgaaaccgatattcatccatgagctatgatacggggttggcgttgcaagtgattgatcggattacccaggaggggtagcattggatggaagcgaggctcaggatcctctatcttcaaaggtacgtgcctttgtcacttacatgtggacccaataaaccatgggcccacttgtcagtgacaaaagcatggtgcatttgaaggtagaggatctgaatcaccatctagtccttttcactgctcaccttgaagtttctattgtctgtaacaactttgtatggctttgttacctgtatataagtatattccctagtgatcatctaggcgagttgcaaatgaactttttttttctacatcttccattttgtattataagtcatttttattttggtcaaagtcaaactactttaagttaaaaaaagtttttagataaatgtggtaatatttacgacatcaaattagttttattaatctatagttaaatatattttcataatatagtaatgggttaaaaatattactattttttcttataaactcagtcgtactttaaatcagtttgatgttggctgaagacaaaacgatttatagtataatcttttaaaacggagggagtactaatactagtactaggggagtaccaacgtggaaagcttttgcctgcgcgtttgaaaaaaaaaaaggttggtgcgacgggcggacggggccagcggcgtgctgtttcggcagcgcaacgggcgggcggggccatgggcccatgcgccgtgcaaagcgcgacggtatgcgcggttaacgaaaggccgatgcgtgtttttatccacgaacggagggagttggtatataagcagccaagcagggcgacggcacaccgcccacatccacacacacacccacgattccccacaaactcaccggccatgtcgacgacctcgccgagggcggaggaggacgcgaaggagacggtgaagccgatcttcatcacgctcaaggtgatggaccaggaagaccggaggatccgccacaccatcaggatggccgacaagctgcaggtggtcatggacatgtactacgccaaggcgcccgatgtcacctacggcacggggaccttcctcttcgacggcatacggctgaagggcgacatgacgccgatggggctcgagatggtggacggggacactgtcgatttcttcccggttatgatcggcggcggaggatttttccaatgcaatcttcttcccagttctcactagtagtctacgactgtcgccgccgagcgtcgtagactcgtagttagaattgttcatcctctgcgatttgccgatcgtcgtagtttgcaatttgcagtgttttatttcctcatggcagcagcaatcgatgttaacattgaatcagttgttctgggatgattaattatggcaacagtagttgatcttggcaagtcactagcgtcatttaatccactcaattgccatgcaatgcatccgctgatccgccatagcctataggaaaccccttcgatgatatcaccgtgcaattactgcggcaacatcaaggttcagttctgagattacgcatatcgccagttaattaaaatcatgctcttacattggcatcatatattcatatatgctgattgaacagcaaaggaagagaaatattatgaatatggatcacgttgtattgagtcctcaggagttggtaactcggtatatatatagcaaattacaaggataaagataaggataacttcgagatacaaatcaatcctatcctagctaatggagtactatctctagttagaacttaacaatatactacataagagtacgtagggtgaaatccatggcaacgcaactactcagatagctacgcaagtacacctaccagatgctaaaacaccggaggcgatgtacggctggtctggcatcccagcggcggtgaaggtggagaaggagaacgaatggaagacgccggcgacttgggaatggaaggcgccggcgaccagggtggccggggaatacgtcacgctgaaggtgcagggcaccgacggccgcggggctgcagga

SEQ ID NO: 65597 - DNA, 2269 bp, Oryza sativa
ttactaacaatcatctcaaccgtttaatttagatagatagaagttataaaaaatctagatacacttactggtggagaaaccatctttgatcggtcgaccaaattccacaatagtctcggttctatttaaaaccgggactaaaaacgattttttagtcccggttaaaaaaagtctcggttccatttaaaatcgggacccggttaaaaaagttttgatctttaggccctaaagataatttttagtcccggtttatcccctgtcagggggccgatgatatttagtcccggttcataataccaaccgggactaaagattaccactttagtctacatcctagttgctagtaccaaccggaagtgggagtaaaattcgcaaccacttcctcacccacagatcgatccttccctcttctcctcctcccccctctcctatcttacacagatcctcccctttctccttcccctccccttcctcctccctcacctggagatagatcttacacagatcctcccattcctccttccttcccctccccttcctcttccctcacctggagatggagaaggccgcgccgcgcggacgcggtagacggacgcgcagtgtgcggcgcagacgtgtgttgcaggggaagcacatgcgcgcagtagtaatggtagcggtagccggcagtagtgggattgatatttcgtgattgatttcttgagtagtagcagtagtagcggttgtgggattgttgcaagggaagcacatgcgcgcagtagtaacggtagcagcagccagcagtagtgggattgatattttgtgattgatttcttgagaagtagcagtagtagcggttgtgggattgatttcttgagtagtaggattgatttcttgagtggttgtgggattgatttcttgagtagtagcactagtagcggcatccggcagcttgttttctctctctttatatttttttgatattttgtgattcactaagatgtataattttgtgattcattgtatagatttaagatgtataatctgtgttgtatttgatttatgtgtaaattttttaggatttgtgatgtattatatttgtgtgtataagtaactttaagatttgtgatgtggatttaggatgttactttgatttggggatttggggtttgatttaggatgtgcatgccatccgattcgggagaaaataaaaaagtaacaaaaaaaaaaggggaccatccgggactgtctctatcctctctttagtttcggttggtaacaccaaccgggactaaagatccctctctttagtaggactaaagattgatctttactctcggttatttcacccgggactaaagatagcgatcttcagtccctagcactaaagattgatatttactctcggttatttcactcgggactaaatatagcgatctttagtcctggatttgtagttccggtcaaccgggactacagggggtttacaaaccgggagtgacagtttctccaccagtgactcatagcatgacacatcagtgttagtaagaatttagtacgtatagacttttcctttaggtatatagtccctactatcattatcattatcatctgaataattatgccagtaattcgctctagtccaaaccatatctcgaactaataagttcgtattttgaaaatcgaaacccgaaattctgaacgtacaactccaatttcacttatgcacatacttgataactgaaggtagagaaaatctatactaatataaaaggtacaagttcatccagcaatcctacaatccttcggatccacttttgtttctgagccattgatctgcgagatcctacgaacgatattcctttcacgatcctcccacgcgcgacccttccctcttcctcagcgagaaaaaaccgctcctcctcctcttctccgcgtccccaccacgtgctccacctccggggccccactctcttcgttgcgcccccaccacgccccgcgtccgcgcctcccctgcctcctcaactcctcgtcatcgtcggttcccctgtgtgcctccctcgccgccgccgccgccgggggcggttccctactctgcctcccccaccacgcctcccacatcgcgccgcccccatcgccgcgcccccacaacgcctccaccgtcggcacccccatcgcgacacccctgagctctgcatcgccgccgaccgccgctcctgctcgccctcatctacgacgccgccgtcactaccctctcttcgctgcgctgcctccctccccggcgtcccca

SEQ ID NO: 65598 - DNA, 10774 bp, Oryza sativa
  unsure (1)..(10774): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccggctgccacgcttcggtccgaagcctcggtccaaggtcctggacattgtgcttccgctggccaccgcatttctcgtcgctgcggtgctagctgccgtcttcttcgtcgtgcggcggcggcgccgcttcgccgaggtgcgggaagattgggaggatgagtttggtccgcaccggttcgcatacaaggatttgttccgcgcgacggatgggttcaaggatagaaatttgctgggtgttggagggtttgggagagtttacagaggggtgctaccggagtccaatttggagattgcggtgaagagggtttcacatgattcaaggcaaggtataagggagttcgtcgcggaagtggtgagcattggccgacttcgacatcggaatctcgtgcagttactaggctattgccgccgcaagaatgaactcctgttggtgtacgattacatggcgaatggtagtcttgacaagtacttgcatgagagaaatgttacaactctattttggcccgagcggctctggatcatcaaaggcgtcgcatcaggtttgttgtacctacacgaggattgggagcaagtagtcatccatcgagacataaaagcgagcaacgtgctcttagacagtgcaatgaacgggcggctaggtgattttggcctggcaaggctgtacgaccatggcaccgaccccaaaacaacacatgtggttggcaccatgggctacctagcaccagagctcgtccgtacagggaaggcgtcacccttaaccgacgtgttcgcattcggggtgttcttattggaggtgacatgcgggcggaggccgatcgagaccgacgagcacaacaaacgggtggtgctagtcgacttggtgcttgagcaccaccgcaatggctcgatcgttggtgcggcggatccacggctcacggggaagttcgatgtggaggaggtggccctcgttctgaagctgggtttgttgtgttcgcacccgctacccggtgcgaggcccagcatgcggaatgtcatgcaatacctggagcgtggcggtaagtcggctcctgacctatcgccgagctacgtgagctatagcatgatggcgataatgcaaaacgaagggttcgattcattcatcatgtcgggcggcccccggtcggcgacaagcattggcaccgtgtctggtgcatcatctatgactattatgtcggagggaagataaaattcagtgcttgcaataagtcttttgattcctactgactcaagttcttaagtgactttctttcttgttccttgaaatgacaagcatttgaaagaggagatagtagtgtgttaagttacctaccaaattcacagtaggcatttatgtttacactacctattagctatgcttcctcgagcatcttaagatagttgggtagaatggtgagttgcttggctgcttcaaaatttctctgtgaactaactctgcagcctgcttgctttgttcaagaatatggcaacttgttctgggtttatcaacaccagttgcttggaaccaggttattcatttatgcaataaccaaacattctctaaccatcaagatgttatgaaatggaaatttgataacaagaatttaaatgttcgataaagctagaatatgtgtacatttctaaggttgtgtttgatacttggggttgggaacccaactccaccacacgaaaaatagagcggtccattagcgcgtgattaattaaatattagctatttattttttccaaaaaggattaatttgatttttttaaaagcaactttcgtatataaatttttttaaaaaaaacacaccatttagcagtttgaaaagcgtgcgtgcggaaaacgaggcagaggggttagaaaccccctcatccgaacgcagcctaagcatataatggatagatatttctcaggtatacaaggagaaccagagattctggcctactaggtactacaaaacagatattgtagttacagcttacaagctagagactgagggtgtgttgtgatggatgataatggatacaaaatgtatattcatagctctatgatatatactaccaacttaaaagtgtgatgaattttttcttcatctccgtagtggttccggtttagggaaaattggttatatagcatcgaaagtttacatttttggttttatagcaccaaaagataccggttcactttaatagcacccaaaattcattccgttcccatttttaacacttccgtcaattctcgaccgtttttcgttcgccttgatcgctattgacctagccacacacgtgatataacgtatctacccctcacaagtacaagtagaatgcatgtcaatgagggtagaaacatcatatcgtgtgcgtgactgggtcaatagcgatcaaggcggacagaaaacgatcgagaattgacggaagtgttaaaaatgggaactgggtgaactttgagtgctattaaagtgaaccagtatctttgattcttcaagaatgtccttacggatataatgttcattgtttagcccaccaaaaccaacctgacggcctgttgcggcatcaagagaagtgtattagatctagtctttcaatatttaaccttctttatcaatgtggttatttcctcttccaagcgtaacgacgcgctacaagaagaacacgttgcagaaaattgcataccttctttaaattgaagagcttggtgctataaaacaaaaaacgtgaacttttgatgctatataaccaattttgcctttagcttatgctcgattgagatcggtcgtgtcctcgatccccagttagaactacatttacttattattaatatttgatatatttctaaatattgtgtgaaataactcatattaaagttatatatataattgagtataatatgacttatttatattaggcatgattattttaaaaattttagggccccatcgaactagtccactgcctgtgtacatttctgagcgtacaaattatcgaacaaataatataaccccggcagctggtgggctctccactacctgttctaccgcagcaccggccggcaatctggcatcctctcaagcgaatgattatacgaacacgtcaaacaaactcaaaaatctcctggattcatttataagatactacaccataaagctccatcaagcaaagctaaacggcatcataaattacaaggccagcatcgtatgaaacgcaatccaaatcccaagatttaagaaacagattgttggacagaaagaggttgaggatacagacgaatgctagagacagttatccatgaaagagcgccatttggatctttgtagtaagcagcaggccgtccaatatacgatacccagtacctttcactacatggcaatacacgaaacaatgtaaaaatacacttgtatttatacaaaaccatatttatcatcagtctagtacatgtccaccaatcagggggtgcagctccgattagcggctcaagctaaggcagccatggcaaccaagaacggtggttttgttgcgttgctgctgctgctgtcgttcttgctgagctcgccgctgccggcgcgatgcgacgcgccgctccccgtcaatgtctggcccaagccgacgtccatgtcgtgggcggagccccacatggccgtgcgtgtctcgagctcgttccacgtcgtcgccccgtccgggaacgcgcacctcctctcggcggcgcggcgctacgccgcgctgctcctcgccgagcggtaccggcccctcgtgacgccggcggtgaacgtcaccgcgggcggcgccggcgccggcgcggcgggaaggggagccgagctggggtacctgacgctcgccgtgtccgacctgcacgcgccgctgcagcacggcgtggacgagtcgtacgcgctggagatcctccccgccggcgcggcggccacggtgaccgcggccacggcgtggggcgccatgcgcggcctcgagacgttctcgcagctggcgtggtggtgcgggcgggagcgggcggtgctggtggccgccggcgtgcgcgtcgaggaccggccgctgtacccgcaccgcgggctgatgctggacaccgggaggacgtacttccccgtcgccgacatcctccggacgatcgacgccatggcggcgaacaagatgaacgtgttccactggcacatcacggactcccagtcgttccccctcgagctcccctccgagccggcgctcgccgagaagggctcctacggcgacggcatgcgctacaccgtcgacgacgttaagctcattgtcgacttcgccatgaaccgcggcgtccgcgtcgtgccagagatagacacacccggtaagtactccatccctttcatatttcaagtcgctttaatttttctaaaatcaaatgtttcgaaagtttgatcaaacttgtcctatagaaaaatagcaatacttgtaacactaaattagtttcattatgtataactaacattgaacatattttgatagtttgtttgttttgtgttgaaaatatttctataaatttattaggcaacttaaagaagtttgaaaaaaaaattggctcggaagtaggaataaaccttctaattaagttctaggcccagtgctaatacggcccagttaatcccaatttaattacgaggcccaattactttctcactaatcgcttcaggccacacggcgtcgtgggccggagcttaccccgagctggtgtcctgcgccggcgagttctggctgcccgacgcgtctgactggcccagccgacttgccgccgagccgggcgccggccagctcaacccgctggagcccaagacgtaccaggtgatgtccaacgtcatcaacgacgtcacctccctcttcccggacggcttctaccacgccggcgccgacgaggtcacgccggggtgctggaacgccgacccgtccatccagcgctacctcgcccgcggcggcacgctcagccgcctctcgagaagttcgtcggcgcggcgcacccgctgatcgtgtcccggaaccggacggcggtgtactgggaggacgtgctgctggaccaggcggtgaacgtgaccgcgtcggcgatcccgccggagacgacgatcctgcagacgtggaacaacggcggcaacaacacgaggctgatcgtgcgcgccgggtaccgggccatcgtctcgtcggcgtcgttctactacctcgactgcggccacggcgacttcgccggcaacgactccgcctacgacgacccgaggagcgactacggcaccagcggcgggtcgtggtgcggaccgtacaagacgtggcagcgggtgtacgactacgacgtcgcgggcgggctcaccgccgaggaggccaggctggtggtcggcggggaggtggcgatgtggacggagcaggtggacgcggcggtgctcgacggcagggtgtggccgagggcgtcggcgatggcggaggcgctgtggtcgggcaaccgcgacgccaccggccggaagcgctacgccgaggcgaccgaccggctcaccgactggcggcaccggatggtggggcgaggggtccgcgcggagcccatccagccgctctggtgcaggaaccgcccgggaatgtgtaacttggtccggtgaaccacccggcaaccgacccgtatacgtgcgctcaactatcacagcaactgctaccatatcataacgatgtgttggagttggagaaactaaagtgtgagttctggatttttttttttggttggttttatttatttgtcattgtgcgagaggggagaatacttctgctactgctgctgctgctaccatttattttttttttattttgagtaatgtgaagtggacggcatgttatgttattgtgtaccttgaaagccggcttttatcttatcatggggccggttccgaatttccaacgcattggttgtactgttcgatttgattaaagtagtattatagaggagagtgttgatgcgagctagtagcctgaagaactctttgtgcttagaaggatctgttctatatctgtggctctgtgtcaagtgctcgcttttgcttgtggaaaaaactatcacttgactgctatctgttgatttgtcagtgatatctcgtgcggaaaaatggagctttcttggggtaacatgaatgagatgatcagaatgagatgcttttcatattggagtgtaactgcaaacgacacacccaggacacaatacggacaataggaatgctagcctctgcggcagaactggccatatttgcccacttgcttcttgctcatcgctgcattgccaatcagactatcttatttgacagtgactaggctaggttcttttcagatgttcccctagattttttgcacgcgttatttgctccacacttcttaaaaaaaatacaatttctcaaaaaactttcttctattacattgatgaaaccacccattctaaggtatttgcaaatcttatttctcaaaatattaatttatcatgttaatcaaataaataaccctcgttaataattaagggaaaaagctatcgctaacagtacctagagtttcgatatctagtgacggattgttgtgtttggatcctgcgctccacggccaccagaacatcatgtaattgtagcctgcctcgtcaaaattatcagcgtttagtcttgattcttgacaacatgattatcaacagttatttataagttgtgatgtctgaccaccaacttctagatggaacagacaacagagaattcttaaaggtttcatatattggctagcatggcctatttagtcccaaaaaatgatgccagtttttgggtttgggcgacctatgtgttgctgcctcctattttggattggtgcattggaaagcttacatccatgcgttccaaaaggacagacaagtgagaataaaacatccaaatcctacgattcagcccaaaactttagaaatgaaaaatttcgggaaaaaaggtcaatagccccactagtattagtaatattagaaatgaaatttcaagcatttcagtctttatctcaaaacaacttcttcgaaaagaaatccaggaatttcacagccaaaagaaaaacaaacggaccagagttacagctcaagagtcgagtcaatagccacaagcttgcaacaatcgtactgaggtgtcttagcagtgatgtactgatgtttaacacttcaacaacaatgattgaagtgagccaaagactagaacaacttcaaaacagcacataagagcaatgtcaataatatagtccgctgttggcttcaaaaaatagccaagtcatctacagtaagcagtatagctaatgtttataatagaaatactacaacacgatttttttattttttcgtgggacccaccatcttctcctacctcacactctctttctccctccttctcctggttctttttcgattctacgaaagacggcggcggagcgcgacgggcgtcggagacagcggcggcgcggcggaggcggaagacggcggcggccgctcaacgggcctcggagacagcggcggcggcgccgcgcggcggaggcggaagacggcggcggccgcgcgacgtgcgtcggagacagcggcggcggggccgcgcgacggacgacgaagacagcggtggccgggcggctcctgctccaagacgacgacggctcctagtggccgtcgtattggacaaggacaacatactccgacgatggctatggtgaacgaagtcgtggcgatgaggcttgctgccatggatgcggaaggaacgatgggcgtttgagcatgggcgggcccacactctcgggtcgcgcgtagagcccggcgactaattagtcgcccgcccattctctctccacttccctctctcctccagctcatcgcaaaatctgacatggagcacttgtcgccgattattgtacccgctctaatggttataaggctgcgttcgttcctccatcttcccaacctactcctcctcattttccgcgcgtacgcttcccaaactgttaaacggtacgctttttgcagaaaatttatacacgaaagttgcttttaaaaaatattaatctatttttcaaacaaaatagctaatacttcattaattatgcgctaatgagttgctccgttttacgtgcactgcacaccagttcccaaccactagtatcgaacacagcctaagggcatccacaatgtacactgaaagtaaccttagacattaaatactgctacagtacaacgcatttagcattgtggagtcagaccacaagtccgatgcaaccaaagtacaccttaagcttaaggtgtagcaacaaagctataaaatacaatacctttactgtttttctgtgcacaccaataaaatatacatgtcagttactaaacacagtaacgagtactactagccgttgctgctattccatttgagttgctcatttggtcccctagccgttgtcttcctccagcattcttctgctgcctacaaaaggaggaacaagtgagatgaacaacaatttttgatctattcagtttccccacatactaaatggagcctttcaaaggaaacttctcaaacctcctcaaccaaggttcctcaagccaagcaacaaatagtgaggcccaaaactccctttctacccaatttcccacaagttatccccaaaacttcagacctagttttctccaaaatttccatccttttggtcctccaagcaactaccaaccatatcgacaccctccaatctttcaaggtgtcagcaacaagaatattatgggcaacctactccaggaagcttggaaggttttcaacttcaagaaaatctggtgcactcatttaaccaagcatttggatttgcagccaatagatcacagtttggtatgcaatatagtacttcaattggggctacagccaacacttctttcatggatcagcttctccatgtcatacaagacataatgagaaagaagtagttgaggttgaagaggcaagtgatagcagtgaagaaggaagaagagggacacgcatcaattggactgaagatgacaatatacgactaatgagttcttggttgaacaattcagttgatcccatcaaaggcaatgacaagaaatcagaacaatattggaaggctgtagctagagagttcaacagcaatatgcctagtaatgggaacaaaaggaaccccaagcaatgcagaacacattgggacaatgtcaagagagatgtcactaagttctgtggattttattctaaagctagaactactttcacaagtgggtattctgatgatatgataatggagaaagcctgtgaatggtacaaaaagcacaacaaccaaaaacctttcaccttggagtatatgtggaaagatcttaaagatcaacctaaatggcgtagagtccttgaagagagtagccataataagaggaacaagatttctgaatcaggagcatatacttcatcgtcgaaccaagacacagaggaggaaacagagcgcaaagagaagcgccctgaggggcagaaggcagcaaaacagaggcaaaaaggaaaaggtgcaccatcacctttaggggataagccaagtcaaaatatggttctctttcacgaagctattacaactaaagcagcagcattgctaaaggcagcagaagcaacactgattggagcagaagcaaaaaaagagaaggcgattgcaaaaaaagagaaggcaagggcagaaaaataccaaatgtatttaaaactgatggagaaggatacatcaacctttagtgaagcaaaactgaagagacatgaaaatgtgttggaccaattagctagagaacttgctgaggaataaatgactagcaagcaatgttagcaattatgcttattttataatgtcagtattcttgtcatatattaaaattatgtactgtgttgatgcttgtactgtgaacctatttgtactgtactatgttatggtaatttgtataaatattgtgtattacagctatggaatgaaactacaatatccttagtacttgagaaatcaccttttcacatggatctagttggtgttgatggttttccttccatccatgaccaatctgttttttttctccacctgaatacatatgagcaataattaatagagaacaaaagcaagagggatgttgacaaaacctaggaaaatatagctgttgtaaaagactgacaaaagcaagagctagctgttaggatattgacaaaacccaggaaaatatagctgttgtaaaaatctgacaaatctagtcgttgtaaaatgtatcatctacaaataggtaatgtagttcagcagaacaacacccattctcattttgttcaacttcatctcaacagccttcccactttcaaaaaaaaaaatgtccagcaagtcaccacatcaatctagtgagtcagatgattctagctctagtgactaccttgaagagctgattttggaagaaatcaatgatcctatggaagctgagattgaagatgagattgaagctcaacttcaagctcaaatgcaagcacaacaagctggtcattctaatcgtcgtgggggctacaaacgaaggtacatcaatagagatcaccaagacgaccaca

SEQ ID NO: 65599 - DNA, 6148 bp, Oryza sativa
tattcttattagtaactgagactctttactttttcatgcactaagagtaatgtaccagtaccattgccttaattagtcaagcacaagtcatattgaaaatatcatgtttttttgtcatttttttttaatttcagatctgttggagcacaactaaacactatgaaaattccatcgggatcgaaatcaacgattcacatgatgcatacgtacaaacagaaaaagaatctgtagtagcagcacttgcacatatttgatgacaaatttaatcgtagcagcagcagcacttgcacaaacagatataaatttaatcaccgggcaaaccaaaagcaagaagagattccacaacacggaaaaggagaggccacggaatcaatcaccttgtctctaacgcagaactcacggacgatgtaggcgaagttgagggcggtgaccgtctagtaggtgctgatggttgagagcagcttcaagtttgtggcgcagacgagacagagaagcacgcgtcggcagcgtcgcggccggagtagttcgcgcatgcagcgtcatcgatgggtgaggccgcgcgcggcaacgtggcaccgaagccacggcacagcgaggtcacagccgaaggaggggaggccgggaggagcagcgacgttggcgcagccacgggaggagcaatcgtcggagaaattggggatccagtgcatgcgctgtgggagaatttggggatcgagcggagcgacgaagagaggaattggggatctgaggcggaggaaatggggatcgaacagagtaacagtggatgaggattttttttcactcgcgcgaacaagcagatggttaggagtgatctgtattctttttctcccgtggggcccagcgggacccaccttatttccatcaaacaagcagtatcattgtagagatttccttaactattgctacctgtagatgggcccactcttgttatgcattttaccatatacattggccttgccctaagaggtttataaaccctaggaaggaaaataactaggctgtcatacttagggttagttcgttttagcaactcgggtaagattttccatagtgccgaaaacatggaagatcattgattaattagctattacaaacttgaagaatgagtttattctatttttttaaaaaaaacttttatatacaatttttttatgaaacgtgccgtttaaccgtttgaaaagagaacgaggaagttgctcaccaaagttgctaaactaaactaagccttaaatatcttaacaatgcgagatggaattgctagcgccagagtttacatgtttctaatgctacacaaataacatgatgagttgatgacatacggtttatatattacttcctctgtcccataatataacaatttagtaccggagaagacacttcatagtacaataaattcggacatgctttttatccagattcattgtattataaagtgtcttatccaatccgagattgctaattataggacggagagagtacaatttatacttaatcgaaataaatatacatgtatttgttacacttgtactactagtactaggagtgcagttactactactgcaggcaaggataagatggggagcagatgaatgatccccgcacataggactcccctccacgctgctccctgtccgccaccctgcagcttaatcatgacgtgggcgagatgtcgcccggccgcctgcctgtacccatcaatgcccaatcatacccccaccaccaggtccaccaccaccaccggcgtcctctccttccatcccacacatccatcacgcggccgcacgcacaccagctcacgctgcctcgcctcatccaacctgtaaaaccccaaaaccctctgagggcaagtattatggtatatgggcatctaatcacaaaacctaagataacacataaaactaaatgatgacatggaagagagaagaaagataagagagaaatagttacctcttatgtaaggggtaacccctacacaaacttcaagaaatatacgagagtgttagggatattggagattgtgtggtagaggcaacatattatacatgttacatcttaatttaattatgtatattatacatgaaattagatgtatagtcacctctatcagagcaaaggttaataatacaggcgacctgttggctataaggttctttgtagccttctcagcctaaccatataatagttagctctttacaattaatatatggcccattttatctattcattaacattaatatgaatgtgggaaatgttagaatgacttacattgtgaaatggagggagtagtttcttgattattgtgtccaaaccgaagtttacagtccgtttcttctctctcttctcttttctctcctctatattagcatttagccatgcttaagcatcgacgacgcggggggcttttaactatttgccactcttacaaatggtgcttaatgatttgccactagacccacatatcatagacacatgagggtccacatgtcattaatagggtgtggcaaatcgttatttgccatgtcataatggcaaatagttaaatttcccacgaagggaacgccgcgaaggggcaggagacgaatcgacgcggaaatccacgggagaataaccaaaagtggccgatgcgacaaggaatcccgcgaaaccggcgcgtgcgagcgagcgagcccaaccgtcccggacccaatccccaaccaggccaaccgaaccaaacccatcgctcgccctcgcgcgagccgcatctcattctccccctccaaaccctacccaaatacgggggattattaaacccaaccgcccccgggtctccctctctctccgcgcctgtgtgttgttgtgtttacacccctctccctccccctccccccacacacgacgccgccgccgccacgcgcgtcacgaaaaccctagccgcctcccccgccgccgccagagaagggggcgcgtatccaatccgatccatccgatggcgtccggggatgaccaggcggccgccgcggcgctcctgggaggggacccggcggcgttcgacgcgctgctctcgacgctgatgtcctcgtcgaacgccgaccgcgccgccgccgaggcggcgttccaccgcctccgggggtcccacccggagccgctcgcgctccgcctcgcctcgtcgctgtcgtcgcccgccacgcccgccgacctccgcgccatggccgccgtcctcctccgcaagctcctctccccgacgccctcctccgacgcgtccagcgccgccgcggcgccggtgtggccccacctctcccccgcggggcaggccgcgctcaagcagcacctcctctcggcgctccagtccgacccgcccaagcccatcgcgaagaaggtatggacgccatatcgagctcgccgcgctcctcctgccggagaacgcgtgggccgagctgctccccttcctgttccgcgcggcgtcgggacccgaggctcccaatctgcaggagtccgcgcttctcatcttcgcgcgcctggcggattacatcgctgaatcgcttctagaccatctgatgacaatccacaacctgctcgcctccgccctggcgcacccgacatctcctgatgtgcgcatcgccgcgttgagcgctgcggttaacctcgtccagtgcttgcccaccaacgctgaccgggataagatgcaggatttgcttcctgcaatgatgagggcgctcacggattgcctaaactctggtcaggaggcctctgcacaggaggcgctggagctgcttgtggaactggctggtgcagagccaaggttcctgcggcggcagattgcagatgttgtaggtgcaatgctgcagatagctgaggctgcacagctggaggatgggactaggcacctcgctgtagagtttgtgattactctcgctgaggccagggagcgtgcaccaggaatgatgcgtcgcctcccgcagtttgttggcaggttatttgcagtgctcatgcagatgttgcttgatgtcgaggatgatcctgcttggcacactgcagagacagaggatgaagatgcgggtgaaggaaataactatggagtagcacaggagtgccttgaccgtctagccattgctattggtgggaatgcaattgtgccaattgcatctgagctgctcccgcagtacctttccgctcctgagtggcagaagcaccatgctgcactaatcacacttgcacagattgcagaaggatgtgcgaaggttagctaaataagttcatgcttattgtgactactatgcaatagaatcactacaaaaaccagttgaaaagctgaaggtattttattttgctgcactgggtaaaataaaatatacaatagctcgtttaattaggtaattcgaatcggtgtgatgtgataatgaatcaattgccttcattgatttctcatgttcaagtgattataaacactgaattttaggtgcacaagagcttttggcgagtattaagacacaaaaatgctacccattgtttcattcatttgcaagaagcagccaaaatagctatttactcaactgtttgttctttgcaggtgatgcttaaaaatctggagcaggttgtttcgatgattttgaatggatttcaacatcctcatgcacgtgtgcgttgggctgcaatcaatgcaattggtcagctatctactgatttgggtccagacttgcaagttaattatcaccagcaggtgctgcctgcattggcaaacgccatggatgattttcagaatccacgggtgcaagtgagtgttcaaatattagtgctagacttgatctagcacacccttttacacatgttctttgctttatttataacatcttttgtggcctacaatgttcataaggacaacgcttattgactcacttacctgttagactttatgaagaaaatgcttcaaagtagatagtgggctttacataaaagataatgctccattgatctacttagacatctaggagtgttcttcaattagttaaattattttatctatccatgttctagttgggctaagtttactttcgtggggttagatgaacatcaacacgaactatccctgtctttcagattttgtttctatccttgttaaataagataatttggcattatattcaaaaaatatgtaacacgtcaatggcatgaagtatgatttataaacacattaattcaggttttttaatgaacttttgttccatatacaattttcaagtgttactttttgatatacagttttcaaggttttggcagttttggggtgcctattatacatacaaacttaacctacttttattatgcttattaggaaataatatgtctggctgtgttactatcattcacaggcacatgctgcatcagctatcttgaatttcagtgagaattgcacgcctgaaattctgacaccttacctggatggaattgttaccaaattacttgttcttcttcaggtatccacctccctcaccagttaaatatattttattgtcttttagtgttatttttttgaactagtagaacatgtgctaatatattgtacttatgctttagaacggcaagcaaatggtgcaagagggagcattgacagctttagcatcagtagctgattcatcgcaggtaatttgtccatgtataagttagcttaatttcttatagggggagggggacgcaacattaccttttatacttatcttgatggttaatgagagtttataatattgtgttaaattttggtgtacttgtcttgcaggagcacttcaaaaaatactatgatgcagtgatgccatacctgaaagctattttaatgaatgcaactgataagtccaataggatgcttcgtgccaagtctatggagtgtataagtctggtcggaatggctgtaggcaaggataagttcagggatgacgcaaagcaggtaattgtgtcttctccactgtaattttgttctgtatgctatgttctatgcatgcacttttctaatctacacattgattgataggtcatggaagtacttatgagtttgcaaggaactacaatggaaaatgatgatccaataacaagctacatgcttcaggtacacataaaacctattatgaattaatcataataaaattcagatcctttgtaa

SEQ ID NO: 65600 - DNA, 4429 bp, Oryza sativa
agatgtgccattttccgtgctttgtatttggccatctttacttcatgcttcatgtcgaacccttttgcttggaggctagtgtcatactcatagtgccgaggtgagcaagactgttcctggaatgaactaaaacaaaactggtcacgaggacctcttctacccatttgtacaaacccattactgtgtacggcttcctgatctttgacatgttgtgtttggccacctccatcatcagagctgcctccggagtcctgcaaatcggtctgctctccattggcttggaatgttatctcctcaaaccgcccatgtagctctgcacactggcaacctcgagcagcagatgacatgtaggcataaagtgaaccacatgacgatacatttgatccgcagttatggcagtatgtagtgtcttgagattcctctatgcctgggccaggcctccaatctggcaccagtgcactaacctcgccatcaatcatctcagcaattcgagtaacctcatggtcagttatatctagctcggctaccatctcagttgcaacactcaatgcggtatcggcctctatgtcaaaaggaaaatagatgttccgtacatgccctgcaaagtgagaaattagatatcaagaataatacaatttggcatttttttggtgcactgaatttaacccaagaatttaaggaattgaacatttgtgcataccatcattatctgcaatccgtaatctgaggaatatgcttccatcctcactttttctccctttgattgtgatatccacattgccaagaggctcatcttcatgcccattgaacaagtcaataccatcagctttaatgtcatcatcttcacaatcccatctatcttccgttggtgtatcctcgtcaatgctttcagataatccattactcatcatggagacattactataagcgtgttctaaataaggctgccgcagatagttcatcaggctgtaatctccatcacccggacaaaagaccaaatcgtcaacctgcaggaatgggtccttgagcagctctctcgctgagagcctccgggatgcagtggccaggcatttctcgacgaactgcctcaccatcggatctttgaccttgtacaacgcttccggcttagtaccctatcagccaaaccactagctaaaatcagcaaaaaccgtttcgaactagccacacaccagaatcacaaagtgctgcaaacattacaaggatccaggaggcaattcttacagagatcactttcttgtagatctgcaccgggtgcgtgcactcgctatacgggtactcgaaggtgaccatctcaagcacgcacatcccgaacgagtatatgtccaccagctcgttgtactcctcctcgtacacctctggcgccatgaactccggcgtgcctaaccaaacaatcccacacctccaccccaatcaaattcccgtaaaactactgcaaattgggatcacgagcacaatccagtagcactatctagccaatcagagacgccttacctacgcagtggacggcgtgggacttgcggaggatggcggcaaggccaaggtcaccgatcttgacctccccctggttcccattcacgaagatgttgtcacacttcaggtcccggtggatgatgggtggatcatggctatgcaagtacagcaatccactcagaatctgcctgcaccagtgcttcaccgcccatatgttcaccctcatgtgcttctgcctatacctaatcagtaatcaccaccacaccacagcaaatcagatcaatccaagaaccaatcacacacacgcaaaaaaaaaaagaaaaaaaaagattccgtcttttacagttgggcagggttgggcaggaaaaaggaacatccttttgggagattgggctttgaggcgtgcgttagcgttattacagcgtgtggatgaaccgggagagagatttgatttgcttactggcggagggtgccggaggtgaacatctcggtgatgaagttgatgttgcggcgggagacgtcgacccaggaggtgtagaacttcatgatgttgcggtgcttgagcgtcttgaggaggtggatctcgcagtagagccgctccaggtcctctgggctctgcaggaagtcgtgcagcttcacctggttccacgccacctccatcccctggtactcgtcgaacgccctgtacctgcacaccaccacccctcgcgtcaggcgagaagccgccgagcaaaacgaacaagatgaagaacaagaacaagaagaattatcttacacggtcttggacgcgcccttgccaagaacgtcgttgtactgcacagcaaaaagaacggatcagcaatctggtaaaaactcaaaagcaagatagaatcaagaaacggaggctgaaggagatggtgccgtacccgtccgtaccggccggtgggatcgacctcggcgtactccgggaggtcgccggcggcggcggcgttggccttggggcccatcattctagctcctctcaccctgaagctccctgtttcttgccgcgctgtgtgctgctgctgctgctgctaggaaggagagtggatagggactgaggagggagaagaagaggagaggattgatgtagtaggagagagaggcctggtcgaggagatgtgggcacacatggtggtgtggtgtgggcagagagagagatggagatggagagatttgatcgatgtgcacgagatggatcatggaaaaagtcgagataaattttttgggtttttactggtgtttttacctgagattttacatgcctgggatttctcctttttttgtgattattataacgctgacaggagcttgggattcttgatatggtcgttggttagttggtgattattcaattggaggggagggctgggctggctgatcaccctcatgtggtagcaatgacaatcaaattattttcaggctgggattgtcggcgtagcaaaacaagatgcatatatttttgtacgaacgcaagatatgtatggtttgtgttgcaataaacaatttactgttatagcaaggctccttggaataaagtggttttaaggatttttggaagacttcaatcctattaaaaaaaatccccaatgtggtactttggatcaaaggaatagccatccaaaaatcctacaaaatttctttggattggcccaaaacatagaaattttgaaggaattttaacataaggtctaacctcttgaaaaaaaaaatcatttgtgcttattcttctctctttttgattccaacgcttttcccgtgctccatctaaacagtcattcttgtagtttttttttgaactttttcaattcatatggtttgaagtgttaggaccttccaatcttgtatttttcatttacgtattttgaaaatcatatattccaaacgagcccttagaatgctaataactttcacctatgcgaccacacgtatatgcattacaatttttactcgattatatggatttgttttttttccttcaactctgtcccctttagaacaaaggaatttgagaaaaaatttgatagattggatcctatgtaaccatttggaacaaaggaataattgctcaaattcctttaaattcttttagattgtgtcaagtcataggaattatgaaggattatcaacatgaggtgccacctcttgggaaaaaaaatttctgtgtctgtcagtctcgtttgattcctatgtttttttttctactcaatccaaatgatcatttctactgtttctttgtgtttttttctatctgtaggatttaagataacaagacacttgaatttaaaggagccattaagctgatgcgttccaaaggagccattaagctgatgttaaaaggatatttttcatgcattcgtattattttgtgtgtacatgtttttatataattggtcaaaaacacttggaaaaaagtagccagcaaaaattatgatatagttttttaagcaggatgtgcaatttatggcaatttttgtttaaccagaagataaagacaagtgccccttaaagtaataatagttttaaagatggaagcaactatgtcatcaatgttgcatttttatcttcttttgtatgaaaggacacctattaataacaaagaaaatctagttgcgaaatcggtcatgaaaacccatagagtataaattattgtgggtcctttcttgttgtccctcttgtcctgtacgtaccaacaaagaaaaaacctgcttgtgctgagttggagagctcacttcatttgtctgcctcttgatttgaaaccgttctaaatgctatgcttcccccagcaagcacacttgggacatgagggtacatggtggtccattcataaccatacaaatcgatgcaatgtatatgcatctgtaaaggtagttatggcccatgttcaacaattttgatttgtgcttgcctcatttttggg

SEQ ID NO: 65601 - DNA, 6928 bp, Oryza sativa
ttgatttgtgcttgcctcatttttggtttatacctccttgacggagcgtggggctcctcaccgggagaccgcgcaggcccccctttgccggttcggccgggggcgctaagtgaggttcttcgccctcgatctgaggaacgtcagcgagagaggaaatgcacaagacacgggcgacgtagacaggttcgggccgctgagaagcgtaacaccctactcctgtgttctggtggatctgtgcgtgaaggaatacagagagccggagagcgagacagagttcaggctctagaacccattcgccagagtccccactcccctcctttctcctcctctcctttctttttctaggcctgggcctcctttttatctggtccggggtcaccacatgggcctcctgctgcctaagaagggaaacatgctttttacaatcagggctagtctacagccggaagtgacctctgacaagcagagcacacgcctcctgccccgctcgcccgcttttccggtggacgcccatttcaaccttcatttaatggccagcgacttccttgccatactttcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgaccggtcacggaccggataagcgtgcgctgcgctgcattaaatgcggcgtggcgcgctcgtccaacctgctataaatgcggttaggtgagccccgtgtgctcacctaacccacacacgtggcgccaaaaccacagggggtcggggcgccccagccctcggggccgaaacgggagcggcccgacccctcggggagacagagggaggggtggccacgtcaccctcgggcccgaccccttccccccccgaggggggcaggccacgtgggtgaccgcggctacccaagcctctatagtcacgatacccccggccccatgtcaccgacagtagcccccggcgttacgccagggcgatcgccccctcgagggaagcgctcggacgtgacgccactccttaggcccggtgacaggtggggccggtccctacaggcgggcagaaacccagcggtcgcaaatcgcgcgcatcggcaagggaaaaccgaccgacaataatgagcggcctctttaagaccgctacattactcgagcagcgtgcgaatcgggacgagccggttcgtttcgcctggagacatgatgatggcgcatttcacggttggcgggcgtagttaatgcgcgcacgatctgcccatctcaaccgccacggccgcacatctgccgcatgcgccgcaaacgggcgagtggggttagtggaggcgtgggcgcgagaaacgagggggcgaggtagtgggcgcgggaagcgaggagccgggcatagcgttggcaagggtgtaaagacgccgaggaagggattcgtttctttcctctcgccactcttccccttgccttcgccacttgtgctctaactcttcgtttcctgtgccctacccttgccgcactcgctcgctctcaagctcctcctccgccggcgtcatggcacggggctccgcaccgctcgatggtagcgtgctgccgccttcccgcatcgtgagcgagaggcaggccgggctgccgcgccgattcatgccggaatctgccaccggccgggaggtggtcgcgctgggcgagggacgcccggcgccacactacccggggcggtccgtcttcttcctctctttcgcaatggaggggctggtcccgccattctctatttttttcatggatattctggagttttatgatctctagatggcgcacctcacccccaacgcgataatgacgttggccatcttcgtgcacctgtgcgagatgtttatcggggtgcgcccatttctccggctgttccggtggttcttcaccgtacagccggtgtcgccgccgacggcagtcggtggctgctacttccagccgcgggggcaggtgctgaaccgctacattccctgcgtcctccgcaaaaagtgggacgactggaagagcgattggttctacacccccctcgccgacgaagcgcgcctccgacttctgagccagcccccggcgcaggacttcagctggcgggcggcggtagatctgggagacggctacgacgccgttcttgaccgcctggcgggtctgcgatcccaggggctcacgggggccatggtgttcggcgattaccttcgtcgccggatcgcgccactccagcggcgcgcctggggcgcctgggagtacaccgggcccgaggactacatgaggacccaccaggggcgcaaatgggactgggaccctgaggacttcaggatggtggtccaacgggtgctaaatctcagctccgtggaggcatccctcatcccccaaggggtcctccccctctgctgcgatccagagcgcgccaagatcctggccatcatgcaggtggtcggggcgtcgagggagcgggccccccgaggccacgatggcgcgggcgggagccgcaggggggaacaatctaccccgggagggggtcgtgcttctgggccctgcgacgggggccgggggggcagccgccctgccgacgcccgggggaagaggaagcaggagggtacccctcccccatctcctccccgagggggcggggcggtgcatgccagcagcaggcgcccggagggtgccgtgccgacgccgcagccccagggggagcgaaagaagaaacggctccgcaagatggaggggatcgtgccatgccgggggaacctcatctcgcccccgaggtggtcgtttagccgacctccccgcaggttcgtccgcgcgcccaccgcggccgtattcattctcccatctcccaaggcgagttttcactcacccgtttctttttgtcttctggtttttcttctgcctcagcgagatcccgtcgcgcccccccccccgccattccaagtccggccggtctgaggccgaggagacggcgaccgcggaggcccggaggcgggaagctgaccggcgagaagccgcggaccgcctccgggaagccgaggaggctgcccaggaggccgtccgggttcgccaggctgaggaggccgctcgggaggaggccagactccgccgggccggggagtccgtccgggaggcagaggcggcgcgcgcacgctaggcggcctgccaaacccccgacccgactccgcccgaggcgacgatgacttccaaggccacccacgacgaggccgcgggcgcgccgctcgggcccgacccctcgggcgacgcttgggacgagccagcttcgggggacgcccccgagtccggcacgtcgatcggcgggccgagccgcgcggcacccacaccgagggggctctcccctctgccttccgctgccccactgagcgcggagcccctcctgcaggccttggccgccgcgaacagcacggtgctggacgggttaagtgcccagatggaggccctgcaggcggagcgggcggagctcgacgcggcgtgggcgcgcgtcgaggaggggcggcgctcggtggaggccatggtggaggcgggccgcaaggcacactgccggcacgtctcacagctcgaggcccgtcgtagggacctggcggagatcgccagggaggtggaggaggagcgggagactgccctcatcgccaccgccgtgctcgacgaggcgcgggacgacctccgcctccaatacgggagccgggcggcggagctagaggagaagctcgacgccgccgctgcccgggaacggcgggcggcggagaacgaggcggcgtcccggcagcgcgaagaggcccttgaggctcgcgccacggcgctggaggagcgcgcccgcgccctggacgcgaaggagagagacctggcggaccgcgaggtcgccgtcgccacccgggaggcaacactggcggcgcacgaggccgcctgcgccgaagaggagtccgcactccgcctccgcgaggacgcgctcaccgagcgggggcgagctctcgaggaggccgaggccgcggcgcagcggctggcggacagcctgttcctccgcgaggcagcgcgggaggagcaggcgcgccgcaatatggaaagcgcccgcgccgagagggccgcactggatcagcgggccgctgagctcgaggcgcgggcgaaggagctggacgcgagagcgcacagcggcggggcggtcgcgggccacggcgacctagccgcccgcctcgcagccgccgaacacaccatcgccgagctgcagggcgcgctggactcgtccgccggggaggtcgaggccctccgcttggcgagcgaggtagggcccggcatgcttcgggacgccgtctcccgtctagaccgcgccgggcggcaggcgggcctctggggcgggcggtacgcgaagtacgccgccaaccaggggggcctcgcccagcgcctctcagagatggccggggccctcgagcggctccccgaggagctcgaggagacgatgcggacgacagcgacgacgaggccgacgacccgggcgcgtcggagtgagcccccaggcccccgccaatcttaataacttttccttcttcttccgaggccttcgggcccccttcttgtatagactgatttaatctgcaatcaagtaaagaggaaatttctacgtcagttctgtttgttgtgtgtatgagacgaggatggtctgtgccgcggtccttctgtgtcttggcttgaacaagggctcgtgcccaggtcccagcctcaaacggcgcgggtcggggctagtgcctggggagatcctcgtgtcgagactggccaggccgggagcgcggtgaccgagggttatggatgacccgattgtgggcctttgccgattcccccccggagttcaccacgccccggggcacggctcggttctgggccccgtttggcgattttagccggcccgggccaccgagggcagggtcgagcacgagcgtgctaattcaagccaagattcttcaaaagaaaacgatggcacagacacagtcctcaagaaatcgaaaatgcttttattgaaatacggaagagaaaaaaggtaagtatatgcatgtggtagcccccggccaaccctgcacgcccagggggggtgcggggttggcccgagcccgagacatgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggatgtggcgctgatggtagcgccgcaggctctgttggtagcgcgtggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccatagacgaggaagaaaggcgtttccccggttgctcggcttggcgtggttaggttcgcccagagcaccgctggcagctcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccaagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcagggcctgggccggctgatgggtttgcctggcgtggaactggcacgccctgcaccgccggaccaggtcgaccgcatcgttgagagccgtcggccaatagaaaccctggcgaaaggccttgccaaccaaggtgcgtgaggcggagtgggctccgcactcgccttcatggacatcgacgagaagcttgacgccttgttcccgaggaatgcacttcaggaggactctgttagccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagcgctcccctcgggtcccgaggcctggactccgacgggcctcgggggccgttcaggcgcgtccgtctcccctagggggtcgggtcgcgccgacggctgggctagcctttcttcaaaggcgtccggtggggtctgggctcgcgaggaagcgagccttgagagttcatcggcgaccgcgttatcccgtctgggcacgtgccgaagctttatcccgtcgaaatggcgctccatacgccgcacctggcgcacgtaagcgtccatctgcgggccagagcactggtactccttacagacctagttaacgactaactgggagtcgcctaacaccaggaggcggcggatccccagtccagctgccactctgagtcccgcaaggagtccctcgtactccgacatattgttggtcgcccgaaagtcg

SEQ ID NO: 65602 - DNA, 3921 bp, Oryza sativa
  unsure (1)..(3921): unsure at all n locations
agcgtaaagcatcttctgggcctgagggtatcgggtcttggcgtcccggagggcctcgctaatgaagtagacgggccgctgcacctttcggcggggccgatcctcttcgccaggggccgcatctcagggcgctcttcgtccgagaggccacgcggggcgcactcggcttctgtgccgacgacctcggggtcagagggcgacaggcgcggtcttcccgcagtggccccggagccatcctgggggtcgggggcgcctggcaccgtcggacaagcaggcggagggccagctccggccgtcgggggccttgggccgccgttcggctcgggggcctctcctccctgctctctcccgggtcgagtcgacacagggtgaggacgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgaaggcccgctcagcctcctccgtccaggtaaacggcccggagcgtttgaggagcttaaataggggtagtgccttctctcccagcctcgatatgaaccgacttagggcggccatgcagccggtgacgcactgcacatccctaagcttgctgggggggcgcatctgctctatagctcgtatcttctcggggttggcctcgatgcctcgggcagagaccaagaacccgagaagcttgcccgcaggcacgtcgaacacacacttatcggggttcagctttatgcgggccgagcggagactttcgaaagtttccgctagatccgagagtaaggtctcttggttgcgcgtcttcacaaccaagtcatcaacataggcctcaacattgcgtcctatctggctacccaaagaaattcgagtagtacgttgaaaagtaggacctgcattctttaacccgaaaggcattgtcgtataacaataagttcctatgggggtaatgaatgcagttttttcctcatcctccctagccacgcgaatctgatgataaccagagtatgcatccagaaaacacaaaaggtcgcaccccgcggtggagacgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacgtatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccgccggtctccaggcaaagacgtcggcgtttgcccgcaggaaggagacgagcgcgtcttcctatttgtcgtccagaagaccaccgattcgtgtggtcttggacgggccgtcgcccagggcaacctccttgaccgggacctcgtcgcacgtgaccatccgctgccttggggcggccgggacggaggtgctgagcctctcgtcgccacccgcgggcttggacgccgcggcaaggtggtccgcgcgctgctccatacaagcaagcgcgactttgaggtcgccatggacgatgatggggccaccggggcccggcatcttcatctggagataggcgtagtggaccgccgccatgaacttcaccaacgcgggcctccccaggaccgcgttgtagggcagactgaggtccgccacatcgaagtccacccgctccgtgcggaagttggcggaaccaccgaaggtgaccgggaggtcgatatgacccagcggccaggtgtgccccggcgtcacaccgatgatcggctgggatgggcggaacaccatccccggggccttgatggcgtcaaaagctgcgggggggggggggaagggatgtnaaggcttcacccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatgccttgaggctccggcgagaagcgtgagcgcacgctcccccatcgacggtggcgacggtggcctcaggctcctggaaccccaggtcatcgtcgccatcgtcgatgtcctcggcggtggccttctgcttggcctcacctcgccggttgccggcgggagccgccggggtcttgccttcacggcgctcctgcctcttctcctcctcccacttcctcgtccgctcagccaaacttttgaccgcgcggcagtccgcgaggtcgtggagggaggtgttgtgcacggtacaccacttgccggtcgggcgctccctgctgggagcgccggcctccttctttttgtcgctcgcaggcctcccctttcggggggcccgcgaagcgccctcgacggcgaggacatgaccctcgtcatcggaacgggccgaccccttcttcctcctcctgtcccgccgccctgaccgagcggcggacccgggggcggccggagctgccacaccagaaccggaggagttccaggtccaggcctcctccttgcgagccacacggtccgcgagctcaaaaagctgcgcggtggtctggggctccttggaggcgatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtccctttgctgtaccgcatgcaagtccgcttcttcgcctgggcgcggatatatgccctggaagttcgtggtgaactgctggcacaaatcctcccaagagtggaccgacgcgggtggcaagttcattagccaaccccgcgcctgacccttcagggccatggggaagaaattcgccatgaccctgtcgtcacccccggcggcctcgatcccagtcgtgtagatctggagaaactcggcggggttgacgcttccgtcgtatttttcggtgatggtgggccggaaccttgggggccaacggacgttccgaaggttcgccacaaaggctcgacagccggcaccgccaaccggggacacggggggccggccccggtgcccggaccgaagtggcgctccggacgaggaagcgccctccgttgcgtgggtggcgcgacgagcgtcgcgccggcgctcgatatcgaggcgggcatccggccccccacgcacatcttcttgggttggaggcgttgacgagggaatggcggacgaacggcaggtaacggccgccgctcgccgcgccctccgcctcgacgacgtggagccggcggcggcagcgccagaggcctcggtggcggaggaccgcccgccggcgcctaggcgctgctgcgccatcatgaccaagtcggccacgtcatccagccaacgtcgggctggagtctctggatcggggacgacgggcgggtgacgcaggagcgcgcccgcagcctggagcgcgccctggggagtgccgccatcgccgtagacgaggcggcgacgcgccccgtctcgccgtcctcccccgtcgcccgcgggcggcgaagtcgcggatccttcgacctccccgagcgcctccccccgcccaagatttcggcgagagggggacggtggggtgcgagcccgacggcgcgggttctgctccccgtcgtcaccgctagcgttcggagagaggctgtgcgccactgcccgttcggccattgggctgagcggg

SEQ ID NO: 65603 - DNA, 4555 bp, Oryza sativa
cacgtgggtgaccgcggctacccaagcctctagtcacgatacccccggccccatgtcaccgacactcctatacaagctaaacaattcaaatgcaaaatcctttttcttttgagaggaaaaaaaacaatccaaacatactccttttcgttccaaaataaattaatataatacgaaatgtgacatattctaatattgcgaatctggatcggactacgatatgccacatcacgtactagattaacttatttgggacggatagagtatctagttgcgatcacaattaacatttcacatttttttccgccttcccagaggtacctactgactgaacagagtgaaaaatatcacctccatgtatatgatcagaaatctattatgaacctcgataaactaattgtaatgttttccacttggtaaattctgtaagttttttggagtagtaaagacttgctagttatgtttaaattaaaaaataaaatgggaggtccagaccttacaaaggttcagactttagttaacatgaaatggagctaaacaaatcttgtttgcctttccttttgggcagaaaattttatcccttgcgcatgcatgagactatgagaggggcagagagaataactcaaattaaaaaaaatgcagtttataatatttttcctgatcacttgtgagccaagttgccatgttgttccttatccttatgtcctcatgtggcatgcttcagttcctgttcattgcgttttttccagctaaaaaaacgggaaacgcatatgaagccactacatcaataatatatcatgccgtgtaaggattactctcaaaagtttgccttgcattcttcagtccctagtcccttgttaaaataacttcagttccagagtccgttgtcaacacacaacgaaaattgtgcgtcactgttaccatcttttggcgattttttcttttgctgcttatttgatatagagtactccatcgatccctaaaaaccaacctaatatatatgtgatatattataatactacgattagaaatataattttatattcgtaatagtattaaaatatgccacatttaatatagattgattttttatgaggcggagtacgacttctttttttttttcaccgtggaaggttctggacgggggtgatttcttttgtcaatgtgggcggtatactggaagttggaacctagcgctggtaaatgttttgacgcgactcggtgacaacgaggttcagacgtttagtcggtgagaaagttcggaggagaaggaaggctccagccacccggccagaatctcctctactctggtccacaagtccatctcttctctcaactgttcggtgaaaacttgataattgaggtattactattaaattactataacgaaaactaatttgtgaagatatattatactattacaatgatatttctttagcaaataaccatattttgttgcaacgatttacgatcgttgttttattcaatatttttgttgcaataggaaatgagttatcgtcaaaaaaccattagtgttgcaaaaaaaaaacatgttctatcgccaccgttttaatttttgtggtaatttgcataacacatggttgtggtaagttactttttttactattttttgttgccacgatcaataaatttgttccaacaaaaaaatttgttatctcataatttaacttactttttttcatatggacactgattgagacaaattttatataaaaattatagctatcgataaaatctacaattttatatgtgacaattttttcatttgaaatctttagatactcaaatccataattctaatctcagttaggtaggcacaaatggaaatatatgtattttctaacagaattggtacacaggtgaattagtgacaataattatttattgcaacgatgtgaagtgttgcaatacgattttttttgccacatcattttgtgccaatatccaaatttgttaccactaaatataaatcgttacaacaacctattagcactatatttattatcacggataacagcgatttaaaaatggtggtaatatgtatctattgtcatgattttagtattgatgccatatatttttttgtgataaatcaattttctagtgtgtaaggctgtgtttatatagattacaattttccaactttaccttatcgttttttacgtgcatatgctaccaaactgttaagcggtgtattttgtatgaacaaatatataagtttcttaaaaattaaataaatattttagtaatcaacactcgattaactatatgttaatagcttatcttgattcacgtgttgtcgaaaagctcaacgaacgaagccttaagctcgtgaaataatatgggtcattagaacataattaattaagtacttcactattacggagtacaaacttgagagatacatttatttatttacggaactcacaaatataaattcattacataatgtacattgaaaaacatgatgaaatagctcaactaataagctgaatcaaatatagccttaaccatcagcaaagatggaatcagtacagatatacgacaccacgcgaatggcatacgctgattatcgcacgacgtataccagaaggacttgtcgtcaaatggctaggtttattgtgatataatacgtacaccggcccgagtttaaatattagaattggtacgaatgctcatatttacggctaattatttcttcggtaatatgcgatatacgtattgatatcgagatatttgtgatgattttgttaatctcaaaatataatgatccgttttttaaatatgtttataaggataaatgtacgtgtgttttgagcatttacgtttgtaataaggactcccaacctttcaatcaccaacagctcaagaaaacagatcgtggtggcaaattaaaactggcaaggctttagcttttgctgatgcagaactccgctacttccgaacaccatacgccggtgtttaacatcatctgctacagtacccccttatcacttgtagctccagataaccaacccatctttcaccaagcaaaggcaccacaccaccgcaccttttcccccgtcatcaaccgagaaatcctgcaacgcgccgcgcgtgcgcgtgccgtgcgtacgctgcgttggctcgttggctcggcgaaaggctcccggtgggtgccgggccggggcccgatgcgggaggttgccgcgtcaaagcgggagggcaccggacacgtcgcgtcgcggggccgcctttttttttattttttgcgttgctttttctccccacgcgcacacgatcgagacgtcgcagtcgcggctgttttatttttttttcttcgtcttctcggggtgggtgggtgggcgtgccgcggccgtacgagctttccggatctccgtacggggggcgtgtaccgccacgcgacccgggggtggggggcttggctgtggggtggggcagcgtggccacgaggcccgcatgtgcgctgccccgtcgcgcacgcacccttccccgccccgaaacaccgcgcgcgctgctgcgcccgcgagccgcgctcgtcgtgtcatcgctgcgctgcctcgcgctgtgggggtatcaacatcggcatgcctgaacgacggcctcgtggtaggaccccagccaccggattcgccacgccgggcggacaccagtagccacgcagcagctagtagccgcctagctagctactagctacttggtagcaggactgggccgtcaaatttgaaggctatgtacaaaggtctaagtgaggcttaaattaagtaccaaatataaataaaataatgtatatactgtagaccaaatgcgatatattaaaaatagtacattttttaactcttgttttgtaatcagaaaccatctaactgaaaacggagaatgttcgttgctgttgctggcttgctgcatagtgccttgcttgttggttgctcgctaagttgctatttgccggttgaatgaaaatatgaaattggatgagccggctagcggcctggtgctcggagaagatgagacgtccagactcgagacgaattgagcaagtcaaagatacgaaaagatgagacgtccagactcggggctcggagtcgagaatatgaagcaccacgcacccgaagtcaccgcgcggagacacgcgctgactcaaacgggcttctgacactctagccccacgcgaatacacgagccttctttggttgggatgatttttttaggccctgaaaatttggaggtcctgcacggtcgcacgggccgcacgccgttgtgcacggctctgcatggtagtagtaactagtaagggcttgtttagataaaaaaaattagctaaaaacgttacatcaaatgtttggacacatgcatagagcattaaatatgggaaaagaaaaaaaaacaattacacagtttgcatgtaaattacgagacgaatcttttaagcctaattacgtcataatttgacaatgtgatgctacagtaaacatttactaatgatggattaattaggattaataaattcttatcgcggtttacaggtggaatctat

SEQ ID NO: 65604 - DNA, 2866 bp, Oryza sativa
tgcaattttctagtggcagttgtgcaataataattcaaagtagtggtaaatttgcaattgcccctgttcggaagcatcacagccgcatgtcctaagattgattaggcatgcatggaagtactgatttttttttcagcaagctggcaatgacctgctaaaggctgagtttagttccaaacttttttttcaaacttctaacttttctatcacatcaaaactttcttacacatataaacttccaacttttccgcgtcacatcattttaatttcaaccaaaccttcaattttaacgtgaactaaacacacccgaagtttttctttccctaggagtaactcgctggagttgcattggtattccgtacatcagtctaccaacaatcgttaaaatagaagggtgggaaagctgctgaagaaaggaagtaatccagtcttattagaggcaagttgtttatttgcctaaccctagctggtaagaggtaacgcaatcgctagacagatggctgcaagtagacgctctcggctctcactaatttagaaacgaatttcaaagctgactggtccgtccttacgtataatacgtagttgtacacctgaaccgtgttatttgtaatattttaaatagcgggctaaagtatttagcggttagcttctcaaacaactatagcggaagatagtggcagctacatacaatgggagatttaaaaccctaattatttggtggttcataacgcgcaacagtagtcacgaatagtgatagtcagatggtgtcacattctagcaaagcatatttcaacattgttcagcaaataatacaatatactaacaggtcacccgcgctgcttaataatagtaccagctaaatcgtgatggttgatagtacagcctacaacactctgcatatccatagtcaattactaataagtgtcacgacactaatggcatgacaaccatattatgcacttctctatctaattttaaaatttattgcagatgtatacacatgacacggtagttacccacagacaactcatgcacatatgtacgtattccatatgatatgaacacttgggactttacataattcttattcaaaaaatttacgtaattataatttattttgttatgagttgttttattactcatagtactttaagtgtgatttatatcttatacatttgcataaaatttttaaataagacgaatggtcaaacatgtgagaaaaagtcaacggcgtcatctattaaaaaacggagggagtagcaaaataaccatgctttactatggtaaaatcccgcgcttatttgatatatgttattcacttgatcgaaaataaatattagaccattataatatcagaaaatatcatgaattaatttgtatagtgtacaaaaagtagtttttacaatagtataggaaattactccatccgttattccatagagaatgttactgtaagattcaaaattattactctggatactaatataattcctgtcaattacctctctttttttttcttccaacacccaaccactctgccactcctgagttaggagtcataaccttacatcatttaacaagcgaaaatatagtacgtagtatttcttttcaaaccttaatctctactaaaaaatactccctccggcccaaaataagtgtagttttgcactattcacgtttaacatttgaccgttcgtcttatttgaaaaatttttatgattagtatttttattgctaatagatgataaaacatgaatagtactttatgtgtgactaaatattttttaaattttcacaaatttttcaaataagacggacggtcaaacgttgagcacggatatccacggctgcacttattttgggacggaggtagtatataataacttttctaaaacatatgaagtattttacatgtgcttaaaaaaagtcataaatttatccttagtaaaagcaattctatatcagagtatcggtttcacattctctaccacaatgaataatgatactatcattatagacactgacatgtggggtaataggaaggtaaaactcacattaggggcagagctaaaacgagatgcacggagaaggtgccacttgtttaatttgctctgcttaatttatatcaagtttaaactaatgcgagtgtttaaatttgtattgaagggggtgcacatatggttgaaatagatcaggtatagctacaaatttatcttgattgagttcttgggcaccccctcaatgctctagctccgcccctactcatatactagtgattgtaatggtataagtgatattatgtagaggatcctcaaccccattcaccacgtttttaaacaaaaaaactagtccaagctttctcatccttatccacccatattctcatccacccgatcgctccgcctccgtcgccatccttcttttcgcgggcgccgggtaagcgccttacgcttcgaccatgccggcgtgacgccagcctgtctctttgacgtcgtcgtcgtccccaccatcgccgcttcctcctccaccaccgacgcccacgccgtcagcagtggtgatgacgacgcgcgcaggcgctcgtgccgcttcactcacctctgtctccctctcccctccactcactctctctctctccctccctctctctttctctctcgggagaaggctgagaaggtggagatgaagccggccgagaggaaggggtcgtcatcgtcgtcgtctccggcggccgaggaggatgacgacggcgcggcctgattggcaagatcaccctcaagctccccaagccaggggtgatcggcgtctctctggcttgccgtcttcgtcggtattctcatcggctgggcatggcgcccacgctgggcta

SEQ ID NO: 65605 - DNA, 4201 bp, Oryza sativa
  unsure (1)..(4201): unsure at all n locations
taccaagataccaggtaccatctaccagtcaatacccagtaccaaaggtaccaggtaccagctggtactcaaagtactaggtgatagtggaacgcacctggaagctcacggaaagaaagtaaaatatcccgttctaacgggatcccgttctgtagtctccctctttttaaactatgtgctttacctaaaattaaagttatcttttttttaaggcgaagtgagtattccacaaacaaatattttttttccattctctcactgtaggttattatgggcttatggcagtttgtacccctactatagacagccaacaatccagccagccacgtcgccacgtccgtgttcgtgcctgtgcgtggtagcgcagcggatggattggtggatgatggggccgtggggtgatggaccagcggtcaataagtgcggtcggtggggtacgcttcggatgcgatgaagaaaaccacacatggcgatccacgacgacgacgacggtcggcacggaccaaacccgcccgactgattggtgatttggtggaccggggctccagcctccatcaccttggagtagctgtagctagcagcggctacagcagccaaacggccggcgtacgtttccagcgcaagaaaaaccgagagagcagcgtgggacgggacgggacgggagctgggggagaaacggaggacaccgagaggcggaggagaacgaaaacgagaggcgcgggcgcccccccgttttgtttttgtctagctcgctcgctcgcgcacgcagcacgtacgcagccaagccaacgactggtgccacacgggcgcgcgacacgcgctcacccccacccacttggcctgttggccatcgccattcgccgcactcgcgacacgacgaggggatccgtcctgaccgggagtgaaaaggagggctgaaagttttttttcgcttgcaatgtagcgagcccggcagtacataggacggtaggagtatatacacgtccgttttttttttgttttataatggaacgaatctcggctctttgctttaaaagaagttacattcatttattacattctctcaatgagtaaacattcagttaacttcataatgactgattgaaaaacatcaacactaaaaatggaaaaaaaattattgaaatcttttgtaaatcttcatccgaaattaatgaaaatctacttgtaacttgtaagcttcaacatgcagcatatattagctccatattctcttcatatttttgaagttgtgtctaaagtcggaacagtgcattgctcggaaatgagatgaaattcgatgatatgtatgaatcctcctcgcgcactgaaatgttggatggtaatacacaacttgaactagagaaatcgtgtacaacttgcttattttgtatgttaataattattcttttggagcatagccgatgtttttccggtgcttgaaaggtactagaggtccgagtgtcaatagttggaaaatacccctatggcaatgtttggctaatgggaaatggaaatgatttcccacccataaaaagacatctttaaatcttaactattcattctccctctttcatttaattctaacccttcattcatttcctaattccaatctcatcctccatttttcgttatccaaacacaccctatgtattgatacttttcgatgatgcacaattcctatctttttttttcgtttgcatagacatataatctcgtatgtattatgaattaatttattcggtgtattacgttattattattttttgaacatgctaaatgtttagacacgggcagataaacctgcaaaatggcataaatcttatggtgtacatcatgctatataccgcaatcatggaacaaagacaaaatgtctatattgtactccctccgtttcacaatgtaagtcattctagcacatttctcatatttatattgatgttgatgtatctagacatatatatctatttagattcatcaacatcaatatgaatgtggaaaatgataaaatgatttacattgtgaaacggatgaagtactggttgtcacactataccatcacaccaatcaagcgaagcttgcatcaacgatgatttaaattttacaaaaaaagagagagaataatttgtattcattagccatttcatctaaaagtttaagctgaccgagaaagtctggtaaatatccactcgtatttcaacaaattatttaaacaaagtctctatttgaaaaacatcaacatcanaagggggggggaaaaaaataattattgaagtctctacgcgctaggtcgctgtcttgttaatcgatcgaattgaataacgtatcaacaaatttcttcgactcaggcaagcaccaagcagatatcaacccaaatcgatcgcatgtcgtcacacacaatctcctttcaccatcttcacgtcattcaggacaggataccacaccgtgcgtatcacgcatttgatatgcgagtgcgctaatatacactcccagtccgatcgatttggcagaggaaatttcatactttcacatacgtgagtctgcctaattgctctccgaatgatctaattgaccaaacgacgagacgagtagtccccggagcgccgctcacgctacaggacgggaaggcggcagccggaagccgcaacgaagccggaaaccgttgagggccctttgaatcaaagatttatatagaaatttaataggatttaaatcctatagaaaattttcctatttgaccctttgattcaaaggattgaagctttctaaatcctacgaaattcctatggaatggcacattgcatatggattttggaagaaatataccaagagctctaacctcttgaaaaatttcctttgagtctatctctctcatccgatttctgtatttttcctgcgctccaataaaacgattatttccgtgtttttcctgtgttttgcaatcctctgttttacacttcaattcctattagaattctgtgtttttcctattccttcattttttcaaccctgcgattcaaatgggccctgaagctagcaacttccaagctccaaccgatagacaactctgtccatggtttcgctctcacgggcgactcttgctgcaccttgcatgcagaacttgtagaatcgcgctataggtttctccaatctccaatatacgaactcgcaaaatcatttcaaccttgtcgacttgtcttacgttgttcttgtgtacgtagagcaaagtacagagaagtacattgctcttcaagtcttcgtccagatggggggtgagagatagagagagcgcatcactttttagccttttgttgcgcggacaaggctaatgtttggaacgctgtctgtctttttcctggccatgccgggctcgtgagattcctggggaactgcccaatgtttcagacgaagaccgtggtgcacagcactggtgccgctggaagtaaaactgtactacgctcgggactctgaaagtctgaactctgaaacctgaccgtgaccggctagagacgaacgcgagtatacgcgacaagtatgcagactttgattcacgattcacgtgcccgggctcagcgggtgtccgcaaccatgcaaacggcggcgtttccggtgcggcaaagctttggcttcttggcgcgcggaacggcggcgtctcacgcgcgcggcacgcccgtgtgagtgggatgggccggtgggcgagcggtagaggggaggggagcacgcggcgggttgggtttcgctggcagcagcgcctcgccttcttgggctctcagcctctcaaccaaaatgggctcctgcgctagctgcagcctaccgcagcacagtgcgctcggttgggtggtgcctgccgccgacgacccccgcggttgcggcgtgcgccgtgcgcggatgcgcccatgccacgagctgtgaactcttaattttagctcaaagaattgggtctagattctatagtgaaattgtgaagcaaaacccagctccatctctcattttaaattatgctgaaactgtttgactgagcttcggctttaagagaggtgaaactaaagctgtgctaaacatgttcttaataaaacatataaaaaaacaggtccctttcgcatcgccctaacaccaccatagtgtctgtcaggcacgttgctaggccaacaaagttgcgagctatgaatctatgaagctgtctcacagtataacagagtatgaa

SEQ ID NO: 65606 - DNA, 5590 bp, Oryza sativa
gggcaacaaagatgaatgaatttcccttctatacaagtatgcagctaattattttcaaaccatgacttgggagttaaagtgttctgctggtcacatgttaacagcaactgatgtataacttaactgaatgtccatgaattctcaaatactgttattaagtcattgaagataacattatttatagcttggtatgaattagttgaaaatcttgaaccaccaatcattttagtcttgtaagcaccaaaattctaagaaggtatttagatacaaacattccaggtaaaattctcaaaactattgccgtaagatataaaattaatacgggggactgatttacatcagctgaacaaagaaattaatacagtactatgtagtacttactcccttcgtcccaaaatataagaacctcgtactggattagacattatctaggaccacgaatctggacaggtccagtactaggttcttatacttgggatggaggaagtacaagatagcatttaatcgatttgaagtagcaagaacaacattatttcagtatgctagtcaatgttagcaaatagccaaacattgtagctcaatattatggacaatggctacattgcgtcctagaagatactagtaaatttgttgttaaccaggctcttcattggctgcatcagaacttttacgaaggcccaagtcaatctgatcaaggccagaacatacaagttgacttctataacattttatatgcttagatctaagtgaagcatctaggaccagctccaagcgctccctatgaaatcaagcgcctggtttctaactttcaatgcaaggagctcaacatgaaatcaagtgcacatctctatgtgagttatttaatggaataaaacctatgcttaattgaatgtccatgagaactgagcactaaaaagatgataggattttctctaagccaacacccagcaactattagaggctaattggcacgatcttcttgtaaaatgtactgcagccctctcaataattaaacatatctgtattgctaaaacatggaggtgactaaaaacgaaaaaggtatcttaccagaacttcaggaagccatgtcgccgaaaatgcaaagcaatgtagttgccccccaagaaggtctgaacaaagcgttgcgcagtgagcataataagcctacttggctggatcaaagtattgcacttgtgagccaatgggccaccaggctgcatcacccactcttcctcaacatcagcatagaacatgtcaccgatcgcgagcacctcagcatccgtggtaaactttggcatgatatcctccacaaatctcttctttggctccttcagcttcgcatcctctggccaagctgcctggatctttcccagtgaaatccccaatcccttcaacttcttaacatgatcctcatcaatgaaacaagggggtgatgccgcgtaacatatgaactgatcaatgctcactttcttcctcttctctgtgaattcctcataggtaattacaaccttccttccaatgcaatcattaatgtggttgatatcaagcacccggtcgtactgataatccagcttctggctaggcaccaccaagatccggccaagcagcgccgcgaagaacatgtgcttctccaagcaaatcaagtggttggacatttgcccggagacgcagatggcgaacaggaatcgatctttcttggggttccactctatggtccgccggttggacggcaattccctcctcctgcacccgtcagccggcagatcaagatccaacccatcctccgtcgcattgcccgcagcgccagtgcggtgcgcggagaggagcgccgcctggatctcgcggttgatcttgatctggccgaggagcgcgtcgtggagatcggcgtacgagacagcgttcgagcccgagctgctgccgttggtgggtgctgccgtacggttgaagagggcgaggaggccgagcgctgcgagcggaggaggtagagcgcgcggagctcggcgtcgcgcatccgggacgccgcggggtcggcggcgggagcggcggcggaggggaggcggatggaggcgggcaggcgaagggaggacgcgccgccaagggatacgaagagcacgaggaagaggacggggagggcgacgaagaggaggaggtagcggcgggaccagaggacgcggccgagcgaggcggcggagggagggaccgcggcgcggaggccggcgacgtggaaggaggaggagggcggcttgacgtggttctgcgggacgagggtctcgaggtcgtcgtcctcgtcggagacggaggggtcgcgatccatggcggaggagagtgtcggtgcggcggggtggacggagtggggaggcgggaggggagggggagagtgcggagtgtggttagagggaagaagcgatggagattggagggtggacgatggcgactgtcgaacggtggtctgctgctgcagaaaatgtagaaaaatgttttcctgaatgctaatactactatatctgtcttatttattactagttcttttaattaattgtactagtattgtgcatcaataaagtagagagcatgaagtcatgaccatcatagtgatttttgcagtgaacacaaactatgccaaaaaaaaatgtggaagtgtttcaataaaatatttgaagaaagactttaacacatagcttgcaacaaatgttctaaataataaagtagaaatactgaactcaatacttctgaatggctgctaaaaggctaaaaaagcatggccaaattagttagattgttagagcatctccaacagactccaaatcagactctccaaatacctatataagcatatctttaattggtttggcaagctaaactcgttgctaacttcaataatctctccatctatcatttctactctaagtctatactactggtatccatatgttatcatctactacctcttcttcttccttctctttattcccctttccctcttctcctactgggggcatccctaagctcctccttggccctctccatctctgtggtggtgacgtccgtgcaaaggcgaacagcgacggtgacagcggacaacgatggaagatccatgagtgcgtggagcgaggtaaccaacgcgggagaaagggaggttgttggcgggcacggtgaacagggcgaggtggctctagagactgcacattgtggcggtgcccatgctacaacggagctcgagctcgccatccactcccaaccccattgtcgctgtaggcatccccacaccgtctccagtaaagtagatggaggagacggcgacgaatcctgagtcgaatccatacgggggaggaggcggtggaggtcgtgcgaggtcagaggcgacggcgagcgggaggccacggtagcgaggaggcgcgttgaggcggagtcgagggagaggcgctcccgtcaacgccaaccgctcccaaatgaaggaagaaagagaatagaatgtagtgggacacgaatagcaagttgagtaggctagttaagtttggcaagtgagagaaggagtttgttagcggatgacttggagagtgggatggatggactgttggtgtgcgatttttatccataattactaaattttgatttaaacagtgggatgaaaaggttgctagagatgcttagcatgctgcaaagtactacataaaactctgaaaccacttctgatttctaaatagctgctacggttgctttgtgcttgccataagaatatttgggaaaggaataacataggaaatccatagaatttgtatcttatagaaaataattatacgaagtcctttaaaacaaagtatttcctccgtttcagaatgtaagtctttctagcattgttcacattcatataaatattaatgaatctaaatatatatgtgtgtctagattcattaatatctatataaatgtgagcaatgctagaaagtcttatattatgaaacggtgggagtatttgcttttaccaattcctttgaaattcttatgggatgagctattgtagtgcaattttgagggtaaataagcatgaggtcttacctcatattttcttcttctgatgtctttgcgttcctacgttttttatgtattcccgctagttttatgaaactttcatgtgttttgaaattttataggaatccattgagcattacgttttattcatgcttttttctacctctgtgtttttatagtcccgtgtccgtagctaatcaatggctaatccacacggtcggtgaacgttcaagctgtccataatctatcctgcaggggcgagccacaaaattccatctgtttcaaatgccaggatttgaaggatcgagggtctcaagggaatagagatgtcgtgatcaagtggtcagctcaggactcaaccaagttgcttgccgttgctcttgatgcaccaggagaggcagtccacgagagtagacggcttaaaccacgacgcatgcttgatcaactgggaatgttcgatgcttccatccccaacatggtacccgctgattttcgttctttcgccgcagtcgaaacccaggtagaccgtatcaccggtgacggagggaaatgtgctcggagaaatcgacaccgaccgagacaatccgatgaacacggcgcggccgctcaggctcctcgccggaatcagcagccgggagtccaaatccatccggtacaccgcgtactccctcctgaattcgtcgtggcttacggttcggtacaccaggatcagctcccgcccgccattgtccaccaggtgaaggctgtcgctcatcgagcagaaggagaatggcgggtcgatcgtcgtgtcgaccgccgtcagcatgcgcggtggctgatctgagctggtggtggtctccggtgtcatgataccaatggcggtggcatggtagatgcggccggcgaagggcaccgtcgagtagagcatgagcctgtggtcgaagtctatcttggtacaacgcttgtcgccgggcttggcgacggcgagtgtcgtgggggatttgagatacgctaccacggtggaggtggaggtggaggaggagtcggcaatggcgacgcctctgacccggaaatcctccccgcgcagtccctggtgggggtcgttgcgctgctccggcgtcaggaccgtggcgaacggcgggagctcggtgaggtggcgggtgagcgggttcagcaggcggacgccgtggggggcgtccttgcggaacagcaggaggaggccctcgggggtcaccatgagcaggtcgtgctccgcgagctccggcaggtccgtgtggatgcactcgccggtggcgacgttgaggaagcggtggcggcggcgggcgacgccttgtcgatcatgatccaccgccgggggaggaagcggccatcaaccgggccgccgccgccgcgcgggctggcgcagcagcgcgccacgggccgcacacggcgcggaagcggacgtagtcggccacgtcggcggcgagcaagcgctccgcgatcaacccggctggcccttccgccagtctctcctgcaaaacccgaccgggtcagattcaattcaaataacacaacacgatttgaacagaaatctaatctcaaa

SEQ ID NO: 65607 - DNA, 717 bp, Oryza sativa
accaatttataaccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaaggg

SEQ ID NO: 65608 - DNA, 1156 bp, Oryza sativa
tgattgttagtggttttatacttaggcccttgttctttttctcaactccaaacttcaactttctcattttccattaacacgttttcaaactgttaaaatgatgtatttttgacgaaaagtttctatttagaagttgtttaaaaaataaataaatcattttttcaaatttataatagttaatacttaattaatcatgtgctaatgagttttcttgttttgcgtgtgcagaaaatattcctcaaactggatgcaccgaacaggtctactaatccgtccaaaaaaaaagactactactccattaaaaaaaaaaacaaatcctagctacaaatctgaacacacatatgttcaggttcctaggtaggaattggtgtttttagacggaggagataactagctaacaatagatgtctaattgtgatggtctatacctatcaatagatatattatacagttttattaaaaaaaacatggtaattagtggatacccagtacttgatgggcatggacatgggttatcttttacgccagatttaactattaggtatgggtgtacgaggagtttaagatcttggattggacatgttcttacttctcctgaagctgatccacccatttccacctctacctcaaacaggggtctcctgcaatggacacggtgacccatgatatcgacaacctagaacggaagcttatgctagtgtgctacgcatgcaaagaggaatcatggattggcagccaaagaacaagaatttcaccaaaagagacacatcggagctgctgaatagccagcatgggctgcataagacatgggtcaagttgcccaactttgatgcaggaaacattaaactttctacaaaatttcttatctaagggtagatcctgtttaaattgttcgagggggtgaactctcggggtgtaacggggtatgtagtggtgtatgtgtgcacgtcttctatataaccggggaaaaatatcctgaaagtagggatgaaaacgactcggaaacgaacggaaaaccacttctaccttttcctttttcataccttttggaatcgaaatcgaaatcagaaatcctagatacggaaacataatcgatatatgaaaacagagtgaattcagtggcggacccagcctaaaattatagctatggtggagt

SEQ ID NO: 65609 - DNA, 7502 bp, Oryza sativa
  unsure (1)..(7502): unsure at all n locations
tggcacgcttttcaaactgctaaacggtgtgtttcgtacgaaaactttctatataaaagttgttctaaaatatcagattaatccattttttaagtttgtaaaaaataaaactcaattaatcacacgttattaccatattgttttgcgtgaaacacttaatcttcatcttcaggagattcaaacaccaccttagtatactttaaattcaaaataaagaatctataaggcaggggaaagtgttttctaattgtagattagattttttccaagcccaatcgtaaaacaatactaaaaatatctaaaaaagtatcaaattctaagacttggaaacaaacttcaaattataatctgtagctgaaccacgtgggctcaagatcttaattactaaaagaaaaacaaacttcctaaaggacgaaggaccattgactccgtgaggtacgcaagctccgtcaggacgtggagcgctcctcctcgtggtcgagctagcgtcgtctttgcctcaccaacaggggggctgctagctggcgcgtgcgcgccagaagcgagcatctctctaactaatctatagtagtattagttaacacccacttaactactaatgacgagtaattagaaaaagattgtcaagattttttatttttttgggagatttttttcaagtcagatttgaaaacttttgatttaagatttaaattttaaagtcaaaatttgaaaactttctactcggatttgaaaactttcaacccgagattttgaaaactttcagctcagattcgaaaactttcaacttgagattcgaaaactttcaagtccagatttaaaaaatttgaaaactttcaacttgagattcgaaaactttcaactcagattcgaaaactttcaagtccagatttgaaaattttgaaaattttcaacttgagatttgaaaattttcaactcgagattcgaaaacttttaagtccatatttgaaatatatgaaaactttcaactgagatttgaaaattttcaactcgagatttaaaaactttcaagcccaaaatttaaaaatttaaagttaagatttaaaaataactagtaaactaaaactaatcactagtaaaaaactaatctaaactaattacgtggaacagcgaaaaagaaaaaaaaagaaagaagcagcgaaaaagccgtaccagcgaaaaagaaaaaatagagagaaaggaccagcgaagaaaaggagagcgcgtgcgcgtgggctgcgtgggccggaaacgcgcgttggcggcgcgcgctaactagcttttccgcaccaacagatgtcactcagccatggcaagtcggcagctcaacggcgatgtagaagacagaggtatatggggtattggtgccacgggacagctatggcggccgccacagcatgccacaagggagggtccacccctgagtgaatatggtaacatatatttatcggaatatgaaaaaactctaattgagcttgtcaaatcaataaagagatgtagctcgttatttttttaaaataataaattgatatttctattttttatcaattaataataatacaaacagttgcacatttcacttttaaagagaactacaataagtaagaactatattcatctatgacagtaagtagtatggcatggtttaataaaaaaaaaagtacttcctccgtttcacattaacattaatatgaatgtggaaaatgctaaaatgacttacattgtgaaacggagggagtaattgggtaaacgaaaaacatatctaaagcatcatactagaaaaaaaatacatgcattcaaataacaacgtcaatactcagtacaaacgtgaacatctagagtagagaaggttgaagctaattagctgtatatgaagagtaattcatttatgatcccgaggaaaaaattttttggaaagtttccgatcgttccagattccgacggatagtagtcttaacgtattcgtttctgtttacgagataaaaaaatcagaatttgtttccgtttctgaaattttaggaaaaatttcaaccaacactttctgtttccagaaacatgtccggaaaccagaaacattctgaatcattttcatccgtacctaaaaggaatgcaaactaatcattactcaacattaattaggaacccccaaccaggattagggccaatctctttggaatggttaatggtggatataccaattaagaggtatggtctctaatatttacatatccaaacgagatcttaaattgttatcaatatttatgccaagttgatactttaaagtgtgtgtgagtgtttggctatgtgcatgttagttatgcagagcctangattgttctcagtacgatacgatagtatcaccttgatgtacttgacaagcttcctttatatcaaaaaaaaataccaagttgataatgtaagctgtgaactagctagcactaacaaacaattacaaagaattaaaagtttataccttgaattgtgaaatatgatcattgtatatggaacatgtttgatgcagcaagctaaaaaaaatacagaattatgacaggttctgaacactaagcaggcaggaaatcaaactggtgaattatgaaatgtgagcaaaataagataaaggaacgcatgatatgaggttcttaacgattcactggtttatccatataatggccaaccacacacaacacaagtaactaggactccacaatcaaaaataacatccacactctggacggacacatatagtcacaacaaaatttgatccactccaattaaaacacaagaaaacttatttgggtctcaaacgtttccaaacagcaggcacagcttgcaacacttggtagtagtttcattcagcattgcatactatttgcagaagcccctcagccttcagttctaatagaagtcaatattgatggaacctccatggctaatttagaccaatgccatcaactgattggtcgtgagtttgaacgaccaattcacctaaagttgaaaggttcagaatattattaggaattcaggtttctagaaatgatagcacaaggatatacaagactacacacatatgtgtcatggttaaaagtggtatatacattttttgaaaaggcaaagttgtatatacattttttgagaaggcaaagtggtatatatacaatttttgagaaggcaacgtggtatatacattttttgagaaggcaaagtggtatacacatacaatctaaaatgaatgttttatgcttccttgctatgaaaaaaatcactatattaatttctagataagatggcaaattcattcgcataagtatggtcacacaaaaatgtgtgatggtaagagaagtaaaataaatgtcgcaaagaaagaacaagtaaccctattctattagaagctgccaactaaaggcctggcacattggagccccaaatgagagtgtttgttcgaatgttaggaaacattggaaaatgaagaataaccgtttggttaaccctaatgcaccaataggcccaactcggaagaaagaaggcatccatcttgaagaaagaaccacccatcagttcaagatttaatagtgacttgaagaatattggtggcacctccattaccactcttttactaccagattttctaaagttgggcatgcgttgttgagaggatcaaatatcgtttcatttagagcagcattagtcagctctcgagttttaagataccaagaactgaactccacaagttttggatccaagtagaaaggttcccatctttcatactcggcaaatttaaccactttagcgttgtgcttgatagcatgattgacccaagaactagcacggtcaatcgcaaaagaatctctcttgaatgtatccatgggagcatcaagattgtcacggctaagcaatagtttgttaatagaactaccaaaaatttccctatctaggcaaaaccaatttatatcaagctgatcaactgcaagcaagtcctcttgctgacccaccagtgggacgggacactagttcgcaccgcctccttcatcgataagaaggacattatgtggtggattagattgttagggagttcgctgatcctaccttttccatagggattggagggttccttgtggcctgcagtgtataagtggatactctgttacttagtgtaagtacatgatctttgagaaccacacaaacaactcgcaacaattttacaatttttatgtgtgctgaagtctagcttcacagagatattgctatcttaaatgcactttacacaaatgataaagaatttcccttgggtagctttgagtgttttcttagaacagtaaggaggttgaggctcacacatcaatcaagcgttgcatgagaataacaaatattcatggtttttgcaccaaaattaccaatgtgtaaaggacacaaatatgaaaattgctttaactcaaacaggggaatcgggttgtggatttgcaaattttattggcatatatttttcatgcgtaaagcattccagaagattagaatcatgtgtagactatggagaaaatacatcatgtaggcaccataaaaaagaacataccactagatgatgtcccctgaacatttccttgtgcatggataatttcgccatgcttattcttctcatggagcaagacaactgaaggggttgaagcttgctttcgaacatgaagaaaattgttcaacagcacaggatatgaatcatccaaatcgccttttataagaccagtcctccatagataatcactctaagtagtgcgagaaagaaaaaaatatgagaacttttattaaaacataacatcctatattgaaccataactttatgaataccagagaaagcatacaaagatagcaaattaagagggcatgtccacaatctggcaagccaagaataagtgcataatcaatatatgaaagaatttatctagcgatacacgtataagcgaataaatcagaaagtgatgattctatccacaatattaaaaagaagttaatcgaaaggggaacataaatatttggaattgtgtataaacgaacactttaattaaatacaacctcagtcctagtgtcttccgcgctacaatactggaatagtaattaattttttttaattagattgacaaaatttgcatagaacatattgcaaccatatgttctcaagtaagatggtcatcctaactgtatcacacaattgttatagctctaagtagttatagacttcttggcaataagttgtactcattcaggagctttgagactttgcaataatcaacagatgaacaaaattgctactattaaggttaacaatattacgtgcattaagatacataaaaaataaaattaatatctaaggaaattatattgcttaaaaaactattaagaacaaaccgtcatacaaagtcaatagctattttgtagattctctcctgtattctggaagccacattttgaagatcaatcaatgttgttgaagtagttgttttcaatttcatctgcaggcttaccaatctgcaaagagaatgccgaatattaatatgagatacgtaaatatttcactatggtacttccaaccgaaataatccaaaatatggttctaatataacaaacaataagcagccaggcaattgatggattggggtagcatgcctttatgcaagaaatacatgcctgctatgtattcactatttgagaaatgcatctttgctaaagtaacatgtttggaatcgcagatacattctcataaatactgaaatatcatttgtccaaccagaagtgtcatcttttagcaaagttgtgtcatcatgcgtgctaatagtttggaggagatcattgataaccaataacacggaggaattataaatactacaaacaaaacaagaagaatgtgtgaacatgggaccatcttcttcatgagttttaccacctacatccaacaaaaaaaaacaacctaaacctacaagtattatctactaacagatcttccctattttttggagtagctgcatcatctcatatatttttggttgtgtaaggtggactcagttacacaactgcacaatcaacaccatgacttctccagttcttcccctgttcttcctcttccctaagagttttaacacctaatttaataagctagcccaaaaaatttgaaagacataatatatagactatgtgcagcactaaaacactagtccattaagcttagacccatgcaaggagctggccacaaaatttagtattgaattatcgacatgcaaccttagttcattttattttggcgacgaatcattaacttgggtcattttctaaatatgaaacaatttaccttttatatttgagtacaatcaaaatataaaaggtttgaatccaaccaacaaaattttgccaagaacaatgctttttgggcgatctgggcctgtggtagggctagatccttgtccattatagccagagccgaaccaaacactaatagatcctcggttttttaaaagtgaagtgcgtggatctgctccaaaaaaagaggtagaaaaggtggagctaccttttttcagatccacaactccagctccatgtaaaatttggagctctaccaaacagatctatctgttacttggagctagaaaatgtcaattggatctgacttccggtatgatgaattaattagatcattaacaagtatagcatggatgatggtttccaatcttgataaatcatcatcaattgaagactctataatcaatttctcatgggaaaaaaagtaagaacatgagagagagagagagagatgagggggagtgcttacatatcatgtgttaccctatcgcgaatatcctggccaaggcgggtcctccagtcgactccttcgtcgataatccctaactcgtccatggtgtgcttctttggttttgttaggcagaagaagtgcccagagaggggaagaacaataagaggtcgatgatataggtagaattgaatcttataggctttagttgttggtgggatccacaaaagaagtaacgcttccatgggagaaggttctggctcacatgacatgacaacattgcctagcttataacacgggagaggggtatggcccacatgatgtgacaacatcacctagcatataacacgtgatgtagcttctagaaccttgacaaaatcctatgcaaaaaagttttgtggcaattgatgtccaatatctatgagtcagaaaccgagaccaaaaatcaaaccaaaaataaccaagatcaaacccaaaataaccaagacaaatgaaaccgaacttctttgcatgggatattcagactaccgattctattcaagccttattctaatccactcctcattcctcagccagtcccttgtgctccatcaactgccacagccagcaccccttcctccattatggtgcttctctccctcttcttcccgcctcaaaatttcttgagcgtgcctcctcggcttcaatcccatcttgggcacaccttcttggctgg

SEQ ID NO: 65610 - DNA, 11795 bp, Oryza sativa
atcggctagtactccgatactactctatattaagatatgaaagtggatgaaatatactgaacaggaaccgatctaacatcaggatggcctaatagattgatagcaagcttaatatatttcaaacaaacgagatcttagtatagaggacagatttagcatatcaagcaaacgcaagagcgacaagataactaaaccagataagatcggatgaaaacctgatgctatctctattagcaactatagacgggctagatattgcaattccaaacattactcgatatagatcaaactcaactgatgcagcattaagtcatgaagagaagtgcaagatctaaacaagtcgatagaagctcttctgagatggtagatacgctatataacctaattcaacgtcgataactaacttgccgactgttttcaatgatagaggctagccgatggggttggataacgatattaatctaggttatatagcatatatgataactcggcgattcacataggcaagattagagtgtcatgatgatgtaagcactaatcccgagaacgcaaaccgccataacaagccttacctcttcgtcggagatcgagaccgatgtagcccaactcgaaagcaagaattcgtcaaaaacaataagagtagaaaaagggtggcgatgcgctgaaagtattattgaactggtgttgtttgtttacaaggcatctggctatatttatacccgaaatagttaatatatccttgctggacacgactttatctctattacaatttaaaacacgaacaattcccttagacggactcttatcaaaaaatatatctaagggaattaattaaaaacatcctaattaatagatacaattgccttctttggacccaatccttgtatggcaatatcggcgtagtgtcttaccaccttgaaaattcagtcaacggcttgattgtctagatatcgtgtttcttttcatacttagtgctgcatcagtacattggacctactaagtcatgtttagaaccatgatctctagccttcttcttgattgctaatatggtagtatcggggtttcagctgatcttacctaatatatatgtttccttatctgttccatgtatattttccatctatatagacatatcacctaatagtaatatatcaagtctaggtcatatcggctgggctatcaatattggctattgacctatatttggtatattactatagattgacttgcccatatagatctgtactagagtattagctagtatattatctttcttgctctaatgtcacatcggctattttaataatattgtcttaagcttctttatcaatcttgatagacagtgttacaatcgatgatgtatatttagggtttaatattctttgatatatctattctatagccgattttgtctaactccatcggctgagaccaccaatgatacgttattggcctatcgactgactaactctgcttttgtctttcttgctgattgtaggatcaaattagctggcacgtccttgacacactcgagactagccttggacttacactggagttaagcagatctcctaggccaccgtattttcacgcaagcaccatggtagatggttgttctggtctagttggtcagaccgagaaacaagaccgaactatcagaatggccgattcacacatttgtgctgacaagtgatcagtcttccattttcaatgaccaaaaagactggactgaattatcagtaatgatggaacaacacccctggaaatacctatcaacaggaagttgtattccagcgtggttcttataggatagtacgttgcggtgattaatgaaaaggaaatgactgagattaattatccctagaggtattgtttgaatatgtttttaaccctgagctacaaagcaggatgtttccaccccaagaatagttggtgtcgccatagttggcgtcatgtgttcatctatatgtgcgtcatgagttggcgttgcattcttggcaagctgtcacaaaatcattatccaggctgacatgcacaatgttgtcataatgaatatagatctactacagctactagtgtcattctcttgcacgtctctccaaaaaccagtcggaatggaactggagaggccaacatgcgacacgatgtgcatgcggacaaacacgcacgagccgcttccctggcacatactgtggggggagaggggtgggggggggggtttagaccacacatggttgccacatcacaagggatacctccaactggtttggatagacccagtttttgaaaggagttcaaagtgaaatttggacaatgtatataatcatgtcaaagaaaaagcatgttgaaaatcaaatcatttagaagccccgaagcaaacatagtcatatatagaaaaaaaaacgaaacacagatgtggttatgcttcttgtggtagaacttatcttatccactagagttaagttctgtactttgacattgttacgacgtaacaacgttggtttgtgtgagtatgagtcttttgtcttttttgcaatcgccaaccttgcacgaaacatatttctttacacaacacatgtaaaggggattggtctcacttcataatagtccccttcaacaaattttgccaactattcgaatgaaccaattgcctcagttttaaagtacaagcgtttcaggtagaatccaattgacaggaaaaagctaaaatcatgcggttttgtgttggaaaaaaatcacaaagataagattaacatctcgaggaatgggatttattcgtggaatgagcatacgctagggttcctctaccaattttcagatttcaccgacgatcaaaaagaatattgtttttcagaaatttaatcacttctatattaaaagcactccatttgctgtacattcgggtcaacattatccgtacaatttatacagaaaaaaatgcaaaaaaaagaatgaaaaaaatattatgcaaaattcatcacatgtttttctaccaagaggaatttctaatccctatgactgtcctagttagttgttaacagtgaaatttggtaagctccgaagtcatcatcggcctaaagtcagtatcggcttcagagtcctagaatcgaccgatgggaattattaagtcaccaatagtcggattcttagtagattcggttaaggaaattaatctactaaaggaagtttatccagaagtgaccgagttcaaggaggatgcggcataacagtttatctattaattaggaatattctgttagtttccttttatctttaggaaagtgtgtttagtgtccgataaggagtttatgttttcctttaatctttaggaaaatttttttcttttccaacaaggactagtatctacccataggtataaatatgtatacccggggtcattgtaaactatctccacgaatacaaattcagcgcatcaccatcctttttacttttctactttttcgacgagtttatacttatcatggctgtttgcgttggcggggctagggcttcaacactctgatcttgtcaatgtaagcacctatctatcatatgtagtttggtggtttattttacttgtatcggctaagattcgtattagggtttatgctggtatcgactaaattgctttaccaaattagtttagctaaggtatctaccaccctgaaaatcagtcaagggcttgattgtctagatattatgtttttttttcatcagccctagtcgtgtacataattcaaatgtatttccattcttcaaacaagctatttcttttaatattttagtattgcacatatatcaaggagcatgtcaatgataatgatagtacggccgctcaccactctatgaggaaagtccactcttattaattatacatatgttgcatggatagttgtatgaggacgtgatggatgcatcatatcgtatttatgtttgatgccaatcattggaaaataaagagtagagatacgcaatgttaattttcaccccctttttatatgcctaattgtttaaacacacctctaaatgtgattaattgattaaaacaacacaataccaagtgatagatttcagtaaaaaaagaaaacccttttcttagacccttaaaatttaaaagaggcccccagaggttttttgggtttgttttttcttaatcccagataattgtcatttgtttccatttcgtaacaaacatacatttctttctcatatagcaaataaagtaaataagtagctaggtaatcttaacacgaaactttattccatcttgatcattgtttcttcatcttgccaatcatatgtagttcagaatacgaggcagatcaacaatcttgactggcttcagaatataatcctttgctcctccatccaagcacctccaacaaggaaaaaaaaagaaggaaaatggagcacatattaggatccacttgctcagattgagaatttatcaactaaggaaatcaaggtatatgtgtttgtacttactttctaatcctttctgggatgttatcagaggaagcaattaccactgggagatgtgctagtttaggtgatttctataagtaaaaacaagtccaatttgaacatgtaaaatatttggtagaaacattataaaatatatatgatgaagattaacactatactccgatccgtgatactattgtacgcaccttcacttccatgagtaagtcatagccggtcatgtctggcatacagtaatcgctaacaatcatgttcacatcatgttcctgtgtccatcagagataaatacatgtttgttatacagttgtaaataacattacctaataaacaagaagagaacttttaatttaccgaatccaaaaacatcaatgcttgcatgacactttctactgcagtcactgcatatatcaaacatggaaacacttagttaataatagtcaaaaagaatgtcagaagatatcaaacatggaaatacttagttaacaatagtcaaaactcggaaacttgcataacaaagaacctcggacgttatggcgcattaaggccatggaaacaacatggcgatcaacaagggtatcatccacaacaagcacatggggggatgacatcgcaaactgttggtgtagagttactttgaattgttgttgaggaaaatggacctagaatgcacatatttatagtgcaaaagtcttaaaatcttggagatatttcaaagatataatatcaattcactggcatgaaaattagctgtcatatcttacagtatcactagtgactgtatatttgataattttgatataccatacaatgcaaaatgattgatggctttgtcctctttcgtacccatagtgttgttcatttttcacaaattaattatagtgaccttgcaacaattatagctacctaggagcaaagatacagtctaatgaatgagcatatattttatatatctgtattgataaatgaatttgccctatttaatttgtacttcctccgtttcaggttataagacgttttgactttgctcaaagtcaaactgtttcaagtttaactaagtttatagacaaatatagtaatatttataacactaaattagtttcatcaaatcaataatttaatatattttcataataaatttgtcttgggttgaaaatgttactacttttttctacaatcttcggtcaaacttaaagcaatttgactttgaccaaagtcaaaatgtcttataacctgaaacgtagggaaatatgtcaatacaacaaagaggctaatagaaactaattaattggtcacactctggtttgatagacggcatggtactaaatgaaagaaaagaaagcaagtgagcagtggcgtactttggcatggcgtggtccttttgtccgaaaggcccacctcgtggagctcttatcttctcctctatggtttttacatgaatttattctaggaataagttcatctgaggtcccttaacttgtcaacgaatccgattttcgtccttcaatccaaaaaccagatacaatgggtccctctactatcaaaaccaatgcagacaaggtccctcggcgatttagatggcggttatggctgacgtggtgcctacgtggctaatttgactcggtcttcatctgacgtggcaatgacgtggcgctgataaaacatgtgggacccacatgccagtttcacaccaaaataataaaaaatggatggacccacgtgggccccacatgtaatcctcaatccccagcggttgctggtgctcctcttcctcctccggcattgctcctagccagcggcagtggcggaggtgagcggtgcctctccctcccccgggaatccgccgctgccttaggttccaggctcctccctcgccggcccaccgcctccatcctcctccccctgcaccgcctctgccgactactcggcgacgccggtcccgtcctccccaacaagctcatctgggtgattttggcctgtctcccggtgaaggggctcctccgttgctacgccatgtgccgtccctgggcgcgtgtcttggtgcgggtgctgctcagcgtaggctgcgtcaagggtgggcgctaggggcaacggctggcagcggcgccgtaggccagggccaggcaggcagcaggcagcaaggtttgcctcatctctcatgcttcgtgatggatcagatatctgctactgctatctctatctgtatgctaaagttgttcatatggttggttttttatccatatttctgccctgctttagtgctgattatattgctggttctgttttagttacctttgagatgtgcctaactgcctaattcatttgctattgttttatccagtgagaccatggaacaagaacggaaaggagaagtttccagtgcatgtatacttacaatcataattctgacagtgggtttgatgtccataaaatctttgttaagaggagcagattccgggttctgttgttaagaggagcagattccaggttctgttgttaagaggagcagattccgggtttgatggatgaaaatgaacgtgtttttcttattgggtctccctgtttgatcatgtgcagagtcagtggtgataatgccaacttttgggttcataatgagttcatgacgatgaactagttgtgtctatgaattatacctctgatggaccgacgagccagtggaaaaagggaatggtgagggcggcgttgaactcgcaggcccaactgcccaacgtgtcggcaggaagagcttcttgacgagctcttcttcttctccttcccgccggagctggagatgacggcgtacttcttgattttgcgtgcgaacagccccatgaaggcgttctccaccagcctgtcccggtattcggtcttctcccccatcggtgctggtgccgccaccgtgaaccgaaagccgctgccctgatctagttcggccgctgctccctcgtcgcccgccgcttccacgacctcgtccccctcgacgactctgtgctggtccgcgtgactgcgtcatccgagatgaccccgcgccaccgtcgtcgtcatcatcctcggcggcagcggggactggggagaaggacgacaacggctgcggcgtgaggagaagcaccgacggcgcggcgtgacctctcactgccggattcccgggggagggagaggtgccgctcgcctccgccgccaccgctggataggagcaatgctggaggaggaagaggagtagcaccaagccagcaaccttaggggattgaggattacatatggggcccacgtgggtcccaccattttttattaatttagtgtgaaactgacatgtgggtctcacatgttttattatttttttggatcgaattgccacgtaagcgccacatcaatgctacgtcagatgaagaccgagtcaaattagccatgtagacgccacgtcagccaaaaccgccatctaaactgccgagggatcttgtctgcaccgattttgatagttgagggacccgttgtatctagtttttcgattgaaggacgaaaatcggattcgttgacaagttaaaggacctcagatgaacttattcctttattctataaggcccaccttgtggtcttatttttgtggcgactcgaagctgcgtttcatccttcattgttttccaaggctctcctcgcgtgttccttctttattcaggtgtttaggaatggaatcagatggggatggatgaatcagccattggccatctaaatcgtggtgtttatagataagaaaacattgggaacatggcttcattcgggaacaatggtgatcaatggcgtctcctcaactcttgagcatatcgacacgttttcagatgagatagctgcaataggatacagtcactggacaaagtgtgaacactggaattccaggcaaatgcacacagttcagtgaacactagataaattatctcctcctttatgttttgtgatagttacatgtgggagttcgtcacaactatagctggagttctatgaccaaaatacttcaccgccatgtgctggccctactcttgttttgaataatgccttgtttacaacgattttgtcatagaatctcatacctacggatggaactagctaccatggacccatgaggtccatggctaccaagttctatgacaaagtactttgtcaccatatgccaacccaaatttctaaattgcgcaacatttcagatggccatgtttgccatcgtgacactttttgtgaccacaaactcaagtttccactagaatcaaccgagcctgaactttatgattatttattgaaaattcatcagagattaacgatggattccctttttatcacagtgaatccattatagaaggccaaatctattgtagtcatatatgtcatgggctgaaaaataaagagagaataagggggtcttgcaatggcggagatagccataaaagctgcgactcgtgaagatgtaaagtttgtgatatatcttaagaaatttataatatgagcataatatctttcatcctcatattttgtacaacaaaaagcccaatagagacatactgcaactcccacgtaacatgtaacaggatgtttagtgtcacatgactgcacgacatcataggatagtctctttggaacattggatatatgaatttcaatggaatatgttgtaatccttacaacatattcaaataagacattaaaatgttaccaataatatgagctgtcaactggccaaccctaacaaatagttgctagaagtaacgactgtgaaataggatcattgtgcatttgtgcatggaaaatgtttgatgcagcaagctaaaaaccaaccataattatgacaggtctaaacaaactaagcaggcaggaattcaaacttgcgaattacaaaatgagaaaaacaagataaaggaacacatgatatgaagttcttaacgattcactcgttcatccatataatggccaatcacgcatagtacaagtaaccaggactccacaatcaaaaataacatccacactctagactgacacatatagtcacaaacaagtttgatccactccaattaaaacacaataaaacttatttgggtctcaagcatttcaaactagtagacattgcacactattgcatcaatccctcaacctttagttctagtcgaagtcagtactgatggatcctccatgggtgatttcgaccaacgccatcaactgatcggccgtgagttcaagtcaccaatccatctgaagttgaaagattcacaatattattaggattttagttttccagagatgatagcatagggatgatgcaatcgatggtactgatcagactaagcttcagaaacaccttccttagaataggtgagtgcttgacgtattggcgtagaggctagaaattattgtcaatgcaccattcacccaagcgcaatgttctaaaattcctgaacattggcccgctcctagattgttccgtgaatataaacttcatatgtgcaaagcaaaaaaaaagtcttctatgaataccgaaaatttgttgcagaaaggtgatactaaagatattaattctcctcctcagctcaagttattatatacgacattacacaaatatgtgtcgaggttaaaagtggcatatacatttttcgaaaaggcaaagtggtatatacatttttttaaaaggcaaagtggtacgcacatttttttgaaaaggcaaagtgctatatgcatatcatccaaaattaatctttcatgctttccttgctatgagatatatactcactatactaatttctaaataaggtggcaaattcattcatgtaacaatggtcacataaaaatgtatgatccaagaagtggcacggtcaatcgcaaaagaatctggctggtatgtatccataggagcatcaagacactttcatggccggcttagcaatagtttgtcaatagaactaccaaaattttccccatccaggtgaaaccaatttatatcaagcttgatcgactacaagcaagtccacttgttgacctgtcagtgggacaggaccatgcacaccgccaatttttccctgtctaagcgaaactaatttatatcaagcttgatcgactgcaagaaactccacttgttgacccactagtgggacagcacactagtgcgcaccgcctccttcatcgacaacaagaatgacattatggggtggattagatcattagggagttcgctgatcctatcttttccatagggatgggagggttccttgtggcctgcagtgtagaagtggatactgatttacttagtgtagctacatgatcttggagaaccacacaaacaacttgcaacaaatttacaattttaatgcatgcttaagtctagcttcacagagatattgctatcttaaatgcactttacataaatgataaagaatttacctagggtaactttgaggtttttttttaaaaaaaaacagtatggatgtgaggctcacacatcaatcaggcgttgcataagaataacaaatattcatggtcttgcaccaaaattaccaatgtgtaaaggacgaaaacatgaaaaatgctttaactcaaacaggggaatcaggttgtggatttgcaaattttattcgcatatatttttcttgtataagtccaagagattataataacaaagagaaaatttatcatgtaggtaccataagaaaaaggaacaaattggtatttaaattttcatgaactaactgctagatgatgtcccctaaacatttccctctgcctagataatttggccttgcttattcttctgatggagcaagacaaatgaaggggttgaagcttgttgacgaatatgcataaaattgttcaacaacaccggatatgaatcatcaaatcaccttttataaggctactccttaggtaatcaccctaaatagtgccagagaaagcatataaatatagcaatgcgagcatgtcctcaatctggcatgacaagaataagttatatattattgaatggtgaatgagccaaaacaaagtacttgccacacgaggataaaatctatatattatagaagttatctacaaatacacatatataagccaataagttggaaaggggtgatttctatctgctatatgaaaaaactgaatctaaaagggaacataaatatttggaattgcgtatgaacgaacacttcaattaaatacaacctcagtcctagtatcttatacgtcactataaaggaagcgtaattaaacatttttaattagattgtcaaaatttgcgtacaacttcttacaaccatatgttctcaagtaagatggtcatcctaatggct

SEQ ID NO: 65611 - DNA, 1811 bp, Oryza sativa
cagatgtcctattttcatcctgcagcgttccagaatggattggatgtcacaatgtcccaaaaaaaaagaaaaaagaagcagatttcttttgccattatttgcacataataattaatttactgtattaacccatgcaattctggtaactttccaaagcagttcaacgtacataacagagcatgttccaaagtaaatcactgcagcatggtaactatggcagttatgcctggacatttttaacagtgaattgttattttgtacagtaaactgcaaatgtcagtatgtcatgaacatggaatgaaggatgtaaaaaatttactactcataaagtacaaacaatgtgatgccttttaattaatacagtaagaagataaataaactgaccttgaggaacatctccagcggtacatcaaaaatgtcatctacctcatcgacattaagaacaggcttaaatgcttctatatctgagaggatgccaacaataggaacaaccaccagaagatgctgcaagaatgtttaaagatttgtatttgtaacaccagaaaaaaaataaaaaaagatttccctattttttattgatgcattgcaacacagttttctctgatctaagaaaaaatttcagtttcgatgtaaaagaagaccgaaaggcattgcacctttgacaagaaatgctctaaagaggcaacaacagtgaccaaagaaggatcaagcccaatctcctcctttgcctctctcagtgctgttgctgcatcatcagcatcaccttcctcagccttccctcctggcaatgcaacctcgcctgacaatctcaaatttaggcaagaaacttagttaagaaaaagcatagaagcagcattgggcatctatgagcatccatcaacactttggggtgtagttgaagcaagtttagataaaatgagccagggcagactacatttggatcagctcacctgaatatgctgactcaaaccaagtcagctctctagtagagccagaagctcaatttataactcttgtgtaagccaaacctatcttgagaccatttgtgagctcaagtccccaaactcaaaatctataacaagaaaatatatgagcaggcttggtttcaaaagtatttcagaaagtcagcttgtttcatttcacttcagaaccaaatctcaagttgctcaaacaattcctgaggtgaggccaagtcgcttaaaatttgtaaattctgatgcaccctacttgtttttctcaagtagacaccgaagtaagaaatgctatgatgttcctagtataagtccaatcatctgtacaaattgtttgttcaaaacattccacaaaagccagttggctaataatgttgaagtggacaagacaagagagaaacaactatatcatttgtaaactaacttcatgaatgaatcacccacatggtagaaactagaaagtgactccctatcatatttgtgaactatatattaacaccccccccccctcacccccaaaaagaaaaaatgtttcaatctgacataatactatgataaaattatcacaaaactacagatttaactcggtgtatcacaaaactacacatttatgatgaagtgtcacaaaactacatgtttattaactaaattaccacaagactacaagtttagaaccaatttagtcagaaagcaataatgtttatagctccaatataacaatggtgctagggatctaaactccaagttgtagttttgtgattacttcaatattaaatatgcatttttgtgatacttaaccttaaaactgtagttttgtgataaatttgatgctaaatctgt

SEQ ID NO: 65612 - DNA, 17596 bp, Oryza sativa
agtttatatagaaaacatattagtactttcaacacaaagtaaacatattattaaaatatatttggtgctagatttaacgagactaatttggagttatattgctaattatttttataaaattgattaaacataaaaaagtttgataacttatgataggatgaaacagagaaatattatctaaaacaaaagggtttagagcttcgaaatgtactccttccattccaaaatattttggaactacggaagtatatttttgaaatcgtattaacagaaaaaaaaaaacatatgaacaaattgttcaatccaattgatcacatgaatttgtgacaaatgttgttggtggcactaaaagaaaatcatagttacttttcgagtaaggagagaaagcacgaggctagagttctccttctcgtttccaaaataaaaaccgctcctcaccgatttataaaaaatctacaaaaaccagtaaaaaccaacgatttttagtcaatgttgtacgaaaaccaactaaaacgcttgttaccacaaactaatgatcagtggttttacgagaaccgatcgtttttggaaccctaggtcaaccggttccaagttagtttctcacaaaaattctatgaaataggtattttcatagtaggaatttgttagttttccaccaaaattcttgtagaaatgggccattcccctggaatatcatagaattttgtggaagccaatctagagcagagttggattatttttcataggattgcaatctttcatttcatcacatttcctttggtaccaaagaagccctaattccagtaactagatatgtccgcactttgctgcgggatatatgttagataacggagaaatgatgaaatcattcgaattgaaatattatgaaaatgatttaagaataatgatgtagtatgtgtatgtttagttttggaatgaaataaattatagatataattattatatgcttgtatcttgaggatttgtacttaacatgttgatgtcccatgcttgcatgtaggttttaggagtactaataaatactatgtttggatgttgagctttaggtcaaagttgaccgttgaaccccccccccccccccccgccaagatttgtagttctgtatttatttttatttattacttcctccattttatattataaacagctttgtttttttaagtcacacttgtttaagtttgataagtttaaataaaaaacatagtagtatttacaacacagagtaaacatattattaaaatatattcgatgctatatttaacgaaactaatttagagttaagttgctaattatttttataaacttgattaagcataaaaaattgactattacttatgatatgaaacgaagaaaatattatataaaacaaaagggtttttaagctccgaaatgtactccttccatcccaaaatattttagaacgacggaagtatatttttggaatcataagagaagaaaaaacatacgaacaaattgttcaatccaattgatcacgtgaatttgtaacaaatgttgttggtggcactaaaacaaaatcatagttacttttggaccaaggaagagaaaacacgaggctagagttcttcttgttttcaaaataaaaaccgctcctcaccgatttatcaaaaatcaatgaaaactagcaaaaaccaacgattttcagtcaatattgtacgaaaaccaactaaaacgctcattaccacaaataatgatcagcggttttacgagaacccatcgtttttaaccctaggctaaccgatcccatgttagtttctcaccgaaattctcatgaaataggtattccataggaacttgttagttttccaccaaagttcttgtgaaatgggccattcctctagaatatcatagaattttgtggaagccaatctgcaacagagtcggattattttttataggattgcactcctatatttcatcaccttttcctttgttacaaaggagcccttacctattacaataattaaatactgcatttgcaaaactttttcagatacaataatggctggattaacagggaaaaattgctccatgttgattgtcagactaaaaaaaatcatttttatgggtaaaactaaaaaatatcatagtaattgtgtggagaggagcaacggaacaccgggtattgctagtgggtgggtgatcaccttcctctcctcctagcgatcacccgtccctccccctgtacgctcttcctctccctctttcctcctccccttcttctcttcctactacagtacaccataatattttttttaagaaaaaacaaagttggaaaatttatgcacagaaatactatatataaaaaatttgaattcaaattcaaatttgaaacgggtatgtaaacttttgacttataaactttgggtctataaactttaaactttagatgtataaactttagatgcatagaaatactatatataaaatatatttgaattcaaattcaaatttgaatcaaatataattcaaattcaaatttaaatcgggtatgtaaacttttaacttataaaatttgggtctataaactttaggtatatatactttagatgtatagaaatactatatataaaaaatatttgaattcaaattcaaatatgaatcggatataatttaaattcaaatttgaatcgggtatgtaaacttttagatgtgtaaacttgaggtgtataaactttaggtgcataaatttactaaaataggaaagtaatgcggtgccaaaaaaggaaaccacgtggaggagaggggggcgcgctaggggcgatcgatcgcccgttagccatttcgcagaacaccgctgccgccgtccgtcaaggactcaagagagccaagactgggctttctcccggcaaccgcccttaaggtgtgagacagcacgacaacgccctcaggagggaaaatgacactcgagcgtcatcgttgttggtccggccaagaccgagctgggttttcacccaccatccaccacctgccaatctaccatacatgcaccactgctccaccgccaactaaacttccgccggcgtgtggggacatggcaccggcgccccccgccagccagtcttcgcgtgcagctaccttgccgggctccgtctccatcggcttcgcctcctgctgcacagccatcacgtgccagcagtcctcgacatcgctggccacgctgcatggctaccggctgcacggctgtcagccacaacatgccggcatcggccagccatagccccccccggccctcgccgtcacccacgcacctcctgcccctccgccgccgtcgcggcctccgcctccgtctccagcgcctccgcgctgttgcgcctgccgccgccagccacaccctccgtcactggcgcccgcaaccaccgcatccacaagatgctaccaccgccaccagtcgtcatcccgctccaccaccgccagatccggccgccgtggcgtcggcgccgccgtcgccatcccacaacaagtgcggtgggaagtgtgctagcacttgtcctcgccagatccagcgcgaatctggcggccttgtcctccgcagccagcgcctccaaactccgccgccacccccgccaaacgcagccgcctgaacgcccttccccgccaggtctggccggtcggcgcggatttgggcggtttccgcctcccaacgccgggcaatccccctgcccttgtgcggtgagacggagcgaagccccgccaccgctgtccttgtggccgtacggctttgccggcagctgctcgggcggcgacgaggtggaggagggagggcggtgggcgacggcgaacggggcgcctcccgtgtcacctgagaggaggtgacgcgagagtagatgctctagtttgtgtgataacagcttgctagttccataaataagaacaaatgaatcggccatcgttgttcccttcgatcaagaggctgccatacagaaataaattacggatctcgctggatcagtcaccacacaccagtggcatgaatatggttaacttagtatatatttccttttaccaccgcaaaacaatacatcgaataataggtacattctgagcataacaatgtaaattagtgcaagtttaatagtacagtcaattcatagttctaaatcatctatagccaatttataccatagttatctataaatatacactacacaattaatatctggttctatctctcatacacgcatagcttcctgaaatccgtatccgtgttgcagttggctataaatttataactcacttcttttctctctgctctctcctctctcctctcttatctatgtacatcactctcacttatagatggcttatactgctattgcacctgctcttatgactggaattggaaaaaggattctcttttgggggtgatgccagcataacaggactttgctgcatacagtgagagtgatgtacatatgaaagtaaaattatgacctcaagaccgatgaacagaagcaaaaccataatacttatggaatgtaaatatacaatcaagtttatgaaatactgacctgtattgagaaagtcagcagatgcataaccgtagattgccctactgttcttattggaaatgaacatggttatctagctctcccaatagctggtgtcaatcatcgtaggtaaccatgataatttgtggttactatcccagacaaggatccacaaacagcaagagtccaatccattgtttcaaaggatgaactgaaagcaactagaaaacttataagctcagagaaaaaggaaacttatgaatgattactagatgcaatgtagagtggtccatgttactaggaccagagttctgctagcagccaccatccagattgaggaagcagattaatgaagaatcaactgggtaagaagtacaaagtgaatttacaagcttccagcactaactaaataatggactcaacctgattttgacatattacaaactgttttagtacaagtctttgtttacatcaatacttattgggacaactgggggtagggatgacagtagtttaatccataggtgcccattgcccaactctatttcacctacaaataaagaaataaagaaaaagtgtgtttttagtaaaactagcggactaatgggtacccatatttataatggattactcccatctaatcagggatttggggtgtactcgaatagcattaacattttcataaatgttaatgttctcatagtattatgtacaaaaaatgtgcaaagaatataaactataaaacaaccttttgattcagtaccaatcttttgagatgaaatctgctctgctgtacaccccaatggtctacaactgaaattgtattgtaaacattagtgtttcacaggtgctgctcatggcattgaagaacactcctttgagtacttcggcaagttgaattgcactgttcgtgcaggaaagtctggtggccgctggaatacaactgaagcagcatgtatcaggatgccagcagtcagaccccatattacgtacttctcactccctttctcgtaattgaagtaatgaattgtgaattcttgtcccatccattcacgctcctcagatgtccttttctcatcctgcagtatttgatcagcaggttgaagatagaaatgacaccaagtcactgagatattccatgatttcagtaaaataagtggtttctttatcccctagtttgttccatatgttgaaaaaaaaaactataatagtatgctattctggttaagtctaaactctaacctatattaccactgtacagaaaactacagtatggaaaactatgtggttggtatcttttacacaataaactggtctcctttgtttttttgttataagttggaaatatcacaaacatgcaacccaggttcacataaaagcctggaaatgtgtgtggtcctttaattagcatggtggaaaagacagtgataataccaaccttgagaaacatctccaagggtacatcgaaaatgctatccacctcatcaacattaagaacaggtttaaatgcttgtatatcagagagtatgccaacaacagggacaactaccagaagatgctgccaaaaatatggagaatattaatcctgatgatgacattgtaagagtaatcttattactgattgctagtagaaacaaactaaaagtaattaaaacagtggggcacaacagcataagaattgtagtggagttggatattaagtattgaagcgaagcaaaggaactacattttagaattgcaacagtgcaacaaagttagtaatttacatgaaaaaacatagaattagcctctcccagctaattcaatttgaagagactacctatatatgtgtaaaatgaattgaaaattttggataattttctatatgagtttcacttgacctcatgacatgacaaggcacaagtaccaagttagtcttaataaaacatgtggcgagcacaattcaaacttcaaaggacaaattagctaaatgacatgtgaaatgatccatcaacagacggatcatactagtaagactagccttcagatgtaatcaaaacctaaacaagacaaccaagacagcaaaagtgaccatgttcacagttccttcaatgaaaaaataatgtgcaccatgcaaagacctatagtcccacagtaacattggtaacaaaatttggttcgtttcaacttacaattttaatattcggtctttgagaattaagtttcatttgcgatgcatgatatcaattcaaagcactaaagtacaatatggttttctgtggcatgcaaacatgattgctaccaaacaagaaaggattttggaaagaacagttagcagcttatgcatcaaaacatctataagcagatcctgagtcaagttggtttagttgcccgtgtttggttctaaaatattattaaggaaaatggtgtatagttccatcttccttgctgtttcatgtggtgtaagggagagccaaatggtattctacctttgacaagaagtgctcaagagaggcaacaacagtaacagaagctggatcaagtccaatctcctcctttgcctcccttaatgctgttgctgcatcatcagcatcaccctcctcagcctttcctcctggcaaagaaacctcccctgcaaaccccagatggaagaaataaaaatcaagcaggtttcagaagccaatttgagctaagcaagctctctgaggcagccaaaaagatggatcagctaaaggaccattttttagcttgaatctgtagcagccaaaacgagcagagcaaaatgaaggttgtatgggtttggaattaaggaaccaactcatattattttatttaccctatctaaatcaattgctgagctcaaagcctttccgtggaccagggaaaaaagggcacccagttaggccagcagcaacagtgcaacactgataaggagaccagcccatatgcaccttagaatattgcatagtacaagcattgcatgatagtttttgaagcatattgttagcatctggtgcaccctacttgtccaagcaagcaccaaagattcaatgtcattatcagcatccaaccatgcaatcaattccaaccatttgtccaaactgttaactcaacaaaacaccgcaagtacgctcctcatgtgctcaggataactaaaatatgtgaaaccagcatcagaaaacaaatgtggtccatttcgcgtatatcattacaaacaactgtcaggccaccatcctattattatgccatggtttatgtcactaatgtcaatgcaaaattgatacccatttttaaatatgatcgatgctcattggatgcttgctatatatttacgccaaataaatagggtcaaagactctgccgaggaaaaaaaaaaggtttcatcataaacgccaccctccacattaatggaatagctgagaccacggtaaaatcgtccttggattaatcgatgacagcctaagatttctgtaagagattacaatttagaactgtagtactcgattatagtttattgctttgcaacttcttccaaaaaaaaaagaaattcgcagcggtatacgcccgaaacagcaattcacctacgaatcgtaaaaagaagaagcactggaaatggcgatactctataagactataaccagtaatttgacccattcccctcaaaggcttctcaccttgcccaaagtatccgatcgatcgatcatatcgaggagaagcagaaaaaagattgggatcgatgataccgaggacagctcaccggagtgggaggagagtttggaggagcgcttggtgaggaggacacggagctcgccggcggcgccgcggaagaggcagatcagcacggcggccctccgagggcggaacagcagctcggccggcggcgcggccgcgtcgggcgagggggccgccgcggcggcgtacggggaggggcgcgggcggtggagcctgaggcgctggatgagcgcctggatgtcggcgccgggtgcctccatggaaggtgggatggtgagatcggtggacatggaaagctttggcacttgggtctgcgcggtcgtgtacagtgtagacggtctccatttataatacagcaatgctacgctggtgtactgtccccgtcctaaaatatgctccatcctttctaaattttctaaattgatcatcatataatcgcataaacacggatttcatcgaaatacaattaacacattatagaagaatatgtacatgctagggtgtaattcgtatgatgctttaatcgaatgcgtacatggtatcttaattgatgcgatttaaattatctttggtcttgatgcataaacatatataatgatcattttgggttagagggagtaataacttagaattggatagaaaatttactattactgtaaatatggatattcatatcttgttcggtcctagctattgatattttggatgaaggaaacacataatagaaaaacagttacaaatataaatttctcaacaatgtgatctaaatgattagaagtaaatcaagatttggtcctaatgtaccatatcatgttatgttcttaaaatatttataagaatctgtttttattttaaaaaattacaagtatatatatatatatatatatatatatatatatatatatatatatatatatatatatatatttgtatacacaggtgcacattcatctctttaaactagatgaagcccccactttgcggtgagatatatggatatatgttgaatgtcgtaaaacttatcgatggatttgatttgggtaaatattgtgaaaataacatgagaaatgataatttagcatgcttgtatcttgaggtttagaatgtactctccctccatccacaaaagttacacatatttcacatttaagtttttccaaataaattgtttctatttttagtttgtatacattcaagacttaaatgaaaagataaattaagtgtttgattagaacctaagaagttatttaaatactcattggttgcatggttgtattcactcattgattttgtaacatccaagatgatttaatttcttcttggtcttagtgataaaaataatatgtgtaacttttgtagacgggggagtaatgaattgtagatgttattattagacatgtatgttgagttttaggtgcttagtggattgacgtggcatacttatcaatagatttgatttggagtaaatattgtgaaaataatgtaagaagtgataatttggcatacttgtatgctagaggtttagaatgtaatgaattgtagatgttattgctatgcatgcatatttggttttaggtgttcggtgggttgatatgacatgcttgtatgttaatctttacgatgtagtaataactaatatgcttgtatgttgagatttagatacataatgagttgtaactttatataatgtatagaaacatacaaacacacattatctttgggcatgtttggaggagaaaaaccagcttttaggttctggttcgttttatgaattctagccttccaagaatctgaaaaagagaagattgattggagtagtttttattccgaaagaagctataggcttagttcacgatgcatatattaaatttgattaatcaagtcgcctcgccatacacatctctacgtggtcttgcatgtatttccatttctatcttgcttccgttatttacgaaaaatactctcctgtcaccaagatgctcaaccttttggacttgaaaaagggaatctcattgacatgtatcaggttctttgaaacatcaataattcagtatggattatttcttccagcggctttttcgcaagtgcccttctgaaacgcatctgtgcttgtcccaagatcgaagtgggagcagtaaataagcaattagtttttgattggttacaaacttttgtaattttttcagtgtgttttgttccctttgtaatctgtaaatattaatttatttttataaaatcacactgttgggcaaatgcctgacagtaatttacataaaaaaaataaacaaaaacattgtagcatttctctgctgttcaacctggtaggaggcacctgacactcatgcgacaacgtacttactactgagtgagcatcactgtatccaatcaaattaacccaaactaaaattgatattaaacttccaaattctgactatacaaggtctgtccagtctccagagcatgtatttttttcctgcaagtacaatttaactgtatgtattttcagaatcctgattccatataattcgacttttgctacatattgcattgaattttttttagaacagaatgagcatcggagtttctaaagactgacgctaatcaaaacaaaatatattacataatgaaataaaaaaatgataaagaaaaggtcgctttgcgtttatcttcttggactgacattggtccatattttcattgcgagtgcttaacttggccaatatttccattatttactctatcacaaaacacaccaaaagacacgcaacatatatgtatccacatcctatagtttagtttccacattctcagcagttctgctgcaaacccgtacatctatctggatctgcctgaccacattgtcactacttgctcccccatattctaatgatgtaatatctttatttctaattctctccaccgtactgctacatcacatgagtatgatatctgaaatccatatataattgcaactggttggattgttttctatgcttaaaagaatagccaagcaccaggcttttctgcagaaatgctgacgagtgatgtagcagggaatctcagaaaatcagactatgacaatttttttcatcatcaattatacagtttaaacaatagtttactgttcaacataccagcaggataaggccatctcgcatttaatagcaattaaaagatcagcctgaagataacggattcacaaattggttaactagtgcaggtagtggactagtgatacacaaagaacaccatactgtcatatttgtctcaattttaattttgaaattttgcaagaagcattcataaaaaatcaatcacaggataaccaaaggtgccctgcagcaggcctagtgaacaatagaagtaacagcaggagctacaagagaaaatgtataagaagatccaccacagcccccagcgcacaggtaaggaatagctgttattcttaattactagaaaagataagcatatgcttcacattacttgcttgaaaataacagatatgagcatttgtgaataagcatcaagtgctaaaagacgacctttgtaagctctagttgcatatataggatgaataaacatgtacgtgtacctgccagatttcttcatccataagagaataatccggcacatgttgtcctatacgacaataatgcatcattcctgaatgccctgaaaaacatctgagatggcagaccatttggaatatctgatagacatgtcaaggatccacatgcagcatcattaccctttgctggggacaaaaagcaagcaatgtgtgaaagaattttaatacgaatataacataactcagaaaagaagatagagcaatatatttccttaccatttggtcttgggtgactcaaggatataggcaagctaaaaaacaaaaatatttccttggtaagttgcccagaaactaaattaaagctcttgatagtactatttaaatatgctaggtgcaaagaaatacacaaaattctaaccaaataaatggtcagaaaaataatatttgtgatatatgtttacttaaggaataacactatctggatgagaacatatcgtacacaatagtggactatcaaaattcaagttcatatgccactggaagttatcatgagaatatcttcatcttcacaattagaaagcatctgctctacttgaagcaacacccttaacatctcatagatctcatccatctttgggtgtgatttatcctctgcattgaaagaatgcacctcattcttcacctcaatccagctccacccagggactttgcttaatcctcgtttcttcattaccctctgcactgttgccctatcactccacatcccaagaccagaatacatgctggacaggagaacataggtagagtgctgtctaggttctgccacaaatagatggctggccacatcgcttgctagttccacattcccatggattctgcaagcacccaatagggtcatccataccatggcatctggttcaaatggcatagaatcaattagcttttttgctttatcaagctgtccagccctcccatacagatcaacaccacatgcatagtgctccattcgaagaggaactccatacttagtttccattgtattgagaatctctgacccttcatctacaagaccagcatgactgcaggaagtaattaggccaacaaacgttatgtgatccaaaggagccttacgttgcagcatctcattgaaaagtatgtctacgttttcagcttgtccatgttgtgcataaccaaatatcatagcattccaaggcactgaactactcttatctgcctcctcaaaagatttccgtgcatcgtcaataatgccactcttagagtacatgaagattagcgagctggaaacaaaatcattggaagcaaaaccagaatggatgactaaaccatgtatttgtttacctaactgaagcacagcaagttcagaagaggaccgcagagccgcagaaaatgcatactcatcggttctaacattttccgaacacatacatctgaagaacttcaaggcatcggcactcaaaccgtgctgtgaatatccagtcagcatagaattccaggacactgtgtccttaagcaccaaagagttaaaacacttgtatgcatcttccatcatgcaattctcattgtacctagtgtacatggcaatcagagcattacaaacaggcgtgactccttccagagcactcttgatcaccaacccatgaattactctcccttgatgatcatcatgcccatgctctgaacatgaacttatgatacttgtgaaactatacatgtcaggatgaactccactctcttgcatcatcctaacaaagaatttcatcgcctcgtcgtccattccattgtgagtgtaagctccaagcatcgcattccatgagatcaaatccctaatgtccccaattccatcaaagatccttctagagtctttcagggacccacattgtgaatatgcagtgattgctgcattcaacactgtcagccctaacgcagatccatacttcacaatcttcccatgcaactggtgcatcaagaaacagcttgggccctcaactgctgtgagcagcgacgcaaatgttgcttcatctggagccaaaccttctctttccatctcaagaaacagctcagtgcagatgccatgtccccagattcagtatacccggcaatgagtgcattccaagaaacagtgttccgctctggcattccatcaaacacctgtcgggcatccctcacgcggccacatttagcatacacatcaagtaatgcacttgccgcgaacacattgttggcaaggccggatttcaaagcgagcgactgcagttgggcgccgatggcaggacgccgcgctacggcggcggagcggagggccgagccgagggcgaacgtgttggaagcgagcccctgcgcgtgcatggcccggaggaggcgccatgcttccgggtgcgcgccggacgcggcttgcgcggcgaggagcgcgttccaggagacctcgtcgcggcggggcacctcgtcgaacacccggcgcgcggcggcgaggccatcgggggaggagcgggagtaggcggtgaggagctggttccagggcgtgggggcggcgacgccggacttgaggagggaggcgtgggacctcgcggcggcgacggcgaggtggtggtggcgcatgcgcagcggcggcggcgtctatggccgcggggcattcgcggaggtccggtatctatggacttgccgattctttgggtcgcggaagtagcggccggagcggcaccaacctcacctccgttcgccggaaatccccagccccagctagtcagctacctccctccgctctccatggcggctgggttgaatcgtcgaagagcaacggaggaggaaggaggaggaggagccatggcggctgggaagaagaagaagaagatggccgacaccatgctgggccgcgttgggctaacctcttggctatcttgttaaattggagatatttaaccatttgccacatttagatgtggcaattaactttttgtcactgtacccatatgtcatagacacatgtggacccatatgttattgagatagaggtgggaaatagttatttgccaaatctaaaagtagcaaatagttaaaagccccgttaaattggtggcccattaaagctgaacaatagagcacgaaaaatggaacgagcaactagcgcatgattacgtgaattatttattattattaacttcataaataagggagttgaaaaaacgaaacgaggaaaataacgtgtcataatttaatgagaaaattacttatgtaattgtgagttcttattcaatccattataagctcagaactatactctatatctcatcctcctctgcacgcctctaggttttcattttgaattttcattttgattccctctatatccatttcgctagttgacatggccgtgaattaacagttaacttattttttaaaatgactgtattgtcactgaatggtatagtcatactcttcaattccctgtatttcactagttgtcctatttgattatatagtatttttagcattgagatttatgtttctaagtaggtagcacataagatctataagttgtataagtacgagcgacaaacagtatagctagccatttcagaaaaatctaatagccaactcataatcaactaaacagtatagatatagagggaattgaaatgaaaaaaaaaggaagaaatgaggcaaaattcataggtatagataggattgtgaaacacttggggacatattttctcaattctaaatggggaaaattatgtttagagcacaagtagggtccaaatcagaaaataccataaaagtatcccattattgcctcataccacagtccgcactacaatattcagtttataccatgaccatggtcgaaaataccctcgcgtcaagtgcagttgcccaaacctaaatgtagtggagttaaaaaaaagcaggggaaggggggagggagtaaaaattcatacgaaataatatcctggattctccttacgaaaaaaaatcgtgaatatatctttttttaataatttacatttatatacacgaacgagaagaatttgcttaaatataccaatcccctaggatgaaaacgtgggactaatgtttgccgtagcgcaaaaacgcgggaccgataatctcgcgggatggtcgcacatcaccggccatggcatgcgttgggtgggcatatataatactgtttagcgctgttaatacactgtttggacattatttaccactgtttattactgttcacagagccagtaccgcgcagcgggacaggttggtaccgtgttttttgagcctccggactgtctcggtactatgtagtaccgctagccaccacagtgccgcatttttgagattcgggaccgttgcggtgttgcacgaccatcctgcaatacagtcggtcacgcgtttttgcgctgtggccatcctgcaatacagttggtcacgcgtttttgtgctgtggcaaacattcggtccctcattttcaccctgtggtacgggtatatttatgcaattttccgtgccggtatataaacttaaattattaaaagaataagtatattcgcaaatttctttcttctccttacaacacgatttaatagccctctcgtagttcacatcaatttgatattctttctcaattactgttgtccgccttttttcacctctttccggatgtgttatatgactttttgatggacatggtcccaaccacttttttttttcagcggcatatatgtcgcactaagctcatctttctcatcttgaatctaccgaagaacataattgttcaccttgtagcaaccttgatgtccaagagcgaagactcatgattactatcgcccaacgaaatgctaggcgtgtgcctgaggagggatgccacaatcatatcatagggcctggtcgacatgaatgacaatcacggctcatcgtatattagtatatattcatatgaacgtgtgtcggctttatggccacgagaataggcaagcaacaataataggaggaggagcaaccaatctcagtccaaggtgaattaagaggagccgaggagtatttgcaataattgttttatagggaggaatcttaaatacatggcgatattttgggtggttttttgcaaatatttttttataaaaaaaatggatcgaaaagcgtcacgaggagcacaattgaaaacccaagctattcactcgataatcaaagatccctatcctcctttcccaagagcactgatagcttcacactagctcgtagagatgagaaagtcagagcacgggtagcctcacaatgacttgcattagatgagaaggtgaattataatagtgatatctaggtagggtaccatcgataattttagattcgtgtataaaagtcgactctaacagaagacacatctgttactgtggatggaggtggaataataaagtataaaccaaagaaagttgtgtaagctgcggtataagacgaccctgagattccgaaccatgattttgtttcctgcctgtgctacactgaacttttcctttaatttgatggctcaatcgaaaccaccgaagagcaagcaagtataagcttagactaaaccgagagttaaataataagtaaataaattaggaggcaatgcagtaaattacttaagtatatatcaaccacctaaacagctaaatcctatcagtgctaaataagtactagtaactaacacacgacgatagttaatgacaaatgcctaaattatatcaatctttgataccctagttgtcaaaagcccaagcgttctccttacggacct

SEQ ID NO: 65613 - DNA, 1656 bp, Oryza sativa
  unsure (1)..(1656): unsure at all n locations
tgagaatggtaagctcattttacctctttttcgctgcccgagtggatcgcaagttgtattgcgtgggttgcgtcccctgaggcgcgtcgggaagctgtgacatgtctatctcctcggcgtctggtgcgacgtagtcctcatcctcctcgtcctcatcgtcatcgtcgtcgctaggtggagccggcgccttcccctttcccctcccttgcttaatgcgtgacgacgacgagccaccaactccttcacgctcttctatcctgatggagtgtcgagcagtacttggacgcgcggattgaggtagtggtggtggtagtctccccggttggtacacgtcgtccaatccaaccgacctgcaacctaatcttgctgcaagtttccggcacctttgacgaactttctgcattgcaaaaaaaaaaagaagtttgttaggcatatctcaagtaatgcaaagtgctaaataaattttacctctaaaacattgcggagcgtgttctccgtgtcctcaccacccctcggagcttggagggcatgccccatttcattcacactcctgaggagctctctcgactgaaagcgtgaaaagatatatgttagggtctagggtgcaaatggaagtaactttgacaaatgcaagaaaacttacgactctgtctctaagtggggcgtgctccatttgatatccaactgtagtccggacatcatagggattccgcccctcatcggagtcgcggtcatcctctatgtcggcttccgtccaagtagggcggaggaacagtctatatgtcctatgcagccaacgaaggtactctgagaaaagatgattttggtgtatagtctcgatgtacctatcgtccttccggctgttctccattcatcaatgtatctattatgctctagcccccagtctttcaccttctttgttctcaccctgtcatacctagacaagtagaaggtgatgaaacagtagtgagcatcgacaagggttaaatggtacaaaattgaacattgacaatgaaagcaaacaaagataagaaatatttacttgtgtaattcaactccagttgagatgtcctcaaccggccaatcttgtttcttcccgaactgtcgcatgacacggtgcggaaggtggtactcaactgcccagaaacaaatcaatgggcactggtacatgaaatagtcagagtctcgattgcacatcgagttcagggtcaggcttgaagcctcatttgtgtggtatggtaaccactcaatctgcaaaagttgaagagatgtcgttggttagtatctcaattaaagaagtaaatgtctaactagaagtgatattggaagtacttacatgttgaggctgcaagcagtccatctcattgacataatacttgtatgccacatcccggtgagcatgtgcagtggcagtactctcaaaaaggtaggccactgtcttctccatgtctggctcattgtagggccaaggagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 65614 - DNA, 15790 bp, Oryza sativa
  unsure (1)..(15790): unsure at all n locations
ttcggaccaccaatccacctgaagttgaaagattcacaatgttaataggatttcaagtttccagagttgatagcacatggatcatgcaatcaatggtactgaccagactgagcttcagaaacaccttcctcagaacaggtgagtggttgacatattggcgtagaggcaagaaattatcggccatgcaccattcacccaagcgcaaggttctgagattcctaaacatcggcctacttccttgttgttccatgaatgtaaacttcatatgtgcaaagcaaaaaattacaagtatgctatgaataccaataatttgtggcaaaactgtgataaataagagaatatntctcctcctcgggttatatttatatatacaacacctcacaaatatgtggtcaaggtaaaagtggtatatacattttttaaaaaagaaaagtggtacataccaattttttgaaaacccaaagtgtattatacattttgttttgaaaaggcaaaatggtatatacatttttttgaaaaggcaaagtgctttataanattttttggataaccaaatggtatatgcatataatccaaaatgatggttcatgctttccttgctatgaaataaatactcactatattattttctaaataatatagcaatttcattcacgtaagtatggtcacataaaaattgtatgatgtttatggaagtaataaaatgtctgcaaaaagggattagtgatacctgtctatcagtagctgtcaactctatgcttgtgacatctgaagcatcaacgagagtgattgttgtgaatgtcaggtaagagtttgtaaatgaaaaactgcccgtttgttgacccttgatgcacaacgagaccaaactcggagtacagatgcttacattatccagaagagagcaaccgatcaaatccaaattttgtagtgaacttgaagaaatgtgttgcacctccattaaacactcttttagtaccagattttccaaaaccgggcatgcgttattgagacgatcaaataccatctcatttagagctgcattagtcagctccaatgtttttagataccgagaactgaactccacaagttctggatccaagtaaaaaggttcccaacttggatactcagaaaatttaactactttagcgttgtgcttgatagcatggttgatccaagaaccggcccggtccactgcaaaagaatctagctggaatgtatccatagaagcatcaagatggtcgcggcttagcaatagtttgtcaatagaactacggaatttttccctatctaggcgaaaccaatttatatcaagctttattgactgcaagcaagtccacttgttgacccaccagtgggacaggacactcgtgcgcaccgcctccttcatcgacaagaaggacattatgtggtggatcagatcatttgggagttcgctgatcctatcttttccatggggatgggagggttccttgtggcctgcagtttagaactggatactgagttacttaaattcagtgtgaacaagttttgacattgattcagtacatgcttcttagtgtaggtacatgatcttggagaaccacacaaacaactcacaacaaatttacaatttctgtgtgggcttaaatctagattcacagagatattgctatcttaaatacactttacataaatgataaaacattgccctagtagctttgagtttttcgtttttttttaaagaaaaaagtaaggaggtgaggctcacacatcaatcatgtgttgcaccagaataacaaatattctcgattttgcaccaaaattaccaatgtgtaaaggatgaaaacatgaaaaatgctttaactcaaacatgggatcgggttgtgtatttacaaattttattctcatatatttttcatgtatcaacctgtctagaagattataatcatgtgtagactatggagaaaatacatcatgtaggcaacataaaaaaaaagaacatactggtgttcaaattttcaagaacttactgctagatgatgtcccctgaacatttccttctgcctggataatttggccctgcttattcttctgatggagcaagaaaaatgaagaggttgaagcttgctgatgaatatgcagaaaattgttcaacatcagaggatatgaatcatccaaatcgccttttatcagactaatcctccgtagataatcaccctatgtagtgcgagaaagaaaaatcatcagaacttttatttaaacataaaatcctatattgaaccataactttataataccagcgaaaacatacaaagttagcaaagagagtgttccacaatctggcaagccaagaataagtgcaaatattattgaatggagaatgaacctaaacaaagtactttctatatgaggataaaatcaatatattatagattttttctagagatgcacatatataagtcaaaaaaacagaaaaggatgatttttgtcaactatataaaaagtgaatcgaaaggggaacataaataattggaattgtttatgaacgatcacttcaattaaatacaacatcaatcctagtggcttctgcgccacagtaaaggaagagtaataaacatttttaattagatgcagaatttgcatagaacatcttgcaaccatatgttttcaagtaagatggtcatcctaacggcctcacacaattgttatagctctaagtagttctagacttctcggcaataagttattgtacttgtttaggagctttaaggttaacactattaaggtgttactattaaggttaacactattacgcgcattaacagacataaaaataaaatttaatacctaaggaaatttgattgcataaaaaactattaagaacaaaccatcgtacaaagtcaatagctattttgtagattctctcctctattctagcagcaactttttgaagatcaatcaatgttgtagaagtagttgtttgcaatttcatctgcaggctgaacaatctgcaagcagaataccaaatattaatacaacatatttaatatttcactatggtacttcactgtttaatattaatccaaaatgtggccagtcaagaaatacatgcatgctatatattcactgtttgagaaatgcatgtttgtgaaagtaacatgtttggaattgtagatacattctcataaatactgaaatatcatttgtccaaccaaaagtgtcatattttagcaaatttgtgccatcatgtatgctaagagtttggaggagagcattcataaccaataataaggaggaattatgtatacgacaaacaaaacaagatggatgtgtgaacatgggaccatctttcttgtaagttttaccacctacatccacccccccccccaaaaaaaaaaaagaaagaaagaaagaaagaaaaagcacctaaacctataagtgatatctaccaacagatttttgcttttttctggagtagctgcatcatctcatatatttttcattgtgtaaggtggactcagttacacaattgcagaaccaacagtccaacaccatgacttctccagttcttcctcctccctcaaggtgggaacatgaatcaccttaagggttttaacacctactccaaattaaatatgctagccaaaaaatttgaaagacagaacaaattaggagcagaactaaaacactagtccataaagcttatacccatgcaccatgcaaggaactggccacataatttagtacggaactattgacatgcaaacttagttcattttcttttggcgatgattcatttactagggtaattttctaaatatgaaacaacttaccttttatacttggatacgatcaaaatacaaaggtttgagtccaatcaacaacgttttgcccagaacaacaatgatttttaggtgatttgggcatatggcagagttagagccggagttgaaccaaacaatactagatcctcagttttctaaaagtgaagtgcgtggatctgctccacaagatatgcagaaagggtggagctacctttttttggatccagaacttcagctacatattagatttgtagctctaccaaacaaatctaactgttacttaaatctagaaaacatcagattggatctgactaccgatatgatgattcagttagatcattaacaagtatagcatggatgacgatttccaatcttgataataaactatcatcaattcaaaactttgtaatcaatttctcatggaaaaaaaagtaagaataggggaagagagagacgaggagggggcacttacatatcacgttttaccctatcgcgaatatcctggccaaggcgggtcctccaatcgacaccttcctcgatgatccctaactcgtccattatgccgattaactcaaatctttgcttctttgctttcgttaggcagaagaagtgctcagagatggcgaagaacaacaagaggtcgatgatataggcagaattgaaccttataggctttagttgttggtgggatccacaaaagaagtaacgcttccgtgggagaagggtatagctcacatgacatgacaaaattacttataacacgggagaaggatatggcccacatgacttgacaacatcacctagcttataacatgtgaggtagcttctagaacctcaatagagacctatacaaaataaaattgtggcaattgacttccaatatctagggttaaaaaaatcgaaaccgaaaatcaaacccaaaataaccaagacaaaaccaaaaaaactgaagcactggtcaatgttcccgacgtcggtctcaggtttgcaaaggccaattcttatttcagtttatttggtctttgtatggggtatccggactacccattctatttacgcgttatccgaatccactccttattcctcagcacatccttgtgcagttgcgctccgtcaactgccgtagccgacacccttcctccattctggtgcttctctccctcttcttcccgccttagaatttcggccgggcccacttacatccggcagctttcataggtcatagactgccctttacgcgttatccgaatccactccttattcctcagcacatccttgtgcagttgcgctccgtcaactgccgtagccgacacccttcctccattccggtgcttctctccctcttcttcccgccttagaatttcggccgggcccacttacatccggcagctttcataggtcatagattgccctttacgtgttatccgaatccactccttattccttagcacatccttgtgcagttgcgctccgtcaactgccgtagccgacacccttcctccattctggtgctttgcgcactctggcagtgcagttgcgctccgtcaactgccgtagccgacacccctcctccattccggtgcttctctccctcttcttcccgtcttagaattttggccgggcccacttacatctggcagctttcataggtcatagactgcccccacagaccaacacaagtcttttctgcacactttgtcctcattcatgcgcacccgggaagaatttccgagtcggtcacccatcccaaattgctccaggccaagcacgcttaaccttggagttctttagagatcggctttcggaaaaaaagttgcaacttgttaatatcagtatcctattaatcctattaagccctaggtcggaatgttacaacatggttctcatcccatctatgcatccacctccacttctagtcgggataccctcctcaggccgccatgcatctacagtaaggtggaaatggtgggggagaactgaagctaagggtgtagcagctggtaggttatggccacgatggtgcctctccggggacatgttgcagcttgcaagggcctatcccctccgtgtaattcgcatcttcacactgctactagcaaaggctgccaatagcggccatctcctctgaggagagttggaagtccacatgaaagttgagaaccacatctggacccatctacatgtaagtgtgcggtttgcctgcatgcagtcctacatgggagatgagtgttctattctggtcggtcataccaagaacagagaccaaactatttgttaaccgaatagtcgattcacacatttgtgctgacaagtgatcagtcttccattttcaaacaccaaaaagactggactgaattatcagtcatgacggaacactcacccctagcaatatctatcaagaagcagttgtattataaagtggatcttatatgatagtacgatgtggtgatttaaaaaaaaaaggaaaagattgggattaatttatccctaaaggtatttctcggaaatgtgtttaacccggagctaaaagcgggacgtttccacccaaagaatagctagtgtcgccatggttggccaccccaacacgccatagttggcgtcacgtcttcatttgcatgtgcaacgtacgttggcattaagctgtctacaagctgactcaaaatcatcatccaggttgacatgcacaacgttgccatagtgaatatagatctactactagtagtagtgttattctcctatatatacctctctccaaaaaaccagtcgaaattgaactagaaagaccgacacgatgtgcatgcaaacgaatgttcagcagccgctcccctagcacatactgtacgtggatgccacattataagggataccaccaactagtttggatagacccagtttttaaaaggagttcagggtgaaatttggactatgattaatgtgtagtgacgcacctcagactaccattgtgaaaagtcatatgtaatcctgtcaaagaaaatgcagatagaaacttcataggtacagtcatctggaggagttggtttgctggctagatgccctcgctttaaagcttttaaaatcaaatcacttagaagccccaaaacaaacagagacatatccctactattataaaaattgaagatgtttttaccagaattttaataagtcatccgtatttgaatcggttttatctatatatttacctattataaaactgaagatgattccgtactcataggtagtttcgtccatcctggtcatgctggttctgtccgattgagttcctattgatcattccttttttttccaacatgagcgttgaatctgcatcggcggcgagcaaactagagcccatatagcttccggtatttttttatccttttttcgctgtttctttatcacactttcgggttttttttctttcgtttttctcgcatctcgccctttttttatctcgtccgatccatctcacgtgcatcccgccaccgccgagacataccctcagcgctgatttttgaaagaaacggaaagaggtgatcgagtggatttgaggggaggattggctcaggcatacagtcacataactgccaccgccaagacaaaccttagcgccgccattcgattttgggaaaaacagaaagagcagatcgagtggattaatagcccttaaccaattttgggagatcaagaaagatttggatgaatttgaggggacaattttgggagatcaagaaagatttggctggatttgaggggaggattggctcatatgaccatcttccgaggttaaagacgactgtcgatgtgtgagcggggtttgtggcctcacttgtgggctaagctcgagaggagagagagagagggagagagaggggggtagtggactgggtggggctaaaaagaaagaaaagaatgggctttcagcccaaaaccaagaatgaatttttattaactttttcaattatgattatacagcggttctaatggttcaatttattggcaagcttccaatagttgttgtatccctgaaaaacggtttctccgttgctacgcacgggcatttttctagtatctatactaatatataaaacgcaagttgtttcttccctacatccacccaagaaagtgtacccataagtttcctagctgttggatcctctaatctaacgatgtacattgccgattggattaacactgtgattagtgtcggattaacaccaattagtgcttcgccaatccttctcttcgctaaaaaaaacggtcgcccgtgtctccacccagaccacccgcccctccacatcccccccaccgccgtccgccctccaccccacccgcacatcccagccacccgccctccatcctcgtttcttaatttctctatttatcttgttttcttccacatttacatatccaaagtggaattcttaggttggacaataccacactttgctaccgtctgcctttgcagggcaggagagaggagggtcagcattctaatggacgaggaggatgcagaccactgccgacatggcgaaggggctcgacttcctcctttgcgcttagatgctggccatctaccaacttcaatccatctaacatcctcctcgactcggtgagagctagcctgtcactttgctcaactgcagtacaattttcagtcattgaccaacatactcttagtactgtcacctattgttgacgcaaaaaacacacactaatcagcacatcaggaactatcttcttgatcacatcttgtagtgtactcatcaaaaccccagactgattctagtaaaaaaaaaacccagactgatcaaacaaggcatgatgaaatgtttcatcaactttatcttgagatgtttcaaccatcggcttaggagattgtcccttgttggcattgacttcctcttcagacatgttgggtataaaacacgtgtcccactgggcgtgccaaaaatgcgttgacgcaaaaaacacacactggcttgggagacctgcttagctctagtgcaggtccaaaggttgatgagatgcagacgtgccagttagtttgaccctgcaactgacaagatatacaaatagcagatcaataagccgatcggctgacaagccgatggagtagttccagcccatgccgatacaagccgatagcgagagggtttcgaggtatcggctatgtgtttgatgtggagtctgacacttgatgtaaataacaacataaaggcaatcggttgatgataatgaaagaaagcaacaatataatccagtagaaaccaatcggctaacaatgacatgatagaataagcactaatccgaaggttaaagcatacatctgctggagatccgatgtcataaaatccacaagattagataaacaataaagtctttgttgtcatcgtctaaatccaatctatatgcaatccttgtaagccgatgcaacgtacagatacctcatcgactgaaaccccgatgaaacccttattgggaatcatgtatcattcttagactatagcaattcagtattttggctgctgatgaaatcattcttgactgaacatgtgatcagtagcatttgtggaaacttgagaataaaacttcagtcaactgcatattgtttgcacaactctaattataatttttcctatcatttgcatgagtttgggtgtacttatttgtttgtgcaaatttaatgcatttttaacattatctgtctgaataatgataccgtcagaaaaattagaacttatactccatttgatatattatgctaacatacatgggttccacatgcacacacaactatgtaattaatgaaaataataaaaaactaacaatttctaccctttcctttctccattaatattaaattatctctttactgtccgattgctacaatatttttatatgtattaccaaataatggataaacatagataatatattttgagaaagtagcatgttttatttgatagtatgatgaaccctgagctccactcgagacactcaaggctgttgttggcctgatctttcgatgagttgatgataactacgatttgggagaaatggtgatgacccgactacaaccgtactagacattgttgtgttgcgccttagcgatcgatacacctcttcgtgagttgttgatcttgccggtgcaaatcaaccttattactgcaaacaaatcgaagaaacaagcaagaacaagataaaagaaatccgaaatgcaaataggaattgagtacaaatgataagttggggttccgtaatgagtaaaccggcgatctaaccgatcacgggattatatggcaaagtagcaaagctaaactttaactaaacaaaacccaagaaaccctggagggatacctagctatttataggggtgggagaacgaccaagggtgccctagggttgttctccaccaggttggggcacaccccacatgggccccacttgagtcggggtcccagacaaagttacaagcccataggccctttataggtgacgcaacatcttgtttcttcaattgcagctcactaagacagaatttcgcaatgagattggatccattagaaagaggcctcggagagctttccatcaagtactcgcggaccaaaaacagagctcgtatgcatatttggcggccgtttgaagttagcaatgtagtaggtggccgaatcgaattccagcacatggaggacttgatcttaatgtcttcttgttgatccatgatatgagcaatggttgtatccatagttgccatgatcacatcatagttcagcacctgtaccaagtcaaagcatacacaacaagcattcttgatttggtttgcgtattttgcaaacaacgttgaaaggctaacttaataaaactttattctaaggtcaaaacatagtagacctaatcatggcttaggcagtttgcatctcttgacgatgttatcttcatagttcttcatttctccctaggaattgactggctgatggagctccctcatcgtcacgatcacatccgtcgcgtatatactgaaagggaactctaacagctctctcctaattgattggttcatagaactcactcttggtcacttgttgtggtggtggatccacttcatcgtcaatcgattcatacgatgccatgagtattgcagcactagtgagtctcgtgggcttatacaacgaaggaggacgtgtgggagtaaggagatgatttgataatatatttatcggcagatgggtacaatgagtcaacgatttttggatgattcacttgcatgtaggaggaaatgacatcacataccatatcattcacaaatattgtcggtgatatgggccagggggtacctggtctaaggggaaggaaagcccttcctgtgtggcgcgcacagcgggcccggtccccctcagggggtcacgccttcgattgggaagcggctgcctgtcccccctcccctcccccgggctcggggtacctcgtcgtacccctcgggcccgaggggttgaaccgcccctgaggccctcgctcggccgccacgtggtgaccacgcaggagcctcgagcaggcgtgagcgctgtccaccaggcgcatttatgagcggcgcgccaaccgccccggtcgcatttaatgcgacgtggcagggcatgcgccgttcaccgatggacgtgcgcctagcgaccgccttttgaccggtctgtgacccggtgatggatggatgggacgggcgacagcgcacccacgtcccgattcgtgtcaggcggcgtgggagcaggtatgccctgtcccatcatgcgcagtgggaggtcctgcaggtcgtcatctccgatgaacgtgtgcccatgaagtcaccaaacatttaatagcgaatgatggggggtgccccccgtgtcagccgtaaagttccggtgggggccacccaaggttagccgcatggattgcttccggcccaaggcacaagatgcattttaatataggcattgtgggccccactcccgtgagaagagagcaggggcgatgcatgtggtatccccttcatctataaaaggaggaccatgccctacgagaaaaggggacgtctcttagaaacccaggtttagggaagaggctggctaagccctagcttgtactcccaggatctgaagtctttgtaaccccacgaagatcatcacacacagacaggagtagggtgttacgattgatagcggcccgaacctgtataaaccctctatgtcaccctctcactttccacctcgagagcttgattcctgtagactcgcctcgctcggacgagtacacgttcctcagcattgcacccagtcccctggccgaactcacaaggggggcctcatagcctcccgctagagaggatcacccctcgacaaatatatatttacattgttttcatcttgcttttcagtgagaaattacggcatggctaactcctatgatctgttagcaattgttgttcatggagttgaaaaatggacatggtagcctcagaagaaatgaaaaaatatctataattttttttttttgcactatgtgaccaatagttttacatacgtgttaaaaagtcacatgtttgacataaaaaaattcaaataaaattaccccgcatatcaagtcaacttttttacaaatttggcatacaataaattttggaatatataaaagaaaaaagtacgaattaccccccctggtctatcacggtcgatcgaattaccccccctgaactacaaaaccggacatccttcaccgcgaactatgcaaaccggacaaataacccccctggctcaatccgcagtggttttcgtcctacgtagcagtacagtcagcaattttattttgttttaaataaatcaatgggccccactgtcagtttcaccctctctacctctccctatcatatctctttccccaatccccctctctcttctccctcccctcaactccagcactcaacggtggtggtgagccgaggacggcggcgaagaagctgggtgctgcggaggggggccaaggacgttgcgggtagttggcgcggacgtcgcgctccacctccgcctccaccgtcggtcgcccaagctcgccgtctccactgcgaccactcgagctcgctcctccaccgtcagcggccgcccgagctcgctccgcgtccgcctacaccataagccactagagctaccggtcgttgaggtaagctccacgtggatccagccaccttgaggtcaagcggcaccacggtggttgggggtggcaacagcgagaaggaggttggggacagggatgacgctggggagattgggcggcggcggcgatttcgcatagagacaccggtggattcgtgcaaacgacgcgctccgcctctacctccacctacaccgtcggccgtccgagcttgccgcctccaccgtgaccacctgagctcgtttcgccaccggcggcagcctcccgagctcactcctccaccgcctccaccgccggccactcgagctcgctctgccactgtcgccacccagcccagcgaggtccacctccaccgctggccacctgagaaagagagagagagagcgcacaagggggacttggagggatttgattgaggaatatgtatgacttgtgggcccagggaatttttttttattttatttgctgactagattccacgttggcgccacgtgtacaagctcaactctaaaccgctatgaacaatgctcaaaggggttatttgtccggtatgaatacttgagggtgtaaaatatctggttttgtggtttagggggtaattcgatcgaccgtggtagttcgtggaggggggtatatcatactttttcctttataaaaaaatatttattaagattggatgatggatacacatctctactacacattttcctttaaaaatcatttttttaaagtcacatgaaaagaaataggtccaatcagaaaaatctctatttttaaagagttccattcgcatggcaacatgcatgcggagatggatggaaggaataattccaatcttacgtgacaatatgcatgcggaataattctaacttgtatggttgatagcgtgcatgcatgcagagatgaatggagtgaattagtctccaactaatatcttttctcctttttgcgctccaacaagcaccgctgtctataaataaccggtgttgggtgaagcctacaattaaaataccagaaatgctcatactatcgtcaacctccaatagtaccctacctttgtgagctggtaaggtgctattatcctttcctttgcttttttttttcatttttagttcacattcctgcatgtatcattgtgttcatacaaatatttgtagaaaccaatcagtttcaccttccagcaagttcaagatgtcgggttctatggggagtaagtcaggtagcgggagaggcagcggtaccaccagcaacaaagttcagtgaacaggtaaatgaaccaacagtgaacatggactccatagatgatgtataacctcctacaaatctaaacacaaagagagaacaccgtcaatacatgaaacaacatagacctgtcagaatcctttttgactatatgtacgatagtaaccatcatgttgagagtgacacggaaaaaatacaagtgcaagtatgaacacttcaaggaggaatttactcggcatatgcacaaagtaaaggctacaatcaaaccaagttggccatcatggatacattctattagatagaactctttcttttttactcccctttctttctccctccctctcttgtattctctcacttatgtacatattattatttattaatatagcacaataggagcctctcctgctgtttaaccgtaaaaaaaaacactcgtcatcacttgtggccgatcttatccattgcgtataacagcacttgtcaacactcgtctaacaactctctctgaattgattggttgatggagctctctcttggtcacttgctgtggcggtggatccaattcttcatcaacagatttataagatgccattagtatttcatcaactcatgggcttatacaacgaaggtggatcgtctgttaggagagaggtgaggagagggaggattgtgtggaagtaaggagataatttgaggatatatttatcgacagatgggtacaaggtgttaatgaattttgatgattcatttgcatgttggaggagataatcatgacaaaactaggtgggactcgcatgtaaatagacacactccaatagaaatacaatacttataagcatgccactatgcaacagaattgaatgagctgtcactcattctcaccccatcactaatttatcacattatatcagcactagaatttaatattaaaatttataaacattattgagatttgataatggataaacatagaaaatatatttctggacatcagttaccatattgttcacaaatatatattcacattgtttttgtcttgcttgtcagtgagaggttacgatgcggataactgtcagaccctaaaaaccgctaaattataaattgttgtgaaaaagaaatttctaggtatttttttaataattaaagtaagtgttgagctagataaaacttctcttaaatactttgagtgttcatgtattttctatattcttcccgtaattttttgagctttggaagtatatttaataagtgaaacaacatttcaacatttatttaaattaataaggaattaaaatctttcttccttccctcgggccaaatccggctcactcctctcctgtctaccttcctcagcccgcagcccgcgcccctctctctcgtccggcctagagagaaagaaaagtctcctttgcaaccctctacctcccttctctctgacgcttcgggtccactcggcacagtgccgtcttcctcctccagccagcctcactccccgtgcccgtgcgttgcaacacagtctcctccaccaaatccgcccgcgccgttgctcctcatccaaaattgatcacgga

SEQ ID NO: 65615 - DNA, 4384 bp, Oryza sativa
aacgaacccgagcgccgctgcctcccgtcgacctccagccgtcacccaccgttgttcccgccattccgaacctttgccgtcgccatccccgtcatcgcagcgccgaggagaagcccgtctaccccttcgatgccgcggcccgtcgccggaaagccgccgcctgcgccgacccgagctcgccgccctttggagctcgccgccggtgtctcccttcgccatgtgtcatcgtgtaagtagtggtaaggatcgcctcggtcccttcttcctccccgtgccctctgtttccgccggagcaccaccgttcgccggcgaccctcggttcctaagccggcccgcgtcgatcccgcatggcttccacgtcgttgccaaattaccaccacctcagcgccacgtcatcattctgtccacgtgggagccgatctaaaccttggatcagcttcaatctaatcggttggatctcaatcaactggcggtcaagatcgatctgagccatccatcccgtggacccgtggaccattttgtggacttggttcatggtagcggctccatgactagtaggtcccacctgtcatcaaccttatctctcttctctcctagtgctgacgtcatattcctctacttttgcgtacaaacataattaaatatgatgcagtaaatcatttagttcgtttttatagggttttattattaaaactttagtaattcataattaattcatatgaactcggaatgagctcgttcaagtttcaattcatatgaactcggaatgagcttgttcaagtttcataattcatatatctctactcatttatgaacttcagttgtactgtttatttggtttctattagtgttttctctcgttctgtttatgaaggatcgttcgttcactggagaagttcctgaagacgaagatgcttatttgtaaggcaagtcacacagatccaaaataccctttgagaatgctgaacacatgtttaaaattctctatttcaatcaaatatgtatttattttcgaatgtcattgggtggtgagccttttttctcatattatggccgaagatgattttattatcttatgggttataatttgactaggttggaccttatatattggttcagctatatattagatgtaattgtttatccatgcttagaaacattagcacactattgggataatgaatgcttcacaattacttaatgatggctatttaatggtagctcgtgatggtaaatcatgattggttaattaaataatcgccagctaaaacctgataatggtgagttgtgagcatagtgttttggtggccatgctgatgacaattaacgaccagttcgcaaactactgttgtgataatgataatggttctgaagcatattattcctccctctccctctttcgatcttctaattggaagaacaaaagagtgggttggaattcggttctttcgagccttgcttgggctcgttctatctttgaatatagcaatttccattccacctcaatccacattcctttcatgctttgagcttccaggaaatcacggttgtgggaaaccacatcacggaagaaaacttatcattcctcatgatcccacagatcctgataagctgcctggagaatagagaaatcatccaggagaatagagaaatcatccattgctcggatagagtcaagataggaacaaagtgccctctctaaaggtagggttccatcagaagtacagctccgttcctcacgtagagagctagaaattcaagaattacatccatcctaacacttgatgtcctttcttccattaagaagagcctcagtcgcccaggtatgttctcgagagggttgatgtcattcaactactgttgatcctactcgtaaaggctcagacataagccaacgtgagcaacgtctggatgcgttgtatagcaatatggttcattgtggagtgccagactgagaagtggcagagagtccacagggttgctggggagtctatacctttaaaaagggtgactatgatccggggatagtgcattgcttttaattgtgtcatgcgaggtgtcttgtcacaatcctgtttcgaggtatcgtggtgctactgatggcatggctacatgttatgggctatgtcttgtgggtaaatttatacacctccggttatggggcgagcctaacaatgttttttcgtgattagtaccagaatattcattaaaaataataatgtgataaatgatgatgctttggtttagctcctggtttggagattgggtctgttcaaccgagcatggttgttcagatatggtggggcatatgcaacaggtatgttgtatatcattggattaataccttttaattaattactctactgttttacaaattctcaactctttgccaaatgcttcttttgcaaatgaaccctatattatgccatcctatattatcgctgtgcacttgcatacttgttgtgtgctttgtgaagtatttcatatactcgccttgcaataatcatcaaacctcacttggagacaaaggattcagaaggagaaaacctttgtcttaaatcctatttgagttgaagcttcgctagattttatttttccgctgcaattttcttcgtggtgaggactaagttattcttctgtaagtattttatcgctttacttattatgatattctgtatattaaattgtcctttcatgcacctcggctaattcctagacgaggatattaatgcataaattagttcgaaaattatttgttagcaattgttgttcatggagttgaaaaatggccttctagcctaagaagaaacgaaaaaagatttataaattcgtttttgcactacgtgaccaatagttggacatacgtgttaaaaagtcacatgtttgatattaaaaactttcaaataaaattaccccacatatcaagtcaatttttttaaaaaaaagataatacaaatttggcttacaatactatttcttttttttaatattggaatttataaataatattattaagattggataatagatacacatctctactaatataaaatttagttttttaatgtcacaatgaaaggaataggtctaataagaaaatctctatttttggaaagtttaattcgcatggcaacatgcatgcggggatggatggaaggaatgatttcaatctcccgtgcatgcggaataattctaacttgtatggttcatagcgtgcatgcatgcaaagatgaatggagataattagtccctaactaatttatcttttcgccttttgtactccaacgagtaccattggctataaataatcggtgttgggtgaaacctccaagcaaaataccagaaatcctcctactatcgtcgaccttcaaaattgtcttgcctttgtcagctaataaggcactacgatcctccactttgctatttccattttcatatttagttcacattcttgcatatatcattgtgttcacacaaatatttgtagaaaccaatcggtttcacgttccagcaagtttaagatgctggctgcactaaggagtaagtcgcgtggcgggagagggtagtggtaccaccattaacaaagtcaatgaatagataaatggaccaacagtaaacatggactccatagatgacgtagatactcgtacaaatccaaacacaaagagtgagcaacatcaatacatgaaacaacagtcttgtcagaatctttttgactatatatgtgatacctaccatcgtgttgagagtgatatggaaaaatacaagtgcaagtagtaatacataagttatacaaagataacaccacctttcaatttattaaataatagtgagatatatggtctccgcaagtaccaataaagcagtttttgttttcttaagtcttttacgtaccagtaaagaaatcttggaagtggactggattattattatgataaaattttaatttagcatgtgcaaatggtttgataaaaaatgtatcttccaatgtaatctttctaaacactgattttgttcttctataatcggacaatctcaggacaaattcaagcatatagttacctcatgacattgccccatgggacaatcataggtattgacgtgctgatgttcaaaaataatttattattatattgcttatgcttttattctttgcagattttactggggtcatagctaatgtggggccaaaggactttagtccggattggcctatgggcgtgagagatgtagcactattagatatttggtactaaagatgctcaatattctttactattatattttaataatttcatatttaagccaccaaccttattgcactttccagccatgatattggattcttttgatgcttggtgataaaggagattattaccgagat

SEQ ID NO: 65616 - DNA, 2652 bp, Oryza sativa
agcaaatctcgctaataatatcctttatcacctagcatcaaaagaaatccaatatcatagctgcaaggtgcaataagattggtggtttaagtatgaaattattaaaatataatagtaaagaatattgagcatctttagtaccaaatatctaatagtgctacatctctcacgcccataatctaagccagactgcagtccttttggccccacattagctatgaccccagcaaaatctgcaaaaattaaaagcataagcaatgtaataataaattatttttgaccatcagcacgtccatatctatgattgtcccatatggcaatgtcatgaggcaactatatgtttgaatttgtcccgagattccctgattatggaagaacaaaattagcgcttagaaagaacaaattggaagatacactttttgtcaaaccatttgcacatgctaaattaaaattgtatcataaaaataatctagtccacatgaaagatttctttattggcatgcataagactcaagaaaacaaagacggctttattggtacttgaggaggtcatatatctcactattatttaataaatttaaaggatggtgttatcttggtataacttatatattccaacatgcacttctattcttccatgtcactctcaacacgatggttggtatcatacatatagtccaaatggattctgacaattctatgttgtttcatgtattcatggttctcactctttgtgtttggatttgaaggaagttgtacatcatctagggttaattggatacatgccactgcaaatatggcaaattagaaaaatgtcactactattcatgaaatcaggtagatgccactataatctactaaaattagaaccatgccactccatcacgatttccgtcctatccatcacattttccgccgtctccgtcttcatcttctcgttgtcctcgtctcgacggcggatgggccgatcaggacggctgtgcgctggtgctgagccaaagcaaccgcacgacggcggtgagatagccggccaatagacagcatgcatggcaggcgggccaacgcagcgggccgacggcagcagcaagagccagcaaccagcaagcaacaagcacaacaagcagaagcagagcaggcaagcaatggcactatggcagcaacattgcagcattcattgatttctctggtggaagaagaaatcaagagtaggaagaaagcatgccctcgccggcggcggccgcagccgctctcgcgaccgtcctcgccagcggcggcgcccgcgcccgcgcccgcctccgtgaccgtcctcgccggcaaccgcgcccctccgcgacctccccgcgagcgtcctcgccggcggcgactgcgcccgcgcccgcctccgcgacctccccacgaacatcctcgccagcggcgcccgcgcccgcattcgcaactgtcctcggcggcgcccgcgaccgtccatgccggcagccgtgtccctccgcgacctccagcgagcatcctcaccggcggcggctgcgcccgcgcccgcctccacgagtgtcctcggcggcggccgcggccctatgcgacctccccgcgagcgtcctcgccggcagcggctgcgcccgctcccctccacgcaactgtcctcgtcactcgccttctcagcgtgcagacgcgacggaggaggatgacaacgtgagagagtaggacggaaatagtgacgggagtggcatagatccaattttaattttttttagtggcacccagacaataaggtaaataatagtggcatttttctgatttgccacatttacagtggcatggatccaattaacccccatcatctatggagtccatgttcactgttggctcatttacctgttcactgactttgttactggtggtaccactgccctctcccgccacctgacttactccccatggcagccgacatcttgaacttgctggaacgtgaaactgattgtttctacaaatatttatatgaacacaatgatacatgcaagaatgtgaattaaagatgaaaatggaaatagcaatgaggaggatcgtagtgccttatcagctgacaaaggtaggataattttggaggtcggcgatagtaggaggatttccggtatttttgttagaggcctcacccaacactggttatttataaccagtggtgctttgttggagtgcaaaaggcgtaaaaataaattagttttggactaattccctccattcatctctgcatgcatgcatgcacactataaaccgtacaaattagaattattctacatgcatataaaccgtacaaattagattggaattattccttccatccatctccgcatgcatgttgccatgcgaatgggactttcagaaatagagattttttattggacctattccttttcatgtgacattaaaaaatatatttttatattagcagagatgtgtatccatcatccaatcttaataaatatttttttataaattccaatattaaaaaagaaatagtattgtatgccaaatttgtatattttttatagaaaagttgactttatatgcgggttaattttatttgaaattgtttaatattaaacatctgactttttaacacgtatgtcaaactattggtcacgtagtgcaaaaacgaattta

SEQ ID NO: 65617 - DNA, 6294 bp, Oryza sativa
tttgtgaacgatatggtatgtgatgtctggaaatatattttctatgtttatacattatcaaatattaataatgtttataaattttaatattaaattccagtattgatataatgagataaatttgcggcgggggtgagaatgagtgacagctcattcaattctgttgcatagtggcatgcgcaaaagtactgtatttctattggagcgtgtctatttacatatgagtcccacctagttttgtcatgattttctcctccaacatgcaaatgaatcataaaaaaatcattgattccttgtacccatctgtcgataaatatatcctcaaatcatctccttccacacaatcctccctctccttacctctcccctaacacacgatcctccttctttgtataagcccatgagactcactagtgctacaatactcatggcatcttatgaatcagtcgatgtcgaagtggatccactgccacagcaaataaccaagagagagctcgatcaacaaatcaattcggagagagttcttagagttctctttcagtatgtacgtgatggatatgatcgaccacaagtaatgacgagggagctctcccagccagtcaattcctaaggagagatgaagaactatgaagataacatcgtcaagagatgcaagctgcctaagccatgattaggtctactgagttttgaccttggaataaagttttattaagttagcctttcaacgctatttgcaaaatgtgcaaaccaaattaagaatgcttgttgtgtatgatttgacttgttgtgtacaatatcatatttcatctacaatctcatacaatctcatactagtctgacaaatcagttttatttattgttaataactaatataatttttacttttagctcgattattaaaaaaaatattaaaagttacttaggaatttccgcagcaaaacgcggggaatcacctagtactatttatgcttaatgccaatcattggaaaataaggagtagagagatacagtgttaattttcatcccctctttacatgtctaattgtttaaacacacctcttaaagtaattgattgatgaaaacaacacaatattatgtgatagattccggtaaaaagaaaaaccgtgtcatgaaaccataatctttgagagaaggcacccgaagtattatcgagtttgttttcttaatcccagataattgtcattagtttccatttggtaataaagaaaatgttattctcatagagcaaacaaagcacaaaatagctagttaatcttaacacgaaaatttattccatcttgatcttgccaatcatatgtatttcataatacgaggcacatcaacaatcttgactggcttcagaatataatcctttgctcctccatccaagcacctccaacaaggaaaaaaaaagaaggaaaagggagcacatattaggatccacatgctcggattaagaatctatcaactaaggaaatcaaggtatacatcgtcatacttactttctgatcctttctgggatgttatcagaggaagcaattacaaccgggagatgtgccagtttaggtgatttctatgagtaaaaacaagcccaatttgaacatgtaaaatatttggtagaaacattataaaatatatatgatgaagattaacactattgtacgtacgcaccttcacttccatgagtaggttatagccggtcatgtctggcatacagtagtcactaacaatcatgtccacatcatgttcctgtgtccatcagacataaatacatgtttgttatatagtttgtaaataacattaccaaataaacaagtagaaaacttttaatttaccgagtccaaaaacatcaatgcttgcatgacactttctactgcagtcactgcatatatcaaacatggaaacacttagttaacaacagtcgaaaagaaggtcagaagatttcaaacatggaaacacttagttaacaacattcaaaaacatggaaacttgcataacaaagaacctcggacattatggcgcattaaggccatggaaacaacatggcgatcaacatgggtatcatccacaacaagcacatggggggacgacattgcaaacttttggtgtagagttactttgaattgttgttgaggaaaatggacctagaatgcacacatttaaagtgcaaaagtcttaaaatcgcggagatattgcaaagatataatatcaaatcactagcatgataattagctctcatatctcacagtatcactagtgaccgtgtatttgataattttgatataccatacaatgtataatgattgatggatttgtcctctttcgtacctatagagttgttcattttttacaaattaactatagtgaccttgcaacaattgtagctacctaggagcaatgatatagtctaatgtatgagcatatatttgatatatctatattgataaatggcttggccctatttaatttgtacatatttaaatgtcaatacaacaaagaggctagtagaaactaattaattggtcacaccctggtttgatagatggtatggtactaaatgaaagaaagcaagtgagtagtggtgtagatgggcatggtttggcccattggtccgaaaggcccatcttgtgaagcttgtaccttctccactatggtttttgtatgatcttattctataaggcccaactcgtggtgttgttttcatggcgactcgcagctgcgtttcatccttcgttgttctccaaggctcccctcacgtgctcctggaatcggggatggatgaatgaaccattgtccatctaaatcgtggtgtttatagataaataaaccattgggaacatgctttcagtcgagaacgatggtgatcaatggcgtcttcccaagtcttgagcatatcgacacgttttcatatgagataaccgcaccgggttataggatccagtcaccggacaaagtgtcagatgtacattgatttggaaaaacaaattctaggcaaatgcacacagttcatgtgaatactagacaaattgtctcctcctttatattttctgatacttacatgtgggacttcgtgacaactattactggagttctatgaccaaaatacttcaccgccatgtgctggccctactcttgtgatgactttgtcatagaatattgtacctacagatggaaccatctaccatggacccatgaggaccatggttaccaagttctatgacggaatactttgtgaccatatgccaacccaaatttctaatgataaattgtgtagtgtttcagatgaccatggtgacattttttgtgaccacaaactcaagctgccactagaatcatccgagcctgaactttacgatgatttcttgaaaattcgtcatagatcaacgatggattccctttttgtcacagtgaatccatcatagaaggccaaatctattgtactgatatatgtcacaggctgaaaaaataaagagaggataagggggacttgcaatggcgttatggcggcgacaaccataaaccgtgactcacgaagatgtaaagtttgcaatatatattaagccatttatagtatgagtgtaatatcttcatcgtgaccatattttgtacaacaaaaagcccaacacatacatactgcaactctcacataccacgtaacatgatgtttagtgtcacgtgaatgcacaacatcataggatagtctctttggaatggtggatatacgaattcaaaagtcttgttctaatccttactacgggtgtgttcagaacccagagttcccaactcacctctcgctttttccgcacgcatgtttttcgaactactaaacaatgcattttttgcaaaaaaaattctatacaaaagttgcttaaaaaatcatattgatccttttttaaaaaaaatagcaaatatttaattaatcacgcactaatggatcactccgttttccgtgcggggagtttagttcccaactccccatatgcgaacacaacctacatatccaaataagacattaggccccttcttagttcccacacaaaaaaaattataccctatcacatcgaacgtttgaatatctgcatgaagtattaaatataggctaaaaacataactaatgcacagattgcgactaatttgcgagacgaatcttttaagcccaattgctccatgatttaataatgtggtgctacagtaaacaattgctaatgatggattaattaggcttaataaattcgtctcgttgtttactgacggattctgtaactagtttttttattagtacccgaacacctcatgcgacaccctgtattacccgatgtgacacgctaaaattttacacccctagatctaaacaccccctaaaatattaccaataatacgagctgtcaacttgccagcactaacaaacagttacccgaaatagttccaggaaagcgttttatgcagcaagctaaaaaccaagcagaattatgacaggtcctgaacacacaaagcaggaggaaatcaaactgctgaattatgaaatgagaaaaaaaaaagaggataaagtatcgcatgatatgaggttctaacgattcactggttcatccatataatagccaaccacaaacagtaaagtaaccaggactccacaatcaaaaacaacatccacactccagactatcgcatatagtcacaaacaaatttgatccactccaattaaaacacaagaacacttatttgggtctcaaatgtttcccgctagcaaacggagcttgcaacactttgcaatagtttaattcagcattgcacactattgcagaaacacctcagccttcagttatagtagaagtcaatatagatggaacctcctcggctaattatgaccaacgccgtcaactgatcggttgtgagttcaaaccgccaattcacctcaaattgaaagattcacaatattattaggattttatgtttctagatatgatagcacatggatgatgcaaatcgatggtactgaccagactgagctttgaaaacaccttcctcaatataggtgagtgcttgatgtattggcgtagaggcatgaaattatcggtaatgcaccattcaccatggtgcaatgttctaagattcatgaacatcggccctctcccattacgctccttgtggtagaacttatccacacgagttaaggtctgaacattgacattattaggacgtaactatgtgcgtgtgtgtgaccatgagtcctttctccttttttttttcttgcaaaattcaccaacgttgcacaaaatatatttctttacacatcacatgcaaaggggattgctctcacttcataatagtttgcttcaataaattttgccaactattcaaatgaaccctttgccttggttttaaagtacaagtgcttcaggtagaattcgattgacagcaaaaagctaaaattatgtggttttgtgttaaaaaaaatcacaaggataagattaacaactcaaggaatgtcatttattcatggattgagtatacggtaggcatcctctgcagatttttcagatttcagcaggtgatgccgtgacatgcatgggatacttcctgaaaatgaaagtgatcaccgacgatcgaaaagaatcaattttcagaaatttaatcactatatattaaaagcactcagtactctgtacattctagtcaacgtctgcgtagtacaatactccgtactacaatgtatacagatacagaaactaacgcaaaaaaaaaagagagaaaatattatccaaaattcatcccatgttctaccaaacaagaacattttataatctctagagtatgaatttcctagctaattaatgagctgatgatcacttgacacgccaaagaatccaattaatcatcactgttctcacacgggaagccggagcagcgtctccgatctgtgcgcgctccggctcggcgcgagaaggcacccactgaaccgctcctcgccgccgtccacgtcgtgttccggcgacctgccgcggcgccggtacgccgcctccacgtcgtcgaggatggcggacacctccgccatccgcggccggctgcgcccgtcgttcgccacgcacgccagcgccaccctggccgtccgcgcgagcaggcgggactcggccttgtccgccggcttgccggcgcgctcgtcgagcacctccgccagcgccggcgggccggcgcgtatcagcgggagcgcccagtgcgccagccggccgccgtcccattgccggccggtgaggaggtggaggagcaccgcgccgaacatgtagacgtcgttctccg

SEQ ID NO: 65618 - DNA, 2944 bp, Oryza sativa
gccgggctccccgagcacgaggtgcggccgcatgcgcttggcggcgagccccggcgccgccgcgtacacggtgaagtgcctcccctgcccgatcaccctgctcgggtggaacccgtcggtggcgcgctccacgtcggccagcgggaccaccggcaacggcgccaccgcaaccgcaatcgcaccaccgtcgccatcaccaccaccaccaccaccgccggcgccaccgcccgctctcgccacgcgcttgttgcgccagagcaggaacagcgcgacggccagcgccacgaccgccgcggcggcgacagcgacgacggcgtggtggacggcttcctcgacggactcgcgcatggccgagctagctagtcaatggatcagagcttcgccgccgccaccgccgccgaggacatggacgaacgggcgtggcacggcgcggcgcggcgcgcgtcggtgtcacctgatgagagagattaattggagacgtttcgtgagcggattttcagtgggattaagtagcacgctaagtgacacggtacgtacttgattaaactaaacatgggtcaaatctgctatgcgtacaatggcaacaaccgaagtcagtgtcattgtgtcaacagaatgccatccaaaatatttattgggtggctgacatggttggaatggttggcatgaattggttttactagaaatacttatgggtatcatgctagtatttttcttggtactttctagtatcttcttaaggcaaaaacaaatataattgttattgttaattttaatgaatttggttggcagtcaagcttatttattgtgttgaacatataagatttatatttctgattcgcacttgctatttgtgtctcaatgaagaatttacatttctttctgcttggttgtttgttttttttttctacatttgaacccgacagataccccattaagaatatgtaggttaacctctgacgatgctggtgtgatcttgtaaattaacaagatttggaccttctggtggcacacgagggattcatgtacaagaacttgccaagttttcttttttagtccagccaaaacatcatgttctaatccaacaaatttgaatgcaaagattgccctctgcctccctagaaaacatattgatttcggattcttattggaaactttggaaatttgtgaaaacataagcggaaggatcattaattggaaataagggcctattcagattgtagccaaaataaaccttaccaaattttagcaataacaaaattttgataagatggtaatattgtcaaaattttggtaggatttcttatgtattaactaaatttagtaacaaactaaacgttttgtaactttaccaaaataaaatggtatggttgaaaatggcatcaaagtgaacagaccctaagttttgttacacattttgaactgaaaaaaactttgagcctgttgttatatatctagctagctgttgagacttcaaagtgtgcattagagggagatcctggacatccaattaattaattaaacagagatgatcatggccattttatgataatgtagtcaagtgcaactgtgcaggtagtaaatcgatcatagcagttgggcggggtttggatgcccaatcttacgtcgactctggaccaaattcatgttaggaattgcaagtttgtatttttatgtttgtgttcatgcacccaacacttgaaacaggtattagttgttataactaacgtgatccggtggagtttattaagggcagagcaggtaaaggaaactgattgttgttaacttcgctcagaagatcttatgtcagcgaaagaacaaatactacaaatggtgaactttctttttttgtgagaacttcgttagttaagtttcttatttgatgatcctccctagtttccgaagttcacaccatgagaacaaagacgagaaatgactacgatacatgggaaaatttaatgaattcattttttttctcttctagttcggacttgtgatttagtgagaatttgtttcacgcatatacccatttctattttttttatgaatttagataacttttatatcctattttgatggatttttacttattaatggtttgatggttatcacagatatgttcacacgatacatcccagttttgatatcttggtaacaacatagagttctttaaaaaaaaaaaacagatagagcaagccacactaacggggatttttttttctagcagatatattttacccatattgttcaacaaaagtagtatatattttctagaaccaagatttgctcaaacaaaaattataaaattcaaccatcaaactaattagaaggatcctcatatttgtaagatgtcctactttcctattaaaattttggatgggctgatcatgggccaactggccgctcagggcccaattaagcctcggagaacaattataaatgcagtggcagatgaccttttttttacaattttttattaaaatatttaaaaatcgtttcaaacatttataaacctagacgtctcacaccctctggaagcgcctttttaaaaaatcgcccttccagacgacgttaagggacctaaatgtaatgtttttatttgtattttttacaggatgtttttatttatattcaaaccctttccgtcggattcaattgcttaaaaacctgtaattaatgcttattcgacactctaaattattttaaaattaaaaagtaataatctaccaagtcgtagatctcgtcgagatctacaatttttatataaagtttattttcatacaatgttttggacatctaaaagatcttaaatgaaaaagttgttaactgcaaagttgtagatcttctcaagctctacaatttcattaaaaattttgatttcatccgattttatatgatatatttttaaattacaaaatcatagaatacacaatctatattgaaa

SEQ ID NO: 65619 - DNA, 2571 bp, Oryza sativa
tttttagttcttaaatataaggtttttttgaaaagagcagtactaactcagttaaatttggaactaagattgagttaatgtttggttgtaaaagagactattgcatacaaatcgacaacaaaaagatttcgaaaatattgcagccaccagcaatgttaatttataaagaaaatgatatgtatatgctatacataccacatttttccacattttccccttgtgtggtaagcatgtttgccacgcttttatgctccaaatttgttttctggcacacttctgacatgttttgctagaaaatgtgtgtcgtatgatttagctaaaacattttatggctccaaatttgtttaccacacttttggtatgtttagctagaaaatatgttcatgacatatgggtctaagagtaaaccttccttttgttttatttcatctcccttcccccttttattttttggaacacatctaaactcttggtgaccatacactgctcactccaacctagcctatgaacgtctataacaaaaaaatcattgacgaaaactccagtcaaagcgtccgtgtcatcgttatcgtccatgacactctcgctatgactgcgggagggaatagaggaaagtcaagggatgacacagaagaggacgcaggcaccaggtggaggaccgtccatcagagatgcaattgatgatggtgagtcgaaaaagatgaagaggatgaagaaatagaatatttcaaatagtagcaatcattcactttgctcccgttacgactgagggggaatgttagaagtacaaatatgttagttagagataagagtcaaatacgaatatggagataagatatatcctagatatagaatcctagagataaaatagagtcctagagataaatctactcttacttgtattgtactctaagtctctatccaagtatgtactcctatatataccctatgagagggtcgatgtaatagattagaaaacattagaatacaacaaattagatttttccacatagatctcagatatttatgatgattattactaatataactgacttgtactccttgaactgaattaggggttctctgatcagaaggaattgaatacaacttccattataggtgaaagtgaaattgagtcacatatcaatttttgtttgttgtaaaagagtttctagcatgcaaatgaaatataaagaagatatagaatattgtaatcaccaagaaagtttacataaaacctgagacatattctacaatgacacaattttccactttttttttgccaaaagtgtggtaagccaaggattttatctcccaatttatgtggcacacttgtggcatgttttagctagctagaaaatgtgtctatgacatatttagataatacagtaaagaaagtagaatgctagaactttgtcaataattcaatactagcctcaaatggttaacttatcaactttgggaaacattggcaacaaatattcgcactaacgagattaaattttagccatttcggttaaaccgagattcatgagattttgagattttcgaaatttttggacaaatttttttgaaagtttaacccaatttaactgaatttgactaaatttaggtcaaattcacaaaaaattaagaaaaaccaaaaatttcagacgagataatgatttgctaatggttcgaacttaccgaaattttgaaaataatcgttgtttaatatttccatccctcccaaaccaagaacacaaacgatcctaagcgtgtccctgtactcaggacaactaaatatcaatggtccaacaaatgttccgaaagaacacagttattccaaaattaaagttatattaaaacacaataaaaaaaaacagcacacgcagcatgttattgtcaactaaataaacaagagatgcacacaaaaacaaaacgaatgacactgactacacctttggtagaaaaataaaagcttaaacattagtccgaaaaatagaattaaacccggaatttgtcccttcgtcccacttactaacagacggtcagtctttaaaactaaacttcgtctttaaatttgcccaatactatgatatttatagtaacaaaatcacaattacatataaaaagtaaattcaaatgtcaatccaataatattaattatttctatcaaataaaactcaatttataataaaacattttttatcaaatatatttcgatagttgaactttaaaatacatgcgggcatttcaatggaacgaaagttataataaaatattactgatcaaatataaaaatatatttggatagttgaattttaaaatacatgcgggtatttcaatggaacgaaaggagtaataataattaattaattaatcaagcgctcatttatacacgaggggtggactcctgcttgccgagcctcgcccggcgctccatcgacagcatccgggcgaagcgcgccagctcctcctcgttggtgcccctgccggcgtcggccacgttcctgccggtctccacgtccaccctgcacgcctgcctccgcagcagcgcggccccggcgccggcgagcgcgcggaggttct

SEQ ID NO: 65620 - DNA, 7074 bp, Oryza sativa
ggatatccgaacgaaattcccggatagtttccaaccgttttccgattccgacggatattatacccatactgtattcgttttcgtttctgagaaaaataaaccgaattcgtttccgaatctgagaatttccgaatagttccgatcaaacctatccgaatccgaaaaatggttttgacggacggattaattaattgcttaccggattgttggcagcaacacctccatcgatgagattgaagacccggggctgaccggccttgtccttggtctcgaaacggtgaccggggaggtaggtcggcgccgctgacgtgctgatgcacacgtcggacaagagagcattcttggatgcatccttctgtgcctggacatacatggatataataaaatgcacatgtaaattttacttctgtttacaatatatagtgatgtcctttttcatcactatagtatatatatactatacagcttacaaaaaggattgtaataagtttacatcaaatctagagaagatggtgggctggaggagcttgatgtcaaatgtggggatgacgacgttggtgatggcctggctaatcctggtgtcaccgagcagctcctgcacaatggaccggaggtatcgcccgtcgtacttgggacccatcatgctcttcagcaaacccaggggtcctttgctgcatttatacatgggaacattaaggtttgcctggatgaattggcatgatcagaaccgtgtagaagtgactgaaatttgtacgtattttcacatgatcttaattaattaactgccagtcgactaaacttgcagaataaatagcctgaattgaaatgcggcaactatagtataaagttgtgaaattcaattttctttctttttaaaactaatttaaaccactttacgcttatctaattatctgctgtttcatctatgctctaagtaaaacttgtactaaagttaactcgctgactgattcacctaattaactacattaattttcataattaagttaacgtaccctttttttcacggcgagaaataaaagtacagaatgttggatgtaaaatttggtcgagaaaaaagtaaatacaaacaccgtatacatgtatacgtacatgacaggagggaatatcttggggctatgccggaggtagaagtcgacgatgtccttggcggcgaagagcggccggccgtcggcgccgggcgccgcgagcatggccgtcaccagcccgcccgtgctcgtcccggcgatgacgtcgaagtagtccgccaccctcgccgccggcccgtccagctcctgcagcttctcctccaggaacgccaggatggtccccgggatgatcccgcgcacgccgccgccgtcgatgctcagcaccgccacgatgctcccgaacgccggcggcggcgacctcggcgtcggcagcgctgccgccgccgcagtcgcctgccgccggccgagcgccgggtccacggtcagtgacccccccgcgcttcctccgccgttgctgctgccgatgagctcagctgggacttgcactggcgccatggctggctgcttgagcgagctagagatcgactgagttgaagggggaggttggtcgcggttgtaattatagtgtgggagcatgcgtccctcgccggcggtgttatatatacggcggcgaatggcggtaggtggtggcgccggagatcagcacgtgcgattggacggcaaagcggatcggggggaggggagctttcccggaatctcgctggctcgtgcttttgcattgcatgcatgctctgcttgaaactgtaaagaaatataatgtgccgtacggataatggcccgtgactccgtgagccgtacttttctacgcggataagctggatatgtgtataatactagtcccgtttttaatagatgacgccgttgactttttccatttgtcttattcaaaaaatttacataattataatttattttgttataagttgttttattactcataatactttaagtgtgatttatgtcttatatatttgaataaaatttttgaataagacgaatggtcaaacatatgagaaaaagtcaacggcatcatctattaaaaaacggagggagtatatactaatatgcttacgaaattaatttggttgcagctaaagctcgtggtcgtcatgatgcacacgctacgcagccacgcatgtaaagtactccctcgttcatattccctagcagttactccctctattctaaaatataagtatttttaattcttacacgattttatatatgctaatttaactaataacatttacaaaaataagattttatttttaataaaaagagttgcatattatgatagcttgttgaatgataaatctaatgacatcaattttacataattgatttttttactattaaaagtcaaagtcaaaaacgtttgatttgtcactatgctaaaaatgcatatatttttgaacggaggaaggagacctattacatatttagatttttcaaatatgttatttctatttatagtctctatttatctcagatttaaatgaaaaggtaaaatgttgggttagaatccaagaagttatcttaatactcatagttttcatgtatatatatactcctttatctttgttacatgtaaaataagttaatttctttttgatcttggtaacaaaagtaataggtgtaacttttgtgaaataagagagtaaaatatataaacctatcataaaaaaagtgatttttgtgtacgtgactctcggtaggttacaaacggacctggccatgtctgcaaaaatcgagcgagcatttttcgtataagggtcattaagaagcccgcatgtaaaaattgatttcgtaggcgaacccctaaggggccgcatgaaaaaataaactctttttttttcatgtggacctcttaaaatgcccgtatatgaaaaatcattatatgaaaaatcatttttatgtatgcgggtctcttaaggatcgatctacaagtctaaatagcctcctccttctcgtcgctgtcctcttcaactgccgccggccccatccacgccaacatcgccgctccacgccgcctgagccacagccccgccggacccgatccgcgctcctcctcctccaacaccgcccccgcatgccctccaacagctgcctccgtggaacaagacatgaagacggaaaaatagacttattcctctacagtaaacatgctcacatcccatatgagaaattaatacccaacggtggcccatttgttacgtgcatataaatacacacacacacacacacatatatatatatatatatatatatatatatatatatatatatatatatatatatatatatatatatatatatataattaaaaaataagtaaggctttcggttgatttttttggtccgtcattaaaggatgggcccacgtgattatttcgccgctaatccgtgaatccggatgcattacggcgatctctgacgctccgcacaaaaagagaaacgaaaaaaagaaaaacctagcgagcagcccagccaagacggcagcaggccggcccaacaaaaagcaaacgtagcccagtagccagcccacagagtagagaagcagcagcccagtacaacatgtgtgatactgtagcaaatgagcactgtagcacgaataataccacctaaataggaggcttgcctgatactatctatatctataactaatataaatattcgtattttttctttcgtcacatctaattttcgtccgtacacaatccgatttggttagcaatagccatggaaaaaattgcaaaaaaaaatccgccgcacccgtcgtcgctacaccgtgccagcgagacaggaaggagagcgggagagggagcgcggacgctgtcgacgccgccgttgggagggcgccgtctccgccgcaccccgccatcaccgcgccgtgccggcgagaagggagggagaagagaagggaagcggtgccggtgggggggagacaacgccggtggcgggggaggcagccggctggggggagggggagaggcgggagagggggagagggagcggcgcccccggaggggaggggagggcgaacggtgccggtggggagatggggagggggagaggcggcgtcggggcgggggaggcagaggcggccggctcggctcggctgggagggagggggagggttagggttcttatcaattttaaactgatctgagccgtccatcaaaacgaacggctgagatcgatcgagggtttgggccgcaccacttgggctgcaccacttgggccgcacgcgggccggcggtccaccaagtgagaggaggagtatgggggcattaagtagactttgatcgcttacgggctgaagaagaaaataggctgaaaaaggctcatagagaaaaaataatttttatttaaataaatgctgaaatgatatttgtattatcaaaattaacaattaagctatgtaaattccaagaaaatttcaatgagtgtaattaatatataatttcaaagagtgtaattaatattgcagaaaatttatatgtcattaaattacaattcattaaatagttcaaatcaaagttcagtcaccatatcattatccggtgtaatgcatgggcattttactagtacacacaagaaataataaaatcagaggtgtcagatcgagaattccagatcgacaccgctctatgcctcgccgtccccacagccacagccgaccgtggcacaggcacttcggcctccgtagcaacgccgtgtgcttggcatcctccgtgccacgccgcggcatccatgctgggcccgcgtcttccacgtcgtgatcccgtcctctatgccacgcagctgcacgcatccacagttccacacggtggggctcccactctactccgcctcctcaaccgcgtcgggcttccgtgccgcaacccgcaaggccgtggcccgttctctctctctctctctcccctttttttccctttttttttgcgtttttctcttttttttctgtcttttcgctttttttcttttttttttgcttccccctcccctcacgcgttttcctttttatcctattctttttccgatttttttaatctatttgagttgaaagttttcaaatcttaacttgcaaatttttcaatctaaagaaaattttaaatctagagtttaaagtacttaaatcttgacttaaaagtttttaaatctcgagttaaaagtttttaaaatttgtcttaaaatttttaaaattataaatcttgacttgaaagtttttaaatttaactgttgaaaatttttaaaaagttaaagcttagagtttcaaattttaaattttaagttgaaaatttctttcgcgtaaagatttattttcaatcttctagtaaaaaaaatcttccaaaaaggaaaaatatttttttagttactgttattatcctaaactaactcggctagtcatgtaactccttcagaaatcgtgcccaaaaatcgcacgtgcgtgagctagctttcacgcaccttgacaccgcctccaagccaatatcgctcccaactccgaacaagcccaacttcagtgacggtgcctgtcttccacgctacgccaccgcatccaagatgggcttatgcactgctctgcctcaatcgcgtcaggcttccacgctgcaagggcatcattgtatgtagacacggacagtttggcaccgcctacaagccacagtcgctcccaactctcaaccagccccacttaagcagtggcggagagaggttgtgctatgggtggtcgcgattcactagggaagttgccatctcatcggcggatgtggctgcttggggcgtcatcaaagatggagaggtagcggcggtgcgagggcaacgattcgtggggtgttgccgggcggcagcaacggccaaaggtattgtcgcacgggatgaggaagcggcgagacggagaggctgcactgctgcagtgagaaggcgagagacgaagacaggccggatgggtcgacagtggcgaatccagaaaatcgattcgttggtgtcataacatgtctatcggtgtcgtagtatgctaattatacttagatcatggtgttataacatatagataagcagttttgttataggttgtaccaaaagtcgacggtgtcgcctgacactggccttagtaccgcagatccacccctgtgggtcgttccggactttgggagcattcgatattgtgggtccgggatatcagttgagagagggggttgcacttggcataacggatatataccaccatttctaatgttttaagtagtatagaaacgagtgtgtgcatgtgcggtgcggatacatccgtcaaagctaggggttgcatttcttcaaaagaaaaaaaaaatccacgcacggttgcacatcacactcatgcaatacatgcgctcctgcatgcatgcctctcttgctgctccaactactagctctttcttgcttaatgagcgtgcagttcctgcatgctcggatggctatctagcttagcaagctaagcatcacttgcttagggattgagctcccgctaatctcgcactccacggtactagagtcacacaaaacagcacaaccacacccgcgcatgtccataatgtggaccaacaggttgcaatacgctatatgcatgcatgccccctcatcacctcatgcatgataatctcattgctgctttaatttgctagtagaagaaagggaaacttgtggccatgcattatcaaacaatattgtttgttgctggtaaataatgaagaaatatatatttttttttgaaaaagatcactttgtattagcagcatctatcagaatgatggtaagagttaataaatactagctcttagcaattgatattgtgtatataactacaaaggttgggttcatgcacttacattagtacttcctccgtttcacaatgtaactcattctaatatttcacacattcatattgatgttaatgaatatagactcatatatctatcgtatatctatctagattgttaatgaatctagatagatatattcattaacatcaatatgaatgtgggaaatg

SEQ ID NO: 65621 - DNA, 8288 bp, Oryza sativa
  unsure (1)..(8288): unsure at all n locations
ctactaatgtgataagagtgtttcttagatttaaataaaaattcctttattctggtcatatataaactggttgtttgtcatcactacttactgtcattgtttaagagttaggtgcacttttaataaatgaaattgtattagtaccactaaaacaaacgatacattattaatacactaaaaaaattcatctacactacataacccgccgttcatcacttatttttacctctatatataaataggctaaatataccatatctaccgaataatacgataacatcattaaaaataaacatgaatgcctctctaatgtatgaagtcggctgtatctaccaaccaaggcttccgtatgtaatgccttaaaacatacaggtctcgcatcgataagccatgcccctaaaaaccatcgtagagtacaattttaacacttagttcactattggtacactcacagttgattatattggtaagtacgtcactttagttacattgcctatgatggcctttcatggacaccaccttaactcaaccatgtacatgtccatacaaatttatgatggcatagcaagtattacaccctgcattgaaggataaagagggacagaaaaaaagaggtgatgaaaataattttttttaagttttgagtcgaattgtggtagagaatagacaaaatatgtatatgaagttagtaataagtacttctcaaattttattggaatacatacaatattatgtttttcaaatgagtggggttaatcattcgacactacttaaaaaaaatataactaaagagacgtaccaccacgaaaatctgcaaaacaccatatcattatttatattttgataaagatttatgcttttgcgccaaatttgtttccacgatatgttgtttataactatacgatactcatttactaattctaagaatgtacttattttcacaaacttatttacactaactaatttgctagagtgcaacttatttacatacactaactaatttgctaatttgctagagtgcacttatagatgggttcagtggtgtataacattcgtccatcaattatacatggtatattagaatttctataactataaaaaatatatcataagtagtttgatgcgtattttattggattattcatgttttgccaatactacttggcaaagaaaatacataattctagtgatgaattaagggttgtattctagcaacacgattgtctaaaatcttatttatttattttttttcacatgtatctatcatgtatgcttcgcactcctcaaataacaataaaaaagttttgaaaacttttaatagttttagaatctcaatctcacccaaaataaacctaaaaagatctacttaaaaaccaaagctaaattatgttgttttattaccactcgctaaaatttaatttaattttctcataaatctattaattgtgcttctgacacctcaaataagaaaagttttgaaaaaattccaaatgctttgagaatctcaatttctcccaaaattaaataaacctaaatagatgtacttaaaaaacaatgctaggttttgtttttttaattttttacatatgtagattcaaattaacgttatatatttgtcaagtgatatttgaaaccataaaatatcatatgaaattatttgaaacattattatcgcattaactattacatgttggcatcatttgccatgatatatttatcacacaataagtttacgattaagtttaactgtgcatatctatgtatagtattatttttaataaaattatagattaaaggttgttgacaacaaattagtgctgaactgatgatttttcctgatcagtatttctttccgatactactatgtacgtgtgcgtgctttctttttatttttttttggctttatctttttttatcatatatggtgtaggtatttaaattttgttttcttcttgggaaggagacgatcgtacgacttaagcacgtcacttttttttaccatgatagagattagtagcataatccctttttttgagaaatcccttttttttagagctctaatccaatgtttaaaataactggtccactaatttaagtgaaaattaaaggttggatggttttctttttttactctaaatttctaagatttctctaattntattagagcatcacgtgataatgtaggagtggttgcagtacatttagtagacttttagtatataatagattggtatgatttctctaaattattggagaaccacgtagcggtgtaaaagcatttgtagaaagtttaatgtacttttagtatataatagatagatttagaagatgcttgaaagaacattgattggatatttattatagatcttaatttaactaaatatatttatatttgtgaagtaatatattttatatttatattgtagaaagtcatattttaaataccgttgatttgtatgaatgtatgttttttctgtcttttttatgtatatgtgtatttgtttttcttctagcgaagattatgaaagttttgttttcaatcatatatacgtttgtacgtacggaaagtacagcagtgacatttgtaacgtacaaactcatacgtacggactgtagcgcttgtatgttataaacatgaggaagttattattttctaataatagatctaatctaatggtgtaaaataacgggtccaccaatttaagtgaaaatcaacggtgagattagatagtgctatgtggcggcttaggagcgtttgtagaagtgccacgtagcggcttgagagcgtttataggatgtttaatggacttttagtagatagattttgtcataaaaagttagaatctttaaaacaattgacaaaatatatcgggcctgtttggcgcagctccagctccagctccatccctcctggagctggagctcagccaaacagtttcagctccaccaaaactgggagtggagttaggtggagttctatcacaaaatatactagagttatatttaggagttgaagctgtaccaaacatgaccataatatatcattttacaaatattcgagtttaaatttttgaaaaattaatttatttttcaacgtttaaatacatgccagtaaaatactttgtttgactgcaaaatggttcttctctaactttgtaaaatggcattttatttgattaaaaaaattatatatcgatttacatttttcttggaaaagatttgactgacaaatttcttatttcgaactgtttgatcacaatttatcatcatgtatgagcaatgccctgcaatgtaaatattatcttatgtgaaacccttccatatcatattatgctttcacctgacaaagctaaaagccatagaaatcataagggcctactttctcaaattaccccacgggcatattcaccacgtgacaagctagcccaagcagttctcactagtaatcatgcaataaaattaaaatattatattaaaataataatttaggaactaatattaaattttcacagataacattcaatataattacaattatattttttaagctctaaatttgacccgccactgcatcgcccccattggatcatgctcactctgtgcgtaggttagcctcaggccctcaagtgtcaccattagcaagcagaacatacgcctactccgtctaaactgagacagaatcacgggcccacccgtcagtcacccaagctccaaaacccaaaccccccctaatctccttcaaaactgacacgagatggtgggtcccacccgtcagtgagacagccgcccacgccttaaagcccaaacccaccttaatagccacccactactcccactcccacttcgctccactccacgcttcccccatgactcccctgctcctcctcctcctcgccctcgccgccggcgccggcgccgcctccttccccgccgacttcgccaacctcttcgccgccaaggccgcgctctccgacccgtcctccgcgctcgccgcgtgggaccctggcctgtccccgtccctctccccgtgccgatggccgcacctcctctgctccaacccgtcgtcctcctcctccgccgccatcgccgccgtgctcctctccaacctctccctcgccggcgagttcccggcgccgctgtgcgagctccggtcgctggcgctgctcgacctgtcgtacaatgacctcaccgggccgttgcccggctgcctcgccgcgatgccgtcgctgaggcaccttgatctcgccgggaatgggttctccggcgaggtcccgaggagctacggcgcggggttcccgtctctcttgacgctcagcctggccgggaacgagctgtccggcgagctcccggcgttcttggcgaacgtgagcgccctcgaggagctcctcctcgcgtacaaccagttcgcgccgtcgccgttgccggagacgttcaccggaatccggaggctacaggtgctgtggctggccgggtgcaacctcgtcggagatatcccgccgtcgatcgggagcctgaagagcctcgtcaacctcgacctctcgacgaacaacctcaccggcgagatcccgagcagcatcggagggttggagagcgtcgtccagctcgagctctactcgaaccagctcaccgggagcttgccggaggggatgtcggcgctcaagaagctgcggttcttcgacgccgccatgaaccagctctccggcgagataccggccgacctgttcctcgcaccgaggctggagagcctccacctgtaccagaacgagcttaccggacgcgtgccggcgacggtggccgacgcggcggcgctcaacgacctcaggctgttcaccaaccggctggtcggggagttgccgccggagttcgggaagaagagcccgcttgagttcttggacttgtcggacaaccgtatctccggcgagattccggcgacgctgtgcagcgccgggaagctggagcagcttctcatgctgaacaacgagctcgtcggcccgattccggcggagctggggcaatgccggacgctgacgcgggtgcggctgccgaacaaccggctctccggcgccgtgccgccggacatgtggggccttccgcacctgtacctgctggagctcgccgggaacgccctgtccggcgccgtcgcgcccgccattgccacggcgaggaacctgtcgcagctgctgatatctgacaaccgcttcgccggcgcgctgccgccggagctaggcagcttgccgaacctgttcgagctgtcggcttccaacaacgtgttctccgggccattgccggcgtcgttgaccgtggtcaccacgctcggccggcttgatttgaggaacaactcgctctccggcgagctgccgcgaggtgttcgacggtggcagaagctgacgcagctcgacctcgccgacaaccgcctcaccggaaacatccccgccgagctcggcgatctgccggtgctcaactcgctcgacctgtcgaacaacgagctcaccggcggcgtgccggtgcaactcgagaaccttaagctgagcctgctcaacctgtcgaacaaccggctcgccggcgtcctgcctcctctgttcgccggcgagatgtacaaggacagcttccttggcaatccggggctgtgcaccggcggttcgtgctcgagcggccgcagagcccgcgccggccgccgcggccttgtcgggagcgtcaccgtcgccgtcgccggcgtcatcctgctgctcggcgccgcgtggttcgcccacaggtacaggagtcaaaggaggtggagcacggaggacgccgccggcgagaagtcgaggtgggtggtcacgtcgttccacaaggcggagtcgacgaggaggacatcctgagctgcctcgacgacgaggacaacgtggtcggcacgggcgcagcgggcaaggtgtacaaggccgtcctcgggaacggcgcccgcggcggcgacgacggcgccgtcgtcgccgtcaagaagctctgggctaacggcggcgcggcgaagaaggcggcggccatggaagccggcggcggcggcggcggcggcggcaaggacacgttcgaggcggaggtggcgacgctggggaggatacggcacaagaacatcgtgaagctgtggtgcagcctcagcagcggcgaccggcggctgctcgtctacgagtacatgcccaacggcagcctcggcgacctcctccacggcggcaagggcggcctcctcgactggccggcgcggcaccgcatcatggtcgacgccgccgagggtctctcctacctccaccacgactgcgcaccgccgatcgtgcaccgcgacgtcaagtccaataacatcctcctcgacgccgacctccgcgccaaggtcgccgacttcggcgtcgccagggccgtctccgccgcgccgcccaccgccgtgtccgccatcgccggctcctgcggctacattgcccccggtgagttaatcattgcgcacctcgatcgccatcgccatggcgcccgctaacgattcttgatttcccagagtactcgtacacgctgcgtatcacggagaagagcgacgtgtacagcttcggcgtggtgatgctggagctcctcaccggcaaggcgccggcggggccggagctcggggagaaggacctcgtcaggtgggtgtgcggctgcgtcgagcgcgacggcgtcgaccgcgtgctcgacgcgaggctcgccggcgcgccgcgcgacgagacgcggagggcgctcaacgtcgcgctgctctgcgcgtccagcctcccgatcaaccgcccgtcgatgaggtccgtcgtgaagctgctgctggagctccggccggagagcaaggagaaggccatggcggaggagaagcctctcctcgtttgatcacacaaagccagcactgatgaacacactgaacagtagtacctcactttaattagcaattagcataatcactcgcttcaaaaatcagttagcataatcacattaacaatcagtagtaattaatgtactcaagtacccagcattaaggttgaagcctcaagcatgcaatgtaagctagaactacttaagtaaaggtcctctatgtatagctcattctagtattttcatgggttaatgtactactaccagtttgtctaaagtatcaatgccaacaaggatttggtttaagctagatggtgctaacacttttgactctgtggaccatctgcattattctgtgctcatttcagaccctgaaaagtgaaaaaggtgcctcttgttgtacctgaacttgttgagcggcttttttccattttacatgttcagttatcacttgctatcagtttatcacacagacacatgtataagatatagtgattgatttggcttggatcgaacaaactattgggtagtaattactcatagcaatctaaaatcgtatggaacacaacatagtacaataaatttggatagatctcctgtccaaattaattgtactatgttatgtcccattcagttcagattcatatattatgggataaggggagtaaaattgctattttagttttaacatgttaattacttttcattttagtataagcatttctaggtatgtacctgaacatcatctctcgacccggataaatatgatccttcagtgctgtaatttttgggccattcagtgctccattcaattgcaggcttaggttgcagcttttgctattaagttgggagcattcagctgtggtggagatcaagtgacagcaacagaacaagaggctgtacagaagctgtgctggctcttttcccttcttcccttacctttctgctagcctgcagggtttagatccaaaaaggttaggtgatttgttgttgggattactgttgggctttgcatctgtcaggatatgcaaattgtggacacagtctggagtcctggaccatagccacacaactgtgtagtgaatgtctgcatctacagtaacatgtacatttggtgtcaatggtcctgaagaaaacctttatgaaatgctaagctccaaattgtcctcatagatttcagagaaaatgtttttactgtctttaagtcctttgtcactgactgatccagacaattaccctctgcttggacagtttatatgaggggacaggatcagcatcagtgaattttcgttttcacttctgtaactaactgaattcaacggctgccgcacaccatagcacagtaaccagttaaccccaaacttgcccaagtgtctgtctgaattacatgtgggtccatgctgttggtactagtagtagacaggagactcttcggatag

SEQ ID NO: 65622 - DNA, 2859 bp, Oryza sativa
tctaacccatactcatgcccatcgagtggggtaccagacttacgggtaaaattgtcatccatggttcgagggaatgcaacaggatgaacggcggggcaggaggggctggtgtttgtcttggtcagaagtaattatttattttatcatataagaacaagctatcggatattaagataatggaagtacaactcagcacattagttaaattacttctgccttagaataccgaactctcacaaatatacatttttacaactcacgtgggagaaaccttgtttatttctataccaggaggaatgttaggttgccattctggaatattttgttagcagtgcaaatatgtgtactaactgaatgctaaaagtggtagtacctttgaaggcattgtttgatattcatgtgatgattgcaaacctgtaggggggttttttcctcgagccttgaccagtttcaattttctcaatattctactttgatgttgtaaacttgagaggttaaacatttaagtggttgtattatctgctaaatctataatctatctcattacgggattgtccaaaacatcgttagtcggatgtagagagctcgaatatatataagccagttgggatcaatcaggctagcaaacagaggaagccaaatcagccaagcctgaattctgaatgtgaccacgaatcaccgtatcgtcctgtttttggatgtgaatcgacacgagattttgtcaatctaagagatgtaccacaagtactcaagcgaaggcccatggttattgagtgcaagcaaacgcaattctccacgcggagacacaggagttggcgtaacgggcttgcaactccattacccgtacccgttagcaggcagctgcaccataagctcagttgcagcttttatatatacatggataattttactcgatttattcagagtagggacatgtatacaaccactaccatagaaatttatttatattatatttaaatcataaattattgattttgacatgtagctttatgcaagttgggtttcggatcttggaaggttaggagatacagtaacccgggaagcaacaattgcctggatttcttggaagcaagctccatgaattttgcttgcctgaccctcctcccaagtctttgatcccaagcgacaagccaagccagaatgtaccgttggtaccacgtactgatcctatccattaatccataagcaacccagctccaccactctgccactagcacacccacacacaaataaacccggattaaaacgcaatcatgcatgcgccacgatcagatcacattctcaagaacacaaataagataatagcatcatggctatgtgagcttagagagagaataatgcagagccagagagacagagagaggtaggtgattgataataagaaagaagggaagaagaacacaggtctaaccggaggagggcaagagaagatggtggtgatgatgatgcagaagagctccctggacctggtgcttgtgccatgtggtctggtgatcatgttcggctaccacctcatcctcctctaccggattctccgccgccccgccgccaccgtcatcggctacgagaaccacaacaagctggcatgggtccgccgcatggtgcaggtaaaccacccaccgccggccgccggcgacatggagcaactgaattttctgtgacaactgaacagctgaatccaagtgtggccgtggtgatgggaggttggtgatttaccgtgttgctgtcgttgcaggcgagcccggacgagacggggctggcactgagcgtcatctccagcaacatctcggcgtcgacgaacctggcgtcgctgtgcatcgcgctgggctcgctcatcggggcctgggtgagcagcacctccaaggttttcatgacggagctcgtctacggcgaccgcacccaggcgacggccaccgtgaagtacatctcccttctcgtctgcttcctcgtctccttcacttgcttcatccactctgcaaggttagcttcccttcaggcttcagctgctgctcacctctgaaaccagcctctgtaaatacctgaaagaaggatattcaaatttaaattttgaaacttgaatttagaaaaattttagtggttaccagtaaaaaaatacaaccttttgcatttgaatctttaaagttgaatttttggagccactaattctggagatactaccggtattccaaccctgctgaggtaacataacatggcatcaaaatcagaaattttcagacctgtttcctctggagatgcaggtactatgtccaagccagcttcctaataaccacgctggattctgatgtcccggcaagctacatccagcatgctgtgatccgaggaggcaacttctggtcaatggggctccgtgcactctacttcgcgacaacgctgctgatgtggatcttcgggccaataccaatgttcacctgctcggtgttgatggtgttcatcctgcacctgctggacagcaattccctgccattgcacaaccatcagttcacaattagaaaacggcatgatcagagagctctggcatctacagtggttacaaggcaccccagccctcagaatccgattctcagtaacccggtcttgtctcctgtaactttttcaataaattaatagatatgtttgctgcaaagcttggaggtttgtatggagtaacattacatgagaatatgagattcaggtacaaaattttcatcagaaatattgcttccctaaaacaaatgctactacatgaaatgtgataaatccatggaatcgtgacactgtcatcgagaaatgtgttgatgttatcatgattgagctgcaccacatcttgggtcagcatac

SEQ ID NO: 65623 - DNA, 5282 bp, Oryza sativa
ttcttctcccatactttcttatgcttgttgtaaatgaacattgctgcacgagcatcctcaatctataagagtatcaaaatggccacgaaaattagtatttagtacaagcataaatgatattgacaagaaagtttagtcaaatgattacaagttttcgctgtacaagtgattaaccatgtgaaagattactagcagtaattcaagagtaatcagaagtacattttaaaatgaataaacaaatctacattgcataaagagaaaaatattatgtataacttactgggcaatgctctttctgttgtattttagcaccaagtacttgagcagtaagatctttcagtgatctcctcttcccttccctaatataacaggagcacatgtcaatacaatgttgagcaatcttaacaagagcacataatatagaaaatatatatgtcaagatcatctaaccttcgaaaaacctcatattctgaggtatcccttatgtccttctttgggtggcctagtagcaaaacctggaaaatgtttaccgtgttacacaagaacacaaagtgcataaataattaaattatggtcattgacaaccttaagatcatggtgcaaggcatgcccaacaagaattcttcctttgatcagctcagctacatctttctgaacaacccagaaatctttggctgcagtgttgtacaacattgttgcataacccatataggttgccatcctctaaagaaataaaatcatgcagtgccagtttagtgatgtttacctttattcatgtgcttcggtctaatcccactaatatgggtacggtagtcaacaatccgctctaccggtcttgtatattcatcatatacaacgttaccccaagagttaacctagtaaaaagcacaataagattaatgggtgatattcaaaagaagggtatttattataactaaacttcttcataaagaggctagaattctcttcagctttctaaatcaaccttaagtccacagcaatttacagattccatgaaatcctttgatgcttcaaccagtgaaatcaatccaacactcaacatactaagaaataacatatatgtacattcaaattacgaaagcaaagcaggaagtaactatacattggtttttgttccttctcaagaactacatcatgcccattgctccccatcagtaaaagaaaataagagtatgggacttccttagttgcttccttccttcctagagagtagagtgcataataaaatgatacaaacataacctctcctcgacgcattgttagcattaccacatagctggtattacagtttaatagtgggtctcatagtttaactccagcttctttgttctttgataaagataacgaaaatgggtacacaaatcagcagaatacttatatggtacaattaatcatgccatgcccatttgactgtaatattacaaatcatgaatttcaagcataacccttaaaatctcagccaatgcatgggaaccatttccatagcacagcacaaagactaggtgacaatattgccaaacaaactagtcactacttagtgaaaataaaaattgaactggctactggtgagaaattcatgtttcttactatatattccttgcaaccaaataaggccataaattcaatcaagtaaatgatccatctgagttccaaagttaataccaatacatactagctaagcccaacattttgtcattacccatcctcctattgtgaatagtccaactagaatataatccaaatcaaactctgtactcaaaacagttgcaatctcattgccagcaaaacacaaatcacgatactaccttctttcaagattaaacagcttatgtcgcctcctcaccattttcatcaaatcgtaacaacaaactccgaaactaatgctcgcgcatatccttgactcccgaactatactgagctgattaatatatactatgatatttagctcattcatcattgctgtgcgcacagaatacaaaaggatgtatggaattgagatttgggaggacggtgcttattaccaaggtgactctgccgagggcgctcttgctgccgcctgcgccgaccccgaccatctcgcaatccacagcgaccgccttcgtcaagctgccaaaaccattccccatccatccggccatccccacagcaatcaaaatcaaaacccaaagcatctcaaaagcggcagcacaatacaaagacaagaagatgcctcctcgcgcggcgtttgctctgatggctcacctggtgtcgtcggaggtgggcacgagcttgacctccgccgcctcctcctccgcggcgggctcggtgggcgcgggggccggagaagggtggtcggggcggtgcttgcgcttgccgagggtggtggcggcgacggggcgggggagcttggactggagctgcgcccagttagggtttagggtggaggcgccggctgccttcggcttgggcttgggtttccgcttcgggctcgcggcggcggcggccgccggtggcggcggagaagccatggatgatttttgcggcgcgggggaaccgcgggatttggggttttctgctctcaacgagggttcatttgatttttgtcttgattttatactgtaatcctgaaggaaatattttgcttccaccttatgcacttatataaagctatactccctccgtttcacaatgcaagactctagcattgcccacatacatatagatgttagtgaatataaacacatacatatgtatagatttattaacatctaaatgaatgtggacaatgttagaaagtcttatattataaaacggagaaagtaatattctcttatcaaacatttttacctttaccaagattcattgaaggctcggatggcctaatcaacaaaaaagaaacaaattttaaattttcaaacttaattttgagatattttcaatctaattttttttcagcattagcttttaagttacctagaacacatatataaaagttttacctacaaatttatttttattccctaataagccgttttagcttattagggaaaaagccaaatgatggggccgcaattgtttaaattttaattaaaataataaaaaccaacatcttatagccaacgttaagtatgtcttgtgacatataatcacacattttatagtctaaatatttcttaaaaccccactcttaacaaatatcaactaatttcagaatatctaaaacaatactttttaaagcagtggagagttaaaccaacaatataataaagaaattggcaattgcaagtttcatatatactctatatttcaaaaattgaagcaagtgacatttactaaatgtgtatttaaaatgtataatggtggggttttatgaaactttataaccatagtttatgtaatgtacatggtactttgtgcattttcgaccactaatcctcgctttttctatctgttggttccctctcaatcaatttcaatatctctaaatatatcgttggatacgatccggctctggtaattttagggttcgcctctccttacttcttagctcctcttcttgaccaacaatgcccaaatgtgttctactttaaaataacactgcacatgacctgtttggttgatatactcaacttgcctaagatcgtcataacttttataacttgtcaaaaacttcagctattataacttttgtttggcattaaaatggtgaagaaaaaatcctgtcataagtgtatcactgaagcaaatggatgcctaacagcccgtgatgattcatttaggcaaaaaatcaagatttgatctaaaagtaatcctgtttaggacacttgaaaagttgcacctgatccagattgtccaagagagcttaaaaggttagacaggttgggattgacttggacagagagaacacttaaaccttcttgaacagaagcaagaggcatcctcaaaatctattgatacaagtagaataggagaacaagtcatggtatcgcggttcaacattttacccattatttcatttagaaataaaaccactatacacaaacttaaaaaatccaaatagaaacatgagctaccacagttttgcaacttgggaactacgtaccccaccagcatatacaaatttggggaggcccaacccagcatcaagatagaaagaaagcctgtcaactgtcgctctcactccatgtatgcaatgttagacggtatcatatcttacaaaaagaaataactcttatgcaaaatatttgtacaagggaacatctcagatgagaaaagggatcactcataagcattttctaattcaggtcgaactgtctgttgcttctaattttctacttccaaaacctccagaactggtgtcattttcaggtcaaaatagatcctgatctctgactactgtaggcattcctctcaaatactccatccgtcccaaaaaaaaaaaagacaaacccagggtttccgtgtccaacgtttgaccgtccgtcttatttaaaaaaaatatgaaaaaaattaaaaagataagtcacacataaagtattaatcatattttattatctaacaacaatgaaaatactaattataaaaagattttatataagacgaacagtcaaacgttaaacacggaaacccagggtttgtctttttttggacggatggagtatagtagcagtggtgtataatcaactgattagacacttgagatcaagaaaacatctcaaactcgttgggctgggaaacactctcaatgccatggatcaatttcctccgtggacctacagcatcaagacccatatcttttagctggttcattgtaagggaaactatctgatgcatccccagcttttcactgtccaatatgtcaacaaaccaccacaattgaaaagccaattcttcagcccaccaaatccagcaatccgtctctcgagaagtcgtgctcgtattatcctattcgtaacttgggacgaaataactggcagctcttcctttataaatgtttccaaaagaatttcctgctttctcatattctcatgaaactgtccttgaatggaagcatggtttgctttcacaacaggggcaacaggacggcgtgaagatgtagcattttcctgagctttcttgatgttggtagcaactttgatgccctctggaagtggctcgtgagctttgttggtagtcatctgctttggatgcttctttctcgcagcatcacagttttccatgctctttttggctaagcaagctcttgttcaaaacttatttttgcatatcatcctgaagacttg

SEQ ID NO: 65624 - DNA, 1159 bp, Oryza sativa
acaggtgcacatccctgtctatctgtctgtctgaaactctgaacatcaacaaagttgctaaagctgaaaaggaataaagcacaagggtttggaagtttccttcagtgggaatttctgtctcaggtcacattcagtggcatgttttgtgtaatccattacctccattagtgcatgaaaaaaaacattgtctttggactaagaggaagtgtgtttgtgccgtttatgaaatgaggagtttgagttcctataccgatcaactgaattataataacaggagtttccaagagatgttattgcgaaatcaataccagtccatctgtccctctttgcttcttcttttgggggatatgcaaaaggagttgtgttgcatcatgtccaactttgctgctcggttttgcaaagaaggcttcttgattcaacaccctctacagtccaaaatttgtggttgttatgatgtgttcattttctaagatgatacatagcattgggtaaccatacacaaagaaggaattgtgccattttgcaactggaataataaaaaagaacaccaaatagtaggcgaggtaatcccatttggaatccaattattagttattttaaacaaaactcgcaactctaaactatctgctaaaaaaatcccttaataaatactccatccgtttcaggttataaaacattttgactttggtcaaagtcaaactgctttaatttgaccaagtttatagaaaaaagtagtagtattttcaacccaacacaaatttattatgaaaatatattcaattattgatttgatgacactaatttagtattataaatattactatatttgtctataaatttagtcaaacttaaaacagtttgactttgaccaaagtcaaaacgttttgtaacctgaaacggagggagtagtggttttccaattgatgtactgttaaatttaatcttatgttctagagcacataatttgggataatcagctaaccaaacagtcaaacaccaacatgcccaacgggtagtccaaccaaacaagagtacgataatccttcgtaattccattccaaacaggattttgggcatgtttggtacagctccaggtctagaagaggtggatctaggtggagctctcttacaaaatgaaatagactggtggagctgtgtt

SEQ ID NO: 65625 - DNA, 1815 bp, Oryza sativa
atgggagattataaacatatcttatatttttgaaaatgatattggtttaacattgacatgtacacatttgactctgtttctcagcatatttttaatttacacaatattgaaagaaatataaaagatgatgttgtcaaaagtatgatataagaacacctatgcataaatgtgtccattcagcaacaatttcaacatcatagacaagatccatcaacatgctgatgaccaaatgtacatagaaggctagcggagcactaacatgggatgacttgttataggctatttcaaaaacaatagacgtgtgaaaccacccacctgaatgagcacaaaactactatttcaatatcaagactaaagcattgcgatatcaaaggaaatatgtcaagtttatagtcctagaaggaaatataacctgttgaacagaagtcctaacgaactctatactatcaccattagtcactacattctcattcatccctaggcaaccaatttgacaagggagtaaaaggatgttgatatctccttaatctgattcttaaaaaaaacagcgctttcaaggtaatgatgatatacattagacctagattgtgacatctattcaattgataacaggcaaccataatcatgtgcaatttgccatattatcaactagtgtgcagaactttacttttgtacacgccatggtaattcacataattcatagaccccacttgaaatgctaaaatgcttcgtacttttttatacatactaaacgtatgccacatacatattcagaaaccaatccagtactgaacaaggaataactttaaaatgacatgataatagagctaattacccgctagaatctaatatttcccgtgaaattttcatcttcttggtggtgcctttgtacaagtcagctagattgcaaggcagtcggttctcaattggtgcagccttctggggccgttggggagcatgcattgatgcctcaccagggaactgagagaaggacccaaatatatcattgtcatacatcccaaactttgatccccgcatgcccctgtcaacacctccacccataccacccatgccacccatgcttgagaatgggctggaaaatccgaagaactcagcaaatatatcatccgcgcttcgagggttgaaccggaacgtcgacccatcacccccatagtatgaagacccaccaggcccacctgctccaggaggtggcacctgccctttgagcccctcttctccgtactggtcatagactgctcgtttctgggaatcacttagcacctgaaatcatgcaaagaatatgaattataccataaccatccagtcaataataaagtgcataatagggttccaaatttccagtatgagctgcatcataattagctcattaatacctcctgcagcaatttttgttctaaaaattgaatataacatgccattccctgaagttacaaaacatacgtaaagatcaaaaagaacagtgggcaaattccaaaataacaaagaaggtggcacaataacatcagaatccagaaatacaaaaggccattgttcccaacctaaggtcaaatgttccatattgttgcatgaaatgaatcgtctcttgagtaacaaaggcactacattgctctgtttggatcccacaagcaccgggaaaaaatgcagcattttcagatcaaacagcattgctttgcagcacccagatcttcctaccaacaacatcgcatcgcaagaacaacctcgtttaggtaatggcgaacaaaaaaactacttcaatcggcgagcggagaggaaatgggggtaagattgatccct

SEQ ID NO: 65626 - DNA, 4104 bp, Oryza sativa
ttgctgtgttgggaactttggacataaccatttctttagattttgttaatatgtactagtgctatattttgggtgatacatgtcggtgagatttggcttattatcttttttaaaaaaaagagtttggatgttgtgtcgataatgtttaattaagtcatattagtacaatactagcatgttacaatgggaaaaaacaaaattgtaattataacaaagtatgtagtataggagatatgtgataacatcatcatgatcatcttgagaaaaccatttgatatatccatgaatattctcgtgattttgcttgagatagctatttccccgcctattataaatcaaaatatttttccagttgaaaacttagttttatagtagctagtactatatgctctagaagtgtgtacttatcaatatataaatattaaatatgttcaaatgaagacatatataaacattgttttgttaacttcatcacaaatgatcattctcggatcgcataacaataaagtttcattacatatgttcctttttctactcttgaagggttttgtatttgttttcttacgatggcgtgctctaatcgtcaaacaacaaaccaagtgcattgcaacactcgcgttggataaagtggcacatatcggtgcagacattcataaagtagtgtttccttgtcgaattgttatgctacgggaggaatttcaagaatatataaaagaaatatgaaaataaaagttagaaattttgatgtccgcattaataaactgcattactatgggatagtatttttcaaagaacaaatctttgtatttatattgtccgggtttgttgtgtaactcccattaaccttaagcatctcacacatgtaatatccacacactacggtctctcggtggttgctcgtcctgtctttcaattattatatatgttattatagaactttgggcataaccatttcttgattttatggtattatgtagtactattatgttttggattatatatgttggtgagatttggcatgttatctttttgagtttggatgttgtgtcgatattattttatgtcatatgtgggcaagatttaacttgttattcttatagctcaagtaaaaaaaataagcatgagccaaagtctaggcttgatgacttttgatctcgatctaaggctcaccattagcctgagttttgaaggttgatagtcataaaagagggtatttggatttattagatgcttctgttgtctatagtaatggcatctgatagtaaactctaatcatttgagctgtggttgataagtcataggaaaatatacgatacaaaataatttattagtaagacttttgtacatatattatttgtggtttaaaattcattgttggcaatgaaaacaaatcaattctaaagttaagtttcacaatttaaattttggttacaactaataagctaacacatacacgataaaaagcccaaatatctataccaatcgtgggtccaatagaaaatgaagtaactctaaataaggaatcaatttattttattaaatccatgaaactacgtaaaggaaattcctaaaatttggaaagtaattatctcccaatataggtcaatggataagccaccctttcaggaaatatgaaaactaaatccaagttcaaatcatccacacacaaactcaaataaaatggtaactctaaatatattcgctctttgggcccaatcctcattccccatcttttcttcccttttgtagtccaacccatctgagcatcatcccccctcccccctcccccaacctcctgttggaccggaccatcaaggcagcccggtccagctcgacacggaatggatcatcgggctaccaaatgtcaaaagacttggatccccttcaaggatgatataaaagcatgtacaatcttgcatttagagagggttctataaaagagagaagatgatagaaccgactctatacactataagattattttcagccactcctagcttagggccaaccaccggccattgtattcttgaactcacatgccatatgccattgctctctgaaatgaatatatcaataccacatcttccttgtgttaatcacagtgggtctcactctccatggcaccctgtggttatatacattacagaagttttcacaaagcatatatttttgttatgagatctacacatagtacgttgtctataaataaacactacatatgccctaaggtactcagggagggtattacttatcaccactcaacaccgtatttaccacctccacaccagccatctccactccactccacctttaaccatgtgtgggtagagcaatgtagtaacacccttgtcaacgaatacaactgatttaactattgtgtatatatcccgaaagagaaaaaaagtaaaacaagagcgaaaaatgttccgaaagaaaaatatcaaagaaaaaagagggcctcatcatttgccttataacttatagaccaatgccaaaaattaaaatattgaagttgattttaatatttattaacatagtttctttttcagttttatttttaagttgtcaaggacacatacatgaaagctttacttataaattattttttcactaataaactgatggagacttcgtgtaagggcattttgctagttaatattcctagttaccaatagaaccttgctatacgtacgacttctccatccgactggcgtacgaccaaaatcagtggcgatcctacgtgtagtttctcgggatcctcgaaccccgggtaaattatccaattcttactaagttatatcatgttaattagtatacaattaaaaaaatagataattagtacgtattgaacccccggtaatttctgttctgggttctccactgaccgaaacagcagagcagcacaatacatgacggcgtgaggcttcatgtgatgtatagcatgatgttgatgccgcgcggcactgtttgtttcagcttaagattattgaactagattactataagctgaattataaaagctaacatagaataatctgtgagttgtttgtttccctaaattataagctgtttgttagttgttagccacccaataatctaaaaaaacacctttagtggattgctaaattatatagtaatctggcttatagattataataatatatcataataagctatatgtttttttagcttatttctaataattcagattataataattctaagctgaatcaaacgggtcatccaaaaagtcagacgctccggtcgtttgtgtagcattttcgttactaatattagggcattttgctagttggtaccgatataaaattgggcctacactacaaaaccagtgtaattcagaattgagcccacggggcaaccattctgctccgcccgtacccgtcgcgtccacctctccagtccagtccgccaccgcgccaccatgaggatcgacgcggcgatcctcgccgccgtcgtcgccttcctcctccccctccgccttctctccctcctcgcccgcctcagcctcaccggcagcgccggcgacctccgccgtccctgcgcggccttcgcgctctccgccgcgctcctcgccgccatcttcgccctcccgcgcgaccacgccagggagtgcgccgcggcctccgtcgtcgtccccgatgacggagagggtgccttccgcggcgaggtgcggtcggatatcgagcagctgaagctccagctcgccaggctgggtacgtggggactggggaattagcggcgacccatacccctccatcgattcttttcgtggcctgagaaattaatgtatttttaatatcgcgtatgagttctctccaatttcttctattcgtggcctgatctgtgtggtcaattgctgaattatgccgcgcgcacagagtctatgtgggataacaattcaaaaccattggatgggaaaagtggtcctttggaggaggatggagaggttgtgagagcaatggggctggatattcagtccctgatcaatgagcatgagaatatcaaggtatgatgttcttttaggatttgtcatatcaatttccataatccatagttctgtaattggttgcttacagagttggg

SEQ ID NO: 65627 - DNA, 2757 bp, Oryza sativa
ggttctctctctctctctctatctatctacatgtgtggccccgtaaaattgtgcacctttttctttttcaactatgttatgtgtcaccaatcaccaatagaaacagttacattaataacatgtataaagtttctcaagctgtccatattcaatgtttcttcatacaaatgtatatgcttcattgagaggattatcatgtcttttttctgctagaacattgagtttgcagtatttgtgttacatacaaactagaggatactgtttctattcttggtctttattttcagccagagatcttatgtaagataaaaattcctatttgcattgctgaaggttgttcttgagcatcagcaacctcattccaatcgtgaatgaagctgttacactcaaacgccagtcccttgaactaaattaggttaactaatattgcaactggagtaactaaccgcattatttggaaacactttaagagtacatgagtatggaaaaatggattacaaagtaaatagtgacattttgtaagcatgaagcactgaaaaacatcaaatactagcattcatctaaactgaaatgccatatgatctggtgaaacaatttctgagtaagttaagaaacctacacataaaacgtactaccagtaatgcaacttgtagatttatgaaatattttcccttgcctatgattacactttataatggttttaatatctcccagtattttcaatcactaccggctgcaaaccaatcagaaaagtacgggtgatgtaaaatttccatgccttcccttgcaccaatgagcatatgctcatagcatgcttagctttgtttgtaccaatcttaggttatttatgttgcccttgcacaaaatgaattactttgagagcccttcattataattattatagtataatatattacgaaatctggttcaaggtgatcatctcatggatattatgattacagattcaaattctaatggatgaatcaagaaagatgaactccaatattcacaatatatggtcaatggcaaaggatacagataatagagtcagcgctctgcattcagatgttaatatggtaaggttatcatcagttttgattgccatgagtaactaccaattctataacattttattaatattagtttttgatcatgcatttgatttattgtgttttttcatctgagattagaaacctcacatttgaatacatttttttaaaaatgtctttcaagcctaaatacatatgaagactcagtattgtgctatcttatttggtaaataaatttgatgtgttgcaatattgtcattctgaatgttctagttcaatcttgatgtgttacttttctgagctattatgatttttttgggggtggaggtattttgattaattcatctcatcagcattgtgataaaaggttcaggttctaatggatgaatcaagacagatgaactctaatgttcgtgaattatggtcattggctaaggatacagagagaagagtagagggtctacattcagatatgagaaaggtatcactatctaggttattatttattttgattgtcttgactcttgaggttgttagaagctgcattgtactgttcctttgtgcatataatttatttgaatttgttatatgagagtagaattttaatttttcaaattcaagcacgtctaaatttatactcttgttttcacaatgtttgtctatttaattaggatatggcattttagagtgcttgtctatcgagaaaaccaagagtttagtcataattctactctctacccttaacctaatgcatgaaaggggttgagtcctaattgtatcatgccgtttaataagggcaatgtaaagccgttctgtagttaattcttttatgttaaatgccaccttggtctttgtgaatggtggcgtatgatgactacagtgtcttgcaattgcgctgacactcaaatattcaatggagggaagaggagaagagagatgagaacttgtgaattcagtgaccctagctgtaagcttgtacataaggtctcattgcatgaactggtaattgttgctctcgatattgttttctggccgtgatgttaccgataggcaatagtgaggtgttctatgaccaattatccatcgacagcacgattgctcctccaagctatgtttcttttagatcaaaggcttttgcgcagctttttactacaaagcataacgattgttctcctccaagctatgttggaattctattggccttttttgccattctatttgccttcaaatatcgtcatgatgttaacttatatcctacacatgaaattaaaatataagccgcttttgttgtttgtacttcctccgtttcatattataagactttctagcattgtccacattcatatatatgttaatgaatctagacatgtatgtgtgcctagattcattaacatctatatgaatgtgggcaatgctagaaagtcttataacttgaaacggaggtagtaatttatatctattctctccagtattggaagatttgatctgatttcctatttctttcttactatactactctaagtgatcatgatggtataatatgggtttctatgctttttaatttttgttatatactaaaaagtaaaaacattagaaaagtatagttaatagttaaatgtaaatgtgtacatttttatctacctgtgccatatagcttttttggcatttagatggtcatacatcacgcatttggtgttttgactttgac

SEQ ID NO: 65628 - DNA, 1708 bp, Oryza sativa
gaggactgcgccttattttattaataagaagaagaagaagaagaagaagaagaagaaatatgtacaaacgagggatccaaaaggacccctcaagaccccaaaaagtcatcacaaaaagcgacgcgcaactaaaataccttatgagagggataataaatgcaatataaaataggccccgtttagattccaacttttttcttcaaacttccaacttttccgtcacatcgaactttcctacacacacaaacttccaacttttccgtcacatcgttccaatttcttcaaacttccaattttagtgtggaactaaacacaaccatagtattggccaaatggagtgctttcacgttggtcttctttcctatatccaattcagcactcactggaaattctgtgtgcccctacttcacttcagcttggtagtttcccccacctttccaggaagcctgggtatataactgcagacttgaatagccacctatgaatgctttatgcccaattattccaactaactatttcatcctatctttgcgtagcttttgccacagaattagctgatgattattcgccagataatattcctctgaaaacatgaaaacattccaactaaactatttcatggatggtcgcagtccttttgtatttctttggcaagccgttttgtactaaaatctgccctaatgggcttgtttgagtccttttggactcttttccttcttaatataacgatgctcagctctcctgtatgttcgagaaaaaaatgaaaacattgttgggtttgaccaatgattaaggactgccatgatcttcaactgctgcagttaactagttaagaatttccaagatatgcaattgccaagtgctattgttctgttaagtgttctgaaatgttcaacaactcacattcaaagtctctacatatttctatatgtactggcatggtgtagtgtattcattcatactatggaagctaaatatagaactgtgtgactgaacaattacctgcagataacagtgtcctattgcttgcacatgagagtagtaaataatttgagtttgcttgcatatgtgtttgttaggttgatatcacccttatacaatgttccagataagataattgttcgatgcaccacagtagaaaattttcctggcagcttctttaattaatgatatggtaaaataaaaacattacaagtaaataaaatgctttattcattaaagaacatgaaatattaatatgggtttgagtagggaagttttatgatgattcctgcagatattaaaatttcaaaatttatattgtttatttttctgtgcaatttaccctgtttcagtaccgttgcactaataacatctacacagggcttcaagcagaagggaataaaagttccatcctggatggattggtgatgttgtcgactcggtgaactatcattaaccttggcggagtatagtgcaccccttgatattgtaagttgcaacactacttatttagcagctgatcatgcattatctatgtttttttgtgatatagatatatgtcacaataggttcttggcgtaagttcatcatgtagttatcagttatgtggtctgctctgaatgcgactgtttgatgtcactacgccgccatggtactgtacatatgtcgccattcggtaacacgtgacctcaaagacttgagtgcttgtaaataagtttgtgttaat

SEQ ID NO: 65629 - DNA, 3400 bp, Oryza sativa
ttttttctaaaatatccaaagcacccgaatttatctctgtccattccactagagtagagttggataaaataacgccatagacacccttcgccaccatggtgcctgtcagggtgatggagaggaattaggggaaccatcacagtagataaatttatctaaatgtctctcttggtttccagcttacaattttccagcttacaattttgccactctaaagaggttttttgcctacgtggcacgtcagcgtggcttacaaatgggaaaaaaacagcgtgggactcagccgtgagcttctcccactctccccttccttttcttctttggcgtgtttgtacagtcacggcgagcttgagccacgacccccagcccatccctagtcgctacgacccccaataccactcccttcccgtgccacccctctctcatcttgctgttgccaccccaacaaccaccgttgtagtgagtagctttcgagcactagccccaccgattaggggtggacatttggtctaaccgaaaattttggtctcggttttcggtctttcggttatttcggtctttaaaaagtgaagaccaaatttcaacgtaaaaatgtcaggaccgacaaattcggtctcggtctataagcaaagactcttattaggttttattaggttgcatgcctagaagaagtagaaatgtaaaaaatagagtttaatcctattgaacttagtggattgtaggttgcatttagacatttttttgttaattcagtcttttcaatctattcggttaaccgatgagactaatcgaattgaccaaacaaaattctgtctttcactacttaggaacgaattgatgaccaaatttctcgatctcagtctttttctgctcacccctaccaccgacgatgaggggtaggccctccacgccgccgatgacgctcgccactctatccccaggagtctgtgtttccccttctctccatccccccctccgacacacaccgacgggatggacctactccaacgacgacggcgttgtcgtgacgctaggatagagcatcgtgctgcgcatgaggttctacggcttccaacgtgccttcctcctcctcgctgccatttgtcaacatgcatcgtggcgcacatgtagggcttccaccttggtggcgcggtcgccacctgctcatcattgagaggttcttcgttgttgtgtaagagtcttgggtgtgtgtccgcctcaagtacctcgcgtcaggttggccaagcacccggtcgcccatgatgtcatgcccgcgtgcatcggagagggagatggacacaaggaagaggctggcgggtgggtcccatgttgtttttcatgtttgtaaaccacgtagataaaggtgacaaatagttaagaagtcacctatgtagagtgataaatttgtaagctgaaaactaagagggtatttttataattgccaaatgcaatagtggcaaatagttaaattcacccgtgtaaatcaccattgctagatggaaatgtccctaaccagtaacagagcttgagagaaatttgaggggctaatatgtaaaatttattggccatgggggctagctactgatgtcataaaaaaaatgatttcattgattttcaggaaagttggggaccataggagcatggcccatgatggtgtctatgaagctccgcccttggcccagtggactggagccccttctacttgacgggtacacgatggtggtgaccttagcacggcttatcaatttttttttaccatcttcctattttagtccccttttgattataaggaaattcaaaattcacagaaattttagagagctttatttctacagtaatgaaccctgtgaaatcttataaaatttctatggaatgtctctttccatgtaaattttggaggaaatttaacatgaggtagaatctaatggaaaaaatcatttgagtgtttatctctcctcaaattcttgtatttttcctacggtccaattaaatggtcattcctatgtttattatgtgttttgcaaacctatgcatatttgtattcctgtcagaattctatatttttcttatttatctgtttttttatttatgtgattcaaaggatgccttagattattcctaatattttacaagtatgagcagatatcagcttatcaactccgttttagcattgactactccctccgtttcatattatagtcttttgaatttttttcctagtcaaatgtttaaccaaatttataaaaaaatttagtaacagctaaaatattaaattagttctattaaatctaacatttaatatattttgataatatgcttcttttgggttgaaaatatcactatatatttttataaatttggttaaacttaaagaagtttgattaggaaaaagataaacgacttgtaatatgaaacggagggagtagatgacatatatgcaccattcaaccacctagaatgatttgcaatgagtggcatatccattctggtctatatgctgttaattcctactccatcgttttggtcaaattctggccaatattaattgatcgaaattaacatgccacttgttataccgtttcaagcatgagttcttcttccatcgaatttggcttagttgataattaaattatgtataggtaaaaacttatttatctacgtcatactttctttcgttactactccctccttcctaaaatatttaacgccgttgatttttttaaacatgtttgaccgttcatcttattcaaaaactattgtgaaatgtgtaaaactatatgtatacataaaagtatatttaacaataaatcaaataattggaaaagaattaataattaaatttaaataagacgaacggtcaaacatttttaaaaaggtcaacgtcgtcaaacattttgggatggagggagtaccacttttaaatatagttacatgataatctctcaaaataagtaggtttttccctgtgcaccagtaataaagatggtgcctgcctctgtgccactaaaaacttatgagcctccctctatgccatcgtcgaactttatcgcgccctccacaacattccgtcgctattctgtttaggtttaaccgtttggtatctctggcatgtgggcccgggcaagaaaaatatcgttcttgccatttcaatcgctggcatcaacgtctgcctcgtcttcccttgtcgccatcgtctccgccgagccgagcggacagcgccgctggccacccctccaaccggcgcccgacctcctcctttgcccggcgccgctccggctcctccagcctgacggcctgcatcaccgccgcgctggccttcccccatcctccttgccgccctgacctccttccccgatgcccgatggccaccttcaggccacggggttcatcagtgtcagcg

SEQ ID NO: 65630 - DNA, 1743 bp, Oryza sativa
aggcgtgactgccgcccagccgccgcccagccgggacaccgggccgccgtcgcctcggcccgatcgccggccgcgccgctgcacctagcctcgccgcgccaagcaacgcaaggcgcgagggagagaaacgaacaaagcaaagagagaaagagagagcaggtttttccctgtgtgccgtctcaagtctaaggacaactaagtcatttggctgtgcagttacccaccgttacgaccaaaaacagacggaatggtgtgaagagcgcaataaagtttgacgatggcatagagggaggctcgaactttttagtggcacagaagcaggcaccatctttcttaatggcacagagggaaaaacctccaaaataagtgtacttaagtaaggatgtaacatatgaactacgaatctgaatagcctgtacagattcataggtctagtgtatcacatccttacctaggtgtaagggtgcaagcgggcaggcttgcaaacccgcttatataccttttacctaggtgcacttattttgaggtgaacgatccattttataataatataattattgtatttttttattataaacccaaaaggttacaattgtattggccgaaatgtcctaatacattataatttaatatgattatttaatagttgataaggatgagttaattccaaaaaggaatattccaaggtttggatgagcttcacacctcaaaatttggcagaccagtccaacataatttctctctcactgacaagtggactacatcctcccatctataagaaaagacgagaccagtctaaccctcatgccaaacagataatggaatcatccaattctaaataatacggatgggtctaacccatcctttcttatcctcaaactaaacacaccctacgaggcctcatattttagggtggctttgatggagattttcagacgcaaatgaaacaagaaaactcaataatacatgattagttaagtattagctattataaatttaaaatttagattcattttatttttctaaagaaaacttttttatattttttccacaaaaaattttgtttagtcgtttaaaagcgtgttaaccaaaaataagaaagttgttggttgaagttaccgcctaaaactcagtcttactcagaaactatcaagtagtttccaactttccatacttaccatatcatttagacagtatatatataaactatatatccaatggattgtgtctttaaattaaattttcatccaatcatcttcattctctctcattttatcaaccaatctctttatttttattcttggttcttgtgtagagatggtttcttgaatgagaaatagtttcttcatctttttatctctctacttattaactctcttgccacatcagatttttactcatgtgacaatatatttaatgttatggatactagatgatatgaaggattggggatagccttagtgcaatggtcacataattcttttccataaagaatagcagcaagcattcgtcactcagctcaggggagaaccaccgcatagcatgcatggatcatgctttgccgcatcctccgtgacgatatacggtccacaagagtccgaaacggtccccaaaaataagccaaaatgttgccggggcttgcgtctgaccaacattgatcgatcaggtcgcaatgggcctctatctttatctcacttcccattaacacgtttattaaatatatgtttcgtgcgaaaacctttt

SEQ ID NO: 65631 - DNA, 1071 bp, Oryza sativa
ttgtgccaaagttctcttgcattgaaggagcagctaaaactatggcaccagtttcttgtccttcatcaggttcatcttgttgaccatctctgatgctcggatttatagcacaattgcattctgtatggtggttaagcaggcatgtcaggtacaagcaaaatgatacaagttgcaggtgacagcgattacctgagttggtaagaagtttcccttcttctataacatgcaattgagctacatctttgcaagttttagtagcccgtttggtctccagaggaacatttgacaaaggagagtttggtaatgcgataccaattttaatggttgttccctctgataatgaaccacaaagaaaatatggtacacggtttctcccaggttccttttcctagaatctcggagtaagctacagtaagttgaatatttatttagcaatgttatagagaatcacaatagcatgcataaatcaatagtttatgtgctgtttagtttacctcaaagcaaacagcagttccatagccacacaataagccgcatagcctggatatcagcaaaacaaaattacaaattcatgaactatcatgaatatatatttgacatttttactctgctcaaatgtgtggaactaaatattgatataaggctataaccaatattccgatacttgacatctactatggttggacatgaggtgaaatgcacctgtaatttctgaggcatggacactccagatcaaatattcaggcaattgataggtagaaacaccctgagttttcgttccaacaaatggccttccagtaacaggaacatcatttgcgattcttaacaagctaacgaactttaatgcgccatcttccaatgatatgacaatacctctgaacacaaagataaaaaatataacagttaacattaccattctagtaaaaagggtatgtctggcatatatacacacaatatcaccatgaatgaaacaatgtggtctatttaatcacgtctactttgatccagtaatacatcaaaccatgtccagtgaaggaagcttgcatctcatttagaaggtacgtgggcaaa

SEQ ID NO: 65632 - DNA, 1509 bp, Oryza sativa
ggaatagaccagagtaacagtacaactggctacctcacagatggtgcccacgacacggttctgatgggagcagattcagcagttacacacataaaaggttttgaacctgtttatcaacagaacacatgatttagttttgtttgaaaacagaacagaataagaaaagcgaagatttgggaactccagtaactggctgcttttaaaccagtaaagcagttctacagtcagacatgttgtcggtaaagcagttcttcaaacttccaacttttccatcacatcaaaacttttatacacacacaaacttttaacttttacgtcacatcgtttcaatttcaatcaaactttcaattttaacgtgaactaaacacaccctaaagcaacctggaatataaaaaagtcaatcacagaactttcagaacagcaacttgaaagactcaaaggtcacatgatttaagataagaaaataattttgttgggtaaggaaaaggtaccgttccatcgtgacatcccgctaataacatatcatgagagggtgaccaatcaactgtcaagggaatgctgtttaccattataaagaggcaatggcttcaacattaaagttcatgctgaggaatttagagatatatccagaccttccacctagtttgagctactactagcaaaaaaaaaaaaaaaagtctacaggtccaatacctttgtctgttcccgcactttacttagttcattctaggttttcggtgccatcgtcctttgctatgttatatctaggtgcatgcatttccctttataacattttcgtttggaaatacatgttagcttgttttgttgtcatttcatttataacagaatactccagaaaaaaaacttgttagactagcttagtaaggttagcattcctacaatcctatgcatatatttatttatctttacatagaagattaaacatttgttttcattatttgtgatcagaaacaagcaatgggtcaaatttatagaaatggcatgccaaaacttttagaaattttcccaattttctagcttttttttttcactattttccacatttttagtaaacaatttttttttgaaatttcacattggtttcttgacaaaatcaatcggttttcgatacaaacagattgatgttttcacttccaactgtcgataagaatttcaacgtttccattcgaaattttggtaaagccaatcgatttttgacacaaagaccgaccgatatgaatttgttggttttcaatcggatttcgtgaaaaccaacgtgctgccagcgtttggcatggaaggtggtatcggaattgtgaaccctggtggtggccatgctggtgatagcctgctgtgctgtttctcttgcaaatctgatccttgcatcaggctccaaaccgattaccattcatattacagctagatactccatgtgttggttcgttttgtggcaagattcttcaaatagaagtattactggtacatgcatgtatactgatacagcaatgg

SEQ ID NO: 65633 - DNA, 2008 bp, Oryza sativa
ctgctcacagccttcactttggctggtaggcctttcttcttgccatctaatctctgctcattggtccctattgttgcaacaggtgggcatgattttcttcttatcctgccattttctattttctcacctacatccaatgctggcgcacggcatgtaaatatagatcttgttgtggtcagattcttcggtgcattgtaagggagttcaggtttcgtcacattcttgagtccacttgtggtactgccttggcttgcgtacgtagcatctgtcagagtgtttcttgtttgcattcctacttgctgtagaaactgtaggtgcagttgcagcaacaggtttgcctgctcattatgcctgcgtaagttgatctcttttcaattgtgcaaggttggttattctcagtggagatggatggtgcagcccgtctgaacaagttctttgatgatgagtcaggtgtgggtaaccgatttttttttgttgcctttgtcctcccagaaagctctcatggataaagtcaagatcaagataagctcttcgatgaagaaacaagttctatttcagacgcgctacatgactgcttttgacacctttttcatgttggtgagctggctaatttggaaggaacgcaatatcagagttttcgaccaaagaagcaagacggctaagcaccttgtggcagatattaaagaggaagttgcagtttggagagctgcgggtgtttttcagtgttgtgaggagtagcccgcgccacccacccccccctcccccccggtttctgctctccaggggtgttagtccccggctcgacagtttaatgttgtgtaaaatctataactttcccctttcaatcttaatgaaatttggtcggctccttcgccgacccggcaaaaaaaaaaaaaaaaagaaacaggttctagaaatgtggttttcagttgaggagaaaagctgcatctgggattttttttttagatgtaggataatacagagcagatagtataccctggaagctgaaggtttaactggttgagggataggttgcttcttctggaaaatcatttgagaggagttggttggtttccgtctctatggaaagaaacagtggtgtaactggaggcgtcttcagcctgaaacgagctgtgcttctcaaaaatagttccaacaacacaggtatatgatctagaacaagtgaattataacctacctgtcataatcatgcttctcatccactgttatgaggaaatccccttccctgatggggctttgctggtgtggccacccatcacagattcagattgagaggaatacaaaaactgcagtgagtttatccatctttgaatcacgcctagacatattaagagattgtgaatatgtccataacatttctgacaacatgtgtaggaaaaatagaaatgcaagaggcaaagatctcaccttggatagcatcaaactcaacagagtacttgtgttccaggaggttaatcgatattatctttgtcacgcttttacagctccctgaagaaaactatgctctcatatttctctttataaattgcagaggggaccttagacttttgctcatcccagaaatcctcctgatgctgttcatcttcaagaacaagctatatgttcgctgcagaaaaagaatacaaagatcaccagaggcatggagactgcgcctaagtcacaaagtttacgtgaatactactactctaaagaatactactactctcaatcagcagtgcagatcttgggtagatgtggccaaagggatggctgacgaggcttctctttggcataaagcaaacccagcgattcctgcgctgcaattcaggagggagggtgtgtttagttcacgctaaaattgaaagtttgattgaaattggaacgatgtgacaaaaagttgaaagtttgtgtgtgtaagaaagttttgatgtaatagaaaaattggaagtttgaagaaaaattttggaactaaactcggctggagtttggttgccaaactcagtgcgat

SEQ ID NO: 65634 - DNA, 909 bp, Oryza sativa
tggggcaaagtagcagacacagctcctcaagggatgcaggcatcgtcggaatatccaatagacttttgcagtctttgatgtgaaacttctctagatagtagagtggcatgatttcctccgatgatgaaccctttccttcaaggttatcacagtgttcaatagacagggatcgaaggtgaatcaagctcatgagctcctccattggccaatgcacaaggtcgttgcatgcaccaatacacaaatcctccacaaaggcaaagcatttccatagcccaagatgcattttggataaaccggatgcagctgtgaagaagttgaggccatatagcctcaaaatcctaaggttttctagtgggccttggtttgtgtcgacctccagagtggccatttggttatatgacgaactaatatgtagtttcgtgagagatggccatgagcccaacgacattctcatagactcattttcccggtaaatgagttcagacaaagtggttagatgtgcaagtaagctcattgcaagactgcaatatccatatgttttcaattcttttagaactgagcaatctggaacacttgcaagttttggacaatcagagatacatagcgttgcgagcttcggaaacgtaactaagctagtattggcctctccagcagtactttctgtccatttctccaagttcgataactggcttagtgtcatatcctttaaccttgggaaaatttgtagagggatgtagtatccttcggctttcacaccaacgacattcataaacaatgtggttagattctccattttagataaagacatacactcaatcgagaccaaaaaccacacagtcgatagatccttacatcctgaacagttggaaaagtggagagttgtaggcactgcaacatttgtgggtcttc

SEQ ID NO: 65635 - DNA, 26469 bp, Oryza sativa
atacctttagttaggagaacaaagaatccctcaagtgagtatttttgtgtgtgtgttgaaagtaagaagggaatatttctggattacctcatgtgtttcaattttagcacttactagtagctaatgcatgttctttttaatcttcttctctatcattttgaatggaatctgtggttgcactgagattctccaatcaactgcagtatgtaaccacagccagggaactgttggagcagctaggatcagaaactactccagaagggatatcaaggtattcattcatgttttatttgttctctatagcactacacatatctttgggaatatcgacatgttggctgtagtataatcttcagtctgtgacccagctataatctgttgagcatccatacttaaaaagcactccagttagtatatgacaaggcaaaaaccaccaaatctctgatccaatataaaactgttataggtgaatctgatctctagatcctacactgtatttcatgacactaatatgaccaattcagtgaattgttttttttgttaaaagactactggatgctaattttgtttacatgatgctgctagtttgctttggtggatggtgtgttcatactttcaacctctgtacatgaatgaatcaggcataatctactgtaatactattcaatgagcgcaaaaatttgatgcactaactacttagctacacgtatcttaagttagttcctagtcaataattgatcttcttctactagtataattctttagtatgcaccatgctttcccacatgataaatactctgtgggagagcattgcatattttgtagctctgttttcatttggtagcagttgttcttgaaaatctcaatactcctttaaagatatgcttttctgtgcgtgagaaaagaacagttatatgaatgtttacaacgtaaattttagtcaccttccttcattttgatgaacctcagtttattatgtagattcctggatttttgctaccttttccattagcaatcttataccttgtttaattgtcctgttacccagtggagcagagcaagcatttacctacattgagttttctttttttttttgtgttacttgtgtaatataatatttttccccatgatcaaacgatgttcattcatgaatttcttctttgtccagtgtatcaaaagctaagacaagtgagtattcagaaaagattgaagcattggctgcccggcttgctgctccagaggtatgctgttgtcgtgctaatatcttaaattcctcaattgatacttcagttctttttttgggtgtggggaatagttcaattgaatgcaaaaccaccaactgcagcatatggtttacttagttttttcttcaaacaaaatcaacttacttttcagaacatatgcagccacaataactcagatggattatacttttgtttgatttttcttttgttcagccagaaaatgaaatgccagttgatgagaatagagaggtagaaagctcttatgaaggagataagccaggaagtccaatatcattatcatcaggattacgtaggagaccaatgtaagttttaaaatttgtatgtttctttttcataattattacaattagcgagctaataatggatgtaaattgaatagagctcacaacgttgttggacctagcagtcatgagagaaaagacagagacattggagcacctattaaattggatgaagaagcacaggctcatattgagaagcataggtacattaaactcttctgtatcggcaaagttcttttctttcctggtctctggtttagcttctgcgttattcttagcggcaaattcccttgttattttctaaactcatcttctaatcgcgcaggaagctgcaagaagatctgactgacgaaatggttgagttagcgcgccaactgaaagagagcagtctcaccatgcaccaatctgttcaagaaacagagaaggtagtatgcttctttccttcacctctttttcctgcagctatggtatgttgacattggcaactgtttgggtagatccttgattccaccgagagagctgtcgagcatagcttggcgagcactgggcgtgcaaccacgcgagcggcagaggtatactcgctggcttccaagacgacatgcttccagtggctgctcatcttcatgatgacctgcatgttcattatggtggttctgctcatccgggtcacctaaaatattgtaattggtgttgtttgagactgactgattgagttttgtattcagttgtgacaatgagcatgaacggaaacgaagtaaaaaaaaagtttggagaacctctgccccttggttgtcaccgcaattccttatccagttttcacataaatatacttgcattttggatatttatatgcagtatattttcggtgcaaattagattatggagctgcttattttggctctgacgactctgtgttgccgaagcacatgcatatattacaaactgcatatgaaatgcatatagtactatagtagcactttctcagttttatgttataagactttcattggtttcatattataagacttttattgaccacattcatatatatatatacgttaatgaatctagacacacgtatatagagtcattaacatttatataaatgtggacaatgctagaaagtcttatactccctccgtattttaatgtatgacgtcgttgactttttgataaacgttgaactttcatcttaatcaaaaaatttatgtaattataatttattttattgtgatttgatttatcatcaaatgttctttaagcatgacataagtatttttatatttgtataaaaattttgaataagacgagtggtcaaacattgattaaaaagtcaacggtgtcatacattaaaatacggagggagtagtagtgtagtgccctttttaacgtggatgggctgaaaagcccataaaattcacgtggcccatcaagtcaccatcaatccatctccaattctccatctctcgtgcggctgtggcgttgagctgagaagctgagcacccaaaaagcagcgcgcgcgcgccggccctagccacgacgcaccacgcgcgccggccgccggcgaggcccacgaccgccgccgcacgcctttggccagatcgcgcaggcgagatcctcctatggccgcctccgtagcgccagcgtcgtcgtccggctgggacttcacctggtgactctccctctccctctccctctccctctccctctccttccgaatggtgacgatttgcgcggtcatatttttttttcaacgattcgtgccttctcgatgagcaatttcggatgatatttctcctaccggagtgcatatgctgctgtggtgctgtgctatccccgtgttgctttcacctgcgctcgtggtgttcgacgaattgcctaaaagaagcatttgctactgtttatgctttctttggctaggcggcggtttcatttcagtttccctgcctatcaatgtgttgcgcatacttccttatacctttttttttacccccaaattcatgcaaatttgagacctattgatactatgatacatagtatagggcaatgactgctattttcgaagcattttgaactgaatcggtgggaatacctgattattttcatggagtaaatatcctgtcgtaattggtaaagctattattttgcgagggtacgcaaagctttgttctcaatgtaaagccacgaactgatggatcattaaataaaccacttccattggcgacatttagtttcttaagagttaagactggaagccagaaattctgtaataatttatcgtagtgttcagagttcagacaacacagaagaaatgaaagtgtgcagcatctgttaggaagttacaatgatgtcccactgacgcacaagcaaatttgctgggttatggaaattagagcagaatagtgattttatcgtttgaccatatagtgttattaaatgatgtattttcatgagcgaatgatcaatgccaaaaaaaaaatagcttaaaaacttgtggcgaatggctgtttcatggctatagtctcacaaacccagccttgcagaaaactcttggagctagtagtaatcaacttgatatatgttgcttttatgcatactgaatcatctgctacctttaatcatcctgttcctcagacattgctacttacgcatagtattgcatcaactatgtagctcatatgtagagaaaatttatcttgcactaacaacctttttgtatggcagtgactttgaaattgattatggatccgaggaacgcgcatccatagtttacaaaacgctagctgttgataaggaggtaagaagttatagtacactttaacatggttcttgttttcataaggagtcccaatgtttcctcttttcttcatgctagcttgttgagaaaagaactcgaatcctgtggtatttatcttgcagttgcaacctgacaaggtaaagagggagatgtctgtttctggtggcaagctcgtcgtgtcagtaaatccattcttaacaattgctatcgattgtgtttactttgattcacgatgtgtactgatacaaaattttctgaatctaattcaggcactttgaagctgtagaggctcggttcctgcgagcatcgttcagcgcgttcgtcgatcttacagtactggttaccaagcttgttgaagaatatggcatcagcaaggaaggagaaggcagtatctagctagttttactcccctgtatcttagaaaaatgttttacaacacctttgagcattcataccttcttttatatcatattatgtgtgttcttcgtttcttaggccagaaatctacaagatagaagcagctgttgtaattccagatttcttgaatcttggtatgggatttgcctctcaagagtaactctgaacatacttggttgggatagtagtcagttcttgtcgccttaaatgaaaaatcatgcatgtatagctcactgtattatataacctgataatgatgatgatgaatcgtaaaaaatggacggaaatccaagaatgcttcgtaaatatatgtagctgaaaataaattgactcggataaagctaggaaaaaacagaaacaaagtctcccctcattaattaatttagtaggaagagaagatgacaagagtgctatctcattgatagaaaaatagaattggcggaatattactccctccttccctaaatatttttgatgccgttgatttttttaaacatgtttgataattcgtcctattaaaaaatttaagtaattattaattctttttctatcatttgattcattattaaatatactactactatagtttttaataagacgaacggtcaaacatatttaaaaaaaaatcaacggcgttaaatatttagggacggagagagtattacccaacaatacaattaaacacgacgtacgcacgatcattagactcaatttaaattacgacaatacaattagccagtctctcatagccgaccgatcagctaagcgacatacacgcgtacatgcaactaaatttaaattacgacacacacaaaacctagacacacagcaaactaaatttaaattgcgacacacacacagaaacgaaccttagctagctctctccaacctcactaaattgaacatgacacgaacacacacaattagtacagctacatagtactacgctactactcctatatgggacacaggtgcatgcgtggcacggatcgatcacactagaaaatgatcgaactacgaacgtcggcctgcaggaggtatcttcctgggcggcgtagcgtccctggggctgtccgacttgatggagcacagctcgtccgaatcctcgccatctgaagtccgagttatgatcaagtcgtctatgtccagatacatcggtggcagatctgcaaagtttattaattttacagcaattaatgcatgcaataatcaagtaagcaattgaagctatggcaataatgcaagaaatcaagaatcaagaagaagaagaagaagaagaaagctagaagttatataccgtgtttctccctctctcgttgtgtttcactcacgctctgctgcttctgggatgatgaggatccctgactttgctcaccttcacctccatgctgctccccggtgcccttctttctaccagacttgagagctaccctgtgggccgctagatttcctgtaggttccacagccaactcacaggaatattaattttcttgacggggttacttatacccacagaaaaattgtgttatttttgtaggttttcacacagacccacagaaaaatagcgctgacaagtaggcctcaagaaccatcaaataaaactcaggcagccaagtcccaaaacctaattccccacccctcttcccaaaccctcgagccgtcgccgcccctctattctctccagatccgcatggcgagcgcctgtgcgataccttcgacgaacggcgggtcggctaccgagcctccgcccagcgccatcggcaagatgcagccgaccatcaccaccatctcctgccggcgacgagcttccaccatcccctccactgccggtgctagccaccccaaggcccaagctcagaacctctagatctggatgccccaaccctgggaaccacggatccagccgtatcgagtgtgggtgctccagatctcgcggttctcggctccggcagcgccggcaggagaatgggcgctgcccctccttcccctcctcttcagtaagtaaaagcatccaaaaatatgtgtttcaatggtgaggaaacggtttggagcacctctgtccatgctagcatgtgtttccgctgctaatcccaaacaccgatttgttcagatagccgccggcggagatttctaggagttcaatttaatctgctccaaagttgcagccaaccattctccttcaggatgaaaaagtgtaagtcatactagtttacacttgtggattattttggctttgatccgtattacgtgactgcccagtagtagatctagattgggttattggcccttgaccacaagtttaatgattgtcagtggaatgtcagtagatctagattgggttcttgtgtcaaaacctgcgttgctgcattcatcaactaatctagattggattagttgatccattactgttgttgccaattattattttttctcagagctctgattcccagatattaagcaagacaagttggttcccatattgtctacattatgtgatttagtttctataatagaaatttaattttcttggattacttactcctagagtataatatttattttacatctaaatgatttgtttcttgtttcagccttgtaagacaattatgtctggaccaactaattttcctctagccattttgtgaagacctaatgttgtggcatgacagattgacaggtactcccacactagagtccctgctattcataaaactttgtttgtgtctggtactgagttgtttgacatggaattaatctatcagtggattatcatgcactatgctttcttggtcacatttagttagaatgcagatgcttttcttatgctatttttaccttgcaattcatggtaaggattgtgtgaataatgagtattatagtgttttattttctctgttttagtagctaagaaaacatatttttagctcaggttgtatgcatgaaatcattagtgctttctagtctctactagtgcatatacatacttcacaagtccaagtccatgtatatcttttggcaagtcacatactgctacatgtgttggatagatacatgccatcagaacaataaattagtttcagtctcttgtttttaaaattttcttatgtacaaaccctttataatttaccttgttcatggcactttgtatttttcttaacaggccatagcttgaatctttaagtgctgcagttaaatatctacagaacgttgcacatgatgaaaatcaaggtatgcttctcattcagtggatgaaatctttcttagtctaagatgtcctagcatttgcaccatgaaacttgtcatttaagcatccatagaaaatgagtttgatcctattatcctagcatttatgtcttatctgaattggcagagtactacaggaagtattttcatggtcacttttcatttcagttgccatatttcattttcatgctttgtagttgacaaatttatgttgctcacttcagtttttcctgtactaatctatttgtttctctataactggggtattcagaatcattgttatttattttgtaatgaagaaaattatgaaattgaacctcttttttaaaaccttttagcttcctttgcccaaggttgaagcaccacggaacacggactgctgctggaagacaatgttcttttacatatgtttgatgaattgtaactgaacacatttatcttttctatggaccctttgtatattactaaatccggtttgaatgaatttgtatgtactgaacttagatggactatttatgtaagctttgcagacttgaattttgatgtatggattgtgattgatgttcatatatttatccaaatcaccatgtgtttttttttgggcgtggaactcattttttctgacggtggatgatggtttttcctgatgggtccacgtcaaaaataagctttcacaaacctgacgccagttgattttttttgtgagccaaccgacaggaattcccgacagaaatgatatttctgtcaggaaaacgacagaaaaatttattttctccgtggtcttttttctgtcggcaaactctgacggtgcacccacagaaaagtattttctgacggtaattcatattattctgacggttttcggcctacagggtagacctcttgatcttctttttcttctcatcatcctccttcttgtcttccgacgactgtggccgctcagcacggttcttctgcctgtccattggagcttaatttgctagctaactaataactatagctaatagctaggcgctggctaactcgatcgaaaagagctgcttatcccacagcttgtctgcaggttgcgatgacctatatttatagtcagtgtacatcgatcattgaattgatctttgttcatgcttacctttaatttgcttctgacttgctgcattatatataatccaggtcttgagatgaccagatcagtgcggcgcatggatgtgtcaaaagagatcactgaacaagtatagtacatgcacgtgaactagctagctactgtaaaatggatcggagtacattgcgacagagagcacatacgtactgtgaaacaaattaaacatcataatctaattcttgcacttaaatgtccaaatgctagtttctcgcaatctctggttgtagcagaaagagccttaattttggatcttaagagctgctattattacttgatgacgagaagtctctgtactttaattagccgtgcatccaaccaaagagtgcctccatgctggttctcatttcggtttagaagaaaacggagacggcccagcaaaccaaaacgacccatctgtgagcatttaatttgcatgtgtacgccttacgcatttcttcgctaaaaaaatagttaaaatttttcgggcttggttttgtatatatatctctctccctgcccaagctcgtccaataactatcgtgggccttttttttttttggccagacttcttcggccccggggaggcaagcctagggacaatgcatatttataaatgaacaataatccaaatgatttaagttatttatatatattattatacggttggtcagtgttggagaaatttattacttctttccaaaacaaattaaccaaatataaaatgtttaaattcataatattatgatgtatcgcatctcatatttaattggtttattgtaagatagagggaatactattaggtacgcttgatcatgtggtgtgtgccttgcattcatatgaatactactctcttcgtcccttaatataagagattttgacattttagttacactgtttgactacgtcttatttaaaaaatttgtgcaaatataaaaagcgaaaagttgtgcttaaagtactttggataataaaataagtcacaaataaattaaataataattccaaaatttttttgaataggacaaatggtcaaacagtgtaagcaaaatatcaaaatcccttatattaagggacggagagaatagtattcatatcaaatggaccaaatacaggcagctgatagatatagggatatgctacacaaagacaagctcaatgtttgtgtggtgtgatgtaatcttaggagtgagcccatgaatagtgggataatgttaaagcaattcgcacaatgctattgctatggctaggatttaagtaaccataagatagggccacatgagatagaaaaaaaaatacttcagctcttgtttatgaggtgaatgagagagataaaaatattttaattttgtttgtgatagaccttaagtataatgtgcaccataaactaatgctacttaccacaatatatgtgacttattttataagtgtaattattattttaagattatatttttcataaattattattgttgcgctaacgccatatcgatcaaaaaaagtgagcagaggggaatatgcatgatatatagcatatcacgggtatgattttgactgctagctgctgctgtatgtatgataggcacaaagctggttggccatgcatgtactgcgtttgcgtggtccatttgaccagatcgacgtgagccaaagcttaagtgcggtatctccaatagggaagttttttttgctagtatcataacacttatcgttttgctaaaactgaaatcaaactttgtacagctttaactatgaacaaaatttaaaatatttattttagaagcatggaaactatatgtatatattaatattgaaatatactttaataaaatcatacattcatgatatttatttaaatattgtaatagaaaatagtgataaagttgcttcttaagattgtgtcccttgttcaaaacaacaagcatatttttaaatggtactacctccgtcccatataaattataattctagatggttgcatatattaaggattgagaaaaaaaactataatcgatgctccttattaaatgttctatatatagataaaagtggaggggtagttgagggtaaaatagagataaatttgaatgagaagtgattaatgagaccattaatactatattgtgataattattttgggacaaatttaaatcctagaaatataactattataggacagatagtaactagcactctttttaaaactaattaatatgggtgttaaatgctgcgtgcatcttggaatgcgttatatataggagtatactactagtagcttgtgtgcctataaatataatcgtatgtcatatttaaccatattaattgtgatatatattatcacgattgcatgcatggtcaatataattcttttatttattaattaatgtaagagtttctggcatttagagtaaacgcgatgttacctttattttactatgtttataatatatatagtccagtatatatatctgatacattgttgacaaacttagtattacttaaaaaaagatgacatcaatagcagtttatttcacgtacggtaaatcaatgcggcgtacgttgctagacaaaactagtgcgtaaaaagtttcgagcacacgcagtcataataatgcagtaatgcagatgaccaaggtgaatggggtagtgcatgcatatatacacttggtcaactctgtcgtatacagtagtagacatgtaaagtactaaactttattcggtctcgtcatcgatatatcgtcatactactttactgtagttcatcagctctgcatttgcatatgcatgcagatatgattcgacgaccaaaattaattaaggctgtgtttaatccaaagtttgatccaaacttcagttattttttatcacatcaacctgctataaacacaacttttcagtcatatcatctccaattttaaccaaaattcaaactttgcgctgaactaaacacagcctaaggtgatgtcaaccacacgacgaagacgcgcgatatgaagcggtccttgttaggataagacgtactacgagcgatccttttggacctcatggtcagtactccgcatatccgtactgacgattatattgctggatggagcggcttgttgcatttcatttccagtagatatagattaattgtttatttctttatttttttcttaaaaatccagttaattagattgcacagatggttttatatatgatcttcattttggacgtcaacgaaattacaggagagtgaatcgtgttagcctagataaagtatggttgggctagtttgcccatataaatatagtttccgtttggtccactatgaactctgcttgtctacctaccccaccaccaccacccttttctctcccttggtgaataatccaactttttttttcgcgaaatacattacagacggagacactcatatatacaaacgtgcgcatgtaccctatatatctctatgaaatatacaaaaatgccaataaggagtacatgacataaaaattgcaaattagctccatcagcatagactacgaccttcttttttgaaagtcatggggatacgcaaatgcaaagcattcgagtggctagttatctactccctccttccctaaatgtttgacgccgttgacttttttaaacatgcttgaccgttcgtcttattcaaaaacttttatgaaatatgtaaaactatatgtatacataaagtatatttaacagtgaatcaaatgatagaaaaagaattaataattacttaaattttttgaataagacgaacggtcaaatatgtttaaaaaagtcaacggcgttaaacatttagggatggagggagtaatatagaatttggacggaggacacataaactactattgccctctctgcaaatataccttcgaaacttacttccatctccacacgaaaggcagatacacaagtatctggaacatattagcaacttggatcggctgcgaggagggacttctgaaaggttacaaatacggtgcacaagtacgtggagtgcccacctaaaggtcctgtctagacctacgatggtgaggcgaagactgaggcacagttacacgctgttctattgtgagcatgaatgggatgatgttgcgtgccgggcggctggcttgggtcgctgtgtgtcaacctcggacgacccaatagatagtggaacccgattagagcaaggataatagtgagatatgcttatgtggaggagagagaaaaaaaggtgttggctctcatgcaagagctagctttgcacgtgctccaagacaaatacattaaatgtataaatgagagaaaaagataggagaagaaaaatcaaagataatcttagagctagctctgcacgtgctgtttttcggaaaaacccctttattttttatctttatagcgctacctctagaagcggaattttcttttcttcgcattgtatttctgtgaaataggagggctttttcagaacaaacacaacagggtgttgtccagtctgaggacatatgcgatattttgtgcaaatacgaggagttttttttttttgcaaaatagccttttaatgaaaccggctccaacccacggtgcagacccatagcgcctaaaattgcgtttggccggttaccgcctacaagcggtcactcgtgcgcgcgcgaggagccaactacagcaaatgggcgacgtgtaaatttacgggatagctaaaaaataaaaaacatgagaaaaagggtacggttaggctggttattgattgatgataccccatctaccatggggcatagagagaaacaaccaagcaagtggttgtgccggctcaggtacgcacggagtccagcattgagacctcatacatctacaacagttggtatatataagcagtagatggaaatacattgaaatccctaagttaaggagctgcaaagacagatgaagtagcactgcaaaacaaatgtccctcttaggaggatgaaatggactacataaacacgagtttcttagtgcccaaatatatcaaccacaaaggtctgtaattgagcatagctgcccctgattttagatatgcagaccacagtgaatgattttcttacaagttccaagctaagatcattctacagttaaactcatgatctcaccataatacgctgggttttctctgggttgacaaatacactgattatattcatgaaaatcattaagcagtgcaatactacctacatgactcagcgacacacagaaggcaacgacggacgaagttatggcagaaacactcttaattttgtaagtgtttttgtatttggaagatcaacaaatcttcttttggatagggaaggtcaacaaatcatttgctcaagcttaatgttctcgcaatatcttctcattgtaagtgataaaacgaaacctgttagaaacttccgtttgaaagaacatgttattgaccctaaggaaagaatgtggtattgaagcattccaatcaacacaataagttattaaacagttgctatgatcacaaaaatgttcgttcttttagaaatcaaggtacaaaggaaaatatctggtttcatgttggagacatggcagcatctgattcatattcatgcggataaatcagttatcacatcttctgattatgtagagcttgtttttatacactcaacaagctgcaaccaaatgtcagttcgaccaaagtgttctgctcacatttcctaattaagtatgtccctgtttcagctaatatataaaagagcactctataaagcaaccaacctcatcctcagtttttgtgatttctgaaatttgcttctttcctctaagaagcggctaagttcaatccctaagattgaaccagattatcaaatgagagacacgccaagatgtgttagctgctcgatttacacggtttctctagaatttatgttagccgtacaaaagaaaattaaccagttgtattagcactatcagttgtattatcactgtgtaattaagtacacctctgaaaacctggcgaattttgtttcacatttacctgcccctgcagagaattgtggtgttgagattgcttgaagtaggtcgaggtaagtaattatctgaaacatgaataatagcacgtacagttttgcatcaatttagggttgaattaacattacgatcaagagctggtggcggaagtagggccaccaggggcgtaaccgccactctgtgctgcaaggacggagcgacgtacgcatggcgagatgaggcgaggtggttggcaaagaagacgcggcgttgattgaaccgctccttgccggccgtccaagtggtgaaaggcggacggcggaggtcggcgcgaggaccagcagattcaagtgcaggtttagcatcgacggcagatcaaccggtggccggcaattgagcggggtgcgggagtggaggcaatccagccgggttcactcgacgataatgacttgaagccggcgacggcgcggtggaagagccgttagcgagggaagagaggatgtggcgctgcgggtggggggcgcggtggcacgatggtcggcgaatcgcgggcatgggcgggttggagattggtggcggcgattatggagtcggactcgggaggggaaggggaacctgcggggtaggaagaggttggaggtgggatgaatctcaagcattggatttaatatggacaatttgaaccattgcattgagtgatgaatgaaagatagataaatagatagataggcatagagaaaattcctatatacccttaaaaatttactcaatccctttaatacccctgaatttgacctcatcccttatatacccctgagttttcattttgatcttctctatacccatctccgttagttaaccattagttgaccgttaaatattttaaaatgactatattacccatcctatacatatgtggtacctacccaataaattttcatatgaaaaaattaacttatacaaaatacaagcaatataatcatttgatgcccaacttaaaaaataaaacttattattttttattattttttaaaaaatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattacatcccctttgtttttttacaacgaatctttttttactaaatatttgttgaaaagtaattttcaaattttatgcagaactttttttacaataaatcttttttattttcatgaaataatgttttgtttttaaaaattcataacaaatatttagtaacttattccttattggttttcacaactcaaataatttacacataaaacatttctagcttttaacaatataccaaggacaataaagtaatttcttcaataactaacggtcaaactaatggtcaactaacggaatgggtatttaagggatgcaaataaaaacttaggggtatataagagattaaacaaatttatggggcgtagaagggattgggtgaaattacaggggcatgtaggtaattggcccataggcatatgcttgtggttatagggcttgtttggttctttaccctaccaattcattggtagtgccaaagtctagaaaaattttggcactaccaaaatattggtagggtaaaattatttagctaacatttggattgctaccaatttaaagccaaatttttatagcatagtgaagaaacttctagaatatgaccaaatattttaggggcactaccaaatatttagtctcaatccaaactaacacacaaactattcaatttgccaataaattggtagggtatgtttttggcatcaaaccaaaacggcccatagttttgtcaaggtctaagatatagaataagtttagtaaaaggggtaaagtgtaaaaattcctgccaccccaatccttctcccggccgtacaccatttcgttccgacgcgagtaattcctccccacgggcggcgactagggcggctagggttcgtcgggcgccgccgtgccggagatcgcctctcgccgccgacacccggatctccgccgccgccggtcgccccaggttatcccgctcccgcagtcaccatcccgtcttctccgccagtcgcctcacgcccggcctggacgccccggaatccattgtcggtctcgccccgccgactgccgttgacgccactggctgaaggtaataagccgctcacctctccctctccccctccccctgcgagctcatggatttaatccattcgctcgtgcgtgttctccgtacttgggtgaactaaacctagttcgtgttctccctacttaggtggagtaaaatagttgaacgtttgttctctgtacaacaactgtcacctatcttctcatttaggagcttcgatttatcctagaatgaacggaaccagcggttttggatgagttcagtactgtggtactcttgttctcgtggacgatttagaggagccactcctgttgagaagaattatatttcatagttccccgatggtaatgaatcactagagcccgtattttgctagtatatattgattaacttccacaaatgtgaaggataatcatggtgcatagtttttgtatgtcaagttttctcaatcaggtggcagctgtattgcttgctagtaaaaatgttgtgctgattggttgtttttaaaggcgatacgcagattggttgcttttcttagatgaaattctgattggttgctagacaagcagtttgcccttcaaatgctatggcccacctgcaaacgccctagagtgctttggtgctctaatctaaatgacctaggaaaggattaggatgctgttgcttaagttgtttgggctgcaatggatacaagttagttagggctggaaatgatgatctccattttcagaacatataaggctgggaatgggccttggcctgtcaccaggccttcaaatggagaatagacaaactatgtcgacttattagttgtgttttctcttgctcttcttttgtctgtaagtgttgggtgttctatttgtttttatacggaattaattgcacgcaaaaaaccgagtgctcacttctgcaacgttctaatggttgcgaccttgggtcgttctcccggtggacttgtaccacaaaatccgcaactgccgctgcacattaatcacttcctccttgatttttcaattttaaaattgaggcccccccacccccgcaaacgccaatcagatggatcggaattccttaattattgccgaattattatggaatcctatgggttgtttgtcgtacaaagccctttggaaacttcattttgctcagcggaggacatgtgctggttagttacatatggaattataagcaggaaatcagctgcattttgcattctcgttagtaagattttctttttatataaaaaagaacccatattaggaccgttatctcgttctcaccccacagattgcgtatcttctgcttcttcttcttcttttttttgctaaactgtgaaatcatcgagaaaatcccaaatttttaatatcatttttacagtttaagcttcaaaacctccaataacatgaatataaatgtttatccataagatttttttgttagttcatttgtttttttgtcgccttatcaatgatagttcaaatgattagagcttagcaatccttttttcaatttatactctcattttccacgtgtttcccgaattgctaaacggtgtaattttcttttaaaaatgttccacaggaatgctactttaaaattatattattttttattttagttaataattacttaatcatgcgcaaataagatacatcgttttttttcgggagaaatgggttagcagcaatgttgcaagctactacatccgttttagattataagctattttgactttgatcaaaattaatctactctaagtttaatcaagtttatacataaatatactaatatctacaacactaaattagtttcattaagcttataattgaatatattattatagtatatttgtattgcgttgaatatgtgactacttttctaaatttaatcaaatttgaaacaattttactttaatcaaaggcaaaatgacatataatctaaaatagagtgagtatctctgctgggtgtggtgggataataggaaatagggagtgagagtgcgattgaaaattgaatgaagagttaggattaaatgaaagagagagatatgatggtgaggacataaatatgtgcgtaggaggagggaaatcatctgcatatcctattagccaaacactgggctatgctaatagcaacattcttcaggagctggatgcaaatttggcagaccaagtccaaaacacgacagccagcagcagcagcaggacaccaacgcgacgccaccacagtataactcgacgcccccactcgctctctcccccaacccaatgacagcatcagtattccagtagcagcggagagagagagggagcggccaaccaaaagcccaagccaagccaacgccgcgtcgcgtctcagccagccagcgaactgcctccccgcccccgcgcttgccggcgaactccccccacctccggcggcccggccccgcctcgctccccggcatcaggcgatcccccccatccccttccccgccccctcccctccccgcgcgcagcattcgcagatcgcatctggctcgctggccgcccgggccctgctctcgcttcgcgtgtgatgtgatgtgatgtgatgtgatctcttccccccatctctcgcggcgggattttctgggggattttgttttttttttttttttgttttttcttctcgggatttatgggggttggatgggatgagatctcgctgccggacttagggatggagtacagctgaaatggcgccgtcggtgtagtgtgtgtgtgtgtgtggacagcgtgcggcggtgtgggggtagttgtgaattagcggtggtcgtggcggcggatttggaggggagatctagcccccgctcggtgcttcctaggtttgttttcctaggtcgtggacggaattgaggaggtactgattcggatgagggtgtcggtagaatacggcgttccggacgacttgctggttgctgcttgttgtttcgggttgttgagttgactgtagctgagttgctgatccagttcgttgtgaattatgcgctaatgcagtggtacttctccatgatgatgattttgcctttttgtttccccttactattacatgattcctcagtacaaatgagcaatcattcgctttgtttgctttggagtatggatattagtggcggtttaattattgtggtacacagtggtggaaggattgcagagttatatatatacctggtggaatttggattaacgagagctcaataacaaccacattgtggttgatttggtcacctatagtttcctatgagcatctgagggctgactaattgctggactttagaaattagaatagctgttgttgcttattgtatttacattgctgttgttatattgttcctatatggatttgtaggctacagctgtaccatattttaattgaaaatgctccaattacttgtcagatatgattcactagctgcatatgaaactttaggagaggtctgagttgtacatggccttatttttctacaatttctctgcacaggtgtgaatatgtcggacagtgcgttgaaagatctgaatctagctcagtcagcagagctggagaaaaccaaggacagttctgccaagtcttgcatcaccaagcctgtcttgaatggcaacaaatgcaacaatacggaagaaaatgctccacctgtactccctgatgctgtgactaatgggtgtgaagctggaaatgcagatgttgagtatattgattctgagagtctgacagatcttgaagatgctggtgcaacccttagtgtatgccaccagatgtttatattcatgatcttttttgtgcttggcatttttctgattggaccagccctaacatttgatcatttcttactgcttgatagactttagttgcaaggttggattcaaaagactgggttatgacatgtgaagctctaaataatgttcgtcagttggcaatatttcacaaggatagattgcaggaacttctgtaagttgcttaccttgttattcaatcaaaaggatctttgtttttgggcaaatgttacttatccatgcctgaagctatagaattacatcattctctgtatcttaatttttggatttgaattatagggaacctctagttcctcttatcatgaaatctgtctgaagaaattcattctgttttttttattggacccagttttattctcttcgattgcttgtatctcaaaacactcaagaatccaaggagcgctgcctgtaaagctgcactcatgacctgttctaatcttaatttttggatttgaattacagagagcctctagttcctcttattgtgaaatctgtcaagaatccaaggagtgctgtctgtaaaaccgcactcatgacctgcgctgatattttcaaggcatacggtgacctaatggttgactcaattgatccactggtgtgtgtttctcagttctcaaacttccattcacaattacactagttctttttcctgtactaactacgctatttctcaaaacatcttttctgccaaatttgttctcagttagtgcagctatttctgaaatcttcacaagataagcgttttgtctgtgaagctgctgaggcagccctcatatcgatgacaagctggatcgccccttctgctctgttaccaaaaatgcaaccttaccttaagaacaggaatccacgaattcgagcaaaagcatcatgtgcttcagcaagagcgtcccacgcttggtaagtgaaaatctcacctgaaatttattttaagctaaccgcttttgttttgcctcaactgttatctgattatctcctaattaacctaggagaggccaaagacaaactcaacataggatttagctctcttttctcacattacaagtactcaatgaatatcttaattcgtggtcttgttggttggcttagagttaacacgcagttttctcgaccttttttagtctatttagatatgcagatgcgggatgaggtttctgtattataagacagacctgtagcttttccaaaactatgggctagtgtgtttggtagagattctatatgccgagaataattagctgacaaatgatttttacctgtggccttttacttcgaggaacttcatctaccctaaattgcctggccattattagtagtgtgacggtatctggaatttttttttcttaattggcttttatgtagtttgtatatcaatggttccatgctctaaccaatgctgataacatcagttttagatgttttacttaaattgacctattttgtttccagggtgtggagggaattaaagaatatggaatggataagcttgttcagatcgcagcaactcagcttagtgaccagcttcctgaatccagggaggctgctcgcaagctggctttggagctacaagcattctatgagaaatcccaagcttcgagttctggtgaagttgacgacgcacctgctcctcacctgatgctgatgctgatgctggtgctgaatcatgggaagctttctgccaatcaaagctttccccattaagtgcacaggcaatccttcgtgtcacctctacgacgaaagagggtgtggctgtgggtgtcacctctacccctccgaaagaaggcgtcactgttggttgctagcatcaggaggtagtagatgcaatgaggttgtggtttttccatccgattcaccttttgctgtacatggttatggttgttctttctctacatccaatctgggattcgttcgttaagcatcggttcgagagttgaggtgtgacctgtgggtgttaatattggtgcgagatatacctgttatagttgactgtatgatcttccttttctcccactgcttggtattgattggtcaggcgaattgtagaatttcttccactattcaatattactacacagtaatttttccatctcgtggccttgtgtttatttgctggtgttcactatttcgtgtttttgaattctaacttcttccattattcaatattatcgaatcaattctcatcagtgctttcttccactggtttctattttactgaaatttttatgctgttctatgagcaagaaataactaactgggctcaaccaactggtactccaaagaactgtgacttgtgaagtttgatcactgtacagttgtacatatgtcacagactcatagtacacgttaaacatcagagaaccccagattatcacagctgcacgaagattaagatgatcatgtatgcatgcgtcgccggcaacacattctgtgcacagagaaaaacttggacaagaacatgccaacagctagcccatcagccggcgatcaccgccggcgaccggccttgccgcaccggacgctcagccaacgatcatcggcggcggcgtcgccggagcaaccagcatgaggtgcgccgccgggtgcagcctgaacaccaggccgccggcgcacccgaccgtcctctcctcggccatctcacgctcgatcctcgccaggacggcgacgaactcgccggcgtcgcaggggagctcgagcgggccgtccgccacgtacccgtactcctcctcggcctcctccagcagcgccctgaacagcgggtggttcacgcactccgtcctcaccacgaacctctccctcgccgcccctccgccgccgccgccgccgccgacgtacaccgcgaagctcccctccggcggctccggccggccaccattcctgtgcttggacaaacacctgtccagcagggccttcatgatcactccctgcttgttcctcacacctctctccttcatcaacacaacagcaaattaaccaaagcttatctgaacacaactatcctatctaatttacaacttagtgaaggttgggttgtattaattagctgatcaagtgttgctaattgctatggccttgtccttaagtgacatcagatcaaactgagataagatggttagtgatcaaagttttgggagggggtcagctaagacctggcctgaagaaagagtgttgcacttgcacccctgcaccatatatagactgtactgtgtggggccttcattttattttaattatttggtgtgtgtgacaattaggagtaagattgtatatttggtgtagatgatgagatcctgtgggtctttcctaatcctacccatcattagatatttaatccatggttaggttaatttttaccatcttgtcctcatattgcacaagggacctgttcttgacaagggttgtgttggcaagatggcaccatgttttgtgaaaaccagattatattgcaagggtaagttagtaatttcacatcacgttgaagacctttgtgtacttgaccgtggtaccggttcaaagtttaggatggaattgacaaaactgaaaatttgtttagtgtgaagctaaaatggctaatgcgaaaccagaggttggacaggattccaccatctcattgtcaacccacttaatatccaatgtcatcagggcaataatacacatgttagtataagatcataagaaaaatgtcactttattggttgcaagttgacttggagctttgcatcggtcagcaagtttaagtgaaactctccaaccatgactagtttactctaatgaatttccttcttcagaatctgccttttcatttctgtcagcttgcatcgagatctgtctgaaggattcagagaacggcacatcgacatcctaaatctgcccaagggtttaacacctggatcaatgcatgtcttaatcctatgagattagtttagaattcttgtcttgattaatggtgctctaatgacaccttgaccgacaatgagcaccacttgtcttgatttttgtggtgcaaaatgatactaacaaacaatagtaaagtaagggttaatttgggaggtagagtaaaagattgttcgaacaagacattgtttagattagataaaatcataaaatacaattcatttcgtcgtttagcgtgctagtctacttcaccttccatcatccgctcaacggtgaaattttttttatcgcccaaaccagctattattaccgcggaattgcgtattctactctatctttgtcaaatcactccacgataatctgcttgttaattcacctggtaatgctgtcttttattaatttggaaggttggaccccctactgcaaatctgcaatgatgcagatttttcatgcgtgctgaattttgtgctctaatggtggattgtgatagcgatttgcaccattttgtgcgaagaacttacatgaatcagatagatgaaaaacctcgagctgtcagatgatgctggagaggcatatgctattctcctgaaagctcaactgcctgaagtctgaactctgaacatgttgttcagttggcctcgttttctcacctttgctggaacaggggtaaataaatggtgacgaattgataccagaagaaagtgtggtaattaattaattaaaaagcataattaacaagctcaaatcacgatgctcaatataataattactctttttttttgttcttcctcgaactcgaagaacgcacaccgtctccctctcgactgtgactctccccgtgtttgggccacacgaaatcgagatcagaatccgttccggcccaatgagtagcatgggccgcacataagtctaatcctactcctttgcagaagagcgttccaccaccgcgtccgaccgccgacgcgaccggcggcgaccctccctcttcagccgttcgccggacttgcggccagactgatccccttcgccgccgggagcaagatcaggcggtgtccgcggcggggctcgtcgggatctgcccccatccatggtcgcacggcgccgcttctgactgctccgcccccgcgttgatgcgctgcccgcggcatcgagccgcaaggtaattcctcgtcggagccctcctattcgcagcaaattagacaagcagatgttcatctaaagcgttgggggttagaaatttcggaaactgattggtctcgtaaagcgtctccctccccagactccagagagtgatgggatttgggggggggggatgattatgctgtacaagagtagtttgatagcaatgttagtggtagaagtgaataatcttgtatggtctgatgttgtgtttgctgggatgttgcataatggtg

SEQ ID NO: 65636 - DNA, 1144 bp, Oryza sativa
tccccagtgcacccaaaaaaccagacaacctaacggtatattgtgttcctcaagaagctagtagcctcttaatttctgatttctgctcagacgtcagccttgaggggaatttgatgttgaacttgatcctaagatttcccttctttgatggatccttcggaattggcatgccctctcggagaacaacctcctcgtagccagggtagacgacattattgattggtactgttaggttccgaccatctagtgctgttacctgaactgtacatcctgtcaaggcctcagccaaggaaatcttctgtgtcatgacgagatcattcccctctcgtgtaaacagatcatgtggtttctcatcaatcacgaatacaatatccgcaggaatcacatgcggagactcgttacccttttcaggaaaagtaatttttgtccctttcttccatccaggttttatgtcgattgttaggatctcctcaacaaccatggttctcctgccaatgcagaaatacgctagtaaggcaccaaatggaagtctattgcaaagtatataaaaatggcatatcaaatattgaagacaacacaagataaacacagaatgaaacagactggataagagcatgtcccatatgacaaaaaaatggaaattagtggaaggcaacagtaacactcaaaataatccgaagcatagtactaaatagcggccactattgcagtagcaggctttcatagtaatttcaagcccagtcaatttcaataattacaggtcctagacaggttaaacatgcagaaatacaaagttgatggtgctagcttgcacatgcatgagttttctgctgttcctgtgcaactaagatataattgtttatcatgaatgtagctatgcatacataccagatcatcttccagttctacttatgattgatgtccttgtatgcagtgtacttctaatacatgtcttattatgataaatgccatcgtatgttcatggttaagttaaacttatgatttatgagtattttttatagtccgctttaggaatgtaacgccgacaatatcccccacaatccgctacaactctgctatctactttttgttatcttgatcctaacggaataatatgactcatactcaaccaagagaaacagaa

SEQ ID NO: 65637 - DNA, 2531 bp, Oryza sativa
tttttacttgtatgcatcatgaaatttcataatttggctcaccacaataaaaaaattattcaaaaaaatatctgttgagatttcatggaaaattgggactagggtacaagaatgaggtcgatgaggtctggtagctaccataccactagggctagtccataaatttaggggaaagtaatcctaaaatatatggaaaggacttcaaagcttgaacatattcctctacttgagcttctatacaagtacacataaactcataccctaagcactaggaaacctagcattttaagcatgaatatgtttgacaacacaccagggcaatatattacattggtaacatcacatgataaaggtaaatttaattactgacctacacatcatacaagcaaaagtcaagcagataaaggtaacagtatcagtatgccataggtaggccagaattgtaagcatgaatatgtttgataacacaccaggagaacactcaattacatcaataactcagatgggtgcagtctgctaaatcatgcatacataaaaagggctgttgcataaacgtcaatgcgtgcatgagacagcataaacatttgggaaatagcaaaggaacaggtgtttgttgaagaatggacaacacatagagaacacatgggatcaatatttgaagaagctgaggcttagcaacaaagtgggatcatcgaggtattactcaatactcccgtctgatcgtatgcatcaatgccctcagtatcaagaagcaaaagactatattcagttccatcaagtgcagttctttttattggggcactccacatccaaaggcccttggtgcagggccgatgggtgcttgctacttgaaatccgctgcttcttcctagaagctgtcaaaaacacagaaatagagcagattactccttgacaagataattagctggtatataaagtactccgtaatcaaaatcttgatatatatgaatttgctaacgaggcttcaaatgcaagaaattgagatgtcaaaaacagactcttctccaaactacaaagtctaatagaaatacttttacaggtcatgctctgataggagtaaaaggacatctgcagtcatttcacacccaaaaaaaatgaaacttatggtaaaccttgttagcatacatcaattccacaaaatagaaaatataccacacttagtccatcttcctttccgattttattttcaagacatcataatccttaataagtcattatataaataccaaaggatgtttcatggtccactagaccagaatcaatgttaaggtctaacaaatataaaatatcctcaggagaatcttgtaagtgtcatcagtcatccataaattcatcgaatcaatgaccaaagtaaccgggcagcaatacgccaatatggtagtacacacaatgcataagaaaagttggccctctttgattatttaggaaagttgcatgccttaatacacccaacctttatcacggttctgaaagaatgtatagcggaaagaagaaaaaacagggaccaaaactgattcccgcaggtggaaagtttattgagaagaaaaaacacggtaagcaaaagttttacttttgcaatgcaatttctgcacgagacatacaacccacgaaatgttgtcttttcttcctatttctaaatgaaatgtttacgccgccaaccaagaccccaaccttccctaccagtgtcccctacagtgcctcgaactgatatttatttcttccagattcttatcaggatcctactagtgttccagtgccgatccacaggacagatttgttcaaccattggtaaaaagaagaggggggcgagagcgaacctggttaaggatgaagctcttgccctgcctggcgcggccgcagacggagacgaccccgacggggcccttgacgagctgcagcgcggccaccgcctccgggtccatccggaacctcccccgctcgtcgcagtacaccagccgcagcggccgcccacccccaccccccgcgaacggcgaccgcggggaggacgccgacgacgacggggtccacggcgagccgtggcccggcgacgcctcgtccccgccgcggcggccccggtcccggtccttggacgcggagccgcgtagccccagcatctgcatcatcgcggccggccgcggggagagagagagagaggggaatggaatggatcctagggtttggggctcgcgagggtttgggggtgttgggggattcaggggatggtcgcgcttccccaggaagggaggaggagacgagagcttcggtggccggtggaggttgtgggctgcgcctttccttttcgtgaggacggttgccttttttttcgctgtctttggttggaggtggggcccacttgacgcgtgtgaggagaaagttttggatatctttcatttggtatcaatgctctgtgatctgctcaactgttcccagcatcaatcggctgagcgttaatgggagctaaaatttgccaggattggattaaggtccacacctctctcataaaagcacag

SEQ ID NO: 65638 - DNA, 3217 bp, Oryza sativa
tggaacaaccgtctatcagtatcatcacaaggcactttcatgccaacccaaggtttatcctcatctttccactggaaccacaaccagcgtagacgaagaatcctggaaaatctttcaagatcagggaccccaagtcctcctattcttttcggtctgcaaactgttttccaattgaccaagcagctgccaggattagtgtgatctgggtcttcacctttccaaagaaaggaccttcgaaagcggtcgatcctcttgaaaacccatttgggcatgtgcagagatgaaaggtggtgaattggcatggagctaaggaccgtttttaccaacgtctcgcgccccgaagaagtgaagaatcgacctttccaagtgggaagcctttcccctattttttcaatgagggggagaaaatcaattttccttaattttcgataatgaagtggaaggccaagatatttgcaggggaaagatttaacgatgccggggaaagcttgcagcaaagaagcaaggtctacctcttcacacctaatagggaaaatctctgtcttggcaccgtttgtatgcagaccggacactggcgaaaacaattaacagctaggtaaaaatgttaagctcagaaatgttcggctttgcaaacactgcaacgtcatcggcatataacgagcatcgaaatctgacccgatttctatcaatcggggaaagtatggaggtattttcggctgcttatagaatccgatgaaaaggttccattgcaaggataaaaagcattggcgataacgggtcaccttggcgcaggcctcttgcatggaagatctgttgtcccggcgcgccattgacaagaatttgggaagacgtcgcaacaagattcgagatccagttgagccattgagtgcagaaaccaaattgttgaaggacatcaaggaggtaaggccaacataccgtgtcgaacgccttcgcaatatccactttgatgaacaggctttgctttttagtcctatgaaggagctgaaccatattttggacaaaaagaaaattgtcatggatggcccttttacgaacaaacgcactttgattttgcgagactaactcattgagtctcggtgccagccgattggccataactttggtaatgatttttttgaagctgtgaacaaactgctagcatcatcttttttttgggaggagacataaaagccgaattcaaatctgcaaggtgtgaggtattaaggttcatgaaagaagagatggctgccagcaaatcccctttgattatctcccaagctgacttatagaaggcttcgataaaaccatccggtccaggtgctttttctgatggcatctcgaaaattgtgttcctgagttcttcagaaatgtctccttcaagatcagccaagtcccgaaggtatttgtagtgagttccagttcaaccgcacacttctttggaaattggtacccaatctttctttgtagaaacggtaaagttcctcttctttatcttggtttgtgacagcaattccggttggggtctgtaaagactgaatgaaattctttcttctccttgagttggcttttaggtagaaaaattttgaattaacatcaccctccttgatccaggtgagtcgagaccgctgtctgatcttaattttgttaagcactgcaagccctagcactcgagatttcaggttagagattaacagacgttccttgtcagatagacttcttgattcttgtgctacgtcaagctgaaaaatgactacagtcgccaccgcaaattgcagcgcaatgtcccccacctgacttttgttccacctcttaagatcacaagctagtcgacaaagcttgatcctgaaaactgcaagagggttggtggcaaagattgatctgtgccaggattcttgaactacttccaaaaaacctggaattttcaaccaaaaggcttcaaaacggaattgaggtggtttgcttcttttctcttttccaacaaggaaaagaggtgcgtggtctgaacatgtagaggagagggggaaaaggtgtgcttctccaaacatgaaatcccaatcagttgtgataaacgctcggtcgatttttgtttgtgttggatttgtcccatctcccgcccacgtgaagcgacgaccaggaaggtgcagctctttcacttggattttatccaggagaccactaaaacgttgtatcatccttctattgagacgatcattatttttgtcagaaattttgtagataaaattgaaatctccgatcaccatccaagctggtttcatggtgggttgaagtgtctctagttcagccaggaattcaattttttcagcttcgagttgagggccatatacaactgtgatcgaccattgaagcccttcttcgcgcatggttatagtagcagatacagagtattgactgagaaagacatcagagagatagaaataattttcatcacaggcaagcagtattccacctctttgccatcagccggcagtgcagcatattgctatgcaaatctctgtccaagagagttgaggaggatttgggaagagatagctgaaagttttgtctcttgcagacagacaatcgacgcgccgtattgttgaatgagaagttttatagcatcttgtttggctctggcatttagacctctaacattccaattaaagtggaaaacattttcttgagacatggaaacacagatcgactaagatacaaactagcaatccccagttatagccgttcttgccgaaacacaacccagatagacagggagaaacacaacaagaaggggtggagagctgcatacagaggtgatgctgagttgcagacacagtttctaccaacagacacaagacactcatactgaagcaagtccgggacagctgattgcgaagtgagctcgggaaagacttcattaaattgcttggcgaccttgcagcacagctccggtcatgcttataccggcgccaccgcagacttcttggttgtggccttcaggcgaatgctcttgcagccacccttctcgaccaaatgcgcgattatctgcagagacaccagagagagtggtttcttgtacaactgcaagtaaattttcttgatgttatcatcaaaggcagatttatcatcaaacaacccaaaattttttgacaggatttcctgggcaaatgtttcaagttttgcacccgtgcgccgtttacaaagcaaatgctcacttgctacg

SEQ ID NO: 65639 - DNA, 15950 bp, Oryza sativa
agaggggaggagcctctttacaagctgcttgttcttgttacatcttgattcggtctgttctgtttctgattcgggccattcggccagttctgtttctggttttgaaatgtctatgtgttggacggacgagaccagatcaaaatactcactgccttctctgcacagtctttgcaagctagggcatccccatagaagtagctctttgagtgtggggagctgctgtaggagaccctacagaaatttctctatctctgggcagttccaaatcttcaattcttcaagtgaaatgaggccatccatcccatcaggcaactctttcaggtcataacagtgctgcaaactcataatctttagcctggccaaatttccaagcttcgaaggaagcgccaccaatcttgggcaatatactagacatagcttttcgagggatgcaggcagcatcgggatatgtaattgaccatcctccgatgatgaaccctttccctcaaggttacgacaagtttcaatagacagggatcgaaggtgaatcaagctcatgagctcctctattggccagcgcacaaggccgtcgcatccactaatagacaagtcctccacaaaggcaaagcatttacatagcccaagatgtatttttgagaaaccagatacatctgtgaagcagttgaggcgatatagcgttaaactccgaaggttttctagtgggccttggtttgtaccgacctccagagtggacattttgttatatgacgaactaacatctagtttcgtgagagatggccatgagcccaacgacattctcacacgctcattgtcctcataaatgagttcagacaaagttgttagatgtgcaagtgagctcattgcaagactgcaacatctagctgagttcaattcttttagaactgggcaatctggaacacttgcaagttttggacaatcgaagatatatagctttgcgagctccggaaacgtaaccaaaatagtatcggcctcgccaacagtattttctgtctatttctccaagtttgataactggcatagagtcatatcctttaaccttgggaaaatttgcagagggatgtagtatcattcggctttcacaccagcgacattcataaacaatgtggttaggtttttcattttagataagaacagaccctcaagcgagaccaaaaaccacacagtcgatagatccttacatcctggacagttgaaaatgtggagatttgttaggcactgcaacaactgtgggtctttcatccattgtgggatctttaggccactatatccgtgtagttccaaaattttgagcttagcgtgaggtttaagagactccaacacttcttcctcgttgcatcccttgttttcaggcatgcaaaatatactaccaccctaagaaagtactagttcacttagattttgcttcagatggagattggcatcttttccattttccctgctatttattttactcaaattgtacagttccaacctgtttttgctgggtcggcggaaggaagtcgaccaaatttcattaagataaaagagggtaatacaatatacacaacattatactgtcgagtcgagggaaacctcgaaaaagaacaggaaaactatttacagggggccaaaaaacatgctgctactccccgcaagaaaaaattccggccgctctccagatcaggacctcctctttgatgtctgccaccaagtgttctaccacccttgatctgtcataaaaaatccttgcgtttctttctttccaaagcttccagcagaccaacatgaacagagaatcggaggcggccctgtaccttgaccgaaaacagagacgcacctgcagccaccattctgcaagctgtagaccgagctgatcaggaaggggaaacgccacattcagctaagttctcaactgatgccacactctgttagtgaaagagcattttgtaaacagatggatgcagtcttccggcgcagctcgacacagtgtacatgtcgtatcatgtggccagcctcgtttgctgaggttgacagccgtaagacaccggcccttcgcagctaaccaaaggaagaacctcactctcgccggcgctttggtcttccaaatcagctcaccgtgggggcacttcaccgaagggtagaagaagaactcatatgcagaggaaaccgagaaggcgccgcttgctgtaaacctccataaaaccgaatctgactgcccgtcttgaagagacacttgttgcagctcatcctataaattcagatagtcagcaagggccctattggaaatggacccctgcaagtctctaacccacctgttgttcgtcagtccttgagccactgtgatcttcgttcgaccgacaaagcagaaaatgataggccaattatttacaatactttccccacgaggcagccagttacctctccaaaaattgatgcgacggccatctcctaccatgtgctgtgcaatcgagctgaaaatgtcgcggacatccttatcagattcccaattagccattgtccatggcctatcttcatgttcaagcctgttaaactcccatttcagtcgtaaaaccttcccgaaaagctcaatatccctgattcccaaaccaccaaattcaactggcatactgacggctctccaagcaactaggcaatgaccccattaacttcttcttgacctttccacaagaaacccctgcagcggcgttcgatgtccttgatggcccattttggcagctgcatcacagagagaaagtgaaccggaatggccatcaaaattgatttgatcagacagagccgcccgtcaggtgaaaggaactttgatttccagcctgccacctttttagccaagcgatcaaaaagaggttgtaactctgcttttgttggtttcctcacggagagcggaagacccaaatagaggattggaaggttctgaagtttgcaatgtaaaatatcctgaaccaaggagctttgttcctctgtgtagcgaattggtgaaactgcactcttggagaagttgggaagaagatcagtggcttcactaaagagatcaagcacggctttgactagcatggcctcatgacgaaccggtttaaagaagatgactgcgtcatcggcatagagcgaattatttggtgctctgctccggtggttaactttatcaagcaacccggctgacattgctttctacaacatagcatgaagagtatccatcaccaggacaaaaggaagaggagataacggatccccttgtcttagccccctcataggcttgaaggggtcacttaaagtgccattgatgtcaatctgaagttgtaatctgaacgagctgattttccgctgtccccatttaccaagtgccttgcttaatcttgccatcttcacatacaaaatacagaaaggatcagagctatcgacctcactcccccaagactcctgcactacgtcattgaaatcatcaagctttgtccaaaaggtttcaaatttgaaccttttttttgcttagggactcggttaccccaggttaaaagaagaggacagtggtctgaacctgaagaacttagagcctgcagatgagcttcagggaagagatcctcccactgagtggaaatgaacaatttgtcgagtttcaccaaagttgggattgcctgctcactgctccaagtatatcttctaccaaaaagatacatctcctttaattctagatcgttcaccttactgcgaaaagcattcatcaagcgccgattgatccttgtgttattcttgtcttcggctgctgtaatgaggttgaaatcaccggctatcatccattcccccaaacaacaattcttgatgacagacaattcctccgaaaacaacagcttctcatcatccctttgagggccatacaccgaggtcacagcccaggatctccctccctggcgccaatccagattaactgtcaccgaccattgtccaacatggacaagagtgccctggaatagatcccccttccacgccacaatgattccacctctagtttgaagagcaggaagaaattcaaaacgatcaaaatcagggccgcaaagttcaaagacagtgacacgatcaacaacttctaacttagattcttggaaacacacaaccaacgcattggaggaaacaacagactccttcaccagggagcacttcacagcgttgtttagccctcttacattccatactagaagattgaaactcactcctgacattacaacaaccagacacccccagcccccggctaacacagcatacaaaatcaagcaggagaagcaactgccaaaggtgccacatccgctagcgcctggaactccggctccgccagttcaagatgaagcagctccgccaaggcctcaaaatggtgaggcggcagcggttcgtcgaagagttgaacatattcctccatcgcctcatcgtttgcttcctcttcttcttcaatgattcccagattcttcatagtcacccgctgtgccttggagatggagtggtgtcgggcgcctgagccttgcagagccagccgtgggcttctccaaggcttgaaatcaactgggatcaccgggcggcatctgctcttggtgattgggacggaggcaggcggcttgctgaggacggacgatgaggacggcgtggagatagcgtcgacgaagatgttgacttgtacgcacatgttctcatcggccgcaacgaggattgcttcctgggccgctgcggctgcgctctgcacttcctgggttgccgacacagcgatctgagttggcaacatgcccaatttagagccggcctcctttcgtcgagagtagacacggtcaaaaggcaccacctgttcctgggctacttgaggaattgccaaatacaacccacggacgacttcagtaggagccggacctccagctcgaaaatgttcccccgctgagttcccaccttgggggctgctgccttcaaccgcccctattaatggaggatccaaacagaggtcgtcgaagcaaaggcgtctagcagggagcggtgtggtctgcagcgaccagcaggaagcaggcgccgaggctggccttggactgctctcttcgtcttgggagttgcgaccgtgaaccttgtccacagtgcaatggtgtgccacaggagaggttgacctcgtgacctctctgtaccgtgggccaccgtcatgtttctcgtccgccagcatcggcgaactgcaccgtgaacctccgccttgctcctcgaccgccaacacgaacgagactgtcggggcgtgtacctcgaccccgccgcaccatcctccgccgccttgctcttggtccgtcagacgcagcgaatcggagacaacaggcgagcacctcgttggcaacatgagctcagcaacaggggatcatatcgcccctgcacccggtacagcaagctcgaacacacgaggtagggacggcgagatcacctcgacagtgtcgaccaccacttcgggcgagaccagcaccatcacctgagtcaacggcgagaattgttaaacgtcgttgacttgcgccacctgaagcgacgcgttgatcgtctcagctgaggagagaaccagaccccataggacgacggcaagcagcgccaacctcaggggtaaccgaagcagccacaccaacagccgtcgccgctacctcgaaaccctgcgttaccggcacttgtgtgcccagctccctcgtcccgacgacagcagcagcgtctggagaagacgggagcagatcctcccccgtagccgacgaaccgaaacgaacgatggccgacacagcttcctccgtgttgaaaagacggactggttgctgtatcaccgacggcaggagatcgaacgcttggcattccaaacccccggctgaacctgatgctcctccatagcgagtgctgcctccccggtccgatggccacagacctgcgctgttgaaccacttagcccagcagtcgaaggtgttgcgccttgtcacatcatcgtcaccatcatcgttgtagaatttatcaggggcatgcagcagcatgggatcgttcacctcttcaacgtggaggaagacgccatacagtaaaagagggccgtgctctaggcgctcgaggaggagcagagctcgaagacgacttcctccaggagccgcccgcccctatcttcttaggcacctccacctgaagccgttgaggaagcttgttaggattcttgaaccaggcgaagaggcccagacatctggtgtcgttggcagggatgctctcgatgagctccccctcgagctcgttgacaaggttgcgcaccacttcgcgctcccacaggtgagcagggagcccatcgagcgaaatcttggtgaagaacttcaagtccgagctgtctgcccaactccggcggctccacagcttgaaggacgtgggaacccccttcacgaaaatctcatgagagcaatggagaacaaggttccgatcttgcagcatgcggaacaacaccagaaaatcctccgtatgtgtcacgtcgacacggacgttgctctcgttgatgccggtgtgctggacgatggcttctaacatctcccccggtgagaccgatggtcttgtcttcagaaccatggccaacagcgagtgctggttgagccaagcttcattgtgctccatgcccaccgtccaggacagcacgcaacggccagtccccagccgcagctccggctcgccgactcgaaaaccctccatgtaggcgtgctccctagccgcgcagatttgaaaacctgccatctccttggaagacttgacgacgtcccgcggatgagcttcttcctcagctcgcccaaccactctgtagtcggcaggcggagcaggccgggacgcgtgcgacccgaagcagcggacggggatggcggacgctggcgagaagtaggagcagctgtatgcggtgctggacgagcagcaggacatggcgtcggctgaacggggcgagcagcagggtgcacgcgagctagagaagcgagggaagcaggctgagcaactgagcacgggcgagttgaagagacttcgtcatgctcggtgcaaaaactcgcaagatggcccgaaaaccaacaacggaagcaacgaatctggccggtacactgcgccttctgatgccctaggccaaggcatttgaaacacctccctgcaaccactaggggatatccctcaccgccttgaatgctgatggacgagtggttgggcgccggtaggtcgccattgaatgaactcctttcctccttctcacctctatccaagccgcctccttctcagccttacctaacgtgtggtccccaatccccaccacgatgtcgcgccaggaaccaaactggggtttggaatgtggccgtcggacaccggagtggccgtccaccgggcggtgagggcgctccctcacgcgctcgctccccagccattttccccctctcccctatcagagaactctctgagtagcccaaccgaccggttccagcttggccgtagctctccagttccaatctgttggcaaggtgattcaagtccttgagctcctcgattccacggccaggttcagtgtccaaaacaaatgttgttagagtgcgaagatttttcagtaggctaatatttggtggcatcctcttcaatggacatctaagaagataaagatggatgagcttgctcattgttctcataccttccggtaaatatgtcagaagtaggcaatcgttgagccttagtgtttgtaagttatacatcgtgcatattgaacttggcagcacatccatctaagacctagaaaggtcaagatatcgtagatgctttggattgatcacctggctatgagaagggcaagcccgaatacagacaatacccaaagcacttaatgacataagtctcaagtcagtaccaaaatctcttaatgacatctgtcttaagtcattaatatgtactagtaaccatgcagttatcaaagtgtggatagaagatgatattttgagcaatcccactgttagactcatttcattatcataggaaaattcggtatatcatcttttgctaagtcatgcatcaaatcatgagttttgcaacaaattatagactcatcagcagtgaaagaaaatgtcttgatcggtttcacgtcttggaggaaggatctccaaaccaaattacagaaaacatattcccccttttgttccaaacccattgtttcatcttcctgaatgaaaccatttgccatccacagttggatcaacacttctttgtccatctcatggtcctttgggaaaactgaacaaaaggcaaagcattcttcattttaggtaataagtgtctgtagctcaattttagtataggtatatcatcttcgcccctgtcattgtcccctaattgcttcttgcaattgtttctcattccttgacttgttgctttgaactcatcataccacccattgtcttcaaagcaagaggaagccccttacatttcttgacaataagtttgccagcggttaccaattcagcttgctgttgtacctctttactgaatgctttctttgagaataattcccatgaatcatcatcactcagacatgctgggttatggtattctagggtgcccattatagatgctactcgctggctctgagttgtcactagtataacacttccatcaccaccaccaacagaagacaggagtggcttcaggtcttcctcccacttcttcttttcttcattccatacatcgtccagcacgagcagaaaccttctccggccaacggccttctgtagttccttttgcaacaactggacggtttcaggcagttagcatgctttgtttgtagccaattcaatgatggatttcagaagggaaacaacttcaaagttgtctgacgcacagtgccacatctttagctcgaagtgattctaaaccctgtagtcattgtagaccatcttggcaagcgatgtcttgcctaaaccccccatccccacaattgggcccacttgtgctgatctcgctgattgagcaacagtttgatcaccactacctccttgtcgtcgtctctgccaaagatatcatctaattcatttgatggcagcactgagtacgtctgccggtaagaaagttgttgtggctcatctcgcagcaacaggccaaacgtgttcatctcttcaaccagctcgttgatcttcttgagcactttggcaagcttccttctcatggtaaaatggaactctaggggggtcatgtagctccgtaccttgtgccctagcgacttgaggctcatggcctcgcggtgcagcacctcgtactggaactcatcgaggacgtcatcggcctcgtcatcggcggtgttgaggtccttcatccagcgcttgatggcggggttggtctcgctcttcgactcagcgtcggccaacaggcgctcgacggccagcagctgccgctccagcttgcggcggtcgccgtcgacgccatacatgcgggtgactttctggacaagcgcgtcggtcgccttgccgatcaccccgtgcactacggggagaagcagcgattctgccatacaattgctctctttcacaggctgtctgctactctctctgctacctattgatgatacacccaagaagcaaagcaaggaggctatgagtcctctgctctggcctcatccaatctaaatcgtagcacaagtcaagatgatatttttggctgtcaccgccttcaatgattcatatgattctcaagttgactgacttttgtgatgttgtcccttcaggccttcacggtgcaggaacgtggcatctcgccacgaaggacagctgctaacgtggcagtgggggaccatttctttgtgaggaacacgggactaaggccttgtttagatcccaaaaatttttagctaaaaacgtcacatcggatgttatgacacatgcatagagcattaaatatgaaaaaaaaaccaattatacagtttgcatgtaaattacgagacgaatttttttagcctaattgcgacatgatttgacaatgtgatactaagtaaacatttgctaacgatggattacttaggcttaataaattcgtctcgcagtttacaggcggaatctgtaatttgttttgttattagtctacgtttaatacttcaaatgtgtttccttatacttcaaaaactttacatccctagaactaaacacaccctaacttaagacatgagaagctcaacggaaaaagcagataaaagcatggaatccaggctgtagaccatcacccccacctccccaccatcgaaacaaacctctctctccaccgtcggggtcaccgtcgctctggatccgtgccgccaccgtcgccctcggcgctccgtctccttgtcgccggccggaagtggagggcgccgacgagctctcacgccggatcctcgctgccaccgtcgtcctccgagccctcgttgctggctgggagtggagggccccagaagctctcgcgctgctgccgtcgccctccgagccctcgttgcctcccgggagaggaggggccccgatgagctcccgcgccgccgccgtcgcccgtcgagcgctcgtcgccggcaaggagaggaggggtctcggcgagttcttgcgcctccgccgtcgccctccgagccgctgtttgggaggaggttggggagccgccgtcctttgttggagctcgctgtgctgccagccgtcatcgagttgtggtggttggggaatagagagaatgatggaaggggagaaattgtatccttgtttctgaaattgagggtgtttagtgctaaattttatacgttatgtagtttaaaaacatgtgaggactaaaatagaagatggcaaaagctgacatgaaaagctaagaacacccttagggcgttcacaatgcgccgatgtggcgttcagcctccctccccaaaaccaaatatttgttgccacatcgtccatccgcgtggcctcctcaagaacgcggagtaagttttggctacgagttcctcatctcaggcggcgggacccacacgtaccagaggagagaggggagaggagcgatgatgagggaagatgcagtggccagagtgaggaggggagatgcagcggcgtgaagccatccccaaccatgccactgtcgtcgcacgcgtgcagtactcgaactcggccactgccatcatcactcggtggtatgctcacccgagcgcaatggcatggagtgcagctccggcctccgggcacgatggcggggatgacaaacaaaggcgaaagacgtgcgccatggcggcaagggagggcctggagatggagacggcggcgccctgcattggtgtaaacggaaggagacgaatgagctgtaaatttgacgggagtaggggtgaaaacggtacggaatatttccggattccgggtaggttttcgaaaacggaatcggccgatcggaatttttcagaaacggaaacgaatacgaaaatattttctcggaaacggaatcgaaaatgataagagcagtttccgtcggaactcggaatcggccagaaactttccgaaaattctctcggaatttcgaagttacaaagtccataatacctcccgcttgcctagcccaacccactacagctaaccctagttgaggagagtgagagtcagaggcagaggctagggattttggagcaatggtagtgcattgtgtgcaccacgcaggcacgccacacgcagccagatctggcgctgtcggccgccgtccccctacgccgccgccgtctcgcgccaccgccgtctcgcgtcgtcctccccccgccgtcactcgccgtccctgcccccggcgtctcgcccctctctgtgcttcaccgtcgccgtccacgccgctgacaccaatgcctcaacgccgatgcccactggcgactcttcctcaccaccaccaacaccgatgacgcctcgccgcctgacctcgccgcccgacgcccgggcgtcgtccccctgcctcgccgccgcccccctctctgcctggtcgagaagcacaaagaagcagagaaagaaaagagatagggagagagagaaaagagacaaggaggaaagagagaaataaaagaaaagaagataaaataaaaagagagtgggacccacgcctctccctcagcgcttgactcatcttggaccagcttatagtcgggccccattaaaatatttcatttgatataattgtattttacgatgaattgttgaccgttgagacttgagaattggacttgataaaagtttgaagctcagtttaaaaggttttttattccgataaattttcattaccgtatccgcgcctgttcgtttttgttcggtatcgataatatttgtttccggggtttcctttttcgattccgattctaaaaataatatgaaaacgaaaataataaagatggttttcgttccgttttcacctctagactggattagtatgaaatgaagaaattcgctatcctagtggtaaaatcttttaaagtcttacgaattgagtgctagactcttaggctgtgttcggacgtccattgtcccaacctatctccctcgttttccgcgcgcacgcttttcaaactgctaaacggtgtgttttttgcaaaaagtttctatacaaaagttgcttaaaaaaatcaaattaatccatttttgaaaaaaaaatagctaatacttaattaatcacgcgctaatggatcgctccgttttccgtgctactgttccaagttgggaacaacccatagcgaacacagccttaaagttcagcgtattagattgtacataatgaaatttctcccacacctcccaacccaaatccgtcacccgccgccgccgacaaaaccctagacccgccccgccgtccaccgccgcccgtcgcatcccgcctcctccccgagtccgcgacaactattcccaaggttggtgtactccccgtcctctttctcctaggtctctaaatctgcatattcacatgttagtctcatccgtatggtagttttttttctttggtttcattgccgtcatccgtaagttgacatttatcgtcaatctttcactgtaaaattgtggctaggaaatggtgtgcctctgatagtatgtgagacaaacctataaattaatagccgcacaaatagaaaaaaaagcagttgtcacaggaatgctttggtgccgtttcattattcctgttctggctattagaattcatttggcttttgccactgcaattggccatattcttacttccagtgtcctttggtaacaatattagctcaatgcacaattctgtttttctattgattagaatgatacaaggtttttttttcaggtcatgaacaaaatgcagttgcacttttacttgttttattactaattcactaagtttaagtcacttttgttctggtagatatatttccttaatctgtactcatttgttgtttgatgactctaatcgatgatcatttatgcacattgtgactttctagcttaccatttgatgttatggtttaaggcacagaggagtagcgaaacatgatcccctttatctagaagtcactaagtcagtgagccccacctttatttgtgaagactacttgttagctgttactttgtattcaggattggcagtttcagtaacagctttaggcttagttcgtttcccctcgttcccaactgcccactctcgtttttcgtgcgcatgcttttcaaactgctaaacggtgcgttttttacaaaaagtttctatacaaaagttgcttaaaaaaatcatatagatccagcgtcatatatacaaagatggtggtagtataaatttagttagttttatttcgataataaaacgaacgagcgatatcgtagcgaacactcttcgtttaacttatgatattctatcaagcccatttaaacaatgatattataacgaaacacttctctatctctgctattataaaaattgaagatgtttttatcggtattttggtacgtcatccgtgtttgagttgttttttaagttcgtacgcttttagaaatacagatatgtgtttgagttagattttaagctcgttttcttttgaaaatacaaaaggagtcgtataagaaatcttttttttaaagaacactcacatgctaacttgagataaaagttggacttgtaattgtagcttgtgattttcttaaaaaaaaaatccaagcgaattcctatagtgaattttatcctatctaaaccgtataacaataataatgttaaaatagtattcacccattgcaatgcacgagtatttttatagtatatgtaaatttatcaatgttcacaccacaactcatcattcatgattagccagagacaaacatccatcaggtgccccatgaggccatatgtgagtcgaacacgggacacgggaagatccgagcagtcataaatcaacacggattgaaactgcctaattcaatggaagcttccaagcgcagccgccgaatcctccatctccggtcagcatagctcccgctcggccgcgccgctcatccctcaccggcacaccgcaccgtcctccaccgctcgccgtcgccgccgagaagagggacacagctgccgtgcgcgtccgagtggatgtggtgtgaggcggccgggtttgaactagccaacgtcatatatacgaagatggtggtagtataaatttagttagttttatttcgataataaaacgaacgagcgatatcgtagtgaacactctttatttaacttatgatattctatcaagcccatttaaataatgatgatataatgaaacacttctctatctctgctattataaaagttgaagatgtttttgtcggtattttggtacatcatccgtgtttgagtcattttttaagttcgttcgcttttagaaatacagatatgtgtttgagttagattttaagctcgtttgcttttgaaaatacgaaaggagtcgtataagaaatctttttttaaaaatcactcacatgctaacttgagataaaagtcggacttgtaattgtagctcgtgattttcttaaaaaaaagtccaagcgaattcgtatataacaataataatgttaaaatagtattcactcattgcaacacgtgtatttttatagtatatgtaaatttatcaatgttcacaccacaactcatcattcatgattagccagagacaaacatccatcaggtgccccatgaggccatatgtgagtcgaacacgggacacgggaggatccgagccatcataaatcaacacggattgaaactgcctaatttaatagaagcttcccagtgcagccgccgaatccttctccatctccggtcagcatagctcccgctcggccgcgccgctcatccctcactggcacaccgcaccgtttctatcgcccgctgtcaccgctgagaagagggacacaactgtcgtgcgcggccgagtggatgtggtgtgaggcggtgaggcggagggaacgcggggagcttggggcacggcgcttcgagaccgccgcccgggcgcgccgcaccgcctcactcgcactctccaaccgcaaggagttcaccaccccgcacaacggcgccgtcaactctctccaggtacacccccttctcactccctcactccccttctccttctctcaccttagtggtttagatcaatttgatttgtacaccctgtagatggaatcttgcgtatttggtgtgcaattcctgagtcgctcccgctggtgttttgtaatttgacaatatggtcaggttgatttgatagagcggcggtacctgctctcgggcgcatcggatggatcagccgctatatttgatgtgcagaatgcgatcgaatacgaagctgggttcattgccaagcataggagcattctccttgtggacaagcagcatgaaaatggccacaagttcgcggtatctatggccgtatggtatcctgtggacactgggctgtttgtggggctgcagga

SEQ ID NO: 65640 - DNA, 2686 bp, Oryza sativa
tactggaagtgcagatgttcaggtccgtttatgtgatattgcttctggagcctttacccacacgttgtctggtcatcgtggttagttgcttacttctagtgtagtgatgaaaatatgcttgctttgtttgtatggttaccaccttatccttggtatctgacatgtcagatggtatcatgtctttggagtggtctacttcaagtgagtggattttgatgagcggtggttgtgatggagcaatacgattttgggacataagacgagctggatgctttcttgttcttgatcaatcacggtctcaactaggaaggcggcctccttttcttgagggcacctcagataaggtatggtcaccattatccatcacttacatttgttttcaaaatatttggttgcaacgctaaagctggacttccacttttattttctgcaaaagcttcaaaaatgttgcagctttaagtaaaacattatggttgtaatgctacagatcaatactgtcagccttcaagtaaaagctgatttctgcggctattaatttataggtttgtctcacatattagtgtcagtatataggtgctatggatcagtttagtgctccaattcttacaatataaggtctgcatacattgtttcttgttgattgttgtgccctagaaatgacgcgcaaactcattgatctagttgtgcaaatgatcaatgtattcatttttaattttgactaggatcctttgaactctttacaaccttcatcttcttcaaagatttactctgcacagcagaggacaggcaagagtaagaaacagtcacacaaattgcacaaaagtcaaatccctggacatggacatatccaacagagattgcaccctggtttgtcttctagtcaaaatcgtgcaacggcgcattatggtgctgttacgggattaagaacaactacagatgggatgtaccttcttagctcaggttgattgaatttaattgctatttctatgagcattcgattgctattgcttgaaaggaattattgcctatggctatcttcttgttatgcctgtatgcagtatgcattaatgattgttatcctctctcttcaggttctgattctcgcttaagactttgggatattgattcaggctgtaatactttggtcaattttgaagctatgcgattacagactagcaaaccactacaattagctgtcactgaggatccatcacttgtattcatcccatgcatggcaagcattaaggtgtggtcattttttagcttctcagtttggacgctgaattttatacttcaccttgtgttgccaaattcatgtaggcgtacaatttatggtctggtatgacatttcaaacattccgtgggcactatgaacctgttaattgctgctactatagtgcacaagaacaagtaagtcttccctctactcctatcctctgttaaccctgaatgttcccgcatcaataccattgctgagtcttttggaattcaggagctttatactggcagcaatgacaggcaaattcttgtgtggtctccatcaactccagcatttactgaaatggtatattttctatttcttgttatcatatatctttctgtagaattttcctacatcctatcaaattcaaatttctcaggagtagtcgggcatattgggatattattgcataagcttttttaggcatttgattgttagcactgctaaacctctgcaggaagatgatggcaagaggcaatggattttgtagtcgatgaggataactggagcgactgagaattatgcatgtatagttgtattgtacactaagaacattgacattagggatgttaacaggccatgtttttttttctttttttaagggaagccacgtttattactattgtacagtacttcatcctgcagtttcacccgaaatatcactttgataaagacagctaagtgaaatgtaaatatgccaaattctctctccaataatgaaaatgctcctatatcgtgtttacccaactgttatgatatcgtgttaacaaagatacatcagatcttctctttatctggtaaggagcaaggacagaaatgctcctatgtcgtagggtcgtgctccctacgagaacttgagcacagcagcgaagaaatgcctcaacacattgctgttgatttgtttaaaaaagcttcgacagcctaacaactcaacaatccttaaaaagagtagtacatattatgaagcaacaaggctgtatgacttccaaaacttaaacagcgatgcatgaaatcccacctaatatcgtgcagttttttagctgcatcaataatctgtgcgatcttacatatgttacaggaaatgaataagaatagctatcaattacaattacaattacaacagattttgcgaatctggatcgccaaaggcacatattgcacttatttcagagtaatgtggaggaagaatcgcatggagtgacaatattttctattttcgaaccaacatgcaatgaattgctggtcccaaaacacagagaacctcgcagctcaggtaaagcttcagtccataaggctatacagctccgtcgggagttccaaagataggccctctttgaaagattagcccagggctaattttgagagctaatgtttagtcatgaattggtaggctaaacattagcctagggtggtatgtttagatcc

SEQ ID NO: 65641 - DNA, 950 bp, Oryza sativa
caacaaatgagtacagattaaggaaatatatctaccagaacaaaagtgacttaaacttagtgaattagtaataaaacaagtaaaagtgcaactgcattttgttcatgacctgaaaaaaaaaccttgtatcattctaatcaatagaaaaacagaattgtgcattgagctaatattgttaccaaaggacactggaagtaagaatatggccaattgcagtggcaaaagccaaatgaattctaatagccagaacaggaataatgaaacggcaccaaagcattcctgtgacaactgcttttttttctatttgtgcggctattaatttataggtttgtctcacatactatcagaggcacaccatttcctagccacaattttacagtgaaagattgacgataaatgtcaacttacggatgacggcaatgaaaccaaagaaaaaaaactaccatacggatgagactaacatgtgaatatgcagatttagagacctaggagaaagaggacggggagtacaccaaccttgggaatagttgtcgcggactcggggaggaggcgggatgcgacgggcggcggtcgagggcggtgcgggtctagggtttcggcggtggtacgagtagaggaaggcgcgatgagggaggagggaggagtcggcggcgtcggggtgacgggatgagtgcgagagagaggagggcggcggtgtcgaacggtcgacggtgacgatgtgggcgccggcgcggcgatgtggggagtccggaggatggattgggggggcggcgagatgcgacgacggtgggggagcggcgggatgggacgactgcggggggcggggggcggggggcggcggggcgggtctaaggttttgtcggcggcggcgggtgacggatttgggttgggaggtgtgggagaaaattcattatgtacaatctaatacgctgaactttaaagctgggttc

SEQ ID NO: 65642 - DNA, 5457 bp, Oryza sativa
aagaacatgttattgaccctaaggaaagaatgtggtattgaagcattccaatcaacacaataagttattaaacagttgctatgatcacaaaaatgttcgttcttttagaaatcaaggtacaaaggaaaatatctggtttcatgttggagacatggcagcatctgattcatattcatgcggataaatcagttatcacatcttctgattatgtagagcttgtttttatacactcaacaagctgcaaccaaatgtcagttcgaccaaagtgttctgctcacatttcctaattaagtatgtccctgttctgctcacatttccttagctcacaaataacagaggatttttatttcgaaaatactgctaaggcttgggatctacggctcgtcctagggtcaagggggctctgataccaacttgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacaaagacaaacgagaaacagcggaagactagggcgacgaccacaggcacttgacggcaggcacgagctagacaccaaagccttcatcttctaggagctcctcttctgagtttgggaaaaattgagcaagactgagtacaaccaccgtactcaacaagacacacccacaagtgcagaataaatgcaagggagtacaaaggagttatactataaagggttagggttgcagtaaacagcatttaaagacattagttgctcagggctattttgcaaacacgattctagtactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagatgtgtacatctttacccacaagacacatcttcctcatatgtaaccacgtgccacataccaccacggtatacagacgaaagacgtgacatagtttccaacccatcctagccatagacaagagtaccgacccaatcccacctacggccggaacctccgggacaggcaggtaggactgagcccctagcagcaggacaccggccctgtgccatgacatctcgactaccgggctgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttttggggattttgagtagagggggcggtgtgaatccaattccacaatactccaacaattccataatatctaggtgatatgaatattcccaaagtctagagttgtgaaaccgcctaatgttacctaattaaagcgaagcatctacctaaaatcatactagtgataccatgagtagagtgtccactagttggggttttgtttattctagggtgaacaaggaaataataacaataacaacaataataaggtcataacaaagataaataggcatggctaaataaaacagtgattacgcgggaatttaaataaagcgataatgcaataagttaaatcaacataattttacaaactgggattcaatatgttcaaagatgatgtgacttgccttgctcgctttcccaaacgccggcttcaacctccacgaagagcggatcttccgaagctgcagcgtctacacgtccaacagaaaagaaacggcttttactctactaaactccatataacaagcagaaacaaagcacaaaaatgggttcttgacttcttaaggaaaaattagagacttgaacggtccaattccgagttcaaatggccaagttatggccatttgaagtttatatgctctttaaatggatatttacgaatttcttcatttaaattttaatttaaaatcggatttattgcgtcagccgggagagaggagcgcgcggaccgggtccacgggagtggggcccacgcggcagcctctcggtccacggtggaccgggagcacgcggcttacgccggccggcgccgtgggtcccacgcgtcagccgcacctgagggcgcgggcggctgacggccgggccccacatggcagccacggggcgcgcccgaaggcggcctttccggcacagccgacgggaggcggcgtgcccgcgcccctatggtcgccggcggcggccataggcacggcggagcggcggccgagagaggggaggggagggggaaacgaaatgggcggtccacggctcaccccgggtcgacggcgacgacgggaacggcgaccggagcggaagaaggcggcggcgcggcacgggtcgacggggacggcggcgttctggcggtcggcgggcgaaacggaagggtggacgaggtcggcgaggacgcggcggagccgaaggaggcgacgccgaggcgggaggaggtccgaggcgacgacggcggcggaccggagctcggcagtgacggcggagagagagagcgatggcgcgagctcgattccggcggagagagagagcggcgagtggcggaaacggtggagggaggcacggggagcgtttatatagtgttgggagggggagagaacggccggataagggggaatcggccgcggaagatccggccgccattgatgcgccggcgaagttaggggaggagtttccaaacgaatccgagggagagagagagagggaaaagtgggggaaaagagggagggaatcacggggaatatttcccccctcttgattgcacgcggggcggacgggagcggcgggattcgcggcggcggcggcgctagggcacgggcgaggcgacgggtgcggcgggagcggcggaaggtaggggatgacgggtgggccccacccgtcagcgagggtggcgggcgggcccgcccgtcagcggcacacgcgcggggaggagccgattgggccgcgggggagaggagagagagggagggaagtgggccgagccggcccaagaggtagagggggagggaaagggaactttttagggtttttctttttataaaaccattttaactttgtttatttcttaataattattatttgtgctctgaaaattccactaaaatttatttacgcattttaggcttttaggaaatatacaaaaatcgtccaagccttatttgacttttaactttgcacattttaattgttggaggctttcacatggattttacttattctatgcataattttgaggatgtattttagagtcgttttaggacgcgacagtgagttgaccttcttcctcgggctacaagtgaagcaagcacaagagggcactttcatctctcaaaccaagtatgtaaaggacattctcaagaagtttgggatggaagatgccaaacccatcaagactcctatgcctactaatggccacctagacctcgatgataatggtaaatgtgtggaacaaaaggtatatcgctccatgataggatccttgctttacttatgtgcatctcgtcccgatatcatgcttagtgtatgcatgtgtgctcgctttcaagcggagcctaaagagtgccatttgattgccgtcaagagaattctaagatatttagttcttactcctaatcttggcttgtggtatcctaagggttgtgactttgagcttttgggctattccgattcggattacgccgggtgtaaggttgatagaaaaagcacaaccgggacttgccaatttcttgggcggtcccttgtttcttggtcctccaagaagcaaaattccattgcattatccaccgccgaagccgaatatgtcgccgccggttcttgttgtgcccaactcctttggatgaaacaaactctaaaagactttggctacaacttcaccaaaatcccactcctatgtgacaatgagagtgctatcaaaatagccaataatcccgttcaacactctcgaaccaaacacatagatattcgccaccactttttgagagatcataagaccaaaggaaacatatgccttacacatgtgagaccgagagccaattagccgacattttcaccaagcctttagatgagaaaagattttgcgagcttaggagtgagctcaatatcttaaattctcgcaacattaagtgatgggtggttggctaatttatagtcaaacatgtatcactaaaatgtaaattaaaaaaaaattgagcttttgtgtcttgagatcacttcttggtagaagatgatcttgataccaggaataaagctcaaacatttcccctttatccaaaaaccccttttgtgataagttttgcaaaatcctttgtgtgccttttattgcgaaaatttggtttttattttcttcttgtgatgtatattgaccatggttatgtaatgttgactgttgactggtcatatgcatcataagtctctgcatgtccttagttctctatttcccttcgttgaattctcatctcctccttgtttttgggcctgactgccctttttctgtcaggccggaagttccgggcctccctgtccggaacctccgggtatcggggagtatatatactcagggggagttagaaaccctagtctctctcctcatttcttctctctccccgacgccagccctagccgccgctacagtgcccctagtggcgatttcctcttccaccgtgaaaatttgattcttctccgtggaatcaaccacattggtggtaggaggatcttcctgcgatcattctacgatttcctctctcaaggtagcactttttgattccctctctcggttcattgtgttttttatcccgatctcttaatctgtgaacctagggagaaaaccacttggatagtcttgttcctgctaccttgtagatcagcgatctataggatttgttcacatgcactggctatttttgagacccctgttcttcatttttgccggccggaagttccggtgctcttgcacccagaacctccgggcgctgtccagccagcctgcaattcttgattctctcaaattttgcctaactactgcactccaatttgttgattcctgttgcagtaagcactatgcctcgtgagaaaagacagaaagcctctcaggatgtgtctggtgatgagagtcctcctattcggtttcctcgtggtcgtttgggtaaaga

SEQ ID NO: 65643 - DNA, 2773 bp, Oryza sativa
  unsure (1)..(2773): unsure at all n locations
nnnnnnnnnnnnnnnnnnnnnnnnnnnnnnnnnnnnnnnnnnnnnnnnnnnnnacagcttttttttaacctctctctgcccaacattaacccgcttcactccaaagcacccacacccatccaccagctcacaatgtcatgtcactatgcatctcacacttctctctccatccccaccttcacgttcctcgccacaacaacacgtacaaaacaaaaattcccactcacatgcaatatgtgcatatgcaaacctctcctacctcacactccaccctagctagcccactacacctcctacaccctcaccatccaatagcgcagtgacagtgccaatggcctctcacaccaccctcatcctcctcctccctctcctcgccgccgcggccgtcgccgccgcggacgtcgcccctgcgccggcgccacctgcggcgcagacgatcaacctcacgggcatcctcgagaagggcgggcagtacaacacgctgctccgcctcctcaacgccacccgcgtcggcgagcagctgggcagccagctgaagaccacctacgacggcctcaccttcttcgcgccgacggacgccgccttcgccgcgctgaggccgggcacgctcaacggcctgagcgaccaggagcaggtgcagctggtgctctaccacgtcctcccgcgctactacaccctcgccacgttccagacggccagcaacccgctgcgcacgcaggccacgggccccgccggcgtgtacaccgtcaacgtcaccaccaccacggggcagagcctcgtcaacgtgtccaccggcgtcgccgccgtccccctcggcaccacgctctccgccgacttcccgctcgccgtctactccgtcgacggcgtgctcctgccggagcagatgttcgggaaggccaaggctcccgcgccggccgccgcgcccgcgtccgccgccgggaagggcgccaataaggagcacaagaagggcggcgccatgcccaagaatgaggtcgcggccaccgcgccgacggccggagctggaggagaagattcagatgacagcgccaccaccaatgcggtggccgttgcaggcgcggccggtgtggtgtggactgctgctctcgtggggattgccaatcttgtcatcgcgtagaaagtgtgtgcttgtctttttctccttcgccgttttctttcgttttcgtcgttgcatatgtttcattgcacgtgtcctattttgtatgtatgcaagagtatttatatatgttgatgatgattcactcagtgaaatttactggcttcttttggtctttccattgcatgtgccctactttgtctgtatctgagaatagttatatagatgattcactcagtgaattaaattcactcttttatatttctttcctacggcatgtatgtataagagttcaaggtggcctttctgggaacacataacctatattaacaaggatgatagcccacgcagggcatgtatattatagtctgcatttgagaaacttctaacaattgaatatcaaccatatgggaccatatcctatatgaacaaaagcttcccgtgcacaatcagtgcacaccaactatagacatttactcctaatagtattacatgtatctataaagtctcatattcaaattcattatattttagcgataacaaaaaagtgaaaaaaattgacagatttaagggtaaaaatctgttagaattttgtctttttctttatgactaaaatataatgaatttaaagataagatttcacaggtaggtgtaatactattggaagtatgtgtccaatttttttaaaaaaaatttgtgacatttgctagttgatgtgtacggagtgtgcacaggaagcttgtgtacatagtatatattccccaaccatatagcacttgccaaactttagaagtatgttttcttcataaatttatttgtcatcttttcttaaataacttttcttacataggagtatttttcacccatatactatctaatatttaattcatctatataagctatttttttcttcatcatttaaaaaggaggtagaatagtttgtttaggaaacatgtctaacaaattaagtttaaattaaaactaaggtgttttttcttttttaattgaatgttttggggctcttttttgaacaaatcttggaaaactattattgctaataatgtaccatcaagctagccctctttttaattggttcacattgatgcaatttgttatatatatttacatatgaatcaataaagagagagtagatatacatatcctagatcttgcttccgagaaacgtacacatgtcatacgacaagagggggggggagttatgtttcctttgagatagatccaatggtttcaacagtttgatttataaatataataatgacccaaagtaatgtatttgttttatacttgttaaatatctattttctaatcaaattgtgtattatcataatattatttataaattttatgtgtatttataacattaattttatgtgttgcatattgttctattaaaagctttgtgtttttaaatagatcattaaaatatctatatgattttacctataaatgtgtttttatctcttttacttattaaatatatagttagtttggataatctaataatgtatgtggataaaatattagctatatgatttagagcatataattgttcggaatttattatcacaaaatatgttttctatctaatatagaatgagggaggaggtatggcgtacgtacgtgtgctggtgcacgtgc

SEQ ID NO: 65644 - DNA, 12250 bp, Oryza sativa
agagggggatcacgaggcaaagatgggaggcgttgagagggagggagggagggaggcgaaagcggaggcacgtgggagggagagagggaggcggaagcaaagacatacgggatcgagacagggagagaggcggaaacggaggccatgcgtgatggggaggtggatggacaaaaatttgtccgaaggccttacatatttttttaattaggtatagaggtgcacccaacggtagaaaatagtgatttcaccgtatttaaagtaaaatcgatggttagatatttttatttctttagaattgtttggattttactctactttattagagcaccacgaggcagcttacgagagtttgtaggaagagcgttttaggaaatatataatagatagatagatttcatacaaaaataaatatacccttgtaagttgaaaaccataaatctgtgcgatggggctttaacacccatcagtaatgcatatatggtacgcacgtataagaattgaacatagttttacactaatattattaattacaacaaattgatactgcagtgtcaattttccaataactaagctatattcttatttacaagaaatgtaatatatattataatatatatccaaaggaattaatcgtcaaagtatatatgtatttacatgtttattacatatatatctcacctctttgtgatgaaaatttggctcagtccgtggttacccactgatgttttatcgtgacttttatatctcacctctttaattaacacattctgtatcctttatagtcctgtttgaagagaccatgttttgatttaattgagtgtgtgttttaaatatttgttttcacttttatgcgtattcctgttattttaatgcagtttaatcgtaaaacaagtaattcctgttagtttaatacacagtttaatcgtaaaacaagtactacctatgtttagagtatatgaccggcttttgtacgtacgtctggccttacaacttattaaaagatagtgcaaatatcatttattttgttataacttatatgtgtactatattttgtaataagacaaataaaagatgaatgataagacaatgtgtccaaaagccaactgcttcttatatttaaaaatggtggaagtaccaaactatgggttaatttgtgcagtagtattttccagtgtgaaggtggtaaaatacacagggcaagtacagtagaattcatattgatttagagatgcaaactaatataaatcattccacactgaaggacaataaatttgctatatataaaaatgatatgtcatataagtactacatccagttcggattgaattacaaattgttacaacgcaataacaacatatgaagattcataatgacaacgctacattcagcagaaaatttcactccagataatcacgatgtccccaagaactatttttgagcttttttcgcagagggcctaccaacgtttttctttttgctgccagaagatccaccaacggttttctttttgccgccagaagatccaccaacgtttttcctattgctgccagaagatccatcattctctctcttcctcctaggatttttcaagatttttataatttcttcaaacactcttgccttctcttctttgatagtatcaatttcatcaataaatctcgccatccgcctacttgacattgcagtgaccggtttgttgatgatcctccctatcttcttctttatacttcttatctgtgacaggttaaagaaccaaattaatatcacataaaatgaaatcaacttcattttatatgcaatgaactatgtacaacatatattactactccctccgtcccaaaataagtgcaattttagcactgttcatgttcaacgtttgaccgttcgtcttattttgaaaaagattatgattagtatttttattattattagatgataaaacatgaatagtattttatgtgtgactaatttttttaatacttttcataaatttttcaaataagacggatggtcaaagcgctaagcacggatatctatagctgcacttattttgggacggaggtaatactcaacaactagaggcatgtagatgatcgttttccatgcacatgcatacctgctccaccgagaaggttattagagctttgtcttccccatcacaaaccttgaagaaattgttcagagtctccagttccttgtcagtttccaccgctgtggcgcgcagatactgtatcacctcgtgtggagccattcttgatggcgtcgcctgcgccctcttcctcttcctgtctaccatgctcgggtacatggtagcagtagcagcagagctacctccagcttgctgggtcacttgagatgattccagtatcttcacgtctgcccttttcgctgctggacgactgtttgcagcggcatagaattcttcaactttgaacagtaaggtagcaacaacagcattctgctcatgggctgctggcggcgccggcgccggcaccggcgctggaagctctgctgctggaggagctccgatgaactgtgccgccggcggggacgctgcatctgtagttactgcgcacataatatcaatttgtatgaattaatacacaatgtacaaattaaaatggttcaaatgaaaacatccatgccttatcactcgctccactgtttcagtatcgaaaatttgacgacggctcgatcatttaccgttctcaaatggggctgacacgatcgtatggagcatgttcatttccatcgccgtgtgactgttggccatgtcggtgcggaccgctccggagaagttgtagccagtgtccagaaaatgatgcccagtcgtatcatttttcagcttctcaacgttgctgcgatgaagtcgctcgcggactcaatggtatgattggtaaggctgaaaacatttgaaaaagaaaattacgatatagaaactgttctgatcccttgagaggttgtctcctcgcttgtttaaatccatccaaaaagatatgagaaaaagtctcaaaaatttcgacaatattcatacaacatatatatatacaagtacacaacatcatgcaaactccactcacactaagatataaaaaaaaacaatgcaacaacgaatggaggtgaaggtgaaaaacaatcaaagtatttatatggtttcacaagaaggtaatcctaacaatataacatttttaaaaataattgggggaggggggataagcaatgttgtttttcatgcacaagagacaattcaacgtcttctttttgaaagtcacatagcacgatttgtttgacaaagtgttttctttgcatccaatattcccactcctcatagtgctcaaaatatatttgaaaattggcttgtcaagatacccaagtccaaaaaaaaaattatgatctgagccaatgcactatgttgttcaatttggcgttgcccaaatggtaaatctttttgtaataaaatttcgctaatcctatagagtaggttatctttatgtgaaccagctctacacttggtattagaagtaggaaactatgcgtagttatatatactgcagttggaattagtagccaaatggtattttgttctgttttatatgtctttgtacctatagaattacttactggaatttgtgtgatttgtcttagcttttaattcaaatggttatcgttttagaggagttggggacttgtcccatcactctatatttttttctttttctttctcaatactaaaatttatttgttgtatccgagttggtagagaccgggagatataaaccacttctattaactaaaaaatatataaaaaaagtactattcatatgatgaatttatcttttatttactgtgcaggacaaacatgaacgtgatttttggagtgatagacgtcattatactcactattgtcaattttttttacactatttgtattgaatttgaaaaaaaaaaggtacacgaggagagacgtacatctcctcaagggattataatctgttttctcggtaacagcgtgtgattgttgggaattttatgaacagccggtgttggggaaaaaacattggatacaacaaaacaaagttaatttaatttgagtcgatcccttactcgaagtatagcagttgtctcccggggaagtgtagtccttcagcaccagtagcagtgtatctgcgatccacaatcgcatgttgaaatgatccaaccccggttgcatgaaccaagaagtatattgtccggctagctgcgcggcacaaagggcaacaatttcacaaaatcacacgccggacatctattcataattcattatcaaagcaataatcacagtcgacattgccaagtaattctcattttgatgcgtattaatctgcacataattaaacacatgaaagcatatgaaatattgatagaacttatttaccgtttgcatgcatcatctccctgacaaggtggcagttggagcagtccagatctccggcctgaaatgggacgaagtcggcgtactcatcgacgacgacgggcggagcagtgtcgccgccggcggcggcgccgtgtgtgtcttggtcagcccacatcaggacatcatccatgtcgacgtcgcccatgtcgacgttgaagtccatgaaattgaacatcacgggggagcatggagcgtcccgtgatggggcggccaagaacaaaccgtcgtcaccgcctgagggcgccatcgtcgtcgccggcgccggctggccggcgaagccgtgcgccgccggcaacggagccagcggttgctgttgctgttgctggtgatgcatcaccggcggcgacgcctgaacctgatgagtgtatccaccggcattcatcgccggcggcggcggcggagactgaaaattcaactcgggaaagaagtcgagatcgacatcgaagccgagatctgcaagcaccgggttcccgagaccgaaatccgccgccggagcgggctcgacgtgagccgtcgccgccggcgccggcgccgtaggaagcggctcgacgtcggggaggacgggcaggggcaatgtggtagccgctttgcctcacgaacaagggaagaaactccatgtcgtcgagcatgtagcggctcacatctccattggagtcgtagaaacggtgctcgccggccatggacatggcgatggtgatggaaataaatcgcaaaggcggcgcggtggggagcaaggagagagatcgagtgagagagagatcgagagagtgtggtaagttagggaatgagttggggaatatatatatatatatatatctcgcgagcgggagggggtggtttcgaacggatcgaggcagcggttggcgatttcccctcgcgtgcgcgtttctttcttttttgaggtttcttttcggccgtcggatgcgtatcgggcggcgcttggcgatggctgcgggggcaagtggtgattagagcaaaggcggcgcaccttcttggattttcaatttagccattttgggcaagtttcgggatgtgaacatgtccttgtcataacgtgtggatggtagaagagtgagacttatataccagtgactgtcataacatgtggatgatagaagagtgagactcatatactagtgattgtcataacatgtggatgatagaagggtgagactcatataccagtgactgtaatgacagtaatattattgtcgaggattctcatccaactattatttgcctgatctgcgttagaataccaattatagatggagcaaatatatggattctcgttcacacatatataaggatgaccatccactccttaccagtataagctaatcaatacttcaacatataaatctgaaagagcataaagtcagaggttgtaagcctaaggccatgaggtaaccggtagtagttgcagaaaaaaagtccaaatctgaaataaaagtttgaaatgaaaatctttaattagataagaatgaaaaaagaagctgaaaatcagagaaaaaaactttaatattggaaaatagtgataaaattagggaaaatcagaaaagtaaacaaattgaaagtactacgaagaaataaaaattactgagcatacaaaaattatgagaacttatcaaaacgatccaaaacctaagtaattgttttactagtttgaaaataaaaacatctcaaaaaaaaccaccacgttcattataaagtctagtaattcctacattaatcaaagggaaaagtatgcttttagctagaaatataatttagaaataacttaaatttggaataacgaaaactgaaagaagtgtctaccaagaagacaacacgatattaattaaaatttaaaataaaaataattgcaaaattatattttaatgtgaatttaagtaggaatatataatatagaaataactgaaattacaattaaaaataaataatattgaaatataagtccatctggaacacaatacatgattagttaaatatctgaaaaatataaaataaattacaaaattggattttactaatttcaaataaacttaaaaatcacaggttcacctctgacagggtgtttcagtgcccattatgcatgatcatcggtgacggggtggagtttagaaccgacaaagatgtatgtcatcagttacaggtgtttgttgcgacccgacaccgatgaggcttttcattaaaaaaacaaatcggttttattggctagcctcaaatgctagccacgcccgctataaaattcgcagtattcctgcaacacataacttcccccatagtcccatatatttgacattcacatacaaaaataagattcagaaacgaccacaacacataaattcaaaacctcagatgcatgcaagtctcaatagttggattacctcaattttttcaattctctcaacgaccaatacctttgatttcttaccttacaaaatcaccgaagcatcttcaaatgagaaccatcaatcacaacatgtgaatgcagttataatttaaattaaccaagtgatgaatatattagttaatatgaatattaccaatgtacatacatataaacagaagccaagaaaaatcgttttccaatagagaatgtcacttaatcatccatttaacacatatacgtgtagctatcctatgataattcagctactactttgcacaaaaactgccctttggagagacaatttttgctaggatgaaggcagccaattcatttctaatatcctcgaaattatgctctagaatgtttgtaacaactgttggtatttaatacggtcacagataaaatccgcaagcgtacggatataccgatgtagcacttcccctacggagtatttcaagggtatcgaatccaagaacgtgtgtggtcaaatcttcctccggttcatccaaggacaccaaccaaatgataggccaggatagagaggatttactagtgagaaacagtgtctagggaaagcttaactttaatcctaacgcaatacttcaggcacaggcaacccgctgttcccagatgtcgctctactacgtacccggacagggaggacttaactaatctcgagggctgtcaccacctctacacctacctcaacacactgtgggatacgcaacaattactggataacaattacctaaacaccacgtctaagcaattaatatctactttagtgtttataactcaccaaagcaatcactatattttaattaattatagtgaacaataatcccgtatgctatttacgaactaaccaagagataattctcacaagataaatctaaattactcaagaagaatattatattgaattcagagtaataaatagaaaaaaaaataggagaagattaccgacaactccggaattcttccgactccttctactctacacttttcctattctagtatacaatataggacaatagagcatcttgtaattcagctcaagcttggaagtgtgtgtgagagtgaatgaagtgaggtccttttatagggcagttatgacggttgtgagaagggaaaatgtccgaactgccctgcaaccgtcattgggagaacatctggagcgtccacgccaaaccccaggatcaacggtgatcaggggggttcggccgaacctgggctgggccctcttggcctggccttcggtcggtggactccctgagacgtcctctatccatttctcggagttttgggttgatttactaatgtttcgatgaagttcacaatccctccttgtatggatacataattctcctcactcgagtctgattttcctcccaacactggggtttattatctgcatacaaatatataccaacacttgtgtaatatttgagatgaaacacctatcactatgttggatgttttattatccaaactttatgcagatgttggcggtatagagtcggcatttaacagccgccaacaacaaccctctgaaagagaggcgttaagttagtacagatcctaggtgcaaccataccaacgtactaatttgttttcccaaatcaatataccacaaacctcgggatctagcgcagtcacctgtcctgtgaggaccttcatggtatggcacacgtggaaaccacaggtctcgctggattgttgcttgcatttgaagtcgtcatggtgatagaggttggatttttccttcttgatgcatgcccatttttgcacgtattagtcccatgctgtgttcaatgcctctttgagagcgttaaagtcatatttgtcgcttatgcggcagttaagatagtaaaacctactccattttggcactatgcacaatagaatccaatggaacccgcaaagttaatatagtgtaagttaaaaaccacacttttagatgtaactagatgatgccccgcgctttgttgtgggatatatgttagatattggagaaacgatgaaatgatttgattgaaatattacgaaaatgatttgagaatgatgatttagcatgtgtatgtctagttttagaatgaaataaattatatatataaataattattactgcctccgtttcaggttataaggggctgtttggttgctatcctgaggagaactagcctgacacggttttggtcctatttggttgctggcctgagactgttttcccctcgcctggcctaatgcatatctccgcgcgtgattagcctgagtcaggcgacttatttcggtcgcgtgagctccaggcacagcagctagcgagattaccgtcgtataattttcctccgtcctccgggcaagccatcgctaccgtcacgcaagactccgccgccgctgggcccgatgtcctcacccgccatcgttgtcgcatgcacatgaaaagcttgcctcttcctccgccaccgccattacgcgcatgcagtgaaaagcttgcctcttccaccgccgccgccgtcgcgcgcatgcagtaaccttgcctccgccgtgggaagccaccactagcttgccagatccggcgtcacacaaatctgcggtgaagtatctcaattcgtcggttccatctgcgacccatctgatctcccacacgcagcagcaactgtcgctgatctgccgaaacaattgaagcactttacacgcagttggagtcttgaagaaatcgttgtaggtttgggcatttatgttttttcttttttttcctcttctttacgtacgtgaagccggcaaaaattattaggcaataaattgatttgttacagttagcacttagcaatacccatctaaactgtagattctttttcctctcagacaactgtccacaaccaaacaagcaaaatgtcaggctgcctggccaggcaagtttcatcaacttctcctatgcctttcaggcacacaaattcctcaggcatgatacttagggcaccaaccaaacagcctctaagactttttagcattgtccacattcatatagatgttaatgaatctaggcacatatatatgtctagattcattaacatatatatgaatgtgggcaatgctagaaagtcttataatgtaaaacggaggaagtatacgcttgcatgttgagctttgtgtgcttaatgggttgatctggcatgcttacatgtaggttttaggagtgctaataaatactatgcttgcatgttgagctttaggtgtttagtgggcattagctttatagaaagaagggattattaattatttagcatactcactattgattgtgtgctaatatgatgaagcctttgtcctagtgggccctcaagttgttcatgatgtaaccgaccacatcatccaatcaagacttaagttgtgtctcattgacttgacgtggatctaggaatctaacttgacttctggtcttccgtgcttccatccaacataaccttcaaggttgatctgtatggctagaagcattctacatggattgttattagctaagtttagtgttattagtacttacaatgagtagcactttgggagatcggtgtccaccgctcgtagcctaaagaggttgaaaagatcagagaagcccactatgatataactgggtggccccaggaagggcgcttggtcatgatgacccagtatggacatatcactattcttcctcttggagttcaatttatccacgtagtaccgacgcagctctcgagtaatagtgcccattctggctaattcattgtcttgatccaacggcatccctggccagaatgtgtcgtgatctaggatcttgagagcaacgtacacctccttatctagatctagccgtttgggaggtaaggacgaccctcctacctttccttttcctttcaattttccccttccatgatttggcctgctagacaccatcggtggagatgaattggccttttcttttctttgaaggaggacgatctatggccattccaccaaaatccaagacgtgggacccaaaaggagcttcaatggccatctgaggtgcatgagctttagctgaccgagctagatgagttgggcctgctgcaacatttgaccttggaataatctttgtggtgatgaagtcttttggccattggataaacattccacgtgcatgagcgagtgtaagtatctcgtcctttggtgggattggtagttgccaattcagcaattgtctttgaccatgtcaacttggactttggcatgtccagctaccaaatccacgccgtacactcttgtttctggagtagatgttgacggtcgttacagaccaattttgaccgtcaatataactaaaataaaggagaactagctatgcttgcaatacatatttattttagaataatatatttccacttgtacttggagtattatttgtttgcagagattagcacatgaataaagaagaaattaatgaaaacttcactcctaagcaagcttaagaatacaagggcccacatgtcaggtgtaaccgtcctggaaaccgtcataactgccacaactgccatgaggacccatctgtcaaccccctgaccaaatctagaggcctgctgggccggcccaggttcggtcgaaccctggtagcaccggctcagctcagccctccacatggacgctccagatgcactcctaatgacggttgcagggcatttctgacaattccaactgccataaccatcattgggaggctatataaaggggtcactttcttcattccaacacacactcaagcaagaagctttgatatctctctctctctctctctctctctctctctctcaagtttagttaatgctctagtgctaagtggagtagaataggatagttctcgaagtcctcgagtattcagaagatttcagtatggctctagtagcttttctttcttctttcgtaagactctcggaattaatagaatattcttctttatataccttcggtactttactctgtctgagtactggatttactttatatttgtgccgacatagttgtatgactagcctaccagagaggtgcagtggtgtgggtttaatgttcatggaaatgattgatctatgttattctagaggatatagagtaatatttgataatgtaagcatggtgcttagattattagatatcattaattgggcatatatgctgcaggacagtagaggtgggccgctgatggtgacaacttagtacgggtattcctccacgttagtatatattcctaagccaatttctggggagggtactcctccgtatttagctccggttggacggccatgacaggttgttataagaaactcagcaacccgaggtggtctctggaagctaaccaattgttataagatactaacaattgtaaacttttactt

SEQ ID NO: 65645 - DNA, 2181 bp, Oryza sativa
atgcagtcatagcttcatcagtattcagagcgcacttcttaacctgtagatcttggatctctaatttccatttgtatcagctacgttgtgtgtttcaactacatactatcttattttctgagattttgtgggagtaagggtgtgtctctaaggtaatatttatcttgactttctgttcaattctagaattggttgattacactgccaatagaatttactaaaatcaagagtaaacatctagagacagaaaaaatctatatggaaaacagaattttattgaaagaaagagtcaaaatccaatgactaccctattgcattcttacctcttgcctattttgctttaatttttatctcagaccagaccattgattttattccaatgcaatctcttcaatttttgatggtttctcattgttaatgtggttcattttcttttgagttgattcgctctcaatgtaaggcattcattatcatgtaggtactgagtgttatacttgatttatcctgctaaaatatcagctcatgtgataagatggctaaataggctccttttcttccaaactcaatcttaatatgaacagatgtgctcagggccagtcctatgattttgagggccctaggcgaactcatcgtgatgggccctctaagctatatataaaatttattgatatatatatacgctaattttacttacaaaacggaaacaagtacatccatatattaaatttaatatgcttggtaattatcaagaaataaagtcgaccaaaataacaatatatttgtaacttggaactaatatcattattcattaacttaatgaagaatagaaccctattccattgcttcctatgaaaagatacttcttctgacatttcttgatgtaaaatcatcaagaatggtattaagatcaatattgtccaagatatcattctcgattgagtacatagccaagccatttaacatttcttgcgacatagttgatctcaaatagttcttcaacaacttcaattttgagaaacttctttcagctgaagctaccgtcacaggtacggttaagagaattcgataggcaactgaaacatttgaatagaaatctgcatccataacaaacttcagaatctcaggtgcggacattgaagaatctagcaaactcacttgcaacacctttaattctaaataaaaatcattgatctcaatatcggatgacgtactagattactagtattaggtgttggcccctcaccattatgggtccccggccgtcgcctcggctgcatagggccagggccggccctggatatgcttcatttatatgctagccttgaggttttcagaccgtcatcggcattaagatcatcaaactgcttgtcataatagtatagatttaagtatcaatatgctctgtcatagccatattatcaagttgacctgacttttttagttaatgaaaactttattgaactcagacaattaaagttgaccaaactatgtgaggtccacctttaatatacatctagatccttctttgatagcaaggtaccacgcttcatgtaacaactctgcaagctatatgacaaattggtcagatttaggtataattttgcatgcttatgcatgatactttcaacgtgatgcttgataatagttggattatcaagtttgaagttaaattcatgtcaaatatgcatcatttattgactcaggtatccctgtatgcagtgtcctccccgattggattttgagcagcgtgagtgtctcctggcacagccattatatgctctgctagctccacttgatatccctgccctggcagtgagcggcaaatacaccaacattttgcttagatgttacaactggtgtaaaagaaattatgattccacagcaactgggtacagatattattccctgatatattttgggttgttgctgtggaatgaagattactcacagccgtgtccagtcgagccagcctcttccggggtaccagaactactttggcaaggggcagcagccaccttcccactaccagccatcacaagatcaccaccccaactccacgaggatgatgacccaggcaatccgacaagcttctaaggtgctgattggatgctggttttcaaagattagttatgctgtgcatcatggacaaattatgttcatgtagttataaaaattttttag

SEQ ID NO: 65646 - DNA, 16524 bp, Oryza sativa
cagtcgcagctggcgcccaacgggtggcagcgtcctggccgggttccccgtgctctgccacttccgcggcgtcggcgcgccgtcgctcccggtgttccgccacttcttcaccctggcgccgctgcccaaggggaaggggtggtactccttccgcgccagggagagcgtccccgcgctgttcacgggcctcccgtcctccgtcaaggcgtggaaggaggagttcctcttcgtctcgccgccgcccgccgcgccgtggcgctgcccgtgcgctggggaaccccgtccaaggaggccacgagcgacccggcgctcaccgagagggaggccgccgtggcgcggcggctcacgcagggccaaggcgtcgtcgacctcaagacctacctctcggagagcaacctcgtcgccgccaagatcagcagcgccccggcatgtctgggaggtacggacggacgatcaaatgccaccaacaaaacgtacatcggatggtgcagattcctcaattgctcgattgttttcttctttcttgcttccagggacggaagcttcacggggttcgtcggtggcggccgggaagaagaggaaggtgctgggcgatggcgtcagcaccggcggtggcgtgcttcggtcagagctgcaggcgaaggacaaggctctggccaaggcgcagggagagatcagccgcctgaaggcgcagctggggagcgccaaggcgagggagctggaggaggcgaggcaggcgttggagtacgagcggaagctggggacgcaggtgctcaagtctgatggcgccgccgccggggccagcaagcgtcgccgtggcggccagtgatccacgttccgccgctgaacgccgccggccagcgattcggtgatgtgctaggtatttactagtactactactacttgccaggataatgagtagctttgcggagtagtgttttagcaaggacctttcatgtttcttcataatcagcatcagctgtgacagacagtgctgatcttggttggtatcatttcgcaacaaactgctaatggaaaatctgttcacagacaccaggtgatgttatgaatcgcaatctgcttagtttatctaccatgttaattagcagcagaaattgctagctactggaatgatcatgggtatgagggtatcccactagttgagcgaaatgaactaaatacatagataatatgcatcagaaagaacacattttatagctgatcttgtaaaacaagagcaaggtcaagttgggtaaccacaagtgaaccgcgcccatactatcgccaaatatccctgcaatctgccatcttccatgaacacaacacgagcatcaggcttctaaaagatggtattttcacagcaaagggtcattataatgttattccacaagtacaagggtagattctgccaaaaatattcatccagttgcaatcagaaagtgtccccaaaaaaactgcttgctaccttttttctttgtacatgttcagccgaaatgttactacagtaattgcaattcaattggtccatatttgcgctatacaatgacactacagctcaagatgagaaaactaaatgcccacaaagattatccaattgtatgtactccaagatttggctagtgcatttgcacggtccactccagctaccctttactcttatcattgctagttgattcgttgtcacttgttgaatctgtggagctattagatgatgccattgtgttggactgctcactgattttctctgcagcgctgctggaattgtcatcgcccatgatagaagcaaaagtgagctggagaccatagagtactaatccaattgagttgattccaaacacaaatgttgctaggtagcatatcccatttataattgttctgcagagaaaacgtggttcattcattagataaaaggattacaatatataacaaacaagagaacagtgaatgaatggagttgtaccttattgttattgttatttgacgaacctgcagaaaacaaaaggaggattccattagatgaattgtgctagttacaaaaaatatgacgaagactgaaattcagttcctctgtaagtatatggaaagttggtagcacgaaatagcacattttacggtgcataaatgtgttaaccgacccacgggaggacaacaagaaataatttttgttgcagctctcttagtatttgttccctgcatcattgttgaatttgtatgtgttggtaaaacacaacaataatttgcattttccatgccttattctccatttgtgaaataatattgaaatgggattcaattccttgctgtaaacttcaaggcacattggcgacaaaaaaatggatggtgattacagcagacaattactcaaagcattgcatagcagtagcgctaacttctactagaccattaacgaaggataacaagaaaatggcaggtaataatacaaatgaagcaaacttcaagttggaaaattcatttgaaaccaaaaaaatgtcaaaaacagcataaggtagaggggttcaaattgctcaaaactaatctgcaatccttacaagaatatagaattattcccacaaaataagtgttaccacactgaattatggtccacactccacacttcatcagagctgctacgaaaattgaagtgtcgacctagggctgtgttttgttcaccacaccaaaattggaagtttggttgaaattggaatgatgtgatggaaaagttggaagtttatgtgtgtagaaaagttttgatgtgatggaaaagttggaagttcgaagaattattttggaactaaacacggcctagataacatagccgcacaagtttcatcggcaaacttggcctgcaataaactatttttgttgaagtctttatcacttacactttcagcctttgaccagaaaactgcatagctctaacacaacttcacttgtgccgtgtttagttgttttggcaaaaaaatttgacgcatacggacacacatttgaagtattaaacgtagactaataaaaaacaaattacagattctgcctgtaaactacgagacgaatctattaagcctaattaatccatcattagcaaatgtttactgtagcgccacattgtcaaatcatggcgtaattaggctcataagattcgtcttgcaatttacatgcaagctgtgtttttttgtccacatttaatgttccatgcatgtgtccaaacatttgatgtgacgaaaaagttgaaagtttgaagggaactaaacacagccttaatggtttatgtaaaccagcattcattgtccactatgatatattgaattatcatccatgtggttagttcacaacctttattaaattgtccacgactccataaaatttatttgtagctattcacataggttcaatggcgcatagacatggcaaactagttccaaacaatggcgtatatacaattatacatttatttgtcggaacaacaaaaggattaaccgataaagtgaagtctgacaaaaatcaaagcaacacagatacttgtcatcacagacacaatcggacacatacagcacagcctcaagatccctgttactcatgctagatttcctccaaaacttatatgaatttggcaattccaatggaagttcaaagggttcggtcctttgttccaaaggagaacataggcaaatcttcctaaaaggatattcatattctaaaaaatttctcaaagaaaccttagtttgaaaggagccctaaacagcctaaatcaatttaatgtgctgtaaaaaaaacatgtatattgttgcaacaagaaaaatactaaaatattgtggagggggaagagagctgaccgagaagctgtcggagatggtctggcggttgagcgcggcctcgatggtggtggtgaacttgtagaggatgagcgcgatgacccccgcggcgatcccgccgagcagcgcctgcacgggcgacggcggcttgtcgacctcgatcggcgacgcgctcaccagcctcagcccctccagggcctccttgctcaggttgttgggcttctccaccccgccggaccgaaccctctgtgtcacggaagcaaaaaggatttttagaccatttttctccagtcgagaaagcgcagcgcaggtggatgaggagggaggggattacgagctccttggcgcggcggacgcggcggcggatggagcggaagaggaagacggagatggcgccggtgaggaggacgctggtggcggtctgcagcggggtggggttctcgtcgatggagaagagcgtcggggtgcggagctccacggggccatctccctcgccgtcgtcgcccgggggaggctcggctgccgaggtggacagctccggctcggcgcggacggcgacggagcggcggaggcggagggcggaggcggaggcggcggggaggaggtcgcgggacggggggaggaggaggcggtggcggaggaggaggcgcggagaggagtggagcagcagcatggtgggagtggagagctgcttggcggtgctcggggagagagttcagtggataacgaacgggtcgggcgagaaagggtgtgatgaattattttcatttctaaatttttattttttaatatttacagaaatattataccatttaaaatatttacagaaatggcccccctgccgccaaagtggagagcggcaaggtgtgcacatttttcattgaggtctcttgccgccctcgtacaaggggctaaatgcaattttcgccatgttaaaaatgcattttgctaatttttcttttgcatctcggctgtctctcacgtcaccctgggtctatttttgtaaatatttttgccggtataatatttctgtaaatattaaaaataaaaatttaaaaatgaaaaaaattcaggtgtgatcggtagatgggctactttgatggaccgaggccttctccatcgtttcttggtggtggcctggtgtgcgtacggtgggggtgggtgctaagggacggggaactgacggaaagttggagaaataagtttatattgactccctcaactcatgcccctcattgaatcgcatccctcaacagtaaaatcgggtataacccattgcaaatcgactccccgagcagtttcgaaggtggttttatcccacgtggcatctttgcctccgagcaacgaggtaaggaataaaactgcagacgcagttgaacggtggtcaggctagctcctgcaacaaattggtattacaatgtcctaaccactttcatttcgtaccaaggaatctaattaaatattataaaatctatgtgcaaccttacaaactatagtccaaattggtggaagaagccttatgattctattttctccgtttcataatgtaagtctttctagcattgtacatattcatatagatatcaataaatctagacatatatgtgtgtctagattcattaacatctatatgaatatgggtaatgctagaaaatcttacattatgaaacggatggagtatctctcaagcagattgctagggtggacatctagtcaaactatagtgaggataggctcaaagtttaagtctaagagcctgttcactttgatttgatgttattttcaaccttaccaagttttggtaaagttgctaaaaaattggctacatttagtttactgtcaaatttttaaattttggtaattatataagaaatgctgtcaaaattttgacaagttgtcaaaatttcggcaactatgccaaagtgaacaggccctaagtcaataaaagcaaagtaaagtacgtacctttacctacatcgaattcaatgttaacataatcaaatagaaaagaaaacggaggagtgcattgccaacataaaagtgcattcttgattagcaagatactagagaaaaatacagaatcctcattggttagcacaaggccattagctaattagcacaaggttattagctaaggagcgaacgagatgagcagagtagcaataatagactagaaccagttgacttgcccatgccagtgacttgcgcctgcattctgctggtagcctaatgcctcgggcactctcccctgtgtggtcgcatcgccacctcacaccatctgcctcgtagatttcaggcatatagcctccatcccaaccctagcccccaaataccaaatgaatgaggggggttcctgttacacgcttaagcgctagcatcagaggcagcgcgcactttcacggccctaagagcgcttagcgctgttttttttttataagaatgcgtatgtttcttccctttgtttaattaactgaaacaaactttcaactttgatttattcaagatttggaaacttttcaactaatatttgaaaactttcaagtctagatttgaacttagatttcaaaattttcaagccaagattttaatactttcaacttaaatctaaaagttttcaactcttattttaaaactttcaaatctttatttgaaaaatttcaagtcaatatttgaaaactttaaactcaaatttaaaaactttcaactaaagatttgaaaacttttaactcagatttaaaaactttcatctcagattcaaaaacattcaactcaaatttgaacactttcatctaaaaacttaaaaacattcttctcaaatcttaaaaactttcaactatttaagttaagatttgaaaactttcaactctgatttaaaaactttcatctaaggttcaaaaacattcaactcaaatttgaaaactttcatctcaaaacttaaaaactttcaactcaaattttaaaaactttcaactcaaattcaaaactttcagcagcaattaaagatgaaagattcaatttctaaaataaaaagatcacaaaaaaaatcggcaaaaaaacatttcacggcgcggcggaaaaaaaaagaagcgagaaaaaaaggaaaaaaaaggaagagatgggacgcgcgtgggggtgggccagaaactcgcgccgcttgtgctaatagcgcatacgcgctaattagcaatttcgaagaatgaggcctggtttagttggggaaaaaaattttgggtttggttgtcacatcggatatacggaaacatatttgaagtattaaacattggctaataacaaaacaaattacagactccgccagaaaactgccggacgaatttaattaagcctaataaatccgtattaacaaaagggtaactggaaaacacattgggcaattattggcgcaatttgggcttaaaagatttgtctcgcattttacatacaatctatgtaattgtttttttcctacatttaatagctccatatatgtatccaaacattcgatgtgatagcgtgaaaatttttgttttgggaacaaaacaaggccgaatcacgcctcgctgctacctctaacctcctacccccttcagttcctaatttgttgacgttttagacaggattacacataccaatgagtgattaattagtgttcctacttcctgttttacccctaacaaatacggtttcgaggtacaccaaaccacaacctgctcttggtttgagtggccatcgcatgcaaaactaaagctactagtcctaagttcgattcttggtgtccacttatttttgcactcatgcacaacgccggcagcgtcaaccacaacggcggcgccgtccacctgttgtgcgagcttcaccaccatggcgccagcgtcgacctactccacggcagcggtggcgtcctgcacgacctgctccatggcgaaaagtagtgcaaggaggcgaatagaaggcagcgccccgcgcagcatgcatgacgttggaaataatgggagtaatggccggctgcatgcatgcagggcaagcaggtccaagatgcaaaaaaaaaaaaaaaaagctaaaacgtcaagaaatatcacacaatacaatggttcaagagctaaaacgccaacaaatttcaaaccggagagagtagtccaaaagtacccaagtgacctatgggcccgcactatgtaacgccaaatcaaccaatttgaccgagcgcgtaccactttatcttctccctaatacagatcatcctcttcatcttcttcgataagcccaatatagatagaaagctctcatgaatctcaaaattaggatatacgggtctacctgctggcttcatccctgcttatttgtaataaataaatacgaaaacggttcttctcattttcctcggtaattttcattttcatttttcaatgggcatagcatctaaagtattaaaacctccccccgctgctcgctcgtccgagttttgcgctggcgtggatgctgccggagcacggcacgtcagcgcgcgtgggacggcgagtagatttcacggcctctcgtgagtccgcgatgattctgtgaactttgcagaaaagccctctccgttatagctattttgatatatgtcctcgccgtacttgttcctgtttaaatatattacgtttagacccttctatttctacgaaatctaatacgaacgtgacaaaaatgagaaaaaaggaccgcgccctgaatcgtggaaactgaggggtcttttcgtagaatttccttttcttacacgccatctctccccctccggaaacccccagccgcgtcaaaaaagaaaacgaaaaagaaaacgaaaaaactcccggccgctagggttccatcgccgcactcatctctctcgctctctcttgcgcgatgcgtcgcgccgcctagatctcacggagccgtggccgccgcccactcttctcccgttcaatacgcttacatttaagaatttaccacttaattcgtaagccattaagattttaccactaggatagcgaatttcttcatttcataccactcccgtcaaatttacagctcatccatctccttcgttcacactagtgtagggcgccaccgtcaccatcgccgggccctcccttgccaccatggcgcgtttctttcgccttcgtttgtcatccccgccatcgtgctcgaaggccggagctgcactccatgccattgcgctcgggtgagcataccagcgagtgatgatggcggtggccaagttcgagtactgcacgggtgcaacgacaatggcgtggtcggggatggcttcacgccgctgcatctcccctcctcctcgctcctctcccctctctcctctagcacgtgtgggtcctaccacttgagacgaagaactcatagccaaaacttgcttcgcgttcttgaggaggccatgtggatggatgacgtggcaacgaatatttggtttggggaggaggctgaacgccacatcggcgcaatgtgaatgccctaagggtgttcttagcttttcatgtcagcttttgccatcttctatttttgtcctcacatgtttttaaactacataacgtataaaatttagcactaaacaccctaaaattcagaaacaaggatacaatttctccccttccatcattctctctattccccaactaccacaactcaacagcggctggcagcacagcgagctccaacagaggacagcggctccccaacctcctcccaaacagcggctcgaagggcgacagcggcggcgcgagagctcgctgggacccctcctctcctggccggcaacgagcgctcagcgagcgacggcagcagcgtgggagctcgccggggcccctcctctcctggttggcaacgagggctcggagggcaacggcatcaacgtgagagcttccggggcccctccattcccggccagcgacgagggctcagaggacgacggtggcagcgaggatccgaagcggcgtgagagctcgtcggtgccctccacttcctgccggtgatgaggagacagagcgccgagggtgacagtggcggcgcagatccagagcgacagtgactccgacggtggagagagaggtttgtttcgatggtggggaggtggggatgatggtctacagcctggattccatgcttttatctgctttttccgttgagcttctcgtgtctcaagttaggatgtgtttagttccaggggtgtaacgtttttgaagtatacggacacacatttgaagtattaaacgtagactaataacaaaacaaattacagattccgcatgtacattgcgagacgaatttattaagcctaattaatccgtcattagccaatgtttattgtagcatcacattatcaaatcatgtcgcaattaggctcaaaagattcgtctcgtaatttacatgcaaactgtgtaattggttttctttttccacatttaatgcgccgtgcatgtgtccaaacatccgatgtgacgttttggcccaaaatttttgggatctcaacaaggcctagtcccgtattcctcacaaagaaatggtccccactgccacattagcagctgtcctacgtggcgagctgtgccaactcgccacattcctgcactgtgaagggacaacatcacaaaagtcagtcaacttgagaatcatatgaatcattgaatatggtgacagccaaaaatatcatcttgacttgtctagatctgtaggtagcagagagagtagcagatagcctgtgaaagagagcaattgcagagggaggcttgcagctaagaactagtccccatggagcatggcggaatcgctgcttctccccgtggtgtgcggggtgatcggcaaggcgaccgacgtgcttgtccagaaagtcacccgcatgtatggcgtcgacggcgaccgccctaagctagagcggcagctgctggcggacgccgagttgaagagcgagaccaaccccgccatcaagcgttggatgaaagacctcaacgccgccgccgacgaggccgatgacatgctcaacgagttccagtacgaggcgctgcgccgcgaggccatgagcctcgagtcactgggacacaaggtacgaagctgcatgaccccactcgagttccgttttaccatgagcaggaagcttgccaaagtgctcaagaacatcaacgagctggttgaagagatgaacatgtttggcctgttgctgcaagatgagccagtacatcaacttccttactggcagacgtactcagtgctgccatcaaatgaattagatgatatctttggcagagacgacgacaaggaggcggtggtgatcaaactgttgctcgatcagcgagatcagcacaagtgggagaacctcccatcgtggggatgggtggtttaagcaagacaacgctcgccaagatggtctacaatgactacagggttcagaatcacttcgagctaaagatgtggcactgtgtgtcagacaactttgaagttgtttcccttctgaaatccatcattgaattggctacaaataaagcatgccaactgcttgacaacgtcgagttgttgtgaaagaccaagaacagctatagaggggggggtgaatatagcaattcaaatcttgcccccgaaaatactcatcaagccggatttctcaaaatccttactagaatcgcggctattagagaagccggatctagaaaagaagagagaaaaagaagagagaaggaattcccgaaactagaggaggaagagaaaaggaattcccgaaactagaagagaggtgagaaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacatggaaactctctcaccgagcatctcaaaatgattaccaaaaggagcaacctccacccttgcatccatctctctatttatagcctaagacccctaagacattgtctcaaatacccctagggcgaaaccctaactcagaacagatctggtccatccattgttccttctactcaaaggaaaagctccagatgattgccacctcatcgatccgaaccttcacatggtcttcttgctgatgaatccgcgtgctctccgtcttgacgaatccaaacttgccacgttgcctagccgcgtcgtgcgcgttccgtctccttttcctcagcgcgcgctcgccagcgcccaaccagcccgaagccgccacgcgtcccgctgagccgctcccgcgcgcgcttgcaaaatcgcgtgtgggtcccgcgctcctgcacccgcctccgatcgagtcacgcgaaacggaggttgccgcgtacggttttcccgcgcgcgtccttgcgcatgcaagctgcctgcacctcctgagcccatgcgccatgggccgccgtcttgggccgtcgctgcttggacgatgcaggcctgccgagccgagccattcaccatcttgggccacgtggaacggctagattggcttggcctccctgccaaccaatcacagcgcacatgcacagctagctagcttgacttttccaccgagccatgctagtagcaaccagtacaatgcaagctcctccttgcacaagtacagtacgtgtacatgcatgtatgctacctacagcaagtactgtagcagcaatgcacttgcacagtcccttctgatttcttcgcgaatccgatgcttgcacacttgaccttgtgaagcctgttgcaaagacctcctcacacggtgttcgtccaccgtgtgcaaccttgtgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaacctgaccaacgttagtccacacacacacttcttgcacatccggtacttgtcaatttcccatcacaaaagaactataaccacacatggtttcacatccggtacttgtcaatttcccatcacaaaagaactataaccacacatggtttcacaatctcccccttgatgggaacattgacaatctcaagcaaaattttgaaaatttgatttttgattcacaaagcaaaccattttgcaaaagcgaactttggtcattttgaaatcgcgaaaaatcaagaccaagtgacaagaagaaaaagggatgcaaatgcaaaactccccctatgtgccaaactccccctttcaccaagatttaaagcaagttttaattttcaataagtgcaaatttctctccccctttgtcaatgatgctatcaagatcaaaagagacaaaaatgcaagataaaaatgagatgaaacttgcaaattttaggttttgagagctttgagagttatctaaaggcatcaaaaggtagacatggatcacacagatacaagcatgtgctcaagcctagctaagcatgtgcataagaagtatgaaacaagtcatgaatatcaagttagtatcgccagcaagcaaaaagctttcaagtgaattagtgatttagtgtgcaaagctatttctagaagaagcttaaaaggaagcaaaccagctcataatcatgcaagatttacataatcaaagcaatgaacccatgctaatgtgctaatgcccagttcataaagagtatcaacatgataacaaagcatagaacatgagcttttaatcttttctcatgacttttatttttatgattttttttaatttctttaaagacaatagcacaatcacgacggtccacctgatcttatcagtcagcaagtgatggttgtgccaaacactgccgtctgacctcaatcaagttttccagctagagttcccattacaggctgtctcagtgctatcttcggcactactcatgcgtaaacgcactcagtagcccggacaaaacagagataaatcttgtaaagcatgattgatacaaagtatggacgcataagcatgagcattcataagcatgtactgacagttattgcgaaaagaatgtaaacatggcatgagtatgagatggatacttcaatttaaacaaacttctagagcaagcattgcacattgattgagttcaaatgaatagttaatttaagcaggtttcaacacgcttgaacagcataacatgatcacacaagctacttaagcaaatgaaagctagacaagagatcaaactagcataagagtgatacatccatagcatagtgatgaccaagagataacaagcaaagctcaattgaagagtgtataatacaatgcataaagtaaacatgatgcaatatgttacaaatgcatgcaaaagaaaaacaactccccctcaaatcaagccataggggtggatcactcctaactcactccgcaagaactcaaaacgagagcgatcaagtggttttgtaaaaatgtctgccaattgtttttcagattcaacaaattctagcacaatggtacctttctcaacattgtctcggagaaagtggtaccgtatctcaatgtgcttggtcctggagtgttgaactggattttttgcaatattgattgcacttgtattatcacaaagcagaggaacaccagagaaagacagaccataatctttcagagttgaaatcatccaaagaacttgactacaagcactagcagcagctacgtactcagcctcagctgttgattgagcaacagaagactgcttacgagaggaccaagagaccaaagaagtgccaagaaaatgacaagtgctagaagtacttttgcgatcaatcttacacccagcaaaatcagcatctgaaaaagctcgaactgaaagggcagaagagcaggagtaccaaataccgtactcaagtgtagacttgatgtagcggaagatgcgcttgactgcttggcgatgtgatgttcttggagaagcctgaaacctcgcgcacaggcacacggagaagtggatgtccggccttgacgcagtcaagtagaggagggagccgatcatgcttctgtactcgcgctggtcaacttcttcatcgtcctcatcaggaccaagcgatgaagtagttgccatgggagtagcgattggcttgcagtcggccatgtcgaacttcttcaggagctctttggagtacttggtctgatgtacaaagattccttccttggtttgcttgatttgaagtccaaggaagaaagtcagctctcccatcatgctcatttcaaattccctgctcatcacatcagaaaactgggcaacaagtgcatgagaggagccaccaaatatgatgtcatcaacatatatctggacaagaagaaaatcaataccactatgaagagtaaaaagagttttatcaacagcccccatttcaaaaccattttgaagcaaaaaggttttcaatctttcataccaggctctgggagcttgttttaaaccataaagagctttttcaagtttgaacacatgatttgaaaattttggattttcaaaaccaggaggttgtttgacatagacctcttcctcaataactccattcagaaaagcacttttcacatccatttgaaaaagcttgaaaccttttgaagcagcaaaagccaaaagaattcgaatagcttctaatctagcaactggtgcaaaagtttcttcaaagtccaagccctcaacttgggtgaaaccctgtgcaaccagtctggctttgtttcgaacaattgaaccatcttcacctagtttgtttttgaaaacccattttgttccaatcacattaaaacccaagggaggttctaccaaagaccaaactttgtttctttcaaaattttctaactcttcatgcatggcattaacccaattctcatcagataaagcatgacaaacatttttgggctcaaaagaggcaacaaaagctgaattgacaagttcataagaccgatttctagttaccctttcacccaggcctccgatcatcgagtcaggcggatgtcggttctggatgtgtcggggagctgtcggtcctaatgtgccaccatcaatctcctcagctgctgaagatgatgtagttggtgcatctcctgaaggtgatgtagtcgaaggagaaccggtttcttgcactggtggtgtactgtctagaggtggaggaatagaatcatcatcatcatcatctgaatccacatccacaaagatgctttcatctggaacacctgaaatttctggtctagctcctgggctagcctcatcaaaagtgacttcacaagtctccacaattttgttagttgaaagaacataaactcgataagcccgagaatgagtagcatagccaaggaaaatgccatccaatgatcgagattcaaacttgtccaaatttccagatttaagaacaaagcatttgcaaccgaagaccctgagatgtgaaacttttggtcgacgaccaaatctgagctcatatggcgtcttgtgcaagatagttctcaaaaacacacgattggagataaaacaagcagcagaaatagcttcagtccagaattttcttggagtcgtaaactcatcaagcatagttcgtgccatctccaca

SEQ ID NO: 65647 - DNA, 3075 bp, Oryza sativa
attgttcctttagccatcatgcgtccactgctcgcatccccaaaagtgatggtctcatcaccggatgcacgagtgagagaagtaaaccacttggcttcaccggtcatgtggcgtgagcaaccggagtccacaagccaagaattacttctccctactccaaaatcctacaagaaggacacagcagatctcgatgattcagtactggggttagtgaaaaatgacttaggaatccagtactgaaccatgcgagaagtacaagcatctttagtgttatgagcagaattatatgcaagatgaccatgtctgttttgccccaaccctgctaggtcacgtcgagggtgcacatctcggcgaggaaagcgagatacacaacttgaacgacaatgacacgcacactcgaacctctcagggactctagtagctcttctagtcctaagacgttcttgtcgctcttttctagcctttctaaagcagaaacctaccaaatgaccagctttcccacaataggtgcactcatacttggttttctctacaggcttggtttgtctctggttttgcttgtgctcaacttgttttggatttttgggtctaggtaactctacaggcttagacttgctagtcataggtaccatctttggttctgaggttttgggtgtactagaactagtgtttccaatgaaacctgcagacttgaaggttataggtttttgagctagttctatcatcccatctgtgacacctaaaatctcatgggtacctatcctcaaagactcagcaaaatcatagcctataccttgattgtttatggacactttggattggtctaggatcatgttcaactttttctttccttgagcaaacctctctaaagattgttataggtatgagttctctttcttagcagactcaagatcaactttcagagaaatgcatgaagacaagaatcaatagatttgatagaatcaatgacagttttagcatcttttagttcagtttccaggatagcacaattagcacatgaagaatgaataggttccttagtagcaaaagattctaacaaattattcttggtcctaagcatggcaacttgttgtcttaattcatcattgtcactagtgagaatgggacaattttcacacctaccaatcctatcatgaacaaatttttcttttagttctttcaattccatctcaagcaaacccatatcaactttcatttcatagcaagtagagcaagcagcactagcactagaaggattcctagctcctaaagcacatgatttcaacttatccttgaggagattaatttcagaaagatatgaagcacaagtagaacaggtatcctcctcaggaatcatggatcgaagcctagcaatttctagcgccattccatcattttcagattttagtttctcaattttatacttagaagacctatacttatcactaatttcaatcatcaagtgtgccattctttctttgcttagttcatcatcaacagagtcattatctgagcaagaatcatcacaaagagaaccatccaaggaagggatatcatcaagacatacctcaggatgctccgatgagtcatccttatcctcaagcgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttgtggatcgccttcttcatcaaatccttcttcccctttcgcccttgtccctcgggcttcttggtcgtcttgtcactcttcttcttcaacttgggacaattcactcttttgtggttaggctctccacactcaaaacacacaaatggttcattggtttttcctctttttttatctctcacatttttgtaagctcttgagaattttctagcaaaaagagcaagatcatcttcagggatcttctctaattgctcctcagtgactgagtgtaaagcggcaagagagaagccaccatacacaaaagctgagtcattagaagaagtactaccagagggatcagctaccaaagccatcgagtgtttgaggcctttccgatggaaaacatccatctcatgggtttttagctttgagtaaagcttgtccatggtaaggtcactcagaggtgcactctctgtgatggaagtaactttcatttcccaaacaccataatcaagacaattcaaaagatggcgagcattatcattatcagaaaattcttttccaacagatctcaacttcgaaataatttctccaaaacgtttgaaataagaatcaatggactctcctgagtgcatctcaaatctttgatattctttatgaaattgattctgacgaaccaattgaatatcattgtttccctcatggaaattgcacagagcagtccacatgtcatgagcggacttgtggtgttgaacacgattaaattcaccagaagaaattccaccaatgattgcatttcttgcacgataattaaaatcaacctgagccatatttgcaggcgtgatgtcagcatcatcgggcacagtgtaaccttattccacacattatgcccttgcgactggaggtaggcctccattcgtgccttccaaatgacaaaattgtgtccatcgaaaacaaatggtttcgcagagtatttttcctccatagctgcgttcgttgccatggttaggttacaacgaacttaaccgggctctgataccaattgaaagaccaagaacagctatagaggggggtgaatatagcaattcaaatcttgcccccgaaaatactcatcaagccggatttctcaaaatccttactagaatcgcggctattagagaagccggatctagaaaagaagagagaaaaagaagagagaaggaattcccgaaactagaggaggaagagaaaaagaatttccgaaactagaagagaggtgagaaagagagagcaaaactcatcatcgcaaagttcaaattgcaagcggaatttaaattgcggaatttaaatggccaaggcaaaaatgaaatccttcaaa

SEQ ID NO: 65648 - DNA, 1695 bp, Oryza sativa
tcttggcacagatgtcgcaacctgaccaacgttagtccacacacacacttcttgcacatccggtacttgtcaatttcccatcacaaaagaactataaccacacatggtttcacatccggtacttgtcaatttcccatcacaaaagaactataaccacacatggtttcacatgttgcaaaaggaactacataaggtcgttggccggagaaggtttctgctcatgctcgacgatgtatggaatgaagaaaagaagaagtgagaggaagacctaaagccactcctgtcttctgttggtggtggtgatggaagtgctatactagtgacagctcggagccaacaagtagcatctataatgggcaccctagaatcccataacctagcttgtctgagtgacgatgattcatgggaactattctcaaagaaagcattcaataaaggcgtacaacagcaagttgaattggtcaccgctggcaaacttattgtcaagaaatgtaaggggcttcctcttgctttgaagacaatgggtgatatgatgagttcaaagcaacaagtcaaggaatgggaaacaatgcaagaagcaatactggggacaatgacaggggtgaagatgatatactacctgtactaaaattgagctacagacacctaccacctgaaatgaagcaatgctttgccttttgttcagttttcccaaaggaccatgagatggacaaagaagtgttgatccaattgtggatggcaaatggtttcattcaggaagacgaaacaatgggtttgaacaaaagggggaatatgttttccgtaatttggtttggagatccttcctccaagacgtgaaacaggaaaggtttttttttccgtttgcaaaatgcatgatttgatgcatgatttagtaaaagatgtggcagatgatagtgtaatttcagaacagttaatcccacaggaagcatataccggacgttgcatatcagcaatgagtcaaacagtgggattgctcaaaacatcatcttgtctccgcactttgataactctgtggttaccagtacatattaataacttaagacagatgtcattaagagatattggtactgacttaagactgatgtcattaagagctttgggtactgtccgtatgcatgattgctcttttcatagccaggtcatcaatccaaagcatctacgatatcttgacctttctgggtctgacatggatgtgctgccaagttcaatatgcacgatgtataacttacaaacactaaggctgaaccgttgcaaaaaactgagatatttactggaaggtatgagaacaatgagcaagctcatccatctttatctttttagctgtccattgaagcggatgccaccaaatattagcctactgaaaaatcttcgcactctaacaacatttattttggacactgaaaaatcttcgcactctaacaacatttattttggacactgaacctggccatggaattgaggagctcaaagacttgaatcaccttgccaataggttggaattgtacaatttgagaaaaataaatagcaggaaaaatggaaaagatgccaatctccatctgaagcaagatctaagtgaactagtactttcttggggtagtagtaaattttgcatgcctttatgctaaacataaagggaaatgctgaacatagccatcattaaatcggacgtgatgg

SEQ ID NO: 65649 - DNA, 1404 bp, Oryza sativa
cccccatcccccctcctaccctcactccaaaccctaaccctctggagtcggggtgtcgctggcgccggagaagaaggggagcctgtcggagttggagagaagccgatgcacgaatcttggcatggatccaatggtctaaaatctgtaagatttcatccccaaatttcatttgaatgccatatagcaatcccgataacgaaaatctttgcgtaaatgtgttggagtaggtgacaccgtgacaacagctgagcggtggtgctgcttgggggtggcgactatagttagccaaacaagcggcacggcccaggcatggcatggcccgaccaacacaccgagccatgccgtgccggcccatgggctgcaccaccggcccaagcacggcccaccagcagtcgggctatgccaggtcggcccgaaggcacgggtggcccatcgtgccttttttaaaataattctatttttttctcccttctctttgggctgtgacatatatatatatatagctaaaataagtctattttccctcccttctctttgggctgacatatatatagcaaaaataagtctattttacatccctattctttggaccgtggcatataatatgtctatttttgctccctatgctttgtgtgttgggcttggcctgtcgacccatcgtgccgtgctggcccaacgtgccggtgggggggggccaggcatggcctagtggccaggcagggccggcatgggcccgacccccgtcgggccgggccatgcttgggtcgggccaaaatatcgtgccatggaccgggccgtcgggcttcgagccttatggctatctatagtggcgacggtcgcatggcgcggcgcggtaccccggtgtagacgacggtggcaaggaagcagcggggaggatgagatgaggagagtggaaacatgggacggaggacgggatgccgcaccggcgtggcctgagtcgttgaagtggcgatggactcgagcaggcagagggtggcggccagatctgggacatggatagggttcctagtgtatgtgacctaaggttttcacgaaacataggctatgtttagttccacgccaaaatggaagtttgactaaaattggaagtttgaagaaaaaagttgaagtttatgtgtgtaggaaagttttgatgtgatggaaaagttgaaagtttgaagaaaaagttgggaactaaactcggccaatgttacggaaaagttaaaagtttgtgtgtgtaggaaagttcgatgtgacggaaaagttttttcttcaaactttcaactttttcgtcacatcgttccaatttcttcaggcttccaatattagcgtggatctaagggtgtgtttagttcacgccaaatttggaagtttcgttgaaattggaacgatgtgatggaaaag

SEQ ID NO: 65650 - DNA, 1184 bp, Oryza sativa
ttcattattttccggcgagttcaaatattcggttttggttttatgttttttttccgcttccgtttctttgccgattaattgttcgctacgtgtgcatggttcatgtttgccttttatggcctttattaaaattagtttattaaattttctcaactatttgtttgttaacgagaactagcaagctgagccgaggcgagccatatatagtgaggccagttttcgttcaaaattgaatagtttagtttaaaaaatttatcaactagagtactttcgaatcgagccagtgataacacgtatttactaatagtgcttattttattcattaatgataattataatacgaattatacgaatagtgtttagggactggttggttcatttgcttattttgtgtgccaaacagcatatatcaccaatttagcaagctatagtttttcgacactcgacaaaaagctcgccacacttatggccaaaataaatcagcttgcaaattgagtctataagcaaatctaaaaacgctacaattgcagttataagccaaacgttttgccagaagaaccggagctgcctactttagacgtgataaagtttggcaataaactaaaacagtcccctagtctgcgtaccattctttgtttactaacaaaagcgtgctactttacccaccagttatataatttgttcactttgatccgattcctattttgcaacatgtacgggtgatatatatttcatatacacatcatcaggcacctataattaagctgcatgggtcttctctgttgtagtgagcacactttggtcataattttaaggactgtagcactgaaaaatagatttatttgaattttttaaacaacttgcacatataatttttttatgaaaatatataattttacagtttgaaaagtgtgctaatgaaaaatgagaaatttggagttcagagttgaaaaaaagaaccggcaaaacaacaaccccatatgcaacacgaggtcagtagggtcacaactcacaacctccctgtaatgtaatcccggggaagatttgtttcgattcaaacccatatagaaccatggatttaattgaatttaaactggatgaagaaaacaattattgaagtagtgttattacacatgtcacatgtgcgcgaatactgtattggcgtcgatctcgaggcgtactac

SEQ ID NO: 65651 - DNA, 1625 bp, Oryza sativa
aattttggtcatttatctgcttatgtaatgtttggtggactatgtgttgtggtcgctcttcggaaattggatggctgttcaaaatgcacagtgtggtgtctagcattgtttgtagctgagaaaaactactggtttaaaatatactatcgaatacttaccaaataaatagtacttatgaatcagagttataatcaaacataagttcatcaaagtaacaaaaaaagtttaattcagttttttatgttcatttcatcctatttctgttaaaacataataatatgttttaaaaattaattgagaagatgaggtttgtattttgtgttcactctgaggtgcgtagttatttaagtgataatgtgaagttcaatgttacgttaaagtaagcatacaattcttatactgagattatttattggtatcttgctttaaaaatattatattggcctcgtgtattcattttatctcaaataattgaattgtgcatgttttgttgttgaatttcttagggagctctaccgaatattcttaagaataccaaggaagaattctttaagaggataattgatttgcttacggaaacatcagatatttgctatagaggaataaaggatattaaatgcatcacttgtcctcacaagcccgaaggatccatgtttgtgatggtaagatttcctcttaaatcattttatcattagagctgtactagcatcaatttatcacactcaaaaaataattatgctatatttaatttagttggcacctaaaacacttaattcagagtcatgagaaatttttggtgtattgtgttgaagaataatgctataattaggaagttgtagtttgccatgttaacatcaattttcttttgttgctacaacatacttgtcacttaagcttcacttccagtaatcttacattgaaatcctataaacaggtgaaattgaacctatatcttttggagggaatccatgatgatgttgatttttgttgccaacttgcgaaagaagagtcggtgattctttgcccaggtacatctaacatttttgttaataaatggatatgtatgtgcctatttaattaaagaaagttaaaaatttaatattatattattcaattcacttgttatgttcttgtaattctctaacgctataccatgacatataagtgatgctaccttatttagtttctcacaaatctaatgattactttttggctaaacatttatgcttattaattaattttgttatgaaactttgaaaattattctatgattttgttgcttaaaaaaagttaatagttaattacttttagttttgcatctctaatcactaatagataatagtttagttagaatatttaaatatatgtggttatgagttttttattgattgcatgtaaactttttatatgtgatatatgaatatgacgacattattttatttctatatatgaaagaaaatttagcaaagtgatgcaatgatattcagacaggcacattatatccctacctgttgtttttgtcttatggatgaacaaatgaaagatcatctgctttttttataatatttgagaatacaaacggatattgactatctaaaagataaaagttgttttaaaatacaaga

SEQ ID NO: 65652 - DNA, 3299 bp, Oryza sativa
ttgatggcacacaaattaggaatttcggtactttgccattccacaaaattagcatcaattatttgacatcttgggccacatgcttggtctcacatgtctacatttcccaagtagtaaaatgtgccttcgtatttgcaaaacaggaggcactcatagtgcacgcgtgggagctatagtacactggtggagaaactgaaagggtcaattaggcctagagggggggtgaataggctaatttaaaacttaagaaatacggaagcagtaatttttggagctaggctgggaattttcggaacttccgaaaatgcacagagcagcgcacacaaaatgaaaactctagatctataagactataacagggaatacaaggcacaatcagcaactagaccaatagcggcacaagcaagcaaagctagaggagagggatgaagaaatatcaccaagatgtagctcccaaagttgttcccttgagttcaaatctttaaggggattctactctctgttgaggaactcactaagagccgggtcttagctaacccttttctcaagaggttgcactaagcactcctcctttcactaagaggtatctcttcccttgcggaggcgagatccggccttcacaaacttctcctggccaaccacaagtagatcggtggctcgggagtgacatctagccgtctaggagtcctcaacctccaagagtaaaagatgatgcaaagaactcccggagatgatgcaattgctcacaaatcttcacaaagaccacaagaagcacccacacaagctcgaatccacactctcacacacacaccaaatccaaatcaaacacgggtggagagatgaatcgaggaagcaaggctcaaatgaactagagagagagagagcaagccaagggcacaaataattggaatggaaccagcaaccctcacaagtgaggggaggtgggtatttatacccacagcacaaatctgcccgttagagtgcaataaaagggattttcggaacttccgaaacaattatcggaacttccgaaaattccagatctgagaaaaatcgaagtcaacgcaattttcggaacttccgaaaaaaattttcggaacttctgaaaatttccagaacgcttctgtgtattttcggaacttccgaaaatttccagagagctctcaaacggttctgtgtattttcggaacttctgaaaattattttcggaacttccgaaaatttccagaacgcccaaacgcggttctgtgtattttcggaacatccgaaaatttccagaacgctccaaaagagaaatgcttcgaagtaaaattgattttgagcacacgcatcactccttatatgtctatgcatcatccccttaatagtacggctttcctacgacacaatgcgaggaaaaagatacaatataccatttgatcattgccgcattgcatcgcgatgtcgcattcacgggatatgcattgtattacaacacgttgagaacttaacaaccttcacatttgcttgaataaaaatgttagtcctctctaatcgcatagtaatcaatcatcaaaatcattaggggcctagatgcattttcagaaaccatctttggtcggtcgaccagattttacaatagtccctgttatattaaaaatcgggactaaaaatatctttagtcccggtttaaaagctacatggtacttttcaatctttagtaccagttggtgttagcaaccgggactaaagatctatttgtagtcctggttgataacaccaaccgggaaaaaagatcgccatacgctttactcccggttggtgactaaagatctatttatagtcctggttggtaaaaccaaccgggagtaaagatcgacgctgagatcggagaggtgtgcacgatcggatcgaggtacctcctcctctcctctgaatgtgcagagatgtagcctagaggggggggggtgaataggctttcctgaaattttctcaacaatcgcagcggttaaattgacagggcccggaacctcctggtgatgaacaccggaacttccgggtaggatgagtagcccggaacttccgaagttcttgagccaggaacttccggacagcagagaaaaacgaaattaggggaagtataacaggtcctagctagagatgatcaggcacagagttgcacaagatgtaattctcaagataccagcagattcaaacacagatcatgcacaagggagacaaaggcgattttttcccgaagttcggatcacacagatcctactctccgatgaggtgctcaaagagccgggtctcgattaaccccttgcctcacttatgaaaagatctcagaagaagtccacagccttcaactcaacacttataggtcgttttctagaattgagtgaccaccaagatccaactcacaattccttctagaaaagaccacaagtgcaagttgctctacctaggataacctctgaaactcagcacaagaatctttactcacttacctcgtttccttgcggaggtgaggaaaatcttcacaaactttcccgggacatccacaagatctttggaagctcacgggcgacacctaaccgtctaggagaagatctccaagagtaataagcccaagtgacagcccacaaggtatccaaagtgctcaatcaaacctaatcttcaagccatctccaaaacactcctacactctaatctaatctctcaatctcacaagataggctctagattagagtggaggaagcaaaggaagcttgggagtggctagaaaaccctagaacatgaaagagctgaagtggaatggctaaagggtgacctggggacgaaatccatatatataacggctaggtgacgtcatctagccgttactcacaagattgaactagaaacctgccaggaggttccgggcaaaagtgcgaagaacttccgggtagcacttagaaaaaatctagctaaacttcggtgcctggaagttccggccagaacctccgggtagccctctctgtctcggggagaaaataaactttggtgtccggaggttccggccagaacctccgggtaggcctctctgtctcggggaaaatcatttccaaaaatgattccaaaaacctttagactcatggatatgactaagagcactttgtataccttggaaccacacttgaaacccctcttaatagtacggtttttcctaaactcaatttcgaaagtgaaaaacctagtctaatcaccttcgatgtttttgcacttaggaacattcaaattgggggggtctccttacattcatatccgtcacaacttgc

SEQ ID NO: 65653 - DNA, 910 bp, Oryza sativa
actgtgcagcggtgtcaacatcagtgggagcatcctcagcagctgcctcggcgtcatcctcctcctcatcatcatctgatcgggaagactcttcattgaaataggtggatggaccttcaccggcaacattgcgggctgcctcataagcctcaaaaggatccacatagacctcatctttacaatcatcttacacttctttcccagcctctcttctatcttccttctgacgccctttcgatcttcttcactttctttgcagtcttagcacacatacagaagatcgcctgaagtgccttcttgatgggagaagagctcgaggattgcggtggggcactagaagaaggaccagctgaggtagaagggatggatctaggtatcactggataagaggaaggtggaacacgaggatgaaaaggattgtggcgcccatctttgatgtagaacactccggtgactgtctcaatcatcttcataatgaaaggagcataaatgcaacctcgcttaggctcaagaatggtgttggcaatctcataccaaataaacttcatcacactgaaaggaggctgattgtagcgcatgcgactgagaagatgagcatgcttggatggcaaagcagtagcatctccaacctttggaagcagagaccaacgaaagatggagtacagcaccttgtagtttgaatgcaaaccatgagtagttcccatacaagtccgaggagcatccttagtatacatgaacttagtcttgatcatggggaggggtgcttcactatgaatattagggctattgagatcctcatcctctaagcccaatatcttagcaaactgtgctatggaaattttgtgcctaacaccctcagtcatccactttacataaggagttcccttcctagtagtaccaaacaatgctg

SEQ ID NO: 65654 - DNA, 733 bp, Oryza sativa
cccctggttatattttgagtatttctcgtcctagctgggccaatcttaaaccatgttgacaatgggctaatctcaaggcatgttgacgacggaacagttggtggaggagctagaatattgtttgaaatacatacgatatgtatgtatttcccctattatatgaaaccaaaggctttctgtcatcagtctacacctgtacggctgtacatgcacattttcggttgttgcggtgttgctgcctgaacgtctgcacgaagagcctgtcattttcaccgcgccctgcttacccggttaccgcaaataccagtccacagtttgcgcctggcatcttatcacatctgtatgcactagatatatttaccctgcatacggggccaacatttacgccggcactaaacagcagtggtaataacacatacggcaaatcgggcagtgatcaggcgatagttgatagccagccaaacactacatttgtcaaattagcacagatgtacaagcctagcaatcttcacacaattacaaactagcaaacgcaatcctaatcgcaaaccaaccatcgatcaatttacaccaagatacaatcgaatcagcaggaccaccaaatgccctaaacaatcaggcatctctcttgttaaatataacctacttggtagcatgctactctatgtactaataaacagtaaatgcacattgcaaactgaaacgcttccaccacatacttcacacagttcag

SEQ ID NO: 65655 - DNA, 4368 bp, Oryza sativa
taatttttccattgacaagcgctgtgcctcgtccttctctttttgggctgtaacggcctcggttcgagctacatcagacaactcggtagctctttttgcttccctttctgcagctttgtatctttcttctgcttcatcatatttcttgcattcagataagaacttctcttgaagatggttcttttcctgttcaagcattcttgcttgcttttcaaatgataccgccctgtctcttagaaattctaattttcctgttagttctcttatttcatccttcaaggctgcagtttccttgttatggctttgtgcctttgattccgctacctgaaaaaacatgtcagcattagaaaactagcactcatacaataaatgcatcaactaaatgaagtggttgaaaggtagtgatgaaggttaagtgacctgcaagcgctcagccaacacactttcttcactctctgcatgtctgatctttgcaactaatctcttcatttcttcttcctgtcaatattaagatgctatcagcatatataccgtcttactcaagcatatgaaacatgttgtgggtacggcctaccttttcctccagatgtgaagcaaactcagcccttataccactctctctttcatgggcaattttgttaatttgctcttgcacagatgctaatctctccaatgcagctttagcttgtgcagcagctgtttcatatttatccctccactctgtggcctcatcctgagcagccgctgcctgttcacgggctgctcccaactttccctctgcagagctatatctggactcaagagttgctagttgagaaatgaatccatcttgctcagccttttgctgagtaacatattgctcatacttcactctccaatcagtgcattcatggcgtacaagatcaagttctttagacaagctcaagcagcgctcatctagtgtgctacacttggtcctcaggtttgcaagatgagcactgtgatcttcagaaactcgttgtttttcacttatagcagcttcatatcgttttagatattccgatttatgggcctcatttgcttcaagttgcctttttagaagctcaagctgatcttcatttgaacgatatttcaatgcgaaggaagtcctctctgattcagcttcatttactaacttaaggcagagatccaatatgggtccttccaaactgcaagaaaaagatgtagtaacttttagatatgcttgctaagcaactagttgaccagttgaccaaaggatccatattcaaatgatggttaattaacaggcttgataacacacaatgaaaatccagaattacccatttaactttaacttgacaatagatttacaaaaagagaaggaatgaaaataattgatgtcatggattcctgaacaaattactacagctgtattgcactagatggacggtagtattaccacaattaattgactggaacacaattatattctacagtttgggtatggagcatctaatattgcaccactcaacacatgatctaacatgcaattgccattcgagatttcaaattcaacaacataacataactaccatgaaagttatcagttgttgggacagttgagacagcaggcaaatttctacaaacaacttgatcaagtcagcagaaactaaggtggctaaatatagaaaaataatattttgtatagtctcacttgaccaaaagataggtggcgtattgtagattctcatccagttcatctccagacaaaagcaaattcaaaatatctgtaagtgcaagcattaaaacaattaggtaggggcaggaacaaaccactgtcttaaaaaggctgcaagcattctccatttgcttgggccagaacaagaagtttcatattcagtgagcaaactttccaggacctgcaaaatgtaacgtggtctctgcttgagtgcatatacagagtgaaataacaccagagcagcttccatgaaagaatgtcacggtaggaaacaaaagcttccatcaaagctactgtttttactgacatcagtgtatttactgttttttatgaacataaaattattaaagcaatggtcaacggtgtgtattggacactgttaatgccataaaaacaccaggtgaaaaataacataaggagtatcgagaataaaataatagtagcaaattagcttaattggatcattgacagtcatacttaaaagtaagtatggccacaagcaaacatccatgtcattagctaaatgcctgtgcttttgcattggaatttaaacaagagaacccccactgtatgctctaaagccccaaaagtcataataaaaatattcccattgtactcaatactaattatttcacataatttttacatgcatgtcaatctacatagctgcttttaaatgtgtttgtacatctgtctatagaggagtccacctactcactatttaggggtatcacatggcagttgtgctgggtgatggcagatgtcattcaccatcaccattggagtcttttaaaggagcatagatgtcggtacatacctgaatcacattagaaactttgactccaggagcagaacacgctgctcggagtttcctctccataatttgtatcatgtttgagcactgcttatcggcttctaaaaaggcattccttttgtattcctaaacaaatgtaagtccatgaaaccaaatgagccacaggaataagaaccaaaggcatcagtaagccacaatgcaatatttgggaacatacgaagaatgacacacagaagaatctcaattaattttacaggcatatatcatatccttagctatttggtataaaatgaaggtaatctttcctttttttttggggggtgggggtgggggtgggggcagcatgatgcatccattataacataccctattatttgatattttatccaccacacaatgtttaatcaagaattcaagatagagatatatacactatacaaaataatctttagagggcttgagacttctacatgttggatcttatatcaataacaaatgtaacaatcatgtagtggatcgcagaaagctcttgcaagatactccctccatccacaaaagttacacctatttcacatttgggtttttccaaataagttgttcctatttgtagtctttatgcattcaagatttaaatgaagagataaattaaatgtttgattagaatccaaggagtcatctaaatactcattggttgcatgcttgcattcactcctccattttgtagcatccaagatgatttaatttttccttggtcttggtgacaaaagtaataggtgtaacttttgtggatggagggagtagctgctaattcttttctattttgggtcgttctgtttgccttgggtgaatggttgtgtgacaactttgctccgttcaatcttaaaacaatgatgcacaagtcttatgcacattgcctaaaaaataatcaatatcaaattgtgcactaactcaattgaaattctgtcacgctaaaggaatgttctcaactcacttcttgggtacgaaaagttgaatataccagcatataaatcaaaggctagtacatgatatcaattagaggaattaagcattagataggaataggatgaatagttgattgagcttaacaaaatgaaaacaagttgaagctttcttaacaaggtttaccacttgattactattaactatgttaatattaacatttaaggcaaacaaacatataaaagacaaaaaaacttactttctcaacatcatagtccatgatcaaataaaccagcggatattgttaagaaatgtttttatttacacctaacggtgctcttgttatttatgtgaatgactaagggtgtcattaacttcttgttcgatatgtatgattccacaacatcagattatgtttaacggcaataccagattcgatgtaataattagagtaaaactgcagatacctgaaatgtttttctgcagaagttgctaagaactttctcataatgcatacgggaagtgccagttccaacagcaacggtaccatatgcttcaagtgccttccttaaagcagcttcatgtgcatcccttaaagcatcctaaatgcagagttaaggcataatggaatttgtagcatgtgctatatactgaataaaccttttaacttacttcttcagcttgtttagtgcgatcaaaagctgaaagatagacctctgcagcagaatcgtatgctctacggcattctgcttcttcaacactctgcagtcaaatatcaaaggcatctaaactcaagatgatacaagtaggcaacgcagatctatattcatataattttaagtacgcattacaaaccacaccttactctttttatatt

SEQ ID NO: 65656 - DNA, 717 bp, Oryza sativa
ttactatcttacatatggtatttatccttcatgggcaacacttgtgaagagcatgaagctaccacaaggaaataagaggaaatattttaccaaagcacaagaagctgctaagaaggacattgaacaaccatttggagtgcttcaagctcactttgctattacccgtggaccccctcgtttttggaggagggggtgattgttggacccaatttttattttggtattcctaattcagatttttggggaatcaaatattgggtggttgatgggcatgctctaattgcccccaattaatttggaatttgggcatcggattgggggggatttggtcgggaaagaagctaggttttcgggagagagaggaggccggcggctggaggtcggggacgatcagcgtgtgggtcccacctaccagcgcacacgctgccgcgcgcgtgcatgcagcgcccgtgaggggcacgtgaggcacgcatgtgtcacgcctggaaattcccgaatagaatttcaagcagaatgtgaccggccagggtacacaaatgacaatgttgtcatcaatggttgcagtctatcagcaaaaactttacaaataatttttacaaagaaattcatgagggagatcagcctgaagtcattaggggattgaggactaggcttctttgggaccaaagttttgtaagaatatttgattgcagataagttaacggtacttccccagaa

SEQ ID NO: 65657 - DNA, 2546 bp, Oryza sativa
  unsure (1)..(2546): unsure at all n locations
catgctcgagagattaaaacttcaacagtcaacacagataattgccttgtacagttgataacttagtacaatattggaatattaagcgctcagtactctaattgatgtattgccaagaggattttcttacaatatggtttattgcatcatgtttctttgccatactggataaatataaaaatataagttagaatgaattcaaaccaacattaattctgtttttagtcagacaacatatacctgatgaaaaatgcaattggccatcacagtagatggaaccatggaagtaaaaggcttgagatgtttaagtaactaaaccctaccaattggcaacataagcaggaaaaaagaaatatgaatgaagcttagcattactgaggataattaagaatgtgtaactaactgacttacgccttgctccctgatccaagaggcccttcatcttttttccagctgactgtggtatcattacaacaggtattgtaacattaatggaagtatcgttgtcactgcaaaccatcttgtaaagttctgaaagaatgaagtttaacagataaatacgactatattaacaggatatatataataatatatttcatattaaccttttcataccttcattatcattgataactagtaaaccaactgcacctccagtctgtgcaatctttgctttagcagtgaaagcgcattctccacgttgtgctatagcaatataatttgttagctgcaaaagcgagaattagtttagaaaatatttacagcagtcattcaaagaaccaaacttgctaataagtttattatagttgatgttaaaatcaaacctttgatgtcgaattggaacaacaatcaagtggatttgcaaggacagcaaatgttttctgagcttcatgaatatctcgaggcacggaggctccaaatcttgcactcaacccaacaacaattgtaccttcagttccatttacccaattcttcaccttaacctggataaaatctcaaggatgagaacccttgtggaaaaacttaaggacccctttgaatcacaggaatggaaaaacagaggaatagaaaaaacacatgaatgaccgtttgattgaaccacaagaaaaacgtaggaatcagatgagagagttagactcaaaggattttttttccaagaggttggacctcttgctaactttcctccaaaatctctataggactacccattccataaaaaatttaaaggataggataggattcaatcctttacttcaaaggctttcataggatttttttttcccataggattggagtcctctaaaattcctacattttccgttcaaataaaaggggccctaaaagtataggtaattttctttgtaacttttattgcgcaccaacagggtacatgcaagtatatgagtctcatgcanaatgactaccatagacatcactagaaggaaaaagattgtttaactccgtcaacgattgttggttgtctgtctacttaaacccccaaaacaatgagatggcctaaatggcacccttgaactatccaagcctatcaaaattccattactagaaagagattggcatgtgcacttggtagccttatatgacagaacggcatcaacagtaaataagaactatattgttagtttttaaattcaatattttacttgggtctttgtttgcaaacaccaggaatagaactgagagcttgacccatggtgaaatttcacaagtacgctgtggaacatttaaatgaaaagggtgaaaggttaaagggtaagccctacacagttcaatccaccgggacaagataactactatggtgacaaaaattgttcaagaaaatatcttgttttatcttcttggttcatggttcacgactagtcatgtgaagatgtctatatgcagcagttgcccctgcttctgtgtaccacatgtagtcactgtgttgcctccagacaatgccactgcattactctgtaccaatgccacctgaagtgagaagtgaccatgcaactgaaaaatacattttagttgggataatcgatcatatgccactgttcagagattgcactctaggatttgccattctctggaggccaattgttttcttaccacttcttagttggtttaacacattgccacttttcaccgaaaatccgaaatacatcattttgcccccttttctttgctaagctaagcaccaggtggtgcatccgttatcctcttgcagtcttgctagacacaatgcatcatatgcttgtccggctcaaaccatcaagcagctgagcccatctcatctctctaatctacaaggcgattcagtggcagcaccatgtcaacgaagcaggaccgcctggaggaccagagcgaggacaagtacacaccactgcagcccagcccaacgcttgttatttctgtactgcctccttgtatccttcgccaccataaccgttgttgccatgggtcatgccactgtccgcctggtaacatgttctgttactatcttccttgcttcttgtaaaatctattcgtttttttctcatcatttg

SEQ ID NO: 65658 - DNA, 6628 bp, Oryza sativa
  unsure (1)..(6628): unsure at all n locations
ccctaccaccaccaaccaccaaaccttgaccaaaatcaggaagagaaaaacgggaacggattggggccgccggggggggggggtgtggggcgcgcgttaccagctggaacttgttggagcagccgggcgacggcgggacgcccgcgtcgtcgtcgctggaggcgtcgtcggccgcggagccgccggcgaggaggacgagcaggaggacggcggcggcggcggggaggcggcgggcgtggtgggtcgccatagggcgtcgccgcgtcgcgccgctcgcctttccgtggctcggacggcagtggcagagaggaatgaggagaacaccgacgcggtgggcccgggctggcagtggaacatggatgggggatgggatggggcggcgcccgggagagagtgatgtttcgtcaatccaatattcgtaaagatcggtttattagcgaaagaaaaatataatgtgtgcttatattggttttaaaataaaaatactgtacattaaactagtatgaaaaaaaataaaaattcgaatttgaaattaaaattttggtttataacataagcaaaaggttgtatgctttataactggtacccactaactgatgagggagttaggtcccgatcttccgataggtattgataaacagttaatttgggcggagttgcgatacaactcgatccggcttctgaacgaacacgctactgagccccgcaatcgcagcaccacgtctcctctggttatcaaccgtgccgaaacccggttgacctcgccgagaaggctaatccctgcatgcgaatcgaagaacacaagaaagaacaagatagattgcaaccaaattacatatgaatgattaagcactcggatttggggtttcacaaatcgatctagcggcgaaactgttcttgataaaataatttaagcaaaacccgactctaaacgatgacggctaatgaataaatatgattaaggacgtcctagggttgccctagggcgcacacccccttgggctaagcccacgacacagttacaaggcccaaaacgcaaatcagattcggactggatgagatacgtggcttgttttgcagtttcccggcagcttggtaggaattttgatgtgggaccaaatccatctgaaagtagactccataagctttccaacaagtactcatgggccccgaaattccttctagaacagcggctagatctatttgaagttgatgctgtcaggagacccgaatctaaattcaaaacgtgtataactttatctcttgtcttctatggaccaaaagtgacgtggtgagatgaaataagacttgaagaaggtcttggtttggttcccaatcaacttcttcaatcatctatgcattccttacgctcggtctcttttctttcgcccaagcaagtacctctgcaaacaaaaacacatgaaactcattgtgtagcaatgtttgttcaaatatataacaagtaaatctaatgtagaacatatgcacctttggttgattaatacataaggtagtcatggttatatccgagctagttgtgtcctcatcactaatgatgattaagcttagtatgtatattaaaacagctttgaaaggagacaccatattcgctgtggggactagaaattcccacattaatcgaagaaaaatagaaaaatctgaaccgttaaatcatgatgagcctgtattataacggtcgagattgattagatatctatagtaaaggaaactatctagagaaattaatcctactagactaggtaaaaaacaattgctactctacacaacaaaacaaaaatcatgttggaattatgtccaaccacccaatcagacaaggtctcactactactccatgtatttctttctatagcatacgttttccttaataatatatataatacacgtatacggacaccatggatacaatagtaacacaaggcctcatatgcatacacgtttatggataaatatatatatggtggactgagaatatatattattaatttagttgattgatgattgataaaagggcatcaaagttggaacgtacatgcggcctgttactgcctaccctagacagcaacaaaataattccgaaaataaaataaattttgaaaaacaaataaaataaatttagaaaaacagaaaaataattataggagttcaagtaagaaaataatttataaatagaaaatatcataatgaaaaattaagtaacatgcctgtaaaggagtagagtggtgatggttgatacgacgtataaaaactgttaataaaacaccaaatagaatcctaatgactattaaaaagagggaagacaggcaggccatgaagcaaacaggcaaggcggttgccgagacttctagaaagtaaaaaaaacatcgataataatattcgatttttaaaatctcaatgacaataaaaaggagaagcagcaggcggggtgtatagaagtatagttgcagagctgccgacggttggcgggacgtctagaaaataaaaaattgaattccaacaatagttatgttcgatttttagaatcccaatgacaataaagagtaggtggcagatgggccgtataggagtatagtggtattgtttgacgggacttctaaaaattataaaaaaagaaacccaacaagacaataaactctaaaaactaaaaggtccaatttttaaaggttcgaaacttctaaaaagtaaaaaaaaaaaccgatgataatcatatttgattttaaaatcttaatgacaataaagaagggaggcagcgggcatgccataaaggagtacaatggtaaagccgctgacggtttggcgggacttctagaaagtaaaaaagaacccgaacgataattatgttcgatttttaaaatcccaatgacaataaagagaaacgacagtggacgggccgtacagaagtataatggcagcgtttgacataacttctagaaattataaaaacaaaacccaacgagacaataaactctaaaactataagatctaatttttaaaggttctaaggagaatgaataatagtagtagatcgagcaaagcaaataaagaaggatatgacagaagtaagatatgacataagtaaggggtagtaactgatgtgacttttaaaaactatttaattagaaatatgaggatgataagatttggcctttcaaagtcttaggacaacaatatatctatttaataaattttaagtaaaattatactgaaaaatatatgattttgtttgggtgctagctgcgcaattacgcgggccacccaactagttgattataactaaagctacttttcccttgtaccacgctatcttaatttgcggaggacgcgcgttaatcttaattcaatcatagagaaatgcccaggggttttccggctagctccataaggtggtgggctagacgacctaggttcgaaatctcgccccttctaattatttgatattaggtcctttcctaatattcacttttttttatcttaattcaatcatatatattttaaacaagtcctggtaagtaacgggctagtttgattttataatttattgttgagcaagttattaccacaaatcactcaattatagtgataaatttaaaattataagaaataatctttaagaaaaaagtttttcaaagtgtggaattatctattttaataatccgatgaataagttgaaaagataggcccagctttgtataagtttcaagcttacttatacaacctcatgatagatggatgacgcaacctctctcaaaactactgtttttcaccgtatcttctatagcaaccgatggtatttaccgtagtatcttatatagctatggatgcgatgggtaagaagcaaagagtccgaaaaaccataatggcaaataacgtgggttgccatgaattactatgtaatctctatattttattttatattataagatattttgactttttcttgatcatatttataggaatacgtagcaatatctataacacaaactagtttcattatatctaaccgagtatattatactatatattttttttaaaatattgctatgttttctataaatttgattaaaattaaataaatttcacttaaaaataaatcaaaacgtctcattattataatatgaaatgaaatggaggggtagcatgtgttggttagttgttagataaacatgcttttctcagctaaacaggcttatattaccaccaactttgtagacaaggtgttatattcatccctggcacatttggaagcagatggtgtcatatttttttttacgaaacccaacatggtgtatttgtgttaagtagggggaaaactgtacaatagcctcaggctaggaggttacaaaaggagcaataaattgaaaggcgagaggagggggggggggggttgggggtacatgtcaagatggtgtcatgtttgaagaccatacagccacgatgactactttagacatctttttaaggtggatctccaaccactcctgtgtatagctgtgttcggatgccccctttcccaacccctcctattcgttttccgtgcgcacgcttttcaaaccgttaaacggtatattttttaaaaaagtttctatacgaaagttgcttaaaaaaatcaaattaatccatttttgaaattttttagcaaatacttaattaatcacgtgctaatggatcgctccgttttccgtgcacggtgtttgggttagagattgcctcctgcgaacacactaaaagacttaagagacatcaactcaagtgttgactttccttgtaatctaagggcccctttgaattgcagggttgaaaaaacggaggaataggaaaaatacaggattctgataggaattgaagtgtaaaacagataattgaaaaacacaagaatgatcgtttgattagtccacaggaaaaacacatgaatcgtgaaagagtcagtgagcaactggtggctatggcctaattgcatcatgcaaaagagctgcatgactagctgataaggaagtcagaaaaatgatggaaaatgatggattttaacgcaaagcaatcactcgatccatgggtagcgtacatggagtcgggcagttgcccgcgctggctgggcggtataactgccactgtacggaacggaagagtggatggtacgtgaaggatgaaggcgaaacttagcggctatgttaccggtaagaatactctcatagaagatgctggaagaccattccaaccgctcttacatgcactagtgatttatggagccatctgattgtactgtctgactaacgtttcaattcttcaaggatataattttgcaaaattacaattaatgtaattttgcatgaatatactgtggcgataaaacccagcctgattctgtagcaacacgtattatatttttactgaaacagtaactgtgacaaacactttatcgagtagcagggganaacattttctcgcatatccctattttattcatgaccttgggtcccaacaggtgccattgtttttgggagtaatttccttgacaccaaggaaaaaaatatctggtgagtacagcattaccggcgccatttccttgtggtcattactcattacccgttccagagaacaaactgaaaaaggaatacttacaagatttcaggattattatgattccggcctttccgtgaaaaataacagctgcatactttggacatgtcaatatggacagaattaagcacatttaacttgaaaatcttaacaaaaaaatcatagctatacttgtttcgtcttacatttttttgcattttttttcatatacaagtgtgacatgtctttggacttattatccaccattttggtctgtatagtagcatagggacaaccatataggttaggaaccacactatagtatataaaattaacatccaacaaaatgaaatacaatcacttaggagttaataggaggtagaggactcatatatttttaactactgctagaaaaatcgtcttgattctccaggaacagataaagggaaagcgaccacagaaaacatgcagcttaatcttgtacaacttgtgtaagcccatttgattcttcatgaacagatcaaggaaaactgataacataaaccataaccttaatcttatgcaacttgtataagcccaaaaaataattattttttcctacgtccatattctaaatccatgcaaagaaatgaaatcacctgaatctcagatcctccaataagatggcaaaatatatttcttaacagaataatgatcagtaaagaaagagaaaaaagctaaccttgagttgagatgtccaattggtatactgagtttagcccccagaaacacttcgaaattaccctatggcaaaaatcatcagtttctactttctaatgtcctccattcgcataccacccccgaactggaatgccaagaatataaaggaatcaactaagccatttgagatctggataaatgcactagtcaccattgcactcctctttcatgttgggtctcaccatgatccaccttaggtttccctccatggcacagctcattgccgcgttgagaataacatattttaattcaaagagcacaacacctgctgctgtgcagattttcaatggtggcggag

SEQ ID NO: 65659 - DNA, 5143 bp, Oryza sativa
  unsure (1)..(5143): unsure at all n locations
nnnnnnnnnnnnnnnnnnnnnnnnnnnnnnnnnnnnnnnnnnnnnnnnnatgtagtgtggcatggatgtttgtcaagatttcgattttgcctccataatagaagaaataaagactaaacatcagaagcactttggtgttgccttagtgagtataagagtggaaagagacatggcctttgaaatggaatcagtggatctaaacatcacagaacaaatattttgattttgtctctcgtgtgtttttccattattattcttcatttgcctcatctacctatgtgcttagtttaatctagttgatgatattgttattttctttgtatcttgtttcacacattttggtagctatatttgttgtttgtttgatctgcaagtggttagttcttgatttaccaccttgccattggacgttttgctataagatcacaactcttaatcttagaccaaatgttccggattcaaatcgaatgtttaggaacgccaatttgaccccttggtgatatcaaggtccttctaaagagtttttgaaattttattatcttttaacctttctaatataaattaaaaaatgaaccttcaatgaacttatatttaaaaaatgaaccttggggccacaaatgttgctaacactggtgtggcaaggtctttcccatgttgtgaggatttcttcgcataccaatgatttcatttttaaataatataagaaatttttgataaaatagaataatctttgaactaaagtaaatatcattagcagtaatacagattaaaaatcctcatcatgacgcgggttgaatttgtatcaacgatatgtaatcgtgaatcagaacgtaactccattcacaacaacctttggaaatatctatatataaattattcataaaattggatgtgcattgatgggttgttaccttaacagtagcaaatgtcaggttgtttccatatgctacggtgaatctgcaaattaattgaagttttagaaaagttattcctgaaagcagtttgtatactgaaaacttattagacaaccattttgattatgtaagccaaacaacagaactaatcaaacataattaaaactcaccctgcggactggccatccacatgccaagctctccagtcatctacaatgggatagttgagtgacctcacccaggtttgtgtaccaagaaatggcaaaacggtatcatggtcaccgctgcgcaccgaaatgttatttttttattaatgcagaaatatgataaagaaacagtttagaacactggagtgcattatgcccttttgccaaccggtctctctagtcatggtagaggacatgcatagctggctagctagctgcaatggtcatgcagataatttattagatagatatgtgcaaaatcattaatacactaagcatacagatctcaaagtgttccacgtaaagacataatggcagaatttatactactctggtctagtgaacatatcgattttgacattaacagtaccaaaatgcaactttgaccactgctttattttattgatccctactgttttattaagagaggcaaattatgctaattcaatggacacaagcttggttatttgaagacaatgatgagttcactactaatctgcagttttgaaaaaaattcaaaccacagtgtgtttgtattgtagtataattcctaagtggatggttcgaacttctcacaaaagagtgttctgaatagatcccgtaatatctataaaaaaaatcatgattcaaagcataatcgccgaatcatctctagttatattcctatactaatataaaaaggaggagttcatctgtagcaatcctacaggccaaatcacagattaattctctactatccatccgcatccgcacataccgactcccgcagcatcaaaacagcggcagaaaccacgccaccccctccgcctccgccctcctaatgatgaccccttgatcccgcttccatccttgcgaccccacttcctccccggcttcacctcccgagctcgagctctcacagaggaatagaggatgcagcggcgtcctcccccgagctccctcccggggccagcgtctcctccttccccatcgaacccggtgtcacctcatccatcgaacgccaggtccaagatgtcaaatcaggtcggttgaggttagaggccattggactcgctcggcacggatggggtggtccactactgctacggtgctacctcctgctggcattctccaccaacaaattccactctccttttcttccactgtctagattttctttgtattggtatgatcacttctaccttccattttactatttgattttaacttgaatgattagcagcaagttcttacctgattgcagattctcttgttttgtccagagctgtttgattgaatgccgctaaacccaagtcgtccctccaacttccgttttgggtgatttactcatggagtcacattcttttagttgtagtgtgttggaaaatttggtcataattcgccatattttaatccaaaatatttagacaataaacatgacatttgtaatttgagtagatctagtgacagtgctagatgtgtacaatatgagcatgcttaatatagaataagcatcaacatagataagagaacgcaataatgttggtgaagatgatgtagagcagtcgcgcttgaagcggtacccaaaaacttgatcgcccgccttcccgtgcaggttctcaagcggacggaatttcggaggcacctgctcgttccgatcacctctgcgcgcgggatgaacagaaccggggaaacagagagacagcgcaggaacagaaggagagtatcgccaaggaacaatagtaggaggaagacacacactttgagagcctctgccttgcgttatatgtagagagagagatctccattaccacacaaataaatctcatttgttgtgaaggttaccacaaaataaatctcatttgttgtgaaggttaccacataatgaatctcatttgttgtgaaggttaccacataatgaatctttcatttgttgtgaagattacaacaaataaatctctcatttgttgtggatgttacaacacaatgaatctctcatttgttgtggaggttacaacacaatgaatgtctcatttgttgtggaggttacaacacaatgaatttcatttgttaatggtgactttattctcgtctgttacaaaacggaagagcagcaggcaggctcagctcggtcggccacctcgcctcgctacgcccacggcccacggccgaggccgactcagcatgcgcgcatgcgtgtggcagtccaaccatcaccttaaccggtcaacagggaatctctaatatcaccctatttaagttgaggttcttccacctaaattttcaaggcagtattattctctctaacattacttgtgcgctcttgagattttaattgaattaaattgggcctagcccatttattctaacaatcccaaccaaatttcatggctcacaagaaatgttctcaaaattgaacctgttagatataccagtgtttcgatggagactgttaagttgaacttctacctaggaaaagagctacaccagatcacaactgaacaatggactatgccttgaattgtcagtcttgtgcgattcaggtttcactcaaacccttaactggtactaggctgtcgtttgcatcccctctgttttgagcgtataagtcatactcctggccttttcatgagtatctagagatcacccagatctcatagactgtgactagcagtcagactcatataggtgtgttccttctaaggtgttctataggccaacatctctgctttatgaaaagccactcggatcacattaaggtgtataccatcctaccatacagattagaagagaagtgcatcatgaagataggctcattttagggtctcttctctcagctacacaatagtttgtttcgccatccaaattcacgggatctccgatcacaatggacaggtttacactattgtgcaactgtaagtgggtctcaagcccatctccctcgatgcactgtctatcacattacgtcctagccccttggtaaactgatctgccagatttttagccgtctggacatagtccaatgctatcactccggagtttttctgctttctgacagacttcagtcttcttttaacatgcctggatgacttcatgttgtcctttgaactgttcactttaataatcattgtttgattatcacagttcatcaggattgctggtactggtttttcaaccaccgacaagtccatcaggagctcacgaagccattcggcctcaactgtggcaatatctaaagctgtgaattctgcttccattgttgaccttgttaagatggtctgcttgcaagacttccaggaaacagcgccccctccaagtgtgaacacatacccacttgtggcctttatctcatcagcatcagatatccaatttgaatcactatagccctccagcacttttgggtacctagcgtagtgaattccatagctcattgtcccttttagatagcgcattactctttcaagagcatgccaatgatcatctcccggatttgaaacaaactggctcaacttgctcacagcaaataagatgtcaggcctcgttgcactagctaagtacatcaatgaaccaacgatctaagagtatctcaattgatcccttgctattctttagtttttccttaatagcacactgggatcataaggagtaggagctgccttgcagtcactataaccaaagcgactcaagaccttgtccacatagtgagattgcacaagtgtaatcccaccctcatctcctctcagtagattaatgttaagaataacatcagccactcccaaatccttcatttcaaagcatttggacagaaagtccttgacctcctcaatcacattgaggctggtcccaaagatcaatatgtcatcgacatataaacacaagatcactccctctccctcaccatagcgatagtacacacattcgtcagcttcgttcacaacaaagccagcagatctaagtgtattgtcaaatttctcatgccattgcttaggcgcttgtttgagaccatacaaggacttcaatagcttgcacaccattcccttctga

SEQ ID NO: 65660 - DNA, 3317 bp, Oryza sativa
agatgaatatgcctctttaatggttcttggagtatcatccacaagatatacaatgtagtcatctccaaaagactttgcagtcctttgtctcttacaatgtagttatcctcctcaggattttcctcaagcgtttgatcaatatgttctatcggcacaaagtgctcaggggataaaataggttcttgactagaagtgctaggtgcatttttcataggaaattcattctcaaaaaatgtggcatctctggactcagtaattgtaccaacacacatgtcgggtactccagaatttactattaagaacctatatcccacactgtggatagcataaccaaggaacacacaatctacggtctttggtccaagtttacgctttttggctataggtacatttaccttggtcaaacagccccatgtgcgcaggtgagagagatttaatttcttcctttcccattcctcgaatggtgttacttccttatgcttagtaggaattctattcaggacatgacacgcagtcaatattgcctcaccccaccattccttggaaagtcctgcagtgtctaacatggcattcaccatctcagttagaatgcggttctttctttcggctaccccgtttgactggggtgaatagggaggcgtcatctcatgaataattccatactcttcgcagtattattctctctaacattacttgtgggctcttgagattttaattgaattaaattgggcctagcccatttattccaacatagtgtggtattattggaaccttttttataaaatgatcgcgtgtatatatagatggaaatataaaattttggaaccattctcacgattagttgcagtgcagccaactaatttggatcttacagtttcacaatcacattgttcaacctgcatacgcaggccggtttctgaattgctgatatattgttcaatagataaatacataacgtctcaatcatgatattttttggagaaggtgaacaactacaagtgactcagttttaacagattctagatgcagcatgctgtgagatcacgtttatataagagctaattatgtggaaccttctaattccttactctcaaaaagttcagaaattggatgtaacatctcggtgtgttcaaattagaaagcatgtttgttttcgagcaaaatcatacgagtgatgtcactcagaagaactgaatagctagacatgaaccatgaaatgagttcttttacatgcgtgctattttgctttgaatccttgatggagtcagacgatgaatctggacacatcatgagatagttacttcactatctaaatgacaaaatctgcatattgttctctggttgcagggtttgcttctttgtcaatcagtaatttacatggcgcactacaatcttatgtttccattctatgatatatatacatagtgcagatttatcagattgttcttcttttctttagatgtaaatacatgatgcttctgatttcaagaatgtgtcagactttcttcttttaaggaaaactgaagatgtgcacatttgaaaagcctgtaatattgttgatgtgttcctttttctacaatcgcatgtatttaatagttcgctggacaatctatttaggtggttacctttggtaattgtttcctctctttttatagcagggaagaagaatccttaccctaaggtgatttcacatcaagaacatgtaattagattgatggccactgtcatcaagaacaagaacaaggtgagaagatatccaaaaagtcaagaatttctgatattctgatgtgtcctaatcaggtacatgcacatggctctctcatgcttttgggttacttgataaaatgcttaacaattcgactttttatcattttcggttgaatcatgtgctcatagcaatggactaaaataattgagttttttttggttttagagtcaggccctttctcttccgtcaaatttataaggtattcttgaattttttcgatgaccttttggagaataatcaacttttggaagagaagaccaaaacgatatataagttctggggttactgatatatgtttttaatcattttcatctctattgtgttggtgttgtttatttgtagcttcactaaaaatatagtgtggcttctccggctatgtactccaggattttaagcatatcagttccttcactaaaattatattccaggtttgtgtatattttagatctatgtatatgttcttttagattgttcaggtactgctaaaaacttctgctaaaaatgtgttacaggtaccccaaatctcaccccttattatggcactgaatatcttgaactgaaattttgatgttacagtcattaagtataagatctcatctactataaagatttgtagtggccgcgtttaatgaaatcatgaggtaagtacatattcatgttttttagaaaactagagcttcacatagacacatacctaatttgctgtcattggtaagcatgttgttgttagaggattttactatgctctgataactctgaatgacataatcataagaatttccacttttttctgatcaaagtttcatatttgtgacgtacatgattccagtcatctgaaatctatatattattttccgagaaactgggcacaagagatatgccccatcacatctaaaggaggtagtcttgtcgagggaagatcctcgaaagcggggaatcgtgagacccccctcttgtgagttcagaagacagaggcttgttcttgaaaacactcgctcgtccctaagattactggcaagcttgcacgccgtcggattatacaggttcgggccgctatgaagcgtaataccctactcctgtgtttaggattatggtagagttttacagaggtttcttcactccagagagcacactcgctttctttcttctgaagctcaggttttctgggagtcgtcccccaatctcagtgggcagggtcctccttttatagctcaaggggataccacatgcgccgcctctacctaccctccataggagggggatcccactccactttttttgggcttcaaaccgtgccttctcccggaagctaagcaacaaacggttctcgagtggaaaccggcgccgccccccgcctgacacgggggacagccctgtcattctctcataaatgaacgatgacttgcgacaacccttcctcgagtgacgctcggatgtgacgggtcatacccacccccactccgccgggtacaggagcgacgtgaggacacgattgccctatccatcggacatgacggtgacaggccggtcacagaccggtcacatccga

SEQ ID NO: 65661 - DNA, 19273 bp, Oryza sativa
tatatatatatatgtgtttcaaatcagtgtattacttgagttcatttttttgagtggattattcagtgataatgtactgtgccactttttcctttcttcttttttttaaatcacggattgagcaattggattgtttttcaattattcactatcttactatgggtagaaaacgaaatttctatatgtttttttatcatttgttcttactaactatccttttctgtagtccggaaaattaggtcgcaggtaccaaggtaccattagtatggtcttcatttatgcaaacactaggtttcgtctcggattggtttgttttgagtacttggtttttttatggttgcccgtttgtgtccgctgcagatagaggggagttgaaggggaatggcggcccgctgcagggtagaggagagttagaggggaatggtggtgcaagtgaggcgaatggattgtgctgccattcaagattgactttagaagttctcttctttttttcatcttaccgattattcaagattgtgctgccatttgtttatcttttgagataacaccaaatgtctggtggttgcagattgtcatgtggatttcgaagcataatgattgttattctttagacagaatctatttctaacatttcatattgctaaaccatataagtttgattcatgaggtaaagtttgtaatatatgtgaagtaactatgccaccttacttatttacctcttggaagtagaattgcttccgcaaattgatgtcagatttgcaatataagaaaatagtatgtttgattataggcaatatatataaccaaaacgtgccttgcaaatgcatgattactagtaatccactagtgaaacaaatagaaaacacctcttctatgtcatatcccacatcatttacttttatctatgacagatttttttttcttctgaaaatcaactaatgtaagcttcagcaagtaacttggtgataatttttctttacctgtatactaaagcacgataaccatttaatgtaacattgtgatggtactgtatgctgctcttgatatctttggtgtacggtagatcgttatcgtggcatctaatccattcatccacgcttccctgaaatattagcatgtatagaattcgaagacaacttcatacattttgtatgtaaactgcaaacaagcgtgtattcatctctagaaaaatgaaggaaccacaaatttaccttcttgattccgagatactctcgtgtgacgttatcgttggcccaaaaatatgacaaatagttggaatagctctgcaataggaaagttcattttaattcaggtctaaattggtataagatagaaacataaaattaaacaagcgtctgttcctgtatcctttaggatataaaggatgccatatatattattttatatattttcagaaagtaatgtacttcctcgactatattatttctatactcactttacatagattataactagccattaccatatagttgaggtaagttctacttacaacacattgtattgaagggcgcggaggtcgatgctttagtattccaagctcctctttcaggatctttctgtccatgctctcaaattttgggatgagagacatataaatgcacttcttgtacaaaatgtggggctttgaaacttcatttagtagctgcagtgaaacattaggaatagcaatgcaatactcgtgttagctagctttccaccaaattccaatggaacagtagcccatattcccgtgaatttcaaggtagcacagaagaatcattgtgtgtgctcagaagataatataggaattttttttcgggaatcatcccatatttgttgcttatttcctatggatgttatatgtagtattcatttaatcgtaataagatgctataacaggatgttacgcctcaacacatacttgacctataaaaggatactagctactttttgaagttttaaatagcaataagttgattttaggcccctaaacatccaaagttaaaaccagatactattcatcgctcaaccttttaaacaattaattttatacaggttgtccttaacctattgtggttttagttgatgtggcacttacgtgttatgtggttagttcgaaaaataaaaaaattgcacacagctggtcaacatgtcattcactcttcccaaaaaaaaaaaatgtcattcactctgctttttcctccgttgctctttctcactctactgcaccagctcgagctcatcgaccacctagccggagctcacaatagaagcacatgtagtaatctactcaactccacggacaacaaaataatacttactacttatactagtacttcataacagaacagatcagatcaattacaaaatggagcacaaaaggcatcaatcagagaaacgaggaggcatatctggtcacttactacttcctactcgatctatttctatccatggccagtaggttgcaggcatccgggtacaaagagggcatggtggtgttgaacacaaggataaaaaaggtggaaaggtgaaaggtgaagagaaaccagagacagacgtttgaatgattttcgctaacgagatactacctccattctaaaatataataacctagaactagatgagacatttactagtagaagatacgttatactaggaaacgtcctatccagttataggtttttatattttgggacaaagaaagtactatataagcgccatctaaactgaaaccaccgtggttcaggattaggggtctagagtatatggtttgaaaatttgagggatgaatattgttcggttgtgaagttcactgatacatggctaagttttttccccagtttcccaactcacctccctcgtttttcacgtgcacgcttttcaaattgctaaacgttgtgttttttgcaaaaagtttttataagaaaattgcttaaaaaatcatattgatccatttttgagaaaaataagctaatgcttaattaatcacgtgctaatgaatcgctccgttttccgtgtgtaggagttggattcccaacccaaatcaacgaacacagcccagaagtctaaggacggataaatcgaaagtttagacttctgcctatccatttgtcgggtgatttctaacaaaaaaaaatctcccagatttttcatatctctagatttacatccaacggactacaaaaaaaaataacaaatacatatttacttacacattatttttatcaaaattacagtgcacttacatgtcatatcaactgaattaacaaatgtaattttagttatatataggactgtaattttatattttaaagaaaataacgaatacatatttacttacataatatttttaccaaaattacaatatacttgcatgtcatgtcaaataaatttacaaatgtaattttagttatataggactgtagttttatattttaaagaaacatagtacaattatagtttacattgtaacttacattaattctagtgtaacttgcatgtaacttttaaaacactgctgctcatacgaaatagacatcacgggagatctctgacccgtattaaggacgttttatcgttcaatcgctttcgttctatacagtggcaaagctagaaaaagatgcatacatacagtacttcacttggtcatcagtgcgccctgctgtctcttccgcacgaaccgtgggatgtgccttgccctaatcaggtgctaatcggacagttgaaaaaacgtcaaattttaaggaaaaaatttgacgatagatttatagcaaaactgttctttggtgaaagcctagggaccttaaaccaaaaggacgaattctagacgtttcccttgattcgaacagaaattcccatgcacgtaatttgaaccgggaaaaagaagtcaaaaggatgataaaaaatgaagttgtacttgtcaccttacatcgttaaacctagtcaaagcttgtttgcaaatcacgttcttggggttgttgtggtcctcccctttgcagcgttccattattgtcttaaggccggtgtaattaagaaatgtaaaaagtcagtctgaatgaaattggactgatgacataataaatgggaagcgtgtttagttaattaaaattacctcgtacaattgatctgaaatgattccgacaccatggagatatggcacctttgattcgtagtcgatcctttcgcctgtagttggattgtctactacatagccctgaataacactcaaaatgcaaagtaattagtacgagtacataatctgtcatgcatggatatagagaccggatattggtattggattcgactagttactgaataaaattggcgccagtatttagttcagttgctatctctaacaacagttcctacaattataaatggatatagctagccatatagacgaatggtcagtcctaattaaacttgtcaaagcttttaggtgaacttatttgtactattatatgatgaacaaacattattaatcaagaacgatggtaacgttttggactactgcccgtattataagatcgaccgtacatgaactacagttagatgcaagttgtacacgaggacgtatttcgataaggacgagagactgcaattttacttgttaattagccactgcgtattaaccatggtaatgattcttctgcgattaatcaatggcagacagatggctaaccttgagattaagagtcggtcttacccccgcttcaatatctgaaaaacagggaatcgttaaattgtgaagtagtcgtaattgctgcgaaacatgcaaaaccttctgagatcttctgcgcgataaatgggacgatctttccggcataagagtctcgcccgacgtagaacggattcgtgaggtactcaggatggccaccgaaccactgaaacaggcgatcagaggcgtttcttggaacaaaaatggtcgaaaaatacagccaattaattgcgtagaactagaacatgggcttacgttggagaggaatttcacgagctgcagtgacgcggagacgtcgccgacgtcgtaccccttgggatccctggagaaggagaagcctgcgccgaccggcgagtcgacgaagaggatgctggcgacctttgtccacgagtaagggtggtagtgcagccgcggaaggctgccgttgtagggctcgatgaccagcttcaatgggcctgcggggtaatcgcaacttacgcgatgaatttaccacatgatctgacactcttgggtgacaacggggcttgtttgctgttgggttgctgaccgatctcgaagaagagggcgctgagcacggagcagcggtcgccgccggtgagccagaggaggacggggtcgctgccggggtcgccctcagactcgaagaagtagtgaaaaagctctgccccgttctcctcgtcgacggtcacatatctgatcgatcgacgacaagactcacatcagcagcagcacgtacctggtcatggtcaagtagaacatgatggcgaagaacttttggcgtacgaaccccgtctcgaggcgggaagggagcgcgccgttgaagcctggtaggctggtgacatgcgtccgcgtcaatggcacttcggcggacacaccagagaataagctaaggaggaggaggaggaggaggaggaggaggagggacatcgtcggattcaaggacaggacagcacagcaccaccatgagcgatttctaaagaaatatctagatggaatagacggtagacttacatatataataagagataatctatgaaataccattgacaagcgtctaagtcccagaaacaccatggacaagtgtaagttccaagaaatatcatcgtactaacaattttattctaaaaataccatctctgttagggttccgtctattccgtgctgttgagttacaaaatcgtttctatgatggcatttctcgaaactcctatgtctcggacacggctaggcaccggtcgacgcgtggccaaggagctgctagatgggcccaggtcgatggtagctatgtgggtaagagaggtaagggtaggaacatgagtggaagatgttttccaacgattttcctgaattatttctctccctcactttagtaattcaattatttaatttctgtgcagaataatttatagtggatttttccggaggtagatgaaattatctagattctattttctttggttgtactaattatgtgtagtttgctgtcagacaaatagagaatatgggctcaccagaactttgtttgaattttaggaggtctaaatagaagaaataaactctagaaaaattatatttgctcttgataattaacctagtatgtgaataaattatttcactcatacacttctatgcagtttaatgcacatttttgtgagttatgtttttagcagattaaagttaaattttacatcctatagttgactgctttgactgaattatttgagctaagaaatttaaatattaatttgagtaaaaattatagtgagctgattatattgatttgtgctttcatgaattttctcatgattttgtcttgcatggattgttcttgataattagcaagacctttctttatatgtgtgtttccaatgcataaatgcatctaaattttataagaattatatttggatttctcttgacctgacatgttattacttaactccattttcatgtctttaaagttatacctcaagaatgactttaggtttgcttagtgaagttagcttttaatcatgttcatcagacctattatgccatgccaaccaaaaatacaaatgcacaagaaaaaagactcaagttaaactatgtcctatgcaagtatgcataattacacatatggttgcacttttttttaatctcaggttagaaatgaaaaaggttttaattttgctctcattttcctacatataaaggttggttttatcttcacctatgtttaaaatgaaaatttttgtctcacaaaaatataaaagtaatctttcaactatcttgacaagaaattttaaaggtctagagtttgggtacgttacattttggagccttttgtatgtaccaactgttattctaggggttggtatagggaaacaaaatatattttttgtttccaaaactgggggcagcaatagtgtattggttttccctttgagatatgtgttgtataagaccaagtttttttttcatctctctcatttaatacagcgccacataagttcgccacataagttaaaagtcttacgttgcaaccgaaagtattaaaggtagctgggaattcacccctccccagcaatttttgactagcgtggccccctgtaggtgctgatatacgtcagcgatttttaaatttataagtacataatggtttaatttattccataaataaattatgacattgcagatgtaaactagcatgaacgcatcattagatctacacatgtaaactaagcagtaaaacatgaacagatcaaatatgtgtaacacgttgaacacgtaccgagggtactgtgtgcgttgacgacagcatggagcacgcgaacgaacaggaagatgagccgtcgtggtcgaacagggaacagtcacgtgaagcgcttcccaaaaacattattgccgccttctcccgatgcaggacatcgaaggtagaggttccggagacttgctctcccgatcgccggtgcacgcctacgagcgggatggagtagactacgagcgacggcgcttgatcagggtgcccgcacgatgttgttgcgtggaggcaaaccctagattgattttgtgtcgttgcatggaggtggcggctcagtttatatagagaaaggtcgcttgatcagggcgtccacacgatgtccactccgtgtaaccgaaccggataaatcgcgcgtaacctatccggactccacgccattttcacgcaccggatttttcgaaatgtttccaaaacaaacaaatccgaatttcctacaacaaaacaaaactacaaaaggaggttgcatctgcgcaagggtgaggaaccaattttggtggaccaggcgaggcgagtgagcgcgcgggtgtgttcgcctcttctctccacctcacatgcttcaagtggctaggaaggcatcctcccttttaaggaggtccccctctcctagaataagcaaggtggtactaaactccccatgcataccatcacatgaggtgggcttttgtgattttccaaagaattaatcttcaagtggactaagacccatctgttaattccaacaatcccccaccaaatcttaaaatctcactgagattttccttttccaatgtactttttatagaccaacggttcgatggagaccgattaaggttgaacatccatctagaactccaagctacacttactcacaacttgaacaatggactatgccttgcattgcaagtcttgtgcaagcaaattttactcagagtcttatctgatactagaccgtctgtaaactacccctcatttggagcgtataagtcatactccttggtcttttagtaagcttcctagaagattcatccaaaatctccgtagactgcgaccaacagtcaagctcacaaaggtgagttctttcaagaatgctctgcaggacagcatcttcgcaaattaaagccaacaaaactcattaaggcatagccaacctgccttgcagctcacgagagtacatgcatcttcacttagagagggtttatattggtactctccttcagttaacttatggcttgttcttcccaggatccaattcacgggatctccgatcacatagactgggttaccacaatagtataactcacatgggtacgaaacaacaccaccacccagtgtgaagacctccacgaaacagcaccaaccttatgttcaatgatttgggaatattccaattgattcctagcaattctcttgttcttgcgaagcagcaagctaggatcataaagtgttggagaaggcttgctgtcaatgtagccaaagcgattcaagatcttctccacataatgggactgcaagagtgtaatcccattctcacccctacttttcctaatgtttagtataacatcagctactcccaacttcttcatatcgaaactttgagacagaatgatttaacctcatttatcacctcagtatttgtctcaaatattagtatgtcatcaacatacaagcacagaataactccctcacccctaccatagcgatagtatacacatttatttgcctcattgacttggaggcttgcaaatgtaaatgttctatcaaatttctcatgctattgcttagtagtttgtttcagaccatacaaagatctcatcaatttgcacaccttgccttcttgaccttcaattgcaaacccatcaggttgatccatatagatctccctccagctctccattgaggaaagttgtcttaacgtccatttgataaacgacaagaccatgtgaggcttagggaaagtagtacgcgaattgtggtcaatctagcaataagtgagtaagtgtcaaagaaatcttcgccttctttctgagtatagcccttttcaacaagctgagccttgtacttttcaatagtaccgtcaggcgtaaacttcttcttgaacacccaattgcaccccataggtctacacccatagggtcgctctgttacctcccaagtcccgttagcgataatggaatccatttcactacggacaacctccttccagtagtctgcatcaggagatgcatatgcttctgaaattgactgcggagtgtcattcacgaggtacacagtgaaatcatcaccaaaagacttagccatcctttatctctcactcctccgacgagcttcactgccatcctccttaatgacatgttcatgtgtatgttcattttgttctggtggtgtgattgaactgggaattatttcagagggttggctagaagtactatgtgtatccttcattggaaaaaaaagctctcaaagaaggtagcgtcacgagacaccataactgtaccaacatgcataaaatgtacctcagatttaactattaaaaatctataggcagtactgtgatgagcatatcccaggaagacactgtccacagtcttaggtctaagtttgcgcttcttcgttattggtacattgactttcgccaagcacccccgtgtgcacaagtaagaaagtgatggttttctcccaatccatatctcgtctggtgttttgttcttgtttctgttaggaactctgtttaacacatgattcgacgtcaacaatgcctccctccaccatgccttaagtagttccgcggtatgcaacatggcattcaccaagtcaatcagtgtgcggttcttcctttcggcaatcccattagactcgggaaaatagggatgcgtcctcttatgtatgatgccatgttcctcatagaataagtcaaactcgtttaagaacaactctccaccacgatcagacctaaatctttttatctctctgtcaagttgattttcaacttctgccttataaattttaaaatagtctagaccctcgtctttcattttcaacatatacacatagcaaaatctagtagcatcatcaatcaacgtcatgaaatatcattttccacccttcgtcaacaccccattcatttcatagcgatctgaatgtaggagttttagaggtgccaagtttctctcctcggcagccttgtgacgcttgcgaggttgctttcattgcacacaactatggcacttagaacctttgacaatggaaaacttagaaattaaacacatgttggaaaggcgagacatcaagcgaaaattaatatgacataaacgtgagtgccaaacattagcctcatcatccacactgccgacttattgcagaaatcagaaagggaaaagcggaacaggcctccacactcataacctttaccaataaaatatccatgtttagacacaactactttattacactcaaaaactaacttaaatccgtctctagttagacgggagccactaacaagattactatcgattgtagggacatgctgcacgttcttcaactgcacgatatttccccaagtaaacttcagatctaccgtgcaaacaccatgaacaacaaaacttcatatctacccattccccattaggacggtggaatcccgtgctacctgataagaagaaaacaacgaaacatcagcacaaatatatacattggcccatgtatcaacccaccaattagtagactgattagctgaaaaaatagtaggtaaattaccatacccgcttccttttccagtgttaccaatggttacattagcaaacttggaagtctgccctacaggtgccttcatccccttgcgttgtggacacttcttggccagatgactagtcaaaccacacacaaagcaagttcactcatcgtggttcggattgctgtatgtatcttcttctgcttcttgaagttggtggtctgttgagctttatatttccccttattcttgttctgggccttgtgcataatattggcactagactgtccaccatcgcccttagacgcggtatctttttctcgagctttctcctcaacatcaagagacgctatcaaccactaaatggcgtattcctatctcttgtgtttgagtgcagtaccaaaacctctctaagatggaggtagtttcgcaataatgcatccggccacaaaattatcgggtaagacacatgtaaggagttcgagttccttagccatggtctgtatttcatgagccatcctgtagtcattaaactgctccatgacgtacagatcattgctaacatcagtagcaccgaatttggtattcagtgcatcccataactccttagcgtcggtcatatgcatatacacgtcgactagacgatcgccaagaacgttaagaatgcatcccacaaagagagtagtggcctcatcgaattctttctgctggtcagcagtaagaactcccatagttttgccagtactcagccagaagcatttcatagctatcagccacagagtgaccctgatctgccatctcttaaagtgcacaccggtgaatttatccggcttcagtgcatcggcaaaaccaatcatagtaaaaccacagtgcctataataaggtttttggattgttgaatttataagcacataatgatttaatttattccataaataaatcatgacattgaagatgtaaactagcatgaacgtatcattagatctacacatgtaaactaagcaggataacatgaacaaatcaaatatgcacagtatgttgagcacgtaccgagggtagtggaagaccggttgctcagcagttgcaggcgttgacaacgacgcacagcacgcgagcgaacaggaagacgagccgtcgtggtcgaacaaggagcagtcgcacggagcacttcccaaaaaccttattgccgccttcccccggtgtaggacgctgaaggcacaggttctggagacctactctcccgatcaccagtgcacgctgacgagtgggatggagtagactacgagcgacggcgcagtatagtggaggaggcaaaccctagattgatttcgtatcgttgcgtggaggtggcggctcggtttatatagagaaaggtcgcttgatcagggcgctcgtacgatgtccactccacgtaaccgaactggataagtcgcgcgtaacctatccggactccacgccgttttctcgcactagatttttcggaatgtttccaaaacaaacaaatccagatttcccgcagcaaaacaaaactgcagaaggaagctgcatctacgcaagggtgaggaaccaactttggcggaccattcgatgcgtacgtcgtgcagacgcgctgccatgccatgccgagcgagcgagcacgcgcgcgtgttccccctcttctctccacctcacatgcttcaagttgctagtagggcatccacccttttaaggaggtccccctctcctagaataagaaaggtggtactaaactcccatgcataccatcccatgaggtgggcttttgtgattttccaaagaattaatcttcgagagggctaaggcccatctattaattgcaacaacaagatgctggaagcctagtggttttcactagctcttgtgcgtccgcgtcgacatttgatgttttgcaaaaacaaaaaccttgatttctttgttaatttttttagatctctggtacttagtttctactttctgcattattatctagatgctctctataaaccgtaatattctacgtaacgaagcgaaatagaacggaaaatgggactgccctatgaaaaacagaagttaagggtgttttatggaaaaatttacacatattacctaatccccatgtcctggttccgtcccccaaaccctagccgccatctgcctctcccctttacctctctccttatgggttgcggcagcatacctcctccctctcgtctctctgttccgctcgaacctccctggctccacttctacacgcctctcatgtctaatagtcaaatctggcgagctcacaagataagggagctggagcgtgaagcggaaacagccctagtgttatcctatcttactataaagtaataacccactaatcctaagctcaacatgtaaacatgccacctcatcatccactagcaatgattatatgcaaaacttatgcaagcatgcaacatcatttataattgaattatgcaaatcaacatccaatcatcttccttcacattattcttcacaatatttttaacacatatatatcgttcacattatttatttctctttgaacatagtttgacaaaccaattttatttgttgttaataattaatacaattttacttttaacttgattattaaataaatattaaaagttacaggtagcgctattctgcgctctacagcgtggaatattagttcgagcgccgcacgacgccctctccttccggttttcccttttttttaccaccccacctttcctccgcatcccaccttttctcggtttgttttattcttttttaccactctaccttccgtgtttctttttttcacttttccatctcatccgtgcttcatcatgggcccagttaaatattaaccatccagatttttttgtttttttgttccctctatgtagtttttctattttcgtgttttagtaaactatttaccgtctagtttttctttctgagttttcgtttttctagtgtctctgcacgtttcaaaagtaacgaatttactccgtgaagtttttcatttagtcccagcctcccacatctgctcaatcaaaagtaacaaattgacttgcatgaatgcctccacatcatatgacgccaatgcctccacatcgtatgacgccatacctagatggtcttaaaagaattactacaacttacaacgctagttattcttttaccaatattataaatattgtttagatttcgtggtctgtgagtaaagcaattactaccttcctctcgatatagcccatgatctcatagtcactgtgtagtaatatgtttactgatgtgctcattacacagtataagagtaaaaactgagatttcgtggtttgcaagtaaaacaattaccaccttcctctcgatatagccatgatctcatagccaccatgtagtaatatgtttactgatgtgttcaatatatagtataagagtaaaaactgatactaagagtattgttgatctgtatcacaaaatagtcgtatgaaaacaacggaaattacttactttaatgctagctacacactaaagtaaatcactgtattttagttgattatagtgtatgatgatcccgtactctgaataggaactaaccaagagataattctaaccgagaaaaactaaattactcaaaagataattctattataatcaaagtaattaacagagcagaaagaaacagggagcggattacgataactccgcaattcctccgacttcttctactctactctcttcctattctagtatacaacatagtacaatagagcctcttataattcagctcaagctttgtcacacccagaaattcttgaaccagaatttctaagctgaatgtgcattaaatccctgtccaggaccagccagggtacacaaacgacaattgttgacatacagacccacgtcttacaaaaatataaaagattacaaatgcagcgggaaagattaaagcgagctaaaccgggaagcttgacttcagcagcgggcgactccactccacaggcaaaccttgacggcagcaacgaaaccaacctctctgagacggctccaactgagaagaacttcaactctggtgtgggggaaaagagagcaagactgagtactacccactgtactcagcaagtcataccggaagaggaggtatgatgcaggatataaccaaaggaagctaggggttcttttgcataaagcaggcatttcaaagcagtagttgaaagcagtaaaacagctgtagtaattaatcaatattaaccaatcactgtccaacgctacaccacgttgcaacaggcccaaccaaccacctaaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccctacccctcaaaaggcagtgggcggtcccctcttgcgccgcggtgaatccggcagctggacaaccgaacacctcggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgactagcaaaaccatgcactcacagcccgccattcagaatattttaattaactgacacccttgcggtggcaccaatctaaagctatgccaatagacaaagtctatgtaataatgtgatccccatttgtgtactagttgaactaagcatggctaagcatttcctaagccaacatctagtcattttgatacccaagttatcaatggcatcaggtaaccaatatgtggctgaggaataggacccatcccacattacattgtaaaagaatgcaacatttaatagaaatgcgggatatttgtaaattgggtacaatatgatcaaacgtattgcatgacttgccttgctctcgaactgatgagacctcagcaacgtcttcgagaaaccgcggatcgacgaaacggccaaaacctatgcgacaaacaaagcacacaagcaaaacatgctataagactacagaaacaggaaacaaaaccatttttaatggattctttgcatttttcttgatttactgagacttgaatggacttaaacggagctcggatgaattacttaagaattttagaagataaactgtgtttttactaataaagaaaaagccttaatcattttattgcgcaataaagcccagggctgacgtcagtgaaagggggggcgccggcacgtgggccccacgggtcagcggctccaaagggagggaggtggcgcctggcaggtgggccccaccaggcggtggctcaaaggggaggcgagggaggcgccggccgggctcggctctgcctaagggccgaccggccgaccaaggcgaggcggcggcgaggcacggccaccgacggcggtgaccggcggtgcgggaagcggcggcgacggccgaaaggcagcggcgcatggccggagcagcggcgtggccggcgctcgcgggaaggtgaggaaaggagggggagggaggactcaccggcgacacggcggccggagcggaagacgaaggcggcgacgacgacccgacgagaggaggggcggacgagcggcggcgacacctagaggaggggaggagaggagttagggatggagaaggcgaccgcgacgaccaaagtggctggccggagacggaggggaatggatagctcaccggctcgcgaggagatgcggttccggtggggttccggcgacgcgaggcggtggccaagatggcccacacggcggcggagctagccgcggcggcggcttggcgcggcggcggccctagtggcgacggcacgcggccggagatgggcggcagcggcggagctcggcgagcgcggcgcgacggcggtagagggcgtgggagaggacggtgaatgggggaaatgagagagagagctcgagtgagggtttttatggcgagggaggggcggaaacggccggggatggcccctatttggccggcgacgtggagaggtggaggagagaaagagggtgttgggggatttcaaatcccccaccacttgcgggtgcgcgcgcgcgggggagatgcgggggagagggcggcgacgtgggcgcgaggtgcgggcgcggagtggaggcgcgacgtgcagcggagaaggcggcggcgcgggcggttggagctccggctccaacgaccagaggtaagggacgaccgacaggtgggccccacctgtcggcacccgaaagagaaagggagggagggaggacttcggggaggggaaaggaggagcgggccggcccaggaaaggggtgccgagcgcggggagagagatgggccgatggcccatctagagaaaaaggaaggaaaagaaaagaaaaagaggagaaggattttcctgggattagatattgcactttggtgatttttaattggttaaaattatttccaaggctctgaaaattccactaaaaatcttgttaatgcattggagcatggggaactcaagaaaaattccaccacgctatttccgattattaattgcatttattaattatggaattagctctaggttaattaagataatttcttcggacgatttatttaacaaatatttaaagcaaggaaaaagggggaaacttctgggcgtgacaagcttgcagtgtgtgagtgaagtgaagaggtgaagtccttatataagggtaggtatgacggttagaaaacacaaaatgtcctttttgcccttcaaccgctatcaggagttcatccagattgtccatgccaaaacctagatcgaacggccgttggagtggttcggcagaacccatgaccgttcatgccaaaaccttgatcgaactgccgtgggagtggttcggccgaacccaggccaggtccaacaggcccaagttttggcatgttgtctctcctcctcctccactatccatatctacgagtggaaggcccaattgaatatgttttctgatagtttctggcccactcttgatatggatgggaattctccttcacttaagtctatatttcatccatctttggcggtttattacctgcatataaatatacactaacactttgtggaatatgttagaatttaacgctatcactatattggatgttctatttctttgatttatgcaggtattggtggcataaaatttgtcattaacagcgccaacaagcagctaattaccagttatttgcggtgctctatagttgatacacgtttttgcggtgttctctagccaattacaaattttctggatatcctgtaacatattttgcctcagtgcaacatgctagtccttccatggtctttctaccggttgtcttatggtttggtagggggggacgtatttgggccttcgaaccgtggtgtagtagtagctacagttgaacaacaatatgtctgtttacaccgaaatttggcacctatgcacgaaataggggaaaattgccaaagtttggaaagtgtcgggtttccttcacggggccggtcagaccgtaggtatgtgggcggtctgaccgtggcttgaactccagtctgaccgcaggtatgggtccggtcagaccgtcagattccgagtctgagtatgttttcgtcgggtctcgggttttcttgcttgggaaggcatattttggatttcctttggtttctataccaagttggacatggaggagagcctgtagagggcaagaccaacccctatttaagggacaaggccggttcaattgtaatctcccatacacacaatatacttgaatcgctttttcttttatctttactttttagctatgttttctattttaccctagttttagtccat

SEQ ID NO: 65662 - DNA, 1557 bp, Oryza sativa
taggctataggatggatatatgtaaaatattgtacaaataatgaatgttaaaatgttatgaaaatgatacgggggagaagatgaagtgtttagattttgataattacccgtggataagaggtggcatagatataacaagcaaaacccaaaaatgtctacttaattcaataaattggcccaaacgtcacaaccagctgcagcaactttatcggcgaaaacatgataaatggaggtatatacgtgggccacccatttttgtctgaacatgagtgttttgtaggattatatatcacaggatgacgcatctataccaatcaactactatagttaacagaaagctacgttaatcaaaacaaacggttacatagtcctgacacaccagtacttaaatcttaaaattcactaatttgagaactaaacatgaatgatatttacttgggtctacctatatagaatttgaccgaaaactagggtccaaatcttggaagaaaaaaaaattcatccatgggatcacaatcccctaattttctgtctaatgttaattagtttatttataaccaccggtgcatatatttgctccaaggggaaaaagtgtttgtcctgtttcagctatccaggttggacacttgtgtatgtatttgtttgaagaaacttaaaaaaatgacatgttatttaggcttaagcaattaatgagttaattgtgacagaattatcagggaaatttcttttttttcctgctagcaattgtcatcataattcaactcatacaatcgcgaaaaaacggaagtgtacttgtctccttacactgtcaagcttggccaaagcttgtttgcaaatcaacttcaattcgcagtctccattgtcattttcagacaaatcacatacatatgcatttccaagcagagttaatcaagcccgagcaggaatcattcgacataattaaaattttgcgagcagcgtgtttaagtgcttacctcatatagctgatctgaattgattccgactccatggcagtacggcacttttgatgcgtagacaatgccttcgccagtaagcggcggattacctatcagatagccctgaccatctcccaaattgcaaattaattaatggccacgagcccatagtaaactatatcttgatatgggtaaggatacctgttcttctttatgtttgatcgacaacctatagcaatctagttatctctaacaccacttatttattatttaattaaatcatcgcgtgtaaaacacctgaatgtatctatagaaaaaaagaaaaatatggacatgtgaactaacttcagattaagcgtcgatctgaccccatcttcaatatctgcaaacagagtgcagactgtacccatgaaacatagccaaacaacacgtttctatgcgtcgacatgccacaacaacatatcaaaaaagggacaggacccttcacacaactccctttaatcaagcttaccacgttgaggtttcacccctgttgacggtcgataagtaccaatttcgactgtcaactatcataataaataaaaggataactaatatttct

SEQ ID NO: 65663 - DNA, 9299 bp, Oryza sativa
taaacaaagaaacagaatagatgatattacaggagtaaactttcaattggtattctggtaaataacatacttgggaaagcaggtgctgtcagacaacaaaaaacagctaccactgaatcagcaaagtagaatccaagaatatgtcacgccggaatatagaccactatattccgtttgtgagtgcattattccttgtcccagaggtaaggtacacataacaaattggtaaggttaaggcttctgcaaagacctacctcacatatatcacccagattgatgaataaccagaacagagcacatgcgcatgctgctaagaatgcaaataaaggattgggctgtgctaggggaggtgtcaaggtaccactgtccgcacaggtccaaactcctctaaaagctatgctaattcttgtgctggaaaataatcggacattcatcattttatttacttttaaatccccactagctccacatcaataagcatatggtccctgggaacagtaccagccattctcataatgcgatgaatatcctgcagcagatcattgatcaagtcagattcactgtgggatttatcacgggaaacaaatacatgaaccttatttgccacctcgatccaactacaccctggctgtttctttagccctcgaacattcatctctgacctaatttctgctgcttctttccatttaccagctgaagcataaatgttacacaagagagtataagttccagcattatcaggttctgcttccaagagatgtttagccgctaaatcaccaatactttcatttccatgtgaattgcatccacctagaagggcactccaaacggtacttgatgtaggtttaatcttgaaccagctaattaatcttttagcatcctcaagccgtccagctcggctacaaagatcaaccaagcaagtgtaatgttcatcacgcactacaatggagttatcctttaccatggattcaaagatcttaagcccttcatccactaaaccggcgtggctacatgctgagagcaatcccacataggtagcatcattaggcttataaccattttcttgcatatttttgtacaaatgcattgcttctatgccaaacccatgatgtgcatatgctgcgattatcccattccatgagattaagtccttctccattgagaaatcaaacacatttcttgccagcctaatttcaccacacttggcatataagttcattagagtggattccacaaaagtatcaaactgagatggtgttttgcatatcatctgatgaacctgctgcccttcacagagtgcagcaaggttgctgcacgcatcaagagaacctagaaatgtcacttgatttggttggattccttgaacaagcatacagttaaataattttagtgccatttcactctgcatgcattgtaagtaaccattcatcatggtggtccaagtgatcacattccttttaggcatctcatcaaaaagttgccgtgcactcttcaagtctttgttctggataaagccagtgatcataatgttccaagaagcaacatccctaataggcatcttcgtgaacaaatcaagtgcttcctcaatcctgtggtttcgtgcatacccagagatcatggcattccaagaaacaacattcctctctggcatggcatcaaacagaacccaagcgtcgtcaacgcttccattccgtgcaaggccagaaatcattgtggtccatgacatgacatccctcactggcattctctcaaacatcttacgagccctctccaaactccctgaccgcacaagtccacacagaagaatgttccaagagccagcatccctcaccggcatgcgattgaaaagggcagacgcatcctcgacgcggccaactgcggtatacgcctccagcatcgtgttccaagagacgacgttcctctccgccatgccctcgaagagggcctcggcctcgtcaacgcggcgtgcgcgcgcgtagccggagagcagcgccgtccaggtgaccacgttccggcgcgcatcagggcggtcgaacagcacccgcgcctcctggagcatgccccggcgcgcgtacgcggcgaccatcgccgtccacgacaccacgtcccggtcgggcattccgtcgaacagcctgcgggcgtccgagactcgcccggccgcggccagctccgcgacgcgccagttcgagtcctgcacatggttgaccccagcggatgcggccggggcggcattgttgctgatgcaattgaccgtggcggcaaggcagagccgcggcgagcggagacggcgcagcgcgggcgcagccaaagctgccattagagaaccaggagattctgcaagtctgcaacctgagagctcctgattgagtcctgaatccttataccctgcgcggctgtgccctgcggtgctcgtcgccgctaggggcgcgcttagaatttttaggttgggtattcaaaatgggaagggataaaaaaaaaaaaaacaacacctccccgcgatggcgattggcggcgcggccgcggtgtttcagcggggcgaagttgggaccaggaggtggtctagggtgacttaattttggggccttcttggctactgggcctgcataatgaggagaggaggccaggctttcttattgggcttttctttcgattaataggcctcttttctatatttttcatattcatatgagacatatatctcatacaaatatatttttttttcaaaaatcttagatattcacctgaatacccttaaattgagctgcgcccgcagcaacgggcatgcccgcggggatgtgcgacaaggagtgcggaggctatgaaacacgagagcgagggcggcgcgtcgtcctttggagtgatttgggtggagttgtttggagcactggaaacctgggctgagaactagaggggctagtagttattagtaattatctactattaagcttgttcacgcttaagaaaattcttggatccgcggactgacggtgtgaggctgataaggtgaagatccctggcgctgtcatgtcgcagctcgagtggttgaaccacgcgcaggaggaggaaggcgtggcagtgttattttaccatgtcattttggctgacgtggtagtattgtcttaccatgtcatttgtactagtgtgacaagataaaactggcacgataaaaccgtgacatgaattactaatgacgtgacaatgttgttcgccacacatcaggcggagtgaaatagaaaaaaaatgtttagatctaaaaataaaaataagtattgagatgatcgatttttaaaattaaaagtttaaaaaagttagtgggtttgttggcttggatatgggccctgctgaagggtagtaggtagagttgggccttcaaatgagaaaccagaactgctagaggtgtttttgttagagtatattgttgaaaatttggtcataattcggtatattttaatccaaaatattatgacaataaatatggcatacacaatgagaaacgatctggtgatgagatgtttaaggtaaaataagtatagacatcgttgatattcacataggattgaaatcctatggataacattgtgaacatgtaaataataagaagaaaatcaaataaagttacaatcttatacccagagaacggtgcagaagatgttgaggaattcgtattgcctctgttgatgttgtctcctttgttctctccagtagaagctatggtgaagcagaagcagaggaagatgcaacgttgtcgtcgaagaaccggagcagtcgcgcttgaagtgctacccaaaaacttgatcgcccgcctacccgtacaggttctcaagcggacggaattccggaggcacctgctcatcccgtacacctgtgcgcgcaggtgaacagaaccagggaaggattctgcagcgcaagaacagaggaggaggaactcgaagcacaagagacgtcgggaagaacttctccatatccttctggtcgctgccgagtatatatatgtgatcgcgagagtaacattcggagtcatcaaccgcggtgtttaattttgtaaccgacgcgctcgttaatacggaatcaattcacggcgtttaattccgtaaccgacgcgctcattaatacgaaatcaattctccatgtttattacggtccgttacatcaaccgtggtgtttaattttgtaaccgatgcgctcgttaatacggaatcaattcacggcgtttaattatgtaaccgacgcgctcattaatacgaaatcaattctccgtgtttattacggtccgttacatcaaccgcggtgtttaattttgtaaccgacgcgctcgttaatatggaatcaattcacggcgtttaattccgtaaccgacgcactcattaatacgaaatcaattctccgtgtttattacggtccgttacaaaatgagagagagagagagagagagagcagctacctgcctcgcctcgccctgcctgctgtccgcgcaccatctcaatcgatcaacagagactctccactagctccgtatttaagttgaggcctcttcacatagatttccaaggtggtattattacccatagcatttaatgtgggccaatggaatttattaggatttaattgggcctagcccattaatctaacatatatgatagttagaaatgtattaggatacgattgatttgtgtgaactccttccttatctttgatctttctttatctctaccaaagtattattctatatataccggcccctgagccttaatacaacgtgtctaatattcagaatatctcctttcttgtactattcaacttggtattagagtgggcgatctagcgcctctctcacacttccactgccatcatccctaggagggttctgatctcctggggcggtgatccttttttttctctgccgttgtcgttgttgtcctagagagatcaatctccgagcattctaagcattctatgtcgttgtcttcgtgtcgttgaatcagtagcaacaacgccaactacctccacgccgccaccctcttcgacctccacccacaccggccagcccctttgtggacatcgccacgcagaaagtaaagaactgcaaaaacttacttcctctcctactcatgtggttggtgaagatcttaatacaagctagtatttgtgcatgattgcgtgagcgaggctaccatggctgatggtgtagcgcacgggttgggagggtgcgaacagagtgaaacttgccagaggacggctagcggcttggcgatgcccaagcttgactcagcggaggtgcttgggggacgtcaggttgggttagccaaagtggaacatgtcatagacaaccgatggcatggcaatgcccgcctgggttctcactggatatactgcatgggtgtgttcggggagagcagtggcggcgcatcagcgcccaccgtagggatggaaggcaacgcacaaagagaattttcctcccccgcgcaccaaaaaaataagccgaagcggaacatgtcataggacaaccgacaacatggcaatgcctacctggttctcactggatttgctgtgtgggtgtgttcggggagagaagcggcggcacaacgcccacggtaggatggaaggcaacgcacgaagagaattttcctcccgcgcgcaccaaaaaaatgtagatggatgttgtgggtagagcctctaggactgggactctatggagagggatttgaggtccttcctattttgaggtcttaaatgagatctctgctgaatctagatttttggcctcaacccttataaaattgtttgggggcttggtttagggttcatgctggaaatgctcttttatatatatatatatatatatatatatatatatatatatatatatatatccaacaagagctccaaccgatgttaaaatttaaaattaggatttgagagctggtgttctaccatactataaaatcttcatcagtcgggttttatcttcaactattacgccaccttctcaccaactctcagatgtatggtcaggggcggagctaaaacgaaatggagggtggtgccacttgattaatttactctactttaatcaagtttaagctgatgcgagtatctaagtttgtattgaaaaatatatatatatatgatgaaaataaataaaatatagctaaaatttttttaccctctaatatcctctacctccaccccctgtgtatggtcatctcgccaccgcgcgccgccctggccttgtccttgtcgatcgccgtcaggcttcgacgatatcacaacgacacaaccccatcgccttgtaacaatgcctgatgtgagcgtgccaacgtcgagtacgtccgtccatcgctcctgccatgtctttgtccatgcacagttgctaaagccgtcgcagccacgcatccctctcgtccacacccaccacccaagtgcccaagcggtggccgcatatatgcatgcattgcatagagtacgccgcggcgcggtggcacgcatgcacagcatatatcccccttgactctcgaatccaagtcctggggtgactccaatccaagttctggggcctcgcgttgttcggcgctgtgctaggctgctagcttctgaaaatatcatgaaaaataaaaagcaaacaaaggccattttcagttctcacgcaaaaacttttcatcatatcacatcgaattatttggacacatacatagagtattaaatatagaaaaaaaactaattacacagattacgtgtaaattacgagacgaatcttttaagtctaattgctccatgatttgacaatgtggtgttacagtaaatatttactaatgatggattaattaggtttaataaattcatctcgctgtttacagtcggaatatgcaatttttttggttattagactacgtttaatacttcaaatatgtgtctgtagtccgatgttacacgctaaaacttttttttttaacagtcagactgttgccgatgatttatattaaaagaagatattctgtttaaagaagaacataccgaaacttttcaaccctgtaacaaaaccgggccaaagaagatagcttctgaaaagatgagcatcgttcatgtgcacacagtgcaaacgcacgcctagtttggtagtggtagcgcaacgaataaatgacggacatgtattttcatcgtcgattggacgtcaccacttttttatatatcatctaaataagaatttttttaaataataaattttatatactttatccgtttcatattaaaaatcgtttgacttttatcctcatcaaatttctttaggtttgatcaaatttatagaaaaacataatattattttcaacataaaacaaacatattatcaaaatatatcgaatattagatttaatgaaactaatttaatattttagatgttattaaattttctataagaaatattatgaaaaactgagggaatatcatctaaataagaatattttaaaataataaaataaattaatagatatatcccttcacatatatatataaggttaaacttaacttgttttatagtgaatttaactaaatttataaaaaatagcaatattttcaatttaaaacaaatgtataatcgaatatgttaaatgttacattatgaaactaatttattgttgtaaatgatacaattatttttgataaatttaactaaacttaaaaaagtttaactagaaaaaaagcaacttataatatgaaaatgatggagtaatttttttttcatatttaatagctaacgctacgacaacgcttgaatggctagctatcaaaacgctatcaaaaccagaaattgataagcagtaattcatgtgacatagcaggtaaagaaatcaaccaaattggtagtaggaaaatcatatcgatattgtgtcaaaatgcatgtaaagatcattacaaaatttcgtcattgacatcgtactacatttcatcaaagttaccgaagaaaaataatgttatgtgggtataaagacaaggcaaccaaaataataaacggatgaattcttataattgaaaataagaccttgttttgcccaagtcattgaagatggtaattgatggctttgctgcgttctttcgcctcccttccaagatcaagtcctaagcaaccatcataaatttggaaatttggatggcacatgaattaaaatctgggtaagcaatttgaaaggatttaaaaaaaatggtgattatggcccgagtcctagtaaaatgtaaccaagagatccttctgcccgatacaccgtagaatatatctttcaacactaaacgcatatcagagtgacaattacaaaaaaaaaaaatgtagtagcagaccactgaaacttgaaactcatctgactcacccaaccaccacaatagaataacaaacttctttaagaaaactgcatcgtggaataacataatgatgaggccctgtgcgttccctaagctttactccctccgtcccaaaataactcaattcctgcgtttccgtgtccaacgtttcaccgtctgtctcatataaaatttttttatgattactattttcattgttgttagataataaaacatgaataatactttatgcgtgacttatcattttaaattttttcataattttttttaaataagacggacagtcaaacgttggacacagaaactcaggaattgagttattttgggacggagggagtaggtgacaccaaaactggagagtgctgcttttttagttcttcaccaaataaaagtcttgcgtatgcaaaatcataatatgaacataccaagcaatagacttagaaatctataaaatttagttctaatttgaaatattttaaaaggttccttaaacaatcaaaacatgtgacatctagattagttaaatatgtaccaaccgtacttgttcacctaatccaaaagtttcatgcctgagatgttatgttacgtgtctatccaaaaggattatattataactctactcagtgcagaataaatcaaaaagcagagatacctcaggattatattattataactctatttcgttttacattataagtcgtttgattttttttaagtttaactaaatttatagtaaaatttaccaatatctaaaataaaatctaacattgaatatatattgataatatgtttgttttatgttcaaaatactaatatatttttatataaacttgatcaaattcagctagaaaaaaaagttaaacaacttataatgaaatggagggagtagaaattaaacacggagcgggcccataaaaagcagaggaccgacgaggagcttcttgtgcggt

SEQ ID NO: 65664 - DNA, 2784 bp, Oryza sativa
atctaaacagagaacatgaagtataatggtatgagtattgtgaaaaaagaagaagaaacgaacatcttgaaaacgagataaaatatttaattcaaccgtttaaagtcaaaaagggagtagctacatcccacagcaccagccggtctttgtttaaaggaaggaagaaaattccttgcgtaccttgagtattttcactcaaacccttacatgtgcttaagttttgtgttatcccttaaatgttagtccctactatactcactccattaactaacattacgtttaagttgtttgttagctttttatgaaatgactatattatccctccctggagtatgagtactaacttgttattatcttcatcggttataaaaaatgaagacaacaaagttgcttgaaccaaattttgaaaactgaaatttaaatttcccactgaattgtaattaaatttgatgaaatttcagatgtagaaattacacaagtcaccattttgtctttcatttcaaatcaacttcaaacaatttcgaagaaatctcgcgagagagagagggagggagggagggagggagaggtgaaattacaattttaaattttgtcaaacttaattaaaggttgtttcaaaatataaattttggttttcaaatttgggttaaataatgatgtcccttttgatgttttagagctacattgttttcgttatgtgaaatatgctttaattaagctagcatttctataaaaacaaggggtaatatagtttatccaactaatggaatcaacacaaaggggcttaaacgaaaatttaggagaatgtaaggcaaaacttggtatagttatgtttaggtaaataagaaagctgtctattatatactaaaagtttattaaacctcttacaaacgctctcaaaccatcatgtgagactactacaaatgctgttaaaccacaagtctaataatttagagaaaatcttaaaaatctgaggaaaaaaaatggaaaacttccttcttttaattttcacatttaatttgtgagtccaatattctaaaccgttggattagattagattgatttaaacaaaccacaatattaagccccaaccagcactcggtaaatcttaaatatctatagatgttgcacgtctggtcagggaagattgcgctgggaaggatgtggaggttcactgctagggtgggatatcgatgatactatgctcagttgatcagctctacaatagatttgcagtcaatgtaatgtaaataatttgttcgtggacgcgtatagtggatgtgtaattaaaaagtgccatcaaaactaaaacaaggctaaatgaagagtgccgaactaactaggagaactaaagatttccacaacacatatgcataaaaacacagaaagaatcatctatagcatcaacaacatgagcaatcacatcggtgttcccatgttacagtgctaaaaataatatagcatgtgggacctccatatattatagactacatgttcaacccttcaattccaaacccattatagcagacaattcaatatataaaatataattaaacaatatttcataaagaatcacctaaaattaaaatttcaaatttttacggtaaataagtttatgaaatctaaatcttgattgagagttgtttcattttggatcaccttttaataaatgttttaacttaaaacctgttaaatttacctttatggcactttggaccaccctcgacttttttatctgtctacattaacttgtcatatgcgaaagcaatagtctaaatatagctatgggagtccattaaagagtagaagccgatgcaacttgtaatcattcatatgcttaagaagagagtcatggttgtccaaagtggaatagaggtaaaattactcagttcatagtgaaatattatctaaagggtggttcaaagtgaaacatcgctaacaaaaggtagcccaaagtgaaactttcaaaaagatgcacttcatttcttgcaaaacagatgatggcttcaatccttatcctatggctcaaaaaattacaaaacacattttcccccaaaaataattaactaatctgagataccaggtcacgtgtgcttcaaatatggccgtaccgcagcaccaaccggcagcaagccgcctccccgcaatttcatgtcatatgcacaattctaaatacgaggactccagatctctgacactgccgccacttcggcttgtttagttcgcgaaaagaaaatttttgggtgtcatatcggacgtttgaccagatgtcggaaggggttttcggacacgaataaaaaaactaatttcataactcgtttggaaaccgcgagaagaatcttttgagcctaattaatccgtcattagcacatgtgggttactgtagcacttatggctaatcatggactaattaggctcaaaagatttgtctcgcgatttcacccctaactgtgcaattagtttttttttaaaaaatcaatatttaatggttcatgcatgtgttcaaagattcgatttaatgtttttggaaaaaactttttgggaactaaacaggcccttatattggccttttccgctcggacaccactcaagtcacttcctgtcctatgagctcctaaattgtgaaagcctatgaaaacctaaatgtctgtaaagttcatccccactaaaaaaatgttaatactaattctctatcatatcataaaaccacattatctaaattgtttttagcctttagatgattcatcaagggtgcgaattatatctcttctcccccaaaatcca

SEQ ID NO: 65665 - DNA, 1900 bp, Oryza sativa
gtagtctatggtaatttaaatttaaatagtatatatagaatgatgattcaaatgtaaaagatgatgtggcttcgtgagagaagaaaaggagagagataatttggaccatagattaatcatctaagggcaaaaacaattgatatgatatagctaaatgagaggagagaaataatattaactaagtgaggatgaactatataggtgtatgggatgatgatttaacattcgttcattttaaagctctaaagttcaataattataaaataaaattatagataatatagcatgcttgtacgatgtttatatgtaataattattagtgaaagatgatgtgtcatcattgcatgtagagttttagaatttagtgggttatagctttatagtaagataagaattatgcgggatgatgatttaacattcttgcattttaaagaactaaaattcaataattataaaattatagataatatagcatgcttgcatgatgtttaaatgtaataattattagtgaaggatgatgtggcatatataagatcttgctacgccatcaaaacttttgcctgaatcaatacattacttcttctatcaacagacctatcccaactatttgtcatatttctgggctaacagcaacaacacacgggaaaatcttggaataaaaaaggtatttaaattaatattatttttccatatcgactggtagtgtttcacttttgcagtttacatcacacttttcttgtttctcctgatgttcataacatatatagggaactgtggatgagtgggtgaggtgccatgacgatggactaccttattctcaggacatagagagcagtattaagtaccatcaaaatcttacatctagaggctatcgtgtcttggtatacaggtaaccaagttcttgtatgttcacatctcaaaagttttatgattatgaaacgcctagagattatgtgcatgtctcttaacaacaattaataattaagaaccgatctcttattattggtgcttccgctaatacagacagaagcaccaatagtagtagattaaaaggtccaactgttgggaaggatttctcagctcatttctcggcttataacgttatagaccctctaacgtataaccattcgaatttatactattggttgttttcttttctttttttctatgtgttgtcaacttcttatttttgtctttcatatagtggcgaccatgattccgtggttccatttttgggtacacaagcctgggtgagatcactcaactacccaattgtggatgactggagagcctggcatatcgatggccagtctgctgggtaagattaatgtgcctaattcgttttcttgtttagttatgtataacactactacggggtgattaataagattttcataagtttaaaatacactgtgtttttcagttcataataaactcagtcgaagagtacattacctgaaatacgatttatttatttgcagattcaccatagcatatggaaacaatttgacattcgctacagtaaaggtgacaatatatctgtctacaaatgcatgattcttgtttttcaaaaagcaaatgaaacttttcttttttacattcattatttttactatggttattttgaatgaagttaattaactcctacagtttcaaacagtttgggagtatctaggttctaatgatttgttaaataccagatgcaaatgtttggttgcagtatgggttgaaagttgaaactgcaaaacgaaaattttgaattaagggtacaagttgtacactccacattttcatgaatgaaaacttcatgcatagtgatgagtaaaaataaatccaaccattaatgtaataaagctatgtttgttattaaagataagtgaattgttcatgcttgttcacc

SEQ ID NO: 65666 - DNA, 15457 bp, Oryza sativa
gggtgagaatttataacttgcaaattatagtttgttactgtaacaaaaggcataggaaataattatgtgagtatgcaaacttttttccacaattacactttcattttaaagtattattgatttgcagattcacaatcacatatgcaaatgacttgaccttcgctacggtaaaggtaacaacataactacaagttacttctccctctctctcaaaactaagaaagagaaacatgcaattttttttcaacaagaaacaaataccctcatccctaactacatgcaagaaaagaaaatgcatgttgggtatttgatgcttttaaggtgggctctactgctctagtgttatttccagtatgaggcgttgaaacttcacaacaaataactttttttaaaaaaacagaggaactttagttgagctggcagggaaaatttgtcaatttactgctctctgggactttctgataagactgaattgtcttaattatagtgtccttgttaattactggacaaacgtactaatgtgacataacgcacaagaatagatgattatgcattacgtatacaattgcaaataactcggctgtaacgctatttaacccagggtggtggacacactgcaccagagtaccagccggagaggtgtcttgcaatgtttgggagatggatttcagagaaatcactttgacgattgtgtatatcagttatgatgagagctgctttgattattatctaatgaatgatacatcccttggccagttcattgggcaaggaggtagctcaggtgaggcgcattatggtagaacatgccacagaggaccagaacaagctttagatgattactaaagtgaatatgaaaggatacaaataatcctgagatctctcagtgatactctcttcgtttttttaatagatgacaccattaacttttaaacacatgcttgatcattcgtcttttttttaaaaaaaatatgtaaatgtataagatataaatcatgcttaaagtattttgagtaataaaacaagttataataaaataaactataattaaatagttttttttgagaaaggcaaatgattaaactagtaataaaaagtcaacaacatcattcattgaaaaacagaggtagtatatatttgaacatgacctctcgataccctgtggttaagccacgtgacagtttaattgtcagccgttagatctaatctgaacgttcgcacaagcgtgaagcccagcccacatttctttcctggtttctccccatccgcatcgctcacagccgctgccgccgccggacgcggtcgcttcccctcccccgcccgcatgcgtgcgtgccagctgcgcagcgggcccgctagccggcgcactcgcttctccttctcccctgcgcatgtgctcgcttctcctccccgcgtcgcactgccttcctcatcccgcacgcaccagccacgccgcggagccgcgcgtctgtagcgtcggctgcaggtatcgcgagatggagatatgcgccgggagccctagcgccatgctggcctcaaccgcccctacaatggccttcgctgcctcccctcccctctcctccctcgccgctgccgccgccgtgatctcctcctcctccccatcaaaacccctctcacgagcaaagacccctccaccagctctcctccaggctattctccccactgccccccccaaacaccattccctctcctgctctgggtcacaagccccacgtgccaccacaggcgaaggatcggccgtgggggaccgcgggagcggctccggaggaaacaacggcaagggtggcggcggcgacggcgatggcggcgacaacgactatgaggaggccgagttcgggcccctgctcgggttcgatgaggtgctgcgcctcaccgcggcatgcggtgtctcgctcccggccgacatgatgggggcggccaaggatgctagcatccgggaagtcatgttgctccaccacttcgatctgcaggtaatccgaattgcagaagaattgtttgtgacaaggtaaaaaaaaatgtttgtgagaaggtattttcagtccccttttcatctcttaggcagcaccatggcctctagccgcgatgatccgggcattcttgatgctccgcaactgaatgttagcggacccatcattcctcttcaaatttggaaccaaggtgcgtgcatgattgatttgttgtttaagctgaggagttcagattgtcgtcctacggagttttgaggattttgcattcgatgcaggttgtgattgactcgtgctgcgctacgtttgcggaggtgtttgagctgtacgatccatggacagatatgcacgctacggtttgctcgctggcccatgttccttcatcagttatacttcatggagtagatccctaatgcatgaagcactgcttttgtcttatctctgagactctaactaatacttcggccaatccttttttttttgaagcatgctttaatttcgtctaatcgctcgaagtttctttcacattgttaggatgttttgttatcactgtgtgcagaaattaactttgcactggctaagtgaatttgtttgatctgctttgtagggattcatggatacagccatcacccccagtttccattctcttatcctgcacagttcattggatgacatatttgtgattccaaaagagtaatagagggtttgtgtttaggtgttccagcaattgatgcgaatgtcaaaatttatctgctttgcgtccacttaactcttacttcagttctttcttttacatgtaaatattggttgcataaaatctatttttggttgtttacgagtttaccgacattctgaaatcgtaaactgtagggatttttcattttgttcttaccattgtgacttatcttatcaatcttttgtctcagccttttaggtctgaattaaacgcagagagttggaacagtcaagacatcaagtagtagcagattatcactacgtttcaaggtgttccagaaatcctgacacaagatcaaatttataattctgattaagcactgtagcacatcatcaccattagttgtttggcacatcgtcttatctattactgaaggttgcatatattctgatcctgtattacctgattattcttttctgcgaatttctaaataatatttattgtgttcgtggttatacttagatcagtcaaacacccatcacaagagctatatatatataacatgtggatagttggatgagaagacgatgaaatgaattggctacctttgatagaacaatataaattgtcactggatacattgcaaccttctatatgtaagctacatcgtgacagcatttgatgaataatacactaatgaattgtatgttaactcatgacctaagtatgtagtatccttttgaagttttggctcaaatgttgatcaaaaagtccatttatttatctctttaattttctaacttgaggatggatgcacatcctatccaattgcataatattgagtatgtcctgcagcaacgcacgggtttcctctagtttccaaacgaatatttctcggcaaggcaaacactgcagcttgtccatttcttccctttgcgggagtagttttcaatgattgcgatggtaatggaaagagaaccgtttccatcgttgtcattgccgttgccgttgttgttcccattctcgctgccaaccatgatgaagaggaaatagtgattagtgaatgtagtcgttcacgaacaacagccaacagtcgcacaatgtattttctaaaaacttgactcgccttatcttctcggtgcaagatcagggaggtggggggagggggttccgaaccgctgtcccaacatccatggacgcagacgtcgggatgggaaaaccatatagtaatagcgtggaaaatagagagttgtgtgttgtcacgtgctcttatatgggagatatttagtgccttctattggactcaagtaagaggaagagaaaaaaaatagccatgaataataagtaaccgacattggctttccattttgaattaagtagacgttttaataatcaatccgttggagagttatatgtgttgtaggattgaaacaagaactaggcctaccagagaggggtgaatggtaggaacacaaaaatctgaaaacttctaacaaaattaaaagttaccctcaaaccagttggagataggtcttactggtgtagatgcgccggtctgatcacctgactgccatcgatctgaccgattggagttgctctagtccgaccaccctacacatcgttgtcaccaatcgctacacaggttcctccacttctcgtcacaacttttggatctgagtctactatgtacccttgggttcagcttgggcatagctctaccatgtctgaacatgggcctagggaggtgcaggttctgattcactcattggatggctctgatttctccgataacaatactatctatagctccgacgactctaccccactccgtgaggtgttcatggctttgaaaggagccaaggatgaacaagctcgaatctagagagaagcggaagaggaataccttcgtaaggaggtagaagatcgtctgcgtcatgattggcattgtgatctaacaacctgaggatgcacggctcacgacaatatcatccaaatgggccacgacgaccacaatgttcgtcgccccacggcacaatgttgttgcgatagtcatgctgttggaccttgtacttgaagccatacccgaccaccaggtgactccgaccctcaacaaagacaaagccatgatgaccacgacgtcttcctagcaagtaggaggatcaagttgcaattttcgccgtccaagccaattacattccaatccgtcgctgagttacctaaaactctagctggcaatcaccctaaccaagagctgtctgggcgtccctctgcgaaaaaccactcggtggcaggcaacaaaggacataccgcttcatccctaaggtgacgtcaaaatggaaaccgtcgaccagctccttcagtagcggacaggcttttaatcgtcaggatggaggatatcgcattggtaaccaccacgacgatggacgccattgtgaagaaatacgcgatcataggaacaatgaggacctcagagatgagctcaactgatggcactgggagcgtgaaaatcatgaccaccatggctatcataattccccactcactatgagggatcacaggatatgatgccgatgaagggattcctgcgttcactcctaaccttcaccgagtggattggcaaccggattcaagcctacaagtatcgagaaatatgatggtaagaccaagccagaatccttgttgacagtatacactttagcaatcagagcagctggaggagatagcaaggccatggtaaactacttaccggcaacattcaccgactcatagaggaactggctttggggattccatggggatctaatgattcctggtgcgagcttcaggagcaattcattgcaaatttcaagggtacttacgagaggcctggtactcagttcgatctatagcacatccattagaagaaaaattaatccctaaaagattacatcacgcggttccctgaaacaaaaaaaaagacccaatggtcatggatgacattattatcgctacctttcaaaagcgactccatgatgagaaccttattggcaagtttctgaccaccgtgacgaagctatttgagacatacaatccatatgccaagtcagcagatgcaaccaatgatgctcacgacgataagccaccggatgctccatgcccaaaggagagaagagataacagagaatttaatcggagagagatcggaagcgtaggccagaataattggcagcgactattgggaactaccagccgcagcaccctcctcacaacaattatgatatgatctaaatgggctctacaagaaattcgctgaagatcatgccaaacaactccaggcgccagccggtgagggtagctccggcaaggataaggccaaggacaaaccggaccacatggacccgagtggattccaggatcaccgagtcgagctaaaccatatttttggaggccccttggcatgagtagaaggggaagcaaaagctaaccgactgtgaaattaatatggttcagccgaatgtaccccaatacatacgagggtcgatgttcgcaatcatgtttgaccactcggatcattctgaccaagtggctcgcccggggcggtatcccttagtccttgacccggttatcaagaaaatcaaattcagagggtcctcattggtggaggcagtgcgctttatattttgtttgcaaaaacactggatgagatgaagattctggatgagatgaagattccaaggtcagagttgaagccaagcactgctccatttcacgggttattcccgggctgtcttcaacaccactcgtccaaattactctagagtaatctctatccccacagattacaccactagacaatggtttatatcatcgccctcttcatctttgtcaagtgaacacacctctactaataaaaggctatggacaattctgctagtgcttcgcttgctcatgcagttatggtatactccctccgttctgaaacataagacattttggctggatgggatatatcgtaacactacgaatctagacaggtaaccaaaatcccttatattttagaacgaagggagtattatcttcactctggcatcaaaagctattgcttgttcttgcaaatgagatagacctgccagtttctcatgtcagtttctcctatttttagatgttgtgtgactaatttgtctatggcagttgctatgagtagcttcatactcctcctatccaaaataagtgcagttgtcactagtatagatccgggcatccttgatgagccaccagtgtcgggctagtgcgactcgtttactttagtgctttacctaatgccttcactcggatgagtcattcctaacagttcaaaaagtatcccgtttaagatatgactatcggggatgacccctcaccgatataaggtcatctttattggcttgtagttctaacacgtcatatatgacttataacgggtctcaattatatcccatcacggataaaatgtcatccgtgacgagtgtaatgggatgacccattaaagatgagagcactcatccgtgatgggtcttaattaccatccttcacggataacattatttgtaaaggatggtagttactaaccatcatggatgaagaaaaatttaaatttttgaaattttcaaataaccttagatagagacataccatatataaaagttatagatctcgatgagatctataactttaaagcggacaatattttaatatgagatagtttatatgcccaagaatgcattataagtggcaagatatatttttaaaagacataattttgaatttttaccttgatctcggatggagacgtttcctatatcaaagtcaaagggtttgatgaaatataattgacaatattttcatttaagattgttttcatccccgaatatgtttataagtgatgtgatctatttccaaaatattttttgaattttccaaacaaccttggatggagacatatcctacattaaagagttgaaagcgttctcgtttgaactcatctagggtttcaaatttttgtttcagatttggataagaatagttaaaaaaaatagcatcgatccctgatcaacatgtggtctataggtgagatggcacgattgattttcattcgttaagaggtcttgggtttgaatcccacttaagacatgcatgcatatcatttgaaaaatcatgaatttttatctagtgatgtgtgaccatggttggaatatcctaatgatatttttaggggtttctatgcatttaaaattcaaaaaacataaattcttatccgtgaaggtttgtaattatgaactgtcacgaataactctcatccacgacaggtcgtaactaccacccattacggatgagagttatccatgatggtcttttatttacacccgacaaagatgactgttatcggtgacggctgccagcccgacacaaatgagttttcacatcactaaccaatgatctatgaccaagccactcaccgacactgatgtggatttccacctgacgcagatgaccaaatccacactagggcgtgtgggatggagggaatactaagattcatcatcatattttacattgtttatttctcgattacactgaatggaaaagtactaataattccaactcgcacaaaccaataaaaaatagtgctagaggtgcaaacaaaaccactacccaaagttcaaaacaaacactaaatgccattccattatattcagcacataactcatcgaagtatatactactacccaaatcccagattgatgtatatactattttgttcgaatagattaacacacacttcacaaaaccaacatttatggcagtttaactgaatccatgatcgctctcaccaagcagaaccttcatctgatttctcttccggattccaacctggagacgccatagattcagaacagaatctggcagtagagatgcaaagaaccactggatcgagtggcgccagtaggggacacatcttggctcataaccgatgcagcggacagcagccttggcgtactcctcgggtgatggtataaacggcgagttaccctggacaggtgacatctttgtggcgacatataatggtatctgcacaaaaaattggttagggcaccacttgagatgacaatggagaaatatgtgatgtacatatgggtagtggattttttattttacgtgatggggtaatgagaggcacatattttctggtgttaatttgtagtgcatttcgatgtcttctgaagaagagtaaaacactcaatccattatgtaatatatgtttggaaacaagatataagttttctagaagttaaaagaaattaagaatatcggtaggttaattttatactttttataatattgtagcaattttagtattttattttacaatatgttaaaaatgagctatgcaatattttcaaagcctaaataatgtgctcataactgccttttattttcacctcgctctagaaatgatctttataaatgtcgaaaacccatttttgcaaaggcctcccactattgtatgaaaaaaaatcagtatcttttcaaccgtgcgacacaaccgcacgttagaacccattttcataggcacgcctgtaaaaaattatttttaagcgaccaaattaggacgttcaactaaaagaaaacaaaacgaatctagacaccccagttagggccgctgtcaccgccactaccgggcaccactgtcatcatcacgcagttgatgtcaaggtcgtcgtcatgccgttaaggctatggtcttcgtctacttggctcctccacctccactctcagtagccgcagacggcaaatccacccgtccgaggccgctaccgatggatccaccgccgcctacaccaccacacgtgccgggaggtagagagctaagaggaggggaaagtgacagtagtgatagatccacatcacccatggccacgaccgtcgtcgtcttcgtgtatccgccgctaacagccccacactgctccaagctaccggatccgactggtggtgccaaatccgccccttctcacctcgccagatgtaatgcctttggccccacccctccctacccttttgctgccgccactaggtctagccgacacaaggtcgttggggccggatctgcccatcaaggtgccaggcgatagcggatccacccgttgttgcagtggctcccaccgctgtccaccgaccccgcactcctctgcagacctcttgtggcaaaccgccccttctgttagggcctgctggctgctccttttgtcggtcatcaaggagagcagatagagggaggaggggagaacagaagagggacgagagcactaaggagaggagtagacatgacagaaaaggacttagcgcaaggaggagaatataggagagggagccggcatgtgagaaaattcatacgtaggccgtttaacagtcctgtctataaaaataaaccttttattttgcatgcaggcctcttccagatctgcctatgagaatgaattttcgcacatgttctttacaaggcaccttcgaaatacatagcttcttttagcccgtccaaaaagaaaataaaggggtgttttattaaactttgaagctgaaataaatgttcacgcaataaacattgtaaaaagataacaaatgttacctggcattgcacatccactccgtgatgcttgtattcaacatgtagacttcgagacaattggtcaacatacctaaaaaaagggtattagaaaaatggtatcagagcaggtacaataacagactattagctagctacaaacatattttaatgagataaaagatgagagagaagagcagcgggctacagatctgtagtcagctatagtacggactccaagacgcaatgtgtgtatgacatgtgggaccatatattaatagtatagtaagcaatattgtataaattagctattaaatcggctacagatgaattggagctagtagtggactatactattaaacttgctctcataagaaatttaagttagagcagtcatattaattacctagagattagtacgtacctaaacttatattatcttgtttgcccctatgtattgagtaacattcccaaattgttacggtccctcttatgtgacgctcatttggtatgtgacatgcacattaaagtggcataccacacggatatttcggtcccaaatttttttctttgttttttccacacgaacagaagggaagaagagaagaaaattagaagaaaaaaagataaaatagaatgactcaacaccgatgttccaaatgagcatcatatcggtgttccaaatgagcatcatgtaggatctcgaggcgtcatgacaattttaaaaatatattttaaaagttcatagatctggatgatatacttagacaaatcttatctcatatatatagtgaaagaagtgaatcagctttcttgcacaatgatgtggcacaacatcaaaacatattggctaagcatgcattaatacaaatagagcatatgggaattaataaaaaaacacaaactgactaagcatatgggaatttatggatgtttctggtgattcatcttggacacatgatacaaatagagagagggggcaaaagacaacgaagaaaaaaaaaatccagaagactttctagtgattcctcatgtgaacatatagtataacttagctaaatctataattagttaggccaatgaatattttgtaaataaattaacttatgttaaaaccttctagaagctaagataaactaataaagcatatataaaagttcttaaacatgatcaaaatttgtgcaaagcgcgactatatggttagtcattgatgatatatatagacaaacaagtttaaaggccgacaatacactttacccaatatgatatttaagttactttgagatgtgcttttcttcaattgtttgttttcagcattatattcaaatgattattgttttctctgaaatatcaatgagaatataccatctggatatatgcatgattgctatattaatttattatttatgtcgtttctcaatatataattattggccggtcctccatgttattcgccgggggaacaaagcatgaacttttccgtcatatacgaacggacattaacgagcattcatatgccatgtgcatttggacggtgatcaatcgttggcttgcacttataatgggaagtttggttcaacgttgaaatatgccataccacggccatatcttagacatgacgagactaaataatacgaggtacttttttatctcaaaataacttcatctcttccttcaccaatttaactcataaagactttatttttaaataatcaaaatattaggacttgttaaagttggcgataaacgtggtgggcttggacttgataaagttaaagacaaaagtactgaaaattaataaagtaaaagatattttaatcttctaaatcttatattggtaattgtaacatagattaaaaaataaagttaatttaaaacagaaatagcatgagaatagccagtagaatttgtggcttaaaaaactatatacgacgacatacatgtgacacctaaacaaacaactgcatcaaaatgttgcaccaaaccgctcaacaaatcttctcactgtagattttgcctttttttaagagtgaattgcacttagtttcatgttagaccatccctagttcaatctttctactttccactagctaaatttatgatggttttactttgtaccgcctaaaccacttcggttctagtacgctagcgaaatccttcacctatgaacagaacatatcatgttatttgtctgagtataggatggacataactaagaaaagattcgggaggtctgaagcactactagaaaaacgatttttagcaacattggccttttatttttccaagcgggtatgaccatcggacccaaatatccgcctagaaaaatataaactgaggtgaattttcgtcatccgcctacgaaaatcgatttatccaggcggaccacttaagcgatccggctgcgaaaatacctttaattttacaggcggaatgcttaagtggcccgcttggaaaaatcgattttcacaagcggaaccttacgtggtccgcctgagaaaatcatacctccaccgaaaaatatctaagtcacagactcaagtactcaatcttatcttcaactcaaccccgccccaccactcaccctctcctctccatctcgcatattatcttcaactcaactcagcaaggccgcggcagggcgtcagcagcagcgtcggcgtcggcgttggcgtcgccgtcgacaccaacgagcggtggcggctccgagaaggagcggtgtgtgcgcgacgagcggcggcgtaggctcgtctcctcaccacctccgctggccgcttccctcctcgccccctccgctgccggccactaggagcgacgacaacggctctcctcctccgctgccggcttccctcctcgccgcctccgccggccgcttccgctcctcgccccctccgctgccggccacgacgaacgacgacgacggctcgcctcctccaccgctggcttccctcctcgccggctccgccaccgatcacgacgggtgatgatgacggctcgcatccggccgctggctcccctcctcgttgacgcgatgacgacactgacggtgttgatgcgacgatgatgatgacgtcgcctgtggaggccggcggacggaggagacacggcggctcggctcctccctctcctatgtggaggcaatggcggacggaggagagccgtggccggaaggtgaggccggtggcggcgccagtggttaggttggtggtttttttaaaaaaatttttctaagatgattttcgttggcgggccacgggcccgcctgcgaaaatggtctattttcgcaggcgatagggtagcggcggtccttccccccacctgcgacacatgttttgggccgcctgaaaaaaccttttttctagtagtgaagtgcaacaaccctaaattcaactataaccagtccaaagtaaaactacaacaataaaagatcatgcaaatataattcactttttttgttgtttaagatcgaaacttcctattaattaattgcttatatgcatgcacccatatgatgcagtctttttaagcattgattcttctcacataaaaaattaaatcaaattggcattaacatttaattttctgagaatcaatcacttggcttttcaaaagtataaatttgctacaattttgcatcggtatctcacagaactaagagaatagcaaagcaattttatcacagagccacagctacgtacctttagccctcttgatctatatgatatatgggtcttgcatacaccaacataaatattgcgtgtgtgtaagataagtaggcccaaaagttgtcaaacaaataaaatttatagctttcagatataaccgtacattattgttgtatttctccaaatatttgtaaaatgtatatataaaattattgtaaattggtaatttttaataaaaatatagttgcaatcatctgaaatttacttttttgaaaacaactgataaagaaaaaagtaaatcaatttaaccttttattgcatgcagtgaagtttgggatgtatactctctctctctttcaaaataattaaacctaggataggtgtgcatttaactatttgctacttttaaaatgtgacaattaagaatttatcattggcagtttatgacacgtaggttcagtgacatatttaattgccacttgtaagagtggcacataattaaatatctctagtacaaagtatgatatattctagtgctcttatatatatttatagtaatacgaaccatcacatatcgtattaggttattattttggttattattttagacgaaggaagtactccacatattgcatgaatagtgatagcactgcaacgtgccttttggcgcctgccaccactagatgatacacttgtgttgacttaaggtggtgtcatgccatcctgccaattgatgggctattaatgtagaactgtactccatacatgccagtagatggttgtttctagatgtcaaattgcacaatttgttccgatgatagaaaaacatttaattagagtcaagtttctgcatggatcaacaaagtcaaattacgttgggagtatcttaaaaaactgctacaagtttttttttgactgaaaagtcgaaaaactttgaaaggtaactatattataattgtaactacactgtaactttttttaatcaagctatatataactatgatataacttatatttagttggctagcaccatgatcttacacgtgacgtgtgaaaagaaatttgtagctacttttttccttcatgcatatataaatctcgaggcaatccaatagttacaaatatgaaagttcttggagcaaagaaacgtgcgaaagttttgtaacacttttccttcttttaattactcgtcgtttgttgtaagtaagacatatatctttcactatcacttttttcaaatccaggccatgtagtttaccaataattgaattatatatttaaagtattttcataaatcttattacattaaattatatttgtttataggagtagatgggttaaagatttaaaatgtttgacttagaacaaacgtgaaacgatcagtaattttctaagacttgttttaagaaggttagttgttaagttgcgctaattttggtcagctttagaaataaatttaggattaaactagaaaaaaatacttatgagcatgacacgatagctttgaagattggaa

SEQ ID NO: 65667 - DNA, 2798 bp, Oryza sativa
cgccacgaaccacatcggcgtcgccggcgccggtgcacggccagatctccggccaccaccacggactccatgttcttcgcgccggcggccgaacagcttgctatatcagggcattcgcaacgttagcagcggttcttttttatgagcatgagcggaagccaagtgcaagcatttgagaactgcaacagtggagtggtgcttgcgcctacgccctacagttggtaggtccgtcagtaatggcgagtgaatgcaagcaaaggtggtggatggctagctttgccgtgtggagagaaatctctctacatatgcaagcgcaagcatatgacatcgcatatggcagattggcagcatgggtgatgatgatggctactctggtccatgggtaatcaacacgcaacagagtactactattgttgcatgatcagtactttgtacaatgtgtcctatttaatgggagagtttgttctatcgtttttatcttcgatcactactccattatgtttgtaatatgatacagtaatttaatagagtaatgtctcgatctacgaatatataggggtttttttagctttaatagtataattctatcataattgtctttggctgtgtttagttccatgccgaaattggaagtttgaataaaaaaattagaagtttgtgtgtaggaaagttttgatgtgatggaaaagttgaaagtttgaagaaaaagttaggaactaaaccaagctttttttccctaatagcttgtttgatttgaaagggattgagagggaataatttcacaccaaaataggtgtggaataaggtggtgtttggatcagtgacaaaactttagtccttgtcatataggatatttggacactaatttagagctttaaatatagactacttacaaaactaattatataaatgagagctaattcacgagatattttttaagcctaattaatccataattagagaatgtttaatgtaacatcacatatgctaatcatggattaattaaactcaatagattcgtcgtccagggttatgtaatgagttttttttattagtccacatttaatacttctaattagtgtacaaacatccgatgtgatagggactaaaattttttacccccatccaaacaccccttatatcccttccaattaatccctccctcaaggggattaaccgaacaaggtctaagcgtgaagaaattcaagatgatacattacacatagatgcaatactaaaggtacatgtaccaaaaagatttataattttcgatgatatttttagtggatgtataacgtgtgtacatgcacaggtttatgtgcatagtatatatcccaagttaaatatattaaacattatagtacaattccagaagataagacggtgtaatgattaatcatccgtcttaatacgcaatataaatgatcaacttttttttgacataaaactttataataatgatcagcttagtacaagagtaatcgcgtgatcacaatggtcctaggtgaagcaaggactagctgtgaatttatagctgagttatagcatatatacgaaacagtacgacattattttgtggtcctccttaacccagatgtgcactatgaccacaccctccattggttattggagaataaatactggttgtttacggagactaataaaatgacagcgtactaaacggtaatatatagtcttaccataaaaacatatgtagaattaatttgaaaatgcattctttcttatttttttctttatttaatttggtattcaagtcgaagaagaaatacaagaattctataattacttttttctttttttgcgggttataattacttttttcaatgaaacatcctagcgtttactcaaagagttacacacaattattacataagtcacacagaaaagttcacaatagcagaaacgaagctaagcaaacacaaactaatagacaccaatagaagaaaaagatcccctaactactaaagaattctataattactaaataattttttcattgcaatattttattcagttaatatatagttattttgttatggaaaaatagatagctaatctaatatattaattaatttttttgggaggttgatagttcatttgttggagaagagtcgattattctctttatcatttcatttatcatttcaccattgatcatctagagtactccgttggggatagaaattccataatgaagtacaagtcataagcaaagcaattatatttcattactatgatagaatatgagtttaaataaattgtatctgtgcagaatcttttcaaatagatactaaactccttttattcatatttgttcatggatagcaaagcaatttaaattagtacagaaaaccagactaattgttacggctaaaagtaaacactaccaaggatctcccctggtagatgatgattcttggtagaaaccatcattgctgtaaaatcaacatggaactaattatctgacctaaaattagagtgacatggtcgctcatactatctccatcctataaaaatctggatacacatatgttcagattcattgtaataatttattgtactataatgtgttacatcccgtcccaaattcttttttttgaaacggagggagtacgtggaaatatgtggaatgtaccgacatgccaatgtccaccatgtaagggccaggttgtagttgggttagaggatcttattccgaatcaccaatccaaatgctattggatgaggagtctttatcggatggcggcgaagaatttatttcttcggccgttgatata

SEQ ID NO: 65668 - DNA, 2152 bp, Oryza sativa
ttaacccattcatctttcaggtaaaacttatcactagggcatgttgagtttgctccacaagagaacccgaaaagacataactacaccaaccaactaggacacccctgaagcacccactgagggggagaaaagatagctatcaaatctttttagggctaaagatctaatgaagctgtggtcaaagagatccttctttgtctcttgcaggcaaaaaattgaacatgcgctttcatctattttctgcttaacagcatgacagctagctagagaatttaacccccttacattccaacaaagaacattccaggattaaagaacagaactaaaggtccatgcatagcataacacccacagtgaccatgtctgacacaaaaaaatccaaatatccaggcagacacaagagaggagctggtactgaataagaaaagtatgacagcaaccccacaggctttaattacaagtctagtcccacaaaaataaacagcaattcaacccattaagcaaatcatggagaagcatcaacatgtttcccagctctagtctgggaagtcaaggcctcagctgacacctcctccttgccaagaccacaaagatcaacccctatctgctgtagaagctgaatagaacaatcaaagggggcagcgtcagtgtcatcaccagaattaggaggatcagtgaattccaggggcaatggattaagggagaataaaataccactctcttcagccaaagctttaagcttcttagaactcttggcctttgtttttctccttaggcttacccacaccctgattgggatcaggggacatgaagccatatgtcaacttgttgattcttgcactccttcttctaccagagtcaataagaaccacttttcccaaatttcttttacccctgctaggcttgggaagcagggttggagatatgtcctgttgaaaaggattagctgggagctccaagggggtaggatcagcatgagggtaaacagcttgaatgggctgaactgtcaaagcctattgagcagtccaattatccttggcccagatcaaagaagaggccagcagagcaaactggaccatctgatgaactgccagctgatagtgggctaaagcattggtctggcccagaatacatccactagcagcattcagccttggcccacccagaacaaacctatagatactgagcaatttccagaattgggggtaaactagcaaggataaaatagttccagatacatcctgcactttattgacaatggatctaccaggaattgaaacaataggtgcatgactttgcaaaactagaattatttgccaatcccctaagtattgttgagaaacaacacttatgttatgagactgctcttcatgggcttcattattgctgttctcccccatatcttcatcagcattttccaaattagcatttccttgttgatcaacttgttgtggctccagaattggaatatggtttactagggcaggtcttcatcagccggctgagcattagcaaagtccccattcaggacaaaaatagaaatagtccaggatcgcccaactcccccaaaactagtgtactttttaatcactatcttggaggggacttcttctaccatggagaagatgactttagccagaactctgcctctgaacctcgggtcgttagaccatctaagcaatcgaccaaatgtgcctactgccttgtctataatgcggtcagtttgaagatccaaaggaaaatccagaaacatcacccaactttgactaattggaggagaattacgacaagtagaagtgttgtcatggtaggagaaccttagtacaaactgataattgaccaaataggcccccctaagaactagggcatctcttaaaacaacagaagctaagtgaacataagcaaactccgaagcatgcctactagtatccaaaacatggaatccaagagtattctgaacataatctactatcatctggatgaactgggcatagagttcaagcagcgaagggggcaagaagcatcttcatgcctcttcgggggatcatctgtgataatcaaatccgcacgagggaggcgatgcatccaagcatcattgatggctattgcaggggcacgaacagggttgggtctggattaacattcgccattg

SEQ ID NO: 65669 - DNA, 6340 bp, Oryza sativa
ttgaattatcaacagagtcagcaaaaaccacgcccttacctttagacttatccgaagaaccagcatcaatcactcccttgaaattagactttgaaattgaaatacttgatgatcctgcattaaccccgcctgcatgaatcacgccgtcgacagcagaatgattgagacccttaccaccgacggtgatcgccggaaaagaagaagaaagccaatcaaaaacaaacttaaccggaataagagaattgcccattcgaacactagagtgagctctaagaaaatccttcggtcatgcggggaccagcacctactacacctacaatgggtggcaatatttcatcttattttttttatgatttttctactttgattttactttgattatcttttcaaacatcgctcagagctcacgaaactttactttgatttgatttgaaaaaaaaaatttgctactagaatgctgctgagtacacagattcctgatttgtggttaaaaacctgtgacatcttttttttctttcattggactacggtccactctgcctccaaatcagttgaccaaatctcatactctttgcgccaatttggatcactgtctctccaaaggaaaaactgagcttcataatctttgcaggagaaagattggagggtgtaaacccaaagcccaactttctttgaacacaataagaaactataacatgaagatcacccggagaaccaccaatgcaagcacgcaaagcaagagcagcagatgaagaacataaacggaatgaagaacgagggaaatccaccactaggatgaacggacgacgagagaaaaaccgggaaaaatgcaccggagaatgtaacctggagaggacctcatccccaatgtgatcatccagggagaagtcccaccctcccggcggccctgggctcaccatcaccggagaggagcccgatcaccaagatcgcctcacaatcacctcaccacccttccggaaaacgcggagctccagtcttcattaattgggtaatattgacggtagaaattattcaagtaaaatttgagggctctttttagatcatggagaatttaagaaaaatactctggaccacattcgcatttttcttgtacgcattttaatgttgccaatttcttttaggattttaataaattatattattacttttaaaaaatgatttttaatttggaatgaatttatcaggacgtgacaatgaccatgcattttcgaagtctataaaatcgaggggcttagaagatgtatctcccattaactaaaagggaaatcccatctcatttattcacatcccactacatacttcatgaaaaaccctaactaccaattacggagtgcatttggtagccccaaagtgacttactttgagctacaaggattctacaccaaaactacttgagatcaaccgatgacaatttataatccttagaatgtcttatgttctgtgtatccaataatatggtctacaacttgtggacgatttggcatctctatattatacacatgagacaagattatcaattaatacctatgctgatgttggaatcatatttttcatatatgatagacactcgttgatcttatgaaaataacaagtaatatcacataaagattctcaggaataagtcacacactcattggtcaacaatgaattatctatttcaaggaacactttattattaatttataaacataatacatggtacaatcatatctatgagtaactaaaccagtgtagctcgactaatagagctccataggttgtctggttgtgaggtttaggccatgcaccaagtattatccgcgatcacatcccacaaggttctgtttattcgtttggatattgcatatgcttgcggcatggcatcttttggtcatagcccattcatcccgactaaatcccagaatcgggttgtggacccatccccaatggtaatgaaaggccaccataggttgttggcgagcatgttcttttccatttgatttgcattttccacccgttatgttgcccatacccacccagaggaagctctttctctgcttgtcaagcacttctagagattccttagtgacctctattgatgtcaaaaggtaaacgggctgcgaggagagcattgacttgaccaacgtagtgcgtccggttagcctcatgtttctcccgcgccaagttgccattctacccaaggttttttcgaaaagaggttgtaagtacaacttacgcaacgaccgacagcaagaggtagccctaggtatgtcattggcagggatgctctcaagactagtgttttctgtagcacgttattcagatctatgctctcacatctgattacttttacctgggatttctgaatgttggtggagagaccagttgcttggccgagtttgcatagcaggttgaagaaagcttgcacttcacttttgacaggtttgatgaaaactgttgcaccgtctgcataaagcaagattcgaaggcgtgcagatcgacctcccagcttactaagcagcttcaaatccgtggcgttgtcaagcagccgttgcaacgggacgatcgcaaggatgaagaggagtggcgagagcgggtctccttgccgcaaccctcatccatgtgatttgttaagttttaggtaattcacgtacctaaaagtaaaatgatatgatgatttagggggcgcttggaaatggaaatagcacaaaatttatggatgtgggtggctgaaccgaatggaattctcagatagcacctaaatgtaatacctaacacaatagatgggttgcgttaagctttcatgggcatataaggtccatggtgaattggagaataaacctacatatgtggagacaaagaacgaccgatcatatcaaatcacaaatgattatattttgtaaggatttactgctatattcatgcttcctttcagtgcacgacagaacaaaaaacaaaatcaagcaactctctctctctctctctctctctctctctctctctcaacaaaactaaagaaaagattagataaagcaacgtaataacagtgtcaaacaaatggcaaaccagtaatcaacattcaacaacgtattgttctcatggtacttggtagtcgtgttaaactgataacagtatgtaagcccaaaatttaccaagaaatgatccaaagaacaataaatgaggtgatcatttggtgtcaatggctcaaagcaccaaggaagcatataggctaaagattttgtttatcagaagcaattgctcgactatgtacacctggactgttgttatgtcttaggtaaggacagcatgaccgaaccaaccagctcttagaggcctaaacgcttctcgagcttctggatctcatttaggaatatccaagtcatctgcacaaaagatgtcattagttaagaatggtagaacatgcagatgtgatgttttctgctaagcaaggaagaaatgtgtgataattgcattaccatggcatgtggtgcaatcctgacacagtacacaggaaagccagtgtagaacttaaatgggcctccactcttcaaggtcttcatggcacaatcaagagacccagtgtatggatacttcccggaggcatcaggctgcatcttttgaatctgtgtcttcacataatcaaagggtaaactgcaagcagacgcacataaccctgaaacagcactggcccctgcaatcaaaatataaaatcaattttgacatgcaaataatatttaggttggcactactcaacacatttgttgcacacactaagcacatgataggagacttttagcaggcctactatcatgtgcttattttcaacaggtaagtagagtttaagtccaaagagcataacaaaggtagagatcatgaacaaaatataaaaatattagtggaactatatgaagacatctgaaatttttaattgatcaactttgttcttttgtgcccacaagttgatatatatgtctggaagtcgacctatagaaagttgcaagcattaagtcactctggatccacatcctcaaacgcttgagaaatgtttgatagagaacaggtaaatcagaaagattgcatgaaaccgaaattcaaatgagtattatcttaccaagtacagtagtgacttctccagcaccaagtgtgtctctaaataactccacactctgatcataggaggcaagcatgcccatatttagcgacatagctctcactacagttggacctgcgcccttccaaagtgctagaacaccttcatcagcagcaatacgataaagtgcatgaaaagcattcttataattgcgactttgggctgctggcaacgttgaatcagcctgcatcctaatgagtgccaaatccgcaggactaccaacacaggctccaattgctcctgcggtgagaccaataccagctttctggactagaggcagtggcttcccatcatttgcttcaaccgctttgtttgttagaaccctgagggaatacagtgtgaagaaactcaaccaaataacacaaccaaagtataggaagggaagatcagatcaaaacagctgaaaacattgcataagtgactttccagattgatattcatggttatggtaaagcctaacagttaacctttcctgcttggcatagagcaatgtcagaaaacttgactattgcagcattctttcttgaaaatttgccaaaggttacttctattattcacaacaagagttgatgggcaccgacacttgtactaggacattgaatccagctgggtaggaggttaaacacctcccgacaacaggacagaaggttctattattgattctctcaagaatccaacagttatattttgctgcaacttacggaattaaggcaatgtaactttatctacattagtgaccctgcttgacaaactgttcaacatgacataatcctgaaacaaaaccatcgatagattaaatggttactacaagaggagtccttcagaggtgcactacacttggtttgtttgatactctttagctgaatacctgctagtaggggtatcgggcggtaatgcacttaggctgagtttgctaggtatgaagtgtcattgcttcaaaaacaaatatatgcatctacaggacagttataagatccaagatagtattgcactttgctgttgtattttatcaaccaaaaccacaggttttcatttcaatacaagataatattgcatactgctgatttattattcagctgaaaagaacaggatgtcaagtcaaagctgttaattatttgacagtcactttaacttactagcaaaagatattatgggctaagtagtacgtacaaacctaaaggatccgagacgagcggttgtgtatgttgcttgcctgagcaaaccagcagacaagccctggacacaaagaatttaagcaataacagtttgagtgacaagaaagctgatgatttagaataatttagaactatgttacaatagatattagcagtcaaaggacaattatggagaccatgtaatagtcaagtggtacaagactacggggttccatccagatgatgtaactgcaggttccgtacgtgtgtaacatgctacagtactgggttagtgcacaacgcaaatactggaatttttaaaccacggcctcaagacaacgaaccttgtagaaggcactaattccctcatttgcaagcattttcttggtgacagaagccgccgagccctcacccaactggatcctcacctgcacaagcatcaacaaatcagtaactgcttggatcataaaacagaaaaacattgtcccacaaacgtgagctcagctgcaaacccagattcaactgctaattcagagcaagaaggtctcaacgaaagcaaccgatgaaggttagaaggtcttggcagtaataatagtaccccctccggccacggaataatgctgttttagaggccgtgtagtccacataaattgactttgaccataaaatttgtttataacataagtttgaaaaaatgacatggtcaagtttgttatgaggaaacattataatattacactagcgtaactattttagatttatgaaaaagaattaagcagccaaagctatgtcttactgaatttaaaaactccaaaatgacattcttatccgaatcgaggcctcgagggagtaaggaatctcccacgagatgtacaactacaagggacctcctttccaactgtgctaactcctcagccatgaaaaatattacaagacatcatcttctcgatgttgagctaaacagtcgaactagcattcggggccagcactaaaatcttgaagagggaaaaccttctatactaacgaatgcaaaaac

SEQ ID NO: 65670 - DNA, 3530 bp, Oryza sativa
catccgcacaccgctcatgtttcccttagaagccattccgcacaagcctagcgcaccaactagccccgcgcgcgaaccctcacaccaaacctccagcggaggcagggagccccagcccgtggggcggcgttcgtaccttgaccatgtcgatgggctggatgacgcaggtggcgagcatcccggaggcgccgccgttggcgaagggcttcaccgtcttccacaccccgctcgccgccgccgccgtcgccgcctgcggctgctgctgctgctgcttcgcctccgccatctcctcctcctcctcgctctcctgtgccgcgcgctgctgcagtttgggactcccggagaagaggaagaggcagtggtggtggtgggagtgggaaggaggcgagagagacgcgtgtccaatccatgggcgctcgcaatgccgaggagagccacgaataatattaaagtattcttctctttttttttaatctttttccgcgacgtttttctcgtctctcatttttcttggtaggatcattctctgcatggtctgtatcatccgcgtgctgcgtgcagccgtccacacaccattgaatgtttcgtcatcttaggaagaaagtttgtgttttattgttcaaataaaagtttgatgttggtacgtgtgttcgtacttacggttaatgttttgtctctacattatatccacaactaaatacaccattcacgtcagtcaaaatgtctctcctaatatttagtaaaagagatggctgtgatataaaaaaagaaatataaaatattctcaaacattatgagaagaaaataaaaagaaaaaggagaaaaggagtgtatgttcaccaatgttcttatgcagcatgagagaaatatagtttgaacaaaaatagtcatatgtccaattaggaataaaaagaatctatggcaaagtagtaccagtgggcgttcggtttttatagttttcttagttcggtgttttttgtttgaaaaaggtcggttttcgatacgtaaaatctaaatcgatagcgctctcgtttttttttcctatcgagtaacaccgatcatatgtgagagaactagtactatacatctataatttgctatcaggtcatacatgtcttttttacttcttatagaattttctgttaaaatacttatccgatttcctatctggttggactgttgtattcattgcaacaaaatctttataacaagatctcaaatgattatattctaataaaaaatatgtatgcattttaaaattactttttagacatttatgaaagaaaattcaataaaacataaaagtaatttacataagtcataaaagtaatttagcacaaatggaattaagttgtcacgatattagaagtaaatccgttctaggggtaaaaacatgagtcaatctagactttggagagtgaggtcacttgttatgacaatcgagcgcgcactctcctcgtagtcatggtctcctttttggtagttgcaaaccgaattttcaaatataagagcaagtttagtagtatagtcaattactagttccaaatcgtttatagccaatttagtagctaattcatacaatagttacctataaatatgtactacactattaatatccggtcccacctatcattcacacattatgtcttatagcccgtgctgcagctggctacaaatttgtatcccgctgcttatctgttttatttcatctactcgatatgtgtttatagctggcttatagtgtgttattgtacctacctaacaaacaaaccgaccaaaacaagccaaaccacttcggctcagttctcggtaaaaccgagcgaagggctgatgggtgcagggcgctcctaatgagcgactggtcgcgcaggagcgtgggcgcgcgaccagttcgctcaggggcagagcccaatgaaccagggggtgcccaggaacccggcccaatatttaaaataccttgttaccctcatatctacagcatggaggcaccaccctagcccaacacagggaacccctctccttgaaagacccaaccggaagaaagccccaaaaccaaaaattacgcagtgggagacactaaaacgcctagcgcacaggagtggccgatgcggcgacgcttcccatcgaagcctcacgtgatatcaaagcggtagtttcgattttctcgcctgagtcgcctcaacgctcaatctctctcctcgctctcgtctgacctgtcgcctctccctggaggtcgcccttgcctcgccggggacctagcccggcagccccaatcggggaaatttctcatgtgtaaagcctctccctggtaggttgcctcttttttccaattttttgcactgatcaggctagggcttgcaactatagaggcatatagaggtagatgacaggggcaggaggaggaggactggaggaggacgacggcaagctgcaagctagcaacggccaatagctggagcttgccggctgccggctcgccctagcttaccgatctactctgagccccacaaaaattgcagccagcagcactagctgagggcaagtgttatggtagatatgactactacaattaaatttatccacatcattcactcataaattaagaggcaacctatacactatgtctcctctagtacacaaataccaatgtctcttatactctcacacccctcttgaaatttgtgttgaggttgccttttcatttaggggtggttcaccatctctctcctcacttctctcctccacctcatcactcaatccaatgtggcacatttaggggcagcatatggagcattatagtacttgccctgagagcaactgaataagtgaactctttctctcaatttttcttatccttagtttgtagttttgtgccaaaataaacttgaaaatttttatttggtcttaatagattgctatatagcaccggatagtacgaacaatatgaagaaatttgttttattttgtaccaaatcatttcataacttattttctgttgagaattaaactatattttcaaagtcattgtcctatggaggaatgaagacgttgacattcgcatgatatattcataagattttgttaatggaggtctttgtcaatggttgaaccattatcaactttacaaatattattagttgatttctttattagggtacgtattttttaactcttttttatgtatttcttgtggtatattatcttcaaatgaagaaataatgcttatatttattggtatgcaactatttagtataatatcgctctataactgtagttgtcattattacgtaaagaaaagtagaaacccctcgtcttttctctagctccgcccctgagttcgctcctactaccgctggtgctatactgctcttctagtagtactactactcctcctcctactgctcctaccgctgctcctaccgctagtgctgctctgctcctgctactactactggcgtgcgctgctgctactagtctactacagtagtagtactactactataacaatactatacgtgtgggctgcagga

SEQ ID NO: 65671 - DNA, 4169 bp, Oryza sativa
ctagatgggctagcagccgtggacttcctatatgtgggctgtgaaaaattgtagtagatgggccttaatagtggtgtgggcttgaattagaaagagaacaaggaagattgcagcctagtttggattaggattatacggtatgttcaggttccaccttctaaacaccgagccgaacaccgaactccgatctatgtaaaaaacaacacctaaaaaagaacgataccccccaaaaaaccattatctccgtttggctcggctcggttcggtttccaggaaatttgtgctcacgctaaccacataccaccttccaccatatagccacacttgtacatcttaataagtgaaagggtcaattaagcctagaggggggtgaataggctaatttaaaactttatgcggaagctaaaactgagttagggtcggaaagtctgatccacagtcagactatccgaaaatatcagatagtctgatgttggatcagactgtctgatccactaaaggaagactacaagtagatctagtgcacaaacaagagtatggcgcaaacagcgactagatctaaagtggcacaaaagcaaagctaaataataggagaagagatatcaccaacaataaagttcaccgagttgttcccggagttcaaatccttgaggggattctactctccgttgaggagctcactaagagccgggtctttgctaaccctttccttaagaggtggcactaagcactcctccttccactaaggggtatctctttccttgtggagacgagatccggccttcacaaacttctcccggccaaccacacgtagatcggtggctcgggagtgacacctagccgtctaggagtcctcaacctccaagagtaacaaacaccacacaactcttggtcaaaccctagtgctcaagatcgagtgaaacacacactaggccctcaaacaccaaatccacaaccaccaagatccactacacaaagaacaaagagggatttgagagagggagagagagctcaaagatccaaagcactttagcaccaagctcaacccaaagtgaatgtgaatgaatgagttgggtaaccctagaaaagggttaggtggggggtatttatagaagcccccaaaatgtggccgttgggagagaatcttttcatcccacctcggaaagtccgaggtgacatcggatagtccgatgtttttgactcccaagcaggccagagatagagaatgaaattctggagaatttcggacaatccgatcgatcgggtagtccgatgtcatatcggatattccgttatttttgaaccaagaatttcatcctctcacagagactcaagttccattgaatttcggagtctctggatcatcggatactccgatcacatcggatagtctgatttaaaactcactcaaaaggaataaaaagcatttcaaaacagagagtgaagttctgagaaatttcagatagtccgacgtatcagatagtccgaccttatatcggatagtccgatatttttttagccaacactcagaccgaagacagtgagcaaagttctgtgaaatttcggatagtctgagcatcggatagtctgatcaacatcggatagtccgacagacataaaacaggaatacttcaaataaatgattttgagcactagtgttctaccaattatatgcatatgacatccctcttaatagtacggcatcctaatactcaagaacacaagatatacatggattagaagacaattaccataaaagatgccgcaatacttattgtgttgacatccactcctttttcatccttgcatacatctcaacaaaaagcattagttaccctctaattgtgttgtcattaacaccaaaataaatgaggggtcctagatgcactttcaataagattgtataatttgttttctcattagatcctatttttgattttgcaatatatgtaatacaagtattgtctcgttattttctcccaccttgagctccacgtataaacattttagagatagaataaaaaaaagaaggcaatactatgccttggtaaggaattatacgcattgaacgatatgcgagaatcatttgagaaactttgggttttatttgcataattcgtgaaaccctccggaaagaaagttgaataaagagtaagacaaggagaaggtaaaagccccatgggaaataaggtaagagaggtaaaagtactattatcaacttattcaaattatatatagaaagacatattctactcatggcaacattgtgacataaaacaaggtagaaactcctgatcaacaacctagtttatctttactcgagtacgagcaaaggtttagtttgggggtattgttgacggtcattaagtaccgatttcgaccatcaactacttcaataaataaaaggagaactaacacttcatccacgtatattagttataaataatgtagtttcatttgtcctggcgaattactatgtatgcaaagattatacactaaagtgaaggagaaaagagccaacatggaaataaacacacctctggcgaatcatgtgcgagtacacagatcgatgggcccacaagtcatatgaaactgatctaaagtggagccaaaccatcctcaatcgctacagagacgcacctagcagcctttggtgaaaggcagtggagaaaggtggcgcccaggggttggccggaccccttgttcggctgaaccgccatcagctccccacatctccaccttccaaccaccatacaaccatcattacaggactatttaatgatgagagtttctcacttcacaatacacacatcaaagagccattctctcattccatatattgtattctctcgagtaatagtggagttagccttagagtagtcttcggtactctagtcctctcggagattcgggtatgtgtttagtactttactcttctgtaagacaatagttgaaataaaggaattattttgtttacttattagtgttcatagttcatatactttactggttatgtgttttataaatagttcatactttatttatatgcttcacctgattttcttggagattcgggtatgtctttagtacttcactcttcttgtaagactatagttgaaataaaggaattattttgtttacttattagtgttcatagctcatatacttcctattggttatgtgttttataaatagttcatactttatttatatgcttcacctaattaggctagtcaatttatgctacagtaatggtccaattatcataacgggttgcagtagttcaaacttattcatttgaagggttggagttccaggggaattagtgatattatttattaatataagcatggtgctcaggttagttaaatatcattggatgcggtatgccccacggaaagtgagataggtggcaggtgatgaaagccctatccatcctttgtattcctccacatccaagtatgacgtaaccatgctagtagactaccaatggtctctcggtagtacctaggtaacttagaactaaattctaaccttgtaagcatgtatgtgttaagtgtaaataaatattagtaataacgaagtacgtatgaatcttaggtctctttagtccttctccactgtctagtgtatctttatttgagatgaatctcctacgtgtcacactacctaaactaccattatcatcttaacccctgtttagactatgataaagtaattatagcataattacgaatatatgaaaaatatgatactcccggaatactcctaagtaaaatgctaaagcagtatccgttcgtttgtggatttatctatgaccataagaaataccagcaacaagcatgatttatatagaagaaatagagagcccccagtattagaccatagttagcctaatacacgaaacgctcgcacaatagatatttgtatgaaatatgctttaggtaaatttaataattaagttactgctccgttaaattgtatttaatatgttgtgtaactttattgatatatgccggatatagattattaatttaaaaacctaatacgaaatggacgtaactatacagctaaccactccatctataagaggcaccatccaactatacttcaaatataatttttctcttacactactcatccgatctacgattcgattacaccgttgt

SEQ ID NO: 65672 - DNA, 3420 bp, Oryza sativa
ggtgcaggttggcggtggcaccttgatcccctccttgatctgaacccctctgcggccgtcgccgtcgccggcgctgttgacgaatccgagttcgcagcggacgaggaagccgtcgtccttgagaaaccccgacgtctcgagctccgccctcttgatgttcatcccgaagtcgttcccggagaagtcgacggcgggcatgccctggacgaacgacggcggcgccggcctcccgtcgcggtccacgaggctgaacctggcgtcggcgatgaccggcttggcgtcgccgccgccgcggcggtaggcgcccgcgatgccgacgtagacggagacgacgccgacatcgcgggggccgtggccgttggggtagaaccggatgaaccagcggtggccgccgacggtgaagttcatggcctcgatgaaccttcccctgcggaggttcttggtgcgggagtagccgtcgatcctgacgaggtgggacaccgtcgccggcgcggcggttatggagtacatggccggagggtggctgggggggaagaggaggtcgacgagcgacactagcaagtccatgatgatggaggaggaggaggcggctacggcgacgcagctcgcgggatcgcgcgagatggatcggctcaggcggtgggcgatcgaactcgcgaggagacggggaggggagatcgagtagggtacgggagggtaagggtagttatcgatgtggggtttatatttgaagttctgaacgccctacgttctcggctgaaacagagtaatgataatttgtgttctttacggaactgagtaaactgtagtgttataaacatctcttctctacttctgcacaaaatttttggtacgacatcctattcctattccgatagaatatcagtgtacgagtacgtggtttttatttctatatctgtacttaaaaaattacggaaggcttcggtggatttttctttatgaaactctggtccggccagcatcacctgagcacgctgccaactcgcgcttgcgaaccaatcctcacggatgctcccaatgcccatctgttcctccgtggttgctgccaagatttgcctccacttttgcctaggccgtcgccgacacaggacaagcttcggcatggctaccaccaggggcatcggttcctccacctcaacttcctctgcttaagtcatcttcaccaagatcctcacgctgacctctcctaccatgttgccgccacctagcactagcgcctgtctaccccgccaccccgacaccttctccaccgccggcgcactgagggactcatcctactaggaccttgctcttccccaacctctacgcaggccgagagtcgccgttaggccgctggtgctgccctgcagccatccccaagccttgccgatgggaccctgccccttgcacgccgccccaactcctcttctacatcatccgcatctttggtgtcctcccccgacctctgtgctcaggacgccaccatccaacctccgctgcctaaggggaaggggcgtcctcctgtatccgtagtccctcgatagcttcgccgctctacgcgggtcaccaccagctgcttccttcccctgagcgtgtcgttgtcgcctgctcaaggttgggtgagggacacccatttatccggcctggtctgatctgtaacctctgctcctcttagctcccacgcttatctcttcttgtgttctttaaactgaagagagaacatagaataatctttctgcagacatctggaatttagatctttactgcacgcaaatagaatatgaaccattttagtgctctttatctccccttgcatggtgtccgcgcggtacgacaccaacgttgttcgtgtgtgaacctctcggatcatacgggatggcagaagctaccgacttctcgaagtatgtttgttgcaagcccggtcactctatttggcagtattataccggcatgtcagtgtggtatcatcacaaggttcaaaactaaagacattattacactggtttattttcaaattatcacaggctccaaacctgatatgaagctaaacttgtgaagctggaaaaaggtactccctccgtcccaaaatatagcaacctagtactggatgggacatatcctagtataacgaatgtggacatactaggttgctatattttaggacagagagtatgtattttatagggcagatccacccactccggctccaggctccagctcctcggacaagatagcggttggagccatgtcaaacatgcccataatatataaaaaataacttccagctgctccttgtctacagacaagaaaagaaatggtagaggcacggatatagactgtatagtgaatatgcttattttaaaaaataaaaataaagagcaacacttatgttagtacaatgcagcactgaatagtactacattactaaaactatatactgcaggtaagcaaatcacattgcatctaacttttcttgcaaaaagtaaactgtgtacatttctgatattgttccaggagatccactgggcaattagtatctcaattgtccgcagattcttctatggttcgtcgactaaattttctgtttgacttctaccataattccatagatcatgaagttcacctctaaaccaaccaagtataacaataagccctggaacgagaaatacatgggagtcgtcacttgcaatgacttaagagtcatatggaaagaaaagaataaaaacaatccatgattgtgtgctaaaggaacgatgcatatacttacctaatgtacatggaacaaggtacagcagcgcaggttgaccatgcccgtccatcaggaagagcgcaagataggtaaggaaaaggcctacatgaaaaaaaaaatgtaatcccattacgacatatccaaggtctccacaaacatgtgttcatgccataacacaatgacatgcatgtacacatgaatccattttgcaaaaaaaaaaaaaatcaaaatcaaaataaaaaacattcaaaataaacaagttagccattgtcaatttcattctaaaaagaaggggaagaaaacaaagataattcctgcaatggaacagtaacattctccctcgttgattggtactccctccatccacaaaagttagacatacttcacatttgagtttttccaaataagttgttcttatttgtagtctttatgcattcaagacttaaatgaagagataaattaaatgtttgattagaaccaaaggagtcatctagatgttagaacttcaatggttactctcattgagaagaggatggcactcagagtggggcaattttctggttttcttcattcacaaactcaaaagccatacctacccgagggaggttggatacatatatatagccatagctggctgctagcctattgctgcaccctcctagtctaaaatt

SEQ ID NO: 65673 - DNA, 1395 bp, Oryza sativa
tcttttccaccacgtaacatcttggtaccatggtacactaacttaattagcaatcaaacaaatcatgaaacgtgataggaactttcaggagccaattagcatattgctttcatatggtgattggtgaattccattttctgctaacattctcagtatcatttgattttaaataaaactacaccctacggtaagtgttcctaaagttttcagatggtttacaacttcactgttttgatttgggattatgttttcctcatcaacagtatatttaccaacctaccgacactttagcgtccagtgaaaccaaggcatcaaaagagaagttacaacttatattgcagcaatatatatagtataatacctgtagctgaatgcaactagcaatccagggaaaataatgtcaccaaagcctatcatgtcatagccaccccatggatcaaagaaacgaggtattcttaagagcatcggaattgcttccccagagttatcaccacgagcaacctgtgcagtatggatagaatcatatctaacactataacacttcataatagataaaaggtatatcttacaggacagatctaactgaagatacacatatcaaacttatatgaattgtcttatcaccaaattttctaacctccaagtgaatgctttcgaattagattgaaacatagaacaaactaacaaaatagtacgctattactattagtaagcatgtgctactatctggttttgaaaataacatggaaactagtagattcatgagccacgtatgcagcatattatggtactattatcaccactggataaatccacagtactaaacagtaagtaataaaaagattgttgcaaaaaaataaaaatcatgcacttactgcaatcatgacactttcatggaatataagaggtgaaatgaacacccagaaaacatcatacacaaatgcagcactaagaagagctgatgcaacctgcaaagttatagtcatgatgaataattctgatacacatatgaaacatataggttttgcacgactacattaaacttaaagacatggcaataccctgatatttggtaagcgtgccatttgaagcacagttatcatcaggcagattccctgaggacaataaacaaaccccatggttaataatatctaattgattttgcaaaggctctgctcacatgtctcaaaacacagaaggcaagaaatttaacatctcacgtatgaattattacaaatgtgcaactaaaacatagatttgttataagactattccacacttcaaaataaaatcatctcaaaaataaaaataaaatggaacaaccagacaacataaattttgacacatgcatgaaatgttgatacaatatccaacttggaaactgggctgcaggaa

SEQ ID NO: 65674 - DNA, 7959 bp, Oryza sativa
tgatgtgcacccagtcttccatgtgtcccaattaaagaaatgcttaccagtgccggaagaacaagctccgctggaagagattcacattagcaacgatctcacgtatccagaacacccgatccggatattggatgaagtagaaaagaggactaggagcaaagtgtggcgtatgtacaaggtacaatggagtaatcacactgaggatgaagccacctgggaaagcgaagaattcttgaggacggagtacccgcatctattcgaaaactggtaagaaatctcgggacgagatttatttaagggggtaggtttgtaacaccctgaaaattcgaccgacaaaatcaaaactctaaaaatacggattttcaaaaactttttaaattaattgcatcatgcggatcttattcgtctattttatctggatttgatctcgaagattattaatcgtgagtaaagaatagttaattaggaataaaccttaaaaacaaattggtaaaataaatacaaattaaaataaagattaggtgtggatagaaataaataaaatattatcgcgaccatatttggatcaattaaatttaaatacgatggaataagaattaaccctaattaaaactcaaataaattatataaaaataaaatatgagtaatattaatctagggtgaattcattagttaagataacacaaatattgagtaaaatgcatatatgcaaaattaggaattgtggaataaaatttatatggaaaatacactaaaatcgggacaaatagaaaaagtcactattcatcggccgccaggtgttcgacgtggtcccctaacccagctcctcctctttccccctctctctctctcgccaccttcaccacgcgccgccgcctcgcgccccgagccaccgcgcgccgtcgccatcgtcgcctgccgccgcgccgccgtcgccatcgccgcctgtcgccgtcgccatcccatcgccgctgccgcgccgtcgccgtcgcgtcccgcctcgcgccgcgcgtgcgtcccatcaccgcctcgcgcccagagccaccgcgcgccgtcgccatcgtcgcctgccgccgcgccaccgtcgccatcgccgcctgtcgccgtcgccatctcattgccgttgccgcgccgtcgccgtcgcgtcccgcctcgcgccgcgcgtgcgtaccatcgccgcctcgcgccgcgcgccaccactgccgcgccgtcgccgtcgccatcccgtcgccgcgtgcgcgttccatcgccgcctcgagccgtgccgctgccgcgccgtgcgccgtcccgtcgcctcgcgccgcgcatccgctgcctcgcgcccagcgccgctgccacgtgccgcgccgccttgcgccctgagccgcgccgcgccgtcgtcatctccgcccgcgcgccgcgcgccgtcacatcgccgccgtcgcctcacccccctccaccgcccttcccttctcttccctctcccccttatcctctctttcccctataaaagcccaccaatctcccctctccccactccatcccctcctcctctcccttttccctccccatctccacgcgtcgccgttgttgtcccgccgctccgccgccttcgagccgccgcgccgccgccacgaagccgccgcgctgtgccgcgccgtgcgccgtcgtcgccgccgccgtcgtcgccgccgccgccgtcggtgagtcgctgccttccccccctgtttgtcgccgtgccgccgggtagagagagagccgagggagagggaggaagggagaagccgagggagagaaagaagaaggaacgaggagagaaaccgggagggagagagagaaggaaaaagaaaagaaaagggatagtgagaaggaaaaaagaaaagaaaggagagagagaaagaaaaaaaaagaaaagaaaaagaaaggaaggaaaaagaaaaagaagggaagaaaaagaaaagggaaataaataggaaattagagggagattagggaagttttgaaaatttaaaataattagaatttagttatagattagttatagtcgtagaattgcgaaatttaatataaattatggattattcttggtaatttctacaagaaatcaattcgcggtagtagtttaaatgtaattaagaactaaacgattagatgaattcttatagactattatagattattttgggtaatctctataagtaattgattcacggtagaaattcggacttaatcactaggaattttagacgtttattatatttagtcgtttagtcctagactaaaattaaatcgtataatattataagataatttttggattccgttcgatatttagcttgcgatagaaatttccaacctattatatggatataacgctcgggtagattaaattaaaaacttatgataacaaaatatttatacccacaaaatagttaggatatacaaaaagaaattgggtttgccctagtacgcgaatagtaaagttaatataaaagaatcgactttcgcgttcgacttccatttggatttatttggatttttatttgaattctaatcgaatccaaatcaattttcgcaggtaactatagagcccgagggagttgcggatccaagtgaaggccaagacccccaagaccttgagcaaggcaagtcatcactattccttgaacatgttgatcctaattgcgaaattattttgtttataaataaaattgcatgcaatgatgcacatcctacttgtgattatgccatgccttgattattgtttatccatgtttacgtatgagtccctagtcaattatgacaattgcttagaaatgctattctaggatcatgcatactcatatttatcaaatgctaaatgcttgggcaattacctttgggaaggtaattgagatgcggcatgtggagacatgagcaccacattgccatgaaattgataacatgatttgtgaaaggaaaataaagcgaaaacaactgttttcaactggggcggacggatgatttgggtggtatctgggaaaggctagtaccgtccccggtcaattaaggaccgagccataaagttaagcatgaaacgacccccgtacaaccgtacttctcgaatgggtatagacctagcggattagatagccgagcggaggcagtatccctgcatagatggttcacccctgagtgaggcaggtgcgctacgatgggacaaccgttgaggtagagccgagaggcgtgccctacatcggtgtcgccgttggtagaactgccatgagtgtgtgagagagagaacttaacttgaaccataatttaatatgtgtgagacttctctttcccgggaccgccagaactcctcacactgctagaaacatggacgcctagagtgcatgaggatttaagttcatagagcggatactgccaatgcgaggttatcgaaaagctttgccgtgacgcgcctcatgtgttgagacgaggctcatgtgttgggcagtcgcggagtgcgagtaaagtgtacatccactgcagtgtgagtgaaccaaatctattcgaatagccgtgctcgcggttattgagcaccgggacatgtattacacttggctagtctctaaattcttaacttatgtgggatgggttgttgcatgacgaatttttatgctgttggagccacttcctgagaagggggaaggtgggcgtcctcagaaaaccataacgactcaatggcgggaagctatccttgggatcacaatggatggtggacagaaccgtcgttgtttaaatacaaacactggtactaaaatttgatcagtcaatgctaggtcttaggtttgtgaaaagaattacaaaactggcttagcgcaaaagagccatagccatcctttgaaatacccctttcatatgcattgttgctgtggtaacttgctgagtacggttggtactcacccttacaaatataaaattaatcagaagcggtagatgaagcttccgaggatccctatgcctactaccaggagggagatgaagacaatggcgctcagtaggtcttagtacggtcgttgcctgtggcaatggtatgccgctgcctgaattccgctgccttatctatttttgcttttggatgtattccggaccgctcggtccgatgatttaagacaatgcctacgggcttatgatgtaataattagcactagactctcgtgtatgtgcttttggtatttcagctatgaactcgtgtaccagactacttgatccagggaaatggtactgtttacacgaatgattcctgttataaaaacaggggtccacagataattagctacggcagtttatcattaaatcgattcaaaagtcatgtgaccttaatccatcatttatttaaatttcgatgaatggtttttaagatacgtgtgactttgagttgcccttaattataatacatatcaaaatataatattacatttaaataatatggatgcccgtgcatacgcgctggccaccttcttagtttaaatattaaaattcatcaatttgagaactacacgtgaatgctatttatttgggactacctatatataatgtgcccgaaaactagggtccaaatcatacaaagtttaagttacaaacaatcaagtctacacatataaaattagattaaggtcaatattctctatagcaagataacacattaatacgggcacatattttcttttctatcaaaatacgggcattcagctggttagcaaatctctgttatggccttgtttggatcctctgggctattaaatatccctctgaaatcttgctatttagaagtattaattaaaaacgtagattaacgacaaaatcgattccataacccctaggctattttgctagacgaatttaattatgtatattaatccataattagcggctaattactgtagcgtcactgtagcaaatcatggattaatatacctcgttagatttgtctcacaaaatagcctaggggttatggaatgggttttatcagtaatctacgtttaatactcctaaatagcaagattccgaaaggctatttaatagctctccggatccaaacagggcctatgtatgtttataacagcaggtgcatattttgctccaaaggggcaaaagtgttagtcctacatacaggatggacacgtggatatgtatttgctgtcgtgtgagtaatacatgttactactgtatatatgttactactgtctgcaaaaagaataaattacactaaaaggactagatattcttgagaaacacagaaaacgccatttttttagacattcgtagttaataagttaattcagacagaattatccaagaaattctttttctcgataatataaaaatgcaactaaatagttttttcgataatatgaaaattcaactaatacaatcgaggaaaaaaaaagagtgtacttgtctccttacgctgtcaaacctagccaaagcttgttggcaaatcacgttgctgggattgtcataatcctcaccttcgcagtgctccattatcatcttcagacaaaccacgtgaatgcatgtgcaatcagagttaacaaagatcacgcaggaatcatttaggacataattaaattttgtgagccgcgtgttcgactgttcacctcatataactgatctgaaatgattccgactccatggctgtacggcactcttgattcgaggtcaatgcgttcccctgtactcggattacctaccagatagccctgacaatctcccaaacataaaattaattgccgctagatcattaatcaactactctaccgtcctaaaatatgagaacttagaattggataagatatttcctaatagtatgaatctggacagactgcctatctatattcgtagtgctagaaaatataccatccgtttctaggttttatccgtttctaggttttttaaggagggatgaagtatatgtttttttaagagaaaatgttggacatgatcctatattgtatatattataacatgttagtaaaattgcagtatttacagatcatgatacaggttgtctatccattgctaaatgaggggttttaaactatctcttggtctcaagttgataatcaactatatcttgatataggaaatatacttttgtttttttttaatgttcgatggacaccctagttatcactaacacctcaaatatatatattaaccgggagttgtagctttatagaaaaagacatgagctctaccttcagattaaacgtcggtctgacgccagcttcaatatctgaaaacagagcacaaaattgtcaagctttttggtgcgcgaactgatcgatcttgaaaagagatcctgtagaaatctggaaatggaattttaatcctaggcaatttcccctcgttgttgcttgtatttaaatagttgtgaaagaatttgaaaaagaattagaggatatattagcacaggcacactactagtaatatatttatccacaaatatgtgggagttcaaattcagtatcagtaactcataccaaaaagaatggattacgtatacgtgtgctcacgtcatatttgtttcgctaatttgtaaaatcaaatttaaaattttatgacattaatctaacttgtcaaaatagtttttttttcagagaaaatctattctatgccattaaatttattatagttcaacagttggtcatcgaatttgtctttctctataatatatcacttctatattagttataaaaaaacttctatattatattatgtaagaagactatgtaagtaaatatatatatatatatatatatatatatatatatatatatatatatatatatatatgtatatatatcttcatgttgcttaatcaatagtcactcttgtaagtcttaaggcattttaagcatcatttttgaaaagtatcagccccaatgatatattatagaaaaagtaaagttggagatatatataccatagatggagatgaagtcaataataaatcgttgaataaattcagtggtataaaatgatttttttatataactatttagatcacacataagaaaacaagagcatattcctttgagatttaaagagtaaccaaggtaacattattgcagcaccttccgagatcttctgcacgataaacgggacgatctttccggcataggagtctcctccaacgtagaacggatttgagaggtagtgcggatactcagtgaaccactgaatcagagtcaaacgagatattaaaccaagagctagcaagaaccaagtacgctgaaaacctggaaccaatggaccaaaaaaaaccaggtagtaatgaattacctccctgagaagcttgatgagctgcatcgaagcagagacgtcgccgacgtcgtaccccttagggtcccttgagaaggagaagccggcgccgaccggcgagtcgacgaagaggatgctggcgacctttgtccacgagtaagggtggtagtgcagccgcggcaagctgccgttgtagggctcgatgaccagcttcaacggccctgcgtggtaataattgcaacgggatgaaccacgcctgacactctagacaaggaggcttgttgttgttgggttgctgaccaatctcgaagaagagggcgctgaggacggagcagcggtcgccgccggtgatccagaggaggacggggtcggtgctggggtcgccctccgactcgatgaagtagtagaacagctcggcgccgttctcctcgtcgaccgtcacgtacctgtacagagtgacaccacaggacctctcacctatactgatgcagggagcatggaaaatcgtcagagcagatgggggaatgattcttgagttgtctcacccggtctcgaggcgtgaaggcagcgcgccgtcgaaccccggcagcgtcgcgacgttcgtccgcgtcagggagccaccggcggcagcgatggtgacgaagaggaggaagcagcagcagcagagccgcacagccattgtactgt

SEQ ID NO: 65675 - DNA, 2365 bp, Oryza sativa
tacgatggaggaaatagctctgactcatcaatagcctactagactagtggcttgatatacaaaatttcaaatcctagatttcgaaagtacaactatggagaaagacagagagaaactacaccttgggtgcctgatttctaaaaaaaaaaaaaaaaaaaggagtcggactatcaaatattgcagttgaccaacaaatgaaaattaacttatatatagtgaaacgaaaaaaatagcaactgaaacatttaaaaaaattatgaaacacagtgaagatacacattgaaatatgtcgatatcacgtactccctccgtcccataatataagtgattttggaaggattttgtgtcacatccccccaaaatctcttatattcctccaaaatctcttatattatgggagctcctgtccagattcattgtcttaatatgtgtcatatccctctaaaatcttttatattatgggatgaagggagtatgaaacttaacggtttgaaacatatatttttcttttatcaaaatataattatataatttttattaaaaattttaataacaacgatatacaacgatatgatcagatcaaaataaaacatatgttcgccgtttttaggttggtgtcaggttgcgtgtaattggaagggttactgggaagaaaataatcatggttctaacagtatttttaccacgcactgtcggtctggccccacggaggaatcaataacacgcacgtctctgtggtgaagtgcacaagattataaaaccatagtcccggaaaaataatatatgaagatctttcaatagggtcaaatttctgtgtcatattttaactagcccatgattcgcatatttgcatgactctacacattccgtcatgtgatatgtgagagtgacaatttgtttttcttatgtttcttattactacgaaaaaaattggttaaaatgagtgatggtattaccctgatacagtaaatggcagtagaataacgatttttccgtacggtcggaatcggtttttgcgtgcggatctttcacccatctggaacgaggtgtctgcgagattttcgggaaaataaaaaatcgaaataaaaaaatcaaaagccgcctggaaccctaatccagccgtcgtcgtcgccgtcaccgccatcgtcgtcgtcatcgccttgcctgaggcctgccaccatcatccccacggacgcggcgatggatccggcctccccgcggtggcaggcgaaggatccggcctccccggccagcgacggatccgctccgccgccgccaccatggccgatgctgccatcgccctagccgagaccgtcgccgtcaccgggagatgggaggagtgggaggaggagggggatagggagaggaaggagtgggaggaggcgggcgatagggagagagggaggagtgggtgtggggcggagagggcgatgggatttgagagggagatgggaggagtgggtatggggcagcgacggagggattaaaaaggtgggtggcaattttcgtgtgcgggtcacttaataggtccgcacgcgaaaataagtggcccacctgcgaatattgatttttctatgcggtcattttaatgagccgcacgtgaaaatggagcatattttttttacagacgcgaccacttacagttcgtctgcaatcaaaaatgactcccattcagaaaaatcattcctatactagtgtggcttaatatttattgtaaactttaataggtatgattcatcgtctttatatgtgtctttaccattgtatgattttttttctcctccacttatttttcatggtcataggttttgtacctttttaagaaaatattttaattttagattcatttttaattttatgtgaaagtcactaaacatatattcaggtgaggatgacctctttattggaaggaatgtacatgtctctgtagcaattttttctctaatacattaacaataattgctacaaacaaaagtaatcacataaacatacattttgaatatgccctgaatagctcaatcttgactaatgaatctttagttaaaggacgagggttttttttcccttcaattcctttctttctttctacttctagtagttacctccggaatgtgttttattaccatccataatccaatggtccaagattcattcactctcttttgtcttgtagtaaatccaacggctaatatttgtcaaatgatgtggctcattcccgtttaactttggatttcacttttcactttgttaagattagtctgttggtttctccttgaagaataattggatgcatgcataccttcaagacataccacccgcgaatgtatatttgtgaacgacctttttcacgggttgggctgcagga

SEQ ID NO: 65676 - DNA, 3680 bp, Oryza sativa
atttatttgttgttcagaaaaaaagaatgctaaaaaaaatcatatatcactatatacaccataagagacggcagattatctaacaataaaaagtaaatatctttgtggtaaaatagaggtagactttatgtaacacccaaattttttatacctaaacacactagtacagaaactgataggtgccggttgggaactagcaataggtgccggtttccctgccggcacctattgctcggcagtaatgacactaggtcattggtgccggtcgtagaaccgacacctttgctctctccctgattaaaaaaaatagagaagctggctccaagccaagcagatgcttgtgagccacaccattcaagcgaagcagatgcaatccatcacaaatcaataaaaataattttacggtcaacaacaacaatcacagatacaatccatcacatatctcctatgaacaacaaaatccatcacagatcaacaacgacaatcacaaagtcccaggtcagcaacaatccaatccatcacaaatcacagatcaataacataagtaattaagatgcacgaactcactccgtcatcgtcagtccgccgctgccagtcgtagctgggatcccttggccacccgctgctgctgtcgccgcttcccttggccaccaccgccgccgccaacccaccaaccggatctgcgcgccattggtgggaggccgacgaagagggagaggagggagaccggccggatctgcaccccgtcacctatggggaggccgcccaccacctcccttggccaccaccgccgctgcacgtcgccgccaccaacccaccagcccgaccacctcctccctagatatggctaactccggtgaggccgacggagagggagaagaagaagaggaggggacctgatttgcacatccccgtcgcccgtggtgagggcgccggtcacaggtgccgctgctcacagtttggccgtccgggagagggggacgcaaggggagggaagcggctggctggccagctaggagagggggacgcagggggagggaagcggccagccggccggctgggagaggggagcgaaggggaggctgcaggtgctagagggagaaggggagggaagggcggcggaggaggatacaggcgagacgaacgagtcgaagcgtgtcacgcccagaaatttaacccaaatttccagactattttgtgtattaaatccctgtccaagaccagccagggtacacaaaacaacaagtaatatatagttccaaacgtaaataaagcataaaatacttacagaagaggcacttagtcctcgcaccgaagcgaaagcagcagcagcggaaaaggcgatcctagcggggcttcagcttcactccacaggcaaaactcaactggggtctgagccttgatcctccaacttcgtctttagctcagaaacactatacttctgaaaaagggggaataatagtaaggctgagtacaaccaccgtactcaacaagccacaccaatgatacagacgtgcaaggggatacaaggatggcttgcggctatttgcataaaggcggttgtaaaacattttattgagcaaaacagtaaaactgttgagtaattaaggtgacattaaatctccactgatcaatgctacaccacgttgaacaggcccaaccaacccacctgaactaaccagtgcattgagtcgatttactaaggtgagactaatcatggtgaatctggttgatcgcgcataaccgcgggcatggctattcgaatagttttactctagccagaggtgcacaactgtacccacaagacacaatccaccggcatgtcaccgcgccaggcctgacacgtcaccatgtcgagtgattgtgacaagacccttcatataaccccttctgaccaagcagaccacacctcaggtttcacccccactcctcaacaggcagcgggcaatcccctctcatgcctaggcgaatcagaaagccacataggtcatcgcagtgcccatccgaactccatcatgctcacccttgcctggatgcgtcacccaaaggaaagctatacttcaagtcaggcagttacccattcccgcttgtggcaagcgttgtatgtcttccagggtgtcccgcgaaccactccttaattgccatgggtgcggctagcaaaaccatgcacccacagcccaccatcaagtcgcattttagttggataactacgaccaatgaaacatggccggatgtctcgagcacgcagctcgtcatgatactagaaagtctaatactgtaattatcccatcaactgagctagtggtaattaagcatggctaagcatatagttctagctaggtcaacataacacaagctagtcgaattatcacccaaggttcacaaaggacatatatcaagtaaacatggcacaagcgagcagataggtaaactatgatcccaattaattagcaaaacatgcatatttatttgcaaacagtaaaacatttgtaaagtaggctcaatatgctcgaggggaatttgtgacttgccttgcttctttgaaagaatcttccgaacacttttcctcgcgatcgcgaacttccgaaacggcggaatctacgcgctggcacgcaaaacaaggaaaaactctaataaaaaccaagtaagcagtacatgaaaagtaaacaaacatgtagagctcgattttagatgaattttgctagttgaatggcccaatttggagttcgaatgaattagttatgaattttttgagccattaaatgaattcctataattattaacactatttatgacgtcaccgagaggataggtggcaccggcaagcgggccctacctatcggtggctcaaaggaggcgggtgcacggtggaccgagtccacgcgcgcaccggcccgcggctagacagctccggcgagcggcggcggctcggcttggcgaggggagagtgggagagggcgcggggagctcgggaaaaattggggaaatgtgagaggagagcacggggatcgtttttatgggctcgggggagggaatccgtggtcgattggggtggcaaccggcggggaaggggcggcatcatgggggaggagagaggcgacggcacacggcgccgattcgtgcggggatagaggggaagtgggggcggttgcaggcacgaggtggaagggatgggcggcgacgtggcctgcacgagggaggcgtgaggaagccggatggggcggcgacgtggggaagaacggtggccatagcggttggacttggggagccggaggaagggaatgacaggtagggcccacggacccacctgtcagccagggagagagaaggccgagtgagggaggaaaggagtgggccgagtgggctgaaggaggggaaggggaggccggcctggccgggaaggaggagggagggagctgggccgagcctaaaaggaagaagagggaaggattaattcgttttctttttattttaattgagttaatgaactttgtattattataattacttcttgagctccaaaaattcatgggaaaatttcagagaataattagggcacaaagaatattacaaaatattcacggccaatgatttttaaaggaaaatttttaattctcccattatttcacttgattaaattgctttaacttttatttaatttctagaaaatgctttattta

SEQ ID NO: 65677 - DNA, 1912 bp, Oryza sativa
acatgtgtacatgaccacgtcaatccctcaatctaatgccaaacaaaataaatggaccttttgcaacctcgtttctagcgataacatccacaagttagcagcccggtaatgtaaactcatttatttgtaaaatagtagcaattttttaggtctattaacttgctatataattatacttaaaaaaagtgtaacaatattttgtaaaagcaaaataacatatttttgaaccatacttaataaatatgtcaaacattaatacaaagtaacaaaactcaattcaatggcctattattttgttggacattatgttatgaaacaacgcttggacattatgttatggaacaacgcctgcacctgagcatcttgtctatggattgaaatttgggtttggcttgcttatatttggaattaaactgatgcatgtgcttacatgtaaaaaaatcggatgctacccaatacgaaacaaaaaccatgaagtcctaaattcattgagaatttcgacagtgtcccctataaatatggacattcatgatagatagttataattctattcccacagtgctatccatccatatacatccattgaaagaaactaataggtatgtaaaagattattacaagaccaacccagaatatagtttaagtgtcattttggacctaagcgatatagtttgatagtgtgcagatagatgtgtatataagggtgctacttcccgcccatgcatgctgatctcaatgtgtacctaaaaccaaataaacacaagagtaagtacgaaaatactcagcaggtacaatatgaaactagaaaacacatatacacatcatctatactaatataaataggaggagtttgcactgtgcaatcaagcggccaaatcatgagaatcttagggccatgcgcagggtcttcgcgccgcctccgcaaattcctcccctctaaacccgatgcccactcgcatctcttccccgcactccgtcaccgcatcgtcgcttccccctccctcaatcacgctgccgatagcttcctcggctcctcccccttgatctcgccatcgatgacgcaccacctacactcgattttgccatccacaaaattgctcggcctcctccccatctccaccttgttggtagtctccatcactgccagacaacctcgccggccgctttcatcgctctcctgcgtcatctgccggcatcgccacccctcatccgccacgcccctggtggtactcccgtccaccgccgggaaccattctccactcctccctccccaggtgtgctccaatccaggactccctgccatagtcctttgcccagatccaggctgccacgtcttcgattatcacatctgcacttgatcgtggtcttcggcgagggcctgcaagggagaggagacctgacagcagggattgaagcggtgcgatggagatccaccgggagggaagaccagtgcatgctcccgccaagcgtgttctcgactgtgcctcctacttcccacctcaaagaaatcagttcgatttaatctaccacaggtaatgcttcacttgcaaagttacctgacaaatacaacttcttagtgcttttgaaggttagtctggtcttggatcttcttggtttggacttgatcaatgaatagtcaggtgatgtatattactgttgcatgcacacggatggaagaacccacaaataaaagcaaactgacatatctaaggccaattcaccgtgcactgtcctaggggcccacatgtcagcctctaggagaaaattggtggagagaggtggtggctttgtttctgccgaactagggttcggcttgtcaaaccaaacacggcccctctcatctccaccatccatgtgacgcttcctctggtctccccaaatgacagttatgcttgattatcttgctctcaaa

SEQ ID NO: 65678 - DNA, 5867 bp, Oryza sativa
tagtaatgctgtatcaatatcaagtttccttcgtcagatatgtactgctaatcagcaaatttatacctgaaataattcatccaaactgctttgctatctcatgtatttgttatcaacataaaagtacattagtttattggctgacatttttattttctatggcatataagccatggcatatggtccgagtaacccaagtaaactggacactagtacggctccattcatttgtgtgttaaggctgtgttcttcccctgagatttcccaactcacctcttccctttttcacgcgcacacttttcaaactgctaaacggtgtatttttttaaaaaaatttaaatcaaagttatttaaaaaattatattaatctttttaaaaaaaatagttaatacataattaatcatgtaataatacgtatttcgttttacgtgccggtgaggaggggtccgaacgcagcctaaggggtgaacaactccctcatatattagcatgtttactaacatgctatacgttctttttatttaagaaaaaccttctatatctatgtttttaacaaacaaataaattcattttaagtttacaataattaatactcagtcagctgtcgtaccctaacaactcgcttcgttacttatgccgtcaaaaaactcatgccaattgttcattctaacctagctttaacagcatattttcttagaaacaaaatacaacaaatgtaggcgctaacgtgtgcacacataaccttataataacctttaaaaaactggcccaacatatattgagattgacgaagttaccacgggtacctcgctgtggataggtacgtcatataccactggcagaataattagttacaaatgcgagcacccatgtcaaatctaggtacccgtgtgggctagttccgccacaagaaacctaaccagttgaactacgttcactttgcttacccttaacaactttgtctttcttagaatatactcaatataaagataaaagttcgtaacaaatccaataatgttattttgtcttcctaaaatttttcaaatgcagcaagaaatttttaaagtaagttagcttcgtattacttccatcgtaatactccatccgtcccatagtataagagattttggatagatgtgacacatcctagtacaatgaatcaacacatccacctaagatcccttgtactatgtggcggagggaataaatacctcaagcccctaaaggcaaaaatgatagctggcctatgacaagaaatggctctaactcgaacatttttagcaatagcccctattctaaagcacttaatgacttgatgggatcgctcccatcttttgggtataaaaattaacttagaacttcagcaacaacccaacaacccctatttctttggtcccatttctatttctgttctattttaatatacacactatatatttatgcctagtttaacactagaataattcaaacacgtagaattattcaaccatatctacagtctcatcttttcacttatacttatacttatcagccaaaatttaaattttcaaccttaaatttagagttgatcttggggttttttttcatcgaaatttatttttcagcctttgcttttagaactttaagaacatatatataaaagttttattcacaaattatttttcatttgcaaatatgacatttagcttattcctcgaataagcgaaacaatggggaccctaatttacaattttgaagaccataattcaaatttaaatttaagattttcaccatttcaaaatgcataataaaatttaattcccacagtaacacacatatgcaagttcacaagcattatataatctttttctataaaataacatattctacaatgatgaatggttcgatctggataactggcagctagcgctagatgtcaccggactttctgtgccgaggtcgcgaccagcggtgtggcagcatggagattacgtaggttgacaggcgacgtcagggtgagcagcgttgtactgtcctaggaagacggtggtcagaccatggtcagcggagcaacaaaggagaaggacaatgacggtgcagtgagggcgcaagaacaatgagaaaatcatgacaacacctttcatataaccctccctaaccaaacataaccacctcaggttgacgggcgacgtcagggtgggcagcgttggactgtgctatgaagacggtggtcagaccatggtcagcggagcaacaaaggagaagggcagtggcagtgacggtgcagtgagggcgcaagaacaacgagaaaattgtgacaaaacctttcatgtaaccctccctaaccaaacataaccacctcaggtttcacccccactcctcaacaggcagtggacagccccctctcgtgcctaggtaaatccggaaacagcagagaccaaagctagttccgaactacaccatcgcctctacccttgccacagtatatcgactagattaagttatactctagatttagcctggaacccaagctggcttgtggtaagtatgagtttatcttctaggaattctcgagaacaggtccttaattatcatgggcacgacttgcaaaaccatgcaccaacaacccaccattaaagcatattttagtttaattaaaccataaccatggtggtacatcatcaatataattaaggactaaattatagtgaatctcattgtgatctaattgatctaagtatggctaagcattcctaaatcaatcatctagtcaattatatccgaagttatcaatggcataaggtaacaaaaggctgactacgatagttctcaatcccacatgatattctaaaacaatgcaatttaatagaaagcaggggattttattatagtgaatctcattgtgatctaattgatctaagtatggctaagcattcctaaatcaatcatctagtcaattatatccgaagttatcaatggcataaggtaacaaaaggctgactacgatagttctcaatcccacatgatattctaaaacaatgcaatttaatagaaagcaggggattttataaaataggttcaacatgatcaatgttgtatgtattacttgccttgctcttgagctgacggaacctcagcaaccatttcgaaataaactagagtgtcggaactgccagaatctaaacgacaaacaaagcatacaataatacatccaataactctactgaaacagcaaaagaaaccaattttaattgattctaaatattttaacgaattcactgcaacttgaatggattaaaacggaactcagatgaattagatatgaattttagaatatgagctgtgtaattactattcaccataaaaccttagtcaattattacacatttagccaaaaagatcaatggaaatgtatcaccggtaaacaagcctcacaggatagcaactcaacgagtcaatccactgtgacacgggaccactcaaacggtcaaccgaaccggcgaacgaaccggtggcttagaacgactccgaactactaactgaacgggacttcagctatactacgtgtgaacgaatggttaacggctagcgaacgactgtggcacaaccggtagacttgactctgtttgcagcaacggataggtacggcaatcggtaggtcggtagcaactcggaagtatggctgtggctaggcaaagtggctaccgagcgacgaacagcggctaggccgtgacggtgacacgatttagaaactgcacagccgcagcaatcggcggcatgaccggcggtaagcgacggcatcgctcggcaacaagcggctgtggctagcggctgcggcggcgcggcacagcgacggcggcggcggcggcagcaggggcggcgcggcgacagctgcacagcagcggcagtggcgctcggcagcggcggcgatggtgcacagcggtggcggcggcgtgcacggcaacggtggcaacggcgcacggctgcagcaaagctagggtttggcgacggcgacgcgattaaggttacgacgacaatgtgactaggaaatttaaacctaaattgagtgaacatagatggattcctcaccaaaccaagacgatcggagaggaggaggcggcgatgacgatcggcggcaacacacggagacgacgcgatgctatacaaacgaggatataggttagattaaaccctagggagaaaacatgatggtgaaccatactggcgggagaggaggcagctcaccggcgacgcgacaacgacggcggccggcagcggcgcggctaggggaggtggctaaggctttgcgcggaggaaaaatagaaaaaaggagggggtatagggacttaaataggaggaggcggaattagagtaggtctaggttaggtggggtcgggcgcgtgaggggagaggaaggggcggcagccgggcgagagcgggaggggtggcgcgcacggcagggaggaggcggaagcgcacgggtagggtgatggggagagggattaggatacggataggagggaccagaaagaaaaggaaaggaaaaccaatgcggtgccgtttcgggaaagaaaagaaaacggaccggaaaaagaatatgacttggctcgtcatacaaaatagaactgcggtagcaaaggggttggcggatacaaagtactgtgaacagggagagtgaaccggggacggttcacgaccaaaggagagagatgaaagaattattaattcaactcctaacatttcaaattaacattagtacttcctatactctaaatattccgctgaacatcttgttagtgattaaagtaaagagaattcaaaaaaaattctccctaacaattccaattattaaccacattattatttagagtttcctcttggttaacagagtattttctatagacgatttagcaatgatttagaaactacggaaaatgaaaaaactccaggtgtgacaatataacccgacccgatcagaaccatcgtcatccaataaattaatcttttaggattcacatagcttcgagatatcactgccaaaaatccgattattctacgcctcgttcgccgggggaggggaaaaatcggtcgctcccccccccccccgacgcgcgcgcatgtgcgccctgggccccacgatgtgtccctatctacctgctatgtgtccccaccacatactccgttgcaacaaatcatccacatattttggaaaccctccactaagggaattcgtttcattttttgttccaccaataatatttcacctagtgtactcacaattttttactatgtataggtcaaatgttgcagtgaactgaaacattcttttgcaacaaatcaccgatatattttggaaacccgttattaagggaatttgttttattttttgttcaacaaaaaaatatttcaccttgtgtactcacaatgtttcactatgtatagatctaacgttacagtgaactgaaacattcttttgctatttactgaaacattgtttttataaaaggtaaaacaatgaccggtttaaaggattgaaacattttcgatttatttagtaaaacaatttcgatatacttggtgaaacagcgtgcaatatttaaaaataattcaataataagctaaaaaaattcatcggaatatgtccatgtgtggttttgttttaaaaatttaattgtagcgaatttaatggtgtaatcggatcatgatttagataaataatttaagagaaaaaatagtttgaagtgatttttcacgtatgcatcatgctgatatgctgatatcagcatgacatcagcgctcgatttttccactccatctggcgcccgacgcctagacccctctcccaaaattctctaacgataaccggagtggacggattgttgccggga

SEQ ID NO: 65679 - DNA, 822 bp, Oryza sativa
atgccctcatcacatgagtccgtccgcctccatcggcgaggtcgtcgcctgcggctgccgtcggggtcgtcgccgtcttccgcgtccgaatcgaccgtcgctatcttccggcttggccgccctgtcttcggcgttcaccgtcgtccagatcgaccgccgccgtcttccgcgtccgccacacggccaccggcttccgcgtccgttgcacagccaccgtcgtctgcctcggccgcctccgccttcctcgttagccgtcgcctgaatcggccgcacccgtcttccgcgtccgccgcacggccaccgtcgtccgccgtcgcccgaatcagccactgctgtcgtccggctgggccgcccccgtcttccgcgtccgtcgcacggccaccgtcgtccgcctcggccgtctccgtcttcctcgtcaaccgtcgctcgaatcggccgccgtcgtcttctgcgtccgccaacgcggccgccgccttcgtctcgcttgtctcccgtgttatctgcacgcccgacgtccggcccgaccaggcgaccaccgccatatcttgtgtctgcgcatgggcttcctcgtcatgcacggccgccggtgtcaaccgcatccgccgcatggccgccgccatttcctgcgtccacaccgccgccgagcatcaccttcactctaccggagtcagccatgtaaagaagtgaagacaggcaaggaaggggaaaggaaggagaaagcaaaaggttggagaaaatgatgggtcccactacaataataaaatatttatgtacatattacctacactagatatgacatgtctaatttttttaattttttta

SEQ ID NO: 65680 - DNA, 3867 bp, Oryza sativa
tctcagaccacatcagcggcgtccggcatcgtcgaccaagcaatgcttcattgggggacatcttcaggcttgcttgaaagctgttgttgtaggagaactcggcctagggcaaacacttctcccagtctttactaaaatccaacgcacaagctctcagcatgtcttctaggacctggttggttctctccgtctggccatctgtctgtggatgataagctgtgctaaaagcaagataacttcctagggcttcatgcactttttcccagaaatgcgaggtaaactgtgtgcctcgatcggatataatcctcttaggtataccatgaagacacactatcctagtcatgtacaactcggcaagtttagcactgctatagtttgtcttgacggggatgaatcttgccgtcttggtgagtcgatccacaatcacctagatggaatcgtaccctgttgcagtcttgggcaatccaacaatgaaatccatacctatctcatcccatttccattcggaaatcctgagaggttgcaacaaacctgccggcctctggtgctcagccttcaccttctggcatatgtcgcagagtgctacgtattcggccacatctctcttcatgttgggccaccagtagccttccttcagatcctggtacattttggtacttccggggtgtaatgagtatgccgatttgtgagcctcctttaggattaatccttgcagtcctccttgttcgggtacatacaaacttcttctcctttttgagtagttgtgtcattggccgggctatctttgagaacccctcgataaacgttcggtagtatccggccaagcctagaaaactccgaatttcggtcaccgacttgggtgccttccattccgtaacagcctccacttttgcagggtccactgctactccactggctgagattacgtgacccagaaaagcgacttccttcaaccgaaattcgcacttgctgaattttgcgtataacttgtgctttcggagtttctggagaaccaatcgtaagtgttccgcatgttcttcctcatctttggagtagatcagaatgtcatcgatgaataccaccacaaacttatccaagtaatccatgaatactttgttcataagattcatgaagtatgctggggcattggttagaccaaatgacattactgtgaattcatacaacccatagcgtgttgaaaacgcggttttggggatatcctcggtcctaatcttcagttggtggtatcctgatcgaaggtttatctttgaaaacaccttagctcccttaagttggtcgaagagatcatcaatccttggtagtgggtacttgttcttaatagttacttctttcagtgatcgatagtctacacacattctcatgctaccgtctttcttcttaacaaatagcactggggctccccaaggtgacgaactggggcgtacaaatcccttttcttgcaactccctaatttgctttttaagttcttttaactcattgactggcatccgatatggtctcttggatatgggggcagttgcgggtatcaggtcaataatgaactctatgtcacgatctggtggcattccaggtaaatcttctgggaacacatcaggaaatcgctgcactacgggcattccctttaggggtagcatggtaaatatacctccggcacgttcggttagcctaggattttgatccatggttgctctcatatccgatccccagggtgtgatcagggtaacttctctacgtctacagtcaattactcctctatgctttgctaaccaatccatacccaatatgacatcaagggtctgtggtatcaaaaccataaggttggagggaaacaccacatccctaaggcgaataggtacatcaatgcaagctgtgtccacggctatttcacccccaggtgaatgtactaacattggttgccttagtttaactctggttaaattgtgttgttgacttgctttcagagatataaatgaatgcgatgctcctgaatcgaagagaactttaactggagtgaagttgagtgaaaacatacccatcagcacgccttggtcttcctgggcctcttcagctcgaacgtggttcacttgcccgcgtccaaatccggtagcggtcctgttagtctgcggagtcctgaatagacctcgtccagcagcaggagtagcagtcccatgaatagccgttgcattagctccggtgcgaatgggtgtcttgtttggatgaggacatttattggcgaaatgcccatactctccacagttgaaacagcttcctggccttactgatccagtggcggcctgattcggtgcaggagctcggttttgaatggtaaccggcctgtggaaattgctggaggtggcaggtcgactggttgtcaccactgttggtctccatgccgaagaggttgcccctttaggacgctggggtgcggtctggggcgggcggttcatggcaagcctccttttacgattgtgctccacgaccttccggtcgttttctagtctaacgaccttattgattaaactctagaaactatcgtggtcttgtccaatcatgggcccgcgcaactcgtcatttaagccttcaatgaatttgtcgatcttttcctcctcgtcggcaagatctctagtcgcgtagcgcgccagctgagtgaaacagttcaggtactcttgtactgtggtattcccttgccgtagtctcctgaactcattcttcttcatccgcatcaccgcggcaggcacgaagttgtcacggaagtctgtggtaaattcctcccagtttggttctccagcatcttcttctcgggcttccttgtatgtgtcccaccagtctccgactggtccttccaattggtttgccgcaaagatcactttatcggcctcacgtactcgaacaagagttagcttcttctcaatgatccttaaccaatctttagcatccattggttcttcagctctggcgaatgtgggtggcttggtcctcataaactctccaaagcttgatccgccacggttgccttggttatttgcaatggcttgcaggagttgggtttgggtggccataactccggcagggtggttaggtcaggtgtctgggtttcgtcattgctggttgttgcccgacgtcggcttgccatctgtgcaggttgattgattgagtaagtatcctaattctctagctattttttacggctttatcccattaggggagattgttttgatgtgaactttattttgcaagcatggtggaataaactcatttataacacaaccacaatagatatcataaataacatcacagagtttcacaaatagtacataaatcatgatgcaatcgactgcatacatacgcagtccagttaaggtttgtccaaaagatacaacgaactaatcatcaaactactcgtcaatctaggtaaaggggggggtgtctcgcatgctatccaaaaaccatctgatacgagatcgaagctgcaaggagtccgtcagtctagtcctccagccatccgtaggatcctggggcaggtagagggtggtcgctggcacgcgcaaacctaagtccccacggctcagaagtagtggcctctggatctggcttgggcctcttgcccggaggtcgtgtgctcttgcgagcagtgctgagggtgcgagggcctccgaggaaggtgatgcggggaacaggggtctcatcctctaaaggatcagtgatgtctggctcgatctttggctcggtgtcggtcccctctgtctcggagtcgacctggatcggagtctccaaactggaacccagctgcggagaaggtgtagggatcagtggagtgtgcaccatcttcgggacaggtggctgtgt

SEQ ID NO: 65681 - DNA, 1409 bp, Oryza sativa
gcatactagcctctcccagaagaacgtggaacgccggtgggtatggcagggtgaggaataagtagcggtcacgacctactgctgtggaagtagaagcccctgtggtgctgatcttggctgctcgaagctgctcctccagctggctgacgtgctcctgactctctctcagctgctcctcaagagtatccatcatcccgcggcgatcgttgtactggtcagataactgctggaactggtcgccgtggacctggagctgtgccttcagtgagtctatctcactgccccaagcctggtgctcctcctccaattgaagctgctgcactgagaggtcagtcaactcagtctccagctctcccatacgtctctggtggtcgtcaatctccaacagagcctcctcgtagtagtcatctactgcctcagcccatcgtgacaaccgagtcaccatcgggttgtagcagcagggcgtgtcctgaactgtgcaaactgagttgctctcctcccggaacgggtgatgagcaaactcggtactcgctaactcagctcggtggatagagctgagtcggaggaaggcctctcgggctgcatcctgcattgcggtttctggcaggtctcggtggtgacgtgtcagaaagctgtagtccaactcggaagggactcgggggtgaacctcgacccaagcctcccaaactgagccacactgtctcactcggtatgacgggaacccagagtatcgcagacgcctcaacatccgatgcagctcaatgacatacccctctgattgaggtaagctcaactcccaggtagcgggtgaatccggatctgccatctaattttaagaaaaacccaaagtcagttgagagtaaaacttgttttgtaaagaaaatagttaagagtaagatgaaaattgtaccgagttttgtaaacatagcgtttttatttttgaaagtattactaaatgggaatttctcccttggccaacttagaaaaggggtggggcgccttttggtcttttcctacagtcgtatggctctgataccagctctgtggacccccgtttttataacaggaatcattcgtgtaaacagtaccatttccctggatcaagtagtctggtacacacgagttcatagctgaaataccaaaagcacatacatgagagtctagtgctaattattacatcataagcccgcaggcattgtcttaaatcatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctccgaagcttcatctaccgcttctgattaattttatatttgtaaggg

SEQ ID NO: 65682 - DNA, 729 bp, Oryza sativa
ttaaaaacaaattggtaaaataaatacaaattaaaataaagattaggtgtggatagaaataaataaaatattatcgcgaccatatttggatcaattaaatttaaatacgatggaataagaattaaccctaattaaaactcaaataaattatataaaaataaaatatgagtaatattaatctagggtgaattcattagttaagataacacaaatattgagtaaaatgcatatatgcaaaattaggaattgtggaataaaatttatatggaaaatacactaaaatcgggacaaataggaaaagtcactattcatcggccgccaggtgttcgacgtggtcccctaacccagctcctctttccccctctctctctctcggcaacgtcaccacgcgtcgccgcctcgcgccccgagccgccgcgcgccgtcgccatcatcgcctgccgccgcgccaccgtcgccatcgccgcctgtcgccgtcgccatctcatcgccgctgccgcgccgtcgccgtcgcgtcccgcctagggccgcgcgtgcgtcccatcgccgcctcgcgccgcgcgccaccactgccgcgcagtcgccgtcgccatcccgtcgccgcgcgcgcgttccatcgccgcctcgagccgtgccgctgctgcgccgcgtgccgtcccgtcgcctcgcacccgctgcctcgcgccccgcgccgctgccacgtgctgcgtcgccttgcgccccgagccg

SEQ ID NO: 65683 - DNA, 752 bp, Oryza sativa
ttcctgcagcccgttcgtctggctgctaattgtattattctgcattggtggtattgaggtattttctcatacatttgttatgtgcattgtgctatttcttattggtaccatcttaacacttctttcccttttgttttcattgaatgttgaagtataccttttttttttttttcattttcctttgttgagagattcagctatgagactgactatgaattttacagggtatgcatgtttgcttggtcacacttctcactaggtaacaaatgaactaatttggatataggaatttggtcaccgctgttcactttatttgcctttcttttcttatttgatgtacttcacctaacaggatttgcaaggattgtggacagaagactgtacaactccccttttttggggaggtgttgaccctttctgttctgattgtaccattttgcactatctttgcaattctttgggctgtctatcggcatgcttcttttgcttggataggccaagacatccttgtaagactaatttatcttcattcttgtgtggtctttctatattttatatatgaccttgtatggtgtgcttctcactaggaggtgcatttttttttctatattttgcttcagtaccattcaaaagtatgcaactaactgtacatgccttcagaggtaccagcaagcaagtctggattcacataatataagtatattacaatatactgtaaaggctaacatagtgttacttctgaaatcaatctg

SEQ ID NO: 65684 - DNA, 14772 bp, Oryza sativa
aggaattgttagttcgatgaccgataattattaacgtggtggtgacccctactcatgaaaattaaatgatggcatctcatcttacaatagcaatatataattctgatgataatatttctgtagccagtcgtgtagtaaaagatttgtgatagtgcagtaagatggtttgaagtgtatactaacaaccatccgagtatcactactagatgttttgtgccaaatactataaggatttagcacgtatgagaagataaaagtttactaagaaaactttattataactaagaaatagcctactggttagtgccatgtggtaatttgagttgaaggtcttgagttctattcccattgaatgcaaaattttcttttatttttttctctctcaaaaaagggagaggtggagggggataaggagaaaaaatgggagaggaggagcgattaggggaggagggcggcgcgctcgggcgctcggggagaaaaaaagggagaggaggagtggggagcgatcaggaggagggcggcacgctgctcgagcgagaaggtggggtgggaggtggggaatcgggaggaagtggggaggtcaatgggtgtgtttggttgtaagccacactttgctatagtttgccacgcctaaggttaggcaaatttgacaggtgtttggttgtagccacagttgtggcaagattcccctccaacaaattgggtcccacgtgtcaatggctcaaaaaagtgtggcaagattcccttaggcttagtaagttgtggctaacaatttgatcacctcaccttaggcaaggtgtggcaactttgttggcaagtaatggtaaagtgtggctgggaaccaaacagccccaatatcttcagatcgaggcaaaatgaacataggctgtgtctagttggatccaaagtttggattttggttgaaattgaagatgatgtgactgaaaagttatgtgtgtataacaggttgatgtgatggaaaaatattaaagtttggatccaaactttgatctaaacacagccataggagtactacagagtggaactgggagcatcctggccgtacacgtgggggccttgattggccattgattcgaagaaagaaagcacatagtccaatgcaaattgcaacaccatgcagcaagaagaagcagccaagcagcacactgcatctgcatggtctccttctcgtcctccgatgcgagttgttaggacagcgacttcgagagcgacgctgtctcttgttgagttgctgtctctctccctctctcttctcttcttgcagctgcagatagaagaagaagaagaagaagaagaaacagtggccattggtgaaacgaatgtagaatgcgagtgaaatttcgaatggttttcaagaacttaagtttggctaacatttattgaaatttggttggggatcgggatccggcacttttaataggaaaagtgaaccctgcatacaccttatcttgaggtcatggatgagagaggtgagattgagaagctaccaatgctcacctcccaattccatggcatgcaggcaaaggaattctgaaaactgaaagccatgccatgtcgtagtaaatgcatatttatgtttttttggagctgatcgatcttgtgatctttattagccacccacacatattgaataaactgaaacatcttcttgcagcaacaaatacagctctgtttatctttgggtccagtactgtactctctggatgccctgctagattcgattatggatctgactgaccttccaacagcgacagtaggagtagttattacatccggtatgctgacagtacattttactatctcacaacacatcagttaggatgtgtttagttcacgcgaaaattaaaaaatttgttaaaattgaaacgatgtgacggaaaagttgtaagtttgcgcgtgtaggaaagttttgatgtgatgaaaaagttaaaagtttgaagaaaaagtttggaactaaactcggccttagtttaactaccttaatttggtacctatggtttgctgtaatcgatacttcatgtactaatcaagtataattaaggcagtgtaccatgtgttcatgaagtggcaagctgtaaaaataagtatgctgactgagcagagctgctgctgctgctttgccttttgcctttctcttttttctctccctttgttttcccagattttgctttgccctttatctgtggagagtgatggctgacctgatgtgtgctcctttagctagctagggtccttcagtccttgcataaaattagttaggattttggaagagagaaaaaaagtatgattgattatcacttaatccctgggatttatcttttttctggttgaattgtttgtttccagcaggttgaggttcccctgtcttggctgttcagtgttgaaattctggttccactgtttttggcctgtcctgcttgtccattcttaccaaaattgttttcttttaacatgttaccaaaatgatcaattttagatgacattttggtttgagcaattttggcataacaaagtagtacaagtttggtatacgaaacatttcctttttctcagtaagcatttgctagtttattatctctctttcagttgtactactacataatcatcatcaaagctactatagcacattgggattcatcagaaagatatcatcagctggggagaatctccactagtcgtaattaataaacaagatattgccctacaaggattaccttgtggagctcatcataatcatcatgcatgagacagtactacgtggccctaattgagaaccccccatctgtttggcaatctcatcacacaatcaattgcataataataaacaaatcaacgaacaaacagtaatccccagaaaaagaagtcgcacatgagaatcatcatgcctccaaaatttcttctcctccatacatccagatacttcttctcttcccaactattagcatgtttatttgcagcatcaattcaaacatttctagctttgacagttaatagcaacaaaaccgtaaatattaatgacttgataacaattttaatagatttaccatgaaacaaactatcataatatgcaactctttctacttagaataatttatcgttataaatattattgaccaaaataacatatcaaagacaacttctaaggtaagcgaatattagggaatgacctaatatcaaatgattagaaggggtgatgcttcgaacccaggtcgtctagcccaccaccttgtgaagctagcgggaagaccctgtacgtttttcacaacttctaaggtctaaaatactttatacttgtattggtggactgagagatagtatctctcatggtaaggatatagctgagcatcaatgttcagaaaagtgcaagaggacaagccattcattgtgcaatcacgctcgtcgtcttgcccaactgctctatgctctctatccccaggtcccctgtcaaattctaaaacagtcatccgatctcgccaaaacgccatcattatacctacctaatgctaattctagcttgcatcacgtaagagctttgccaattatataagataaactagtagaagaaagtttgtcaaatgctagctaggatcatgtgcatgggcctcctctgatctgcatggtcggtctcctttagcaattagcactagcttggctaaggttttagcaggttgatgttgtggagaggagaataataagtggtgcccttgtgatcttatctggtttttcagcatattccaaatcctggccggcaagcttgctggttctgataaatgtccgagaaactactttatttgcccccttagggtgtgtttaatataggccgagcttagatctaaacttttttttctaacttacaacttttcaatcacatcaaaacttttctacacacaaactttcaacttttccgttacatcgttccaattttaatcaaatttttaattttagcgtgaactaaacacacccataatgatggataaatctgcactttctgatcttctaaacagtatgattttcattaaaaaaaacttttatgtaaattacctagaaaatggagttttctaggtaattatttatgataaaatggagtaaatgaaattaaactcgaaaaaatatatatatattcccaaatttattagtaaatgatttttttatgatgaccaaaatggggttaaggaaatattgtgaagtaaatattgcatctgtaaccaaaacattccttgtggtacaagatgcatttttttgggttgagtagcccagttttccaggtaagtactacagtactagtagaatataaaaagaagaacagagccaatactttttctgtcatcttcttcagtttcttcagacagctgttgagattgctggagtcaccactcaccagtcaccacaatttgggtgtgaacagatttgaaaagccaaactgtttcttcatgagcttggaactgaaggacaaaaaaaaactaataaagcaaactgttccaggagtgcttaaaactgaagaaaattttttttcacccaattcttttgtcggtcggtggtggtggctactggttatagcacattaagcaccgtcgcctcagatttttcgacgaactttaaactggatttgacgcgacaaaaagcagccttggattggttccatgcaagtgctcttgcagcacctagcaatagcaagccaaagcaagccatcagagatgagcccatgaccatgaccctggtcaatccaaaaggaaagacactgagcattgcagtagtaccaattgtacacacctcatgtccatctccatccatggccatgggcccctccacaagccaagccttcaccttttaccccccccccccccctcccttcacaaactacacggccacgcctctctttctcatggcaacaacggcgtccaagacggactccgagtctccgatccctcaccgtaacgacaggtgccgttgaggcgcactgatatgcgagaccattggtaccattgaggcacatatgtggactacttctttatttaccacgaacacgtttcccacgttgttaaatactacctcggttttaggttacaagactttttaacattgtccatattcatatagatattaataaatctagtcatatatgtgtatatatttattaacatttatatgaatgtgggtaatgctataaagtcttataatacgaaacggagggagtagtatgtttcgtgtaaaaactttttattaaaaagtttctttcataaaaataaaataactctaacttttaagtttatatatgtcagtgacatttctttccatgaagtttgaaaatctcagccttacctcacaaacaaacgtagcacaaagaccgacacaaaacctctgtcataacaatcagtgccgttgatacatgtttacctcgcttcacaagccacacctctatctcactgtaacaactaagcaatttacagcgacgtccagaacggactcggaacctccgttgtaacggcaggcaccattgagacactgacatgtgagatcatattattgtgatattttattttagtagaatatattattgacagaaataggagatttgtcccatcttatttttttaagcttttttctgttcacttttggatattttggttgtgtgcctacggataaaggacggagatgtaatccatttcctttatatgaaaaaaaaccgtgtcatcgaatcgattcaccgacatgtgggcccatttgggcaattgggcacctaccgttacggcagaggatactcgtccgacccacagagtgagggattaaggaagaagaagaggttgattgagatgttggtaaagaaaaacagtaaacaattgggtatgtgtgtccccatttggggagatgaaggtgaatgagctttggatgagatacatggacacatatatatagatatgtatatatatacagatttccctccaaagtagggtgaagcaaagcatctcattccctcaccccccctaccccagttcttctccttcttcttcttcttgttacctttaatcctctccccttctcttctctgttgcgtgcaagcatctctcctcgtcttcctcctcagattgcttgcttgcttgcttgcatcctcctcacattcaccacgaggtttctgctgctggtttgtctgatgtgtgagatagaaagagagtgtgagattgaggacgaattgaagcctagcttgtgacgcaaagttggcatcttttggtttggagaggcccactgtttcttccacttctcgccttgctcgcattccttccttgcctccatccccatctccatgccatccgtgtgaagcctcgcgccgtttggttggttgcaagaacgccacccgcgttggttgttgccttcgcttctttggttgctgccgtctacaagaagcctctctctggcctgtgctgcattggcctcgatcggtggtcgaacacatgttccacggctcgccggcggcggtggcggcgtcggcggcggtggcggagatgaggttcacgacgggggggtcgtcgacgcggtcgtgggagccgacggtgacggcggacacgtcggacctgcactactggatgcagtggcgcgccgcggtgtgcgcgctgtccgtgctcgcgtgcatggccgtcgcggcgtgcctcgtgtggcgccacgagggccccggcgccgaacgccgccccggcggcgcgtccggcggcggcggcgggagcaaggagcggcggcggccgggggtgctgtacgacgacgaggcgtggcggccatgcctccgggacatccacccggcgtggctgctcggctacaggctcatctccttcttcgtcctcctcagcttgctcatcgtcattgtcatctccgatggtggcaccatcttctactactacactcagtaagccactccatttcattttctcagctactactttttttttacctcttcattaattatctgttcctttcccccaaaaaaaacatgtcattttaacttggaactttggaagatggtgttcttgatgcaaagtttaacttcctccttatctgttttcccccatataacttggatggtgttcaggatgcaaagtttggtgataagattttttttaaaagaaaaaaaaaagcaaggaaatgagattgattaaaattttcattgtgtgctcaagtgcttcaactaggaggaatgtactgtggtcaagaagtttggcatttgttcccctttggtgtaatttagatttttcagggaataaagggtgcttttccatgaagcaattggttttctgaacatgcatataaagaattaatgaaaactgtcaggcagaattcctggcattttctgttaaaaatactatgcacaattgatggctaaaaacggtttgcctgttagcttagacagcaagcgacgcgcctcaccattttggttctattgttcatggtcatgggtagtaccaagatttgtactagcacatctctgaaactgtttttatatgtgacacattacctcaatttaataattacaaaggacctcacatgttatttggagcgcatttaaaaatgcagtcttttgtgcagtatggaatacagtgtcataactgttcatactcagtttattaactaccagtctaccagctagaagtactgaaattcggcattactacctgtatggtcagtagtttttattaatgtttttgattaatggaatggacaacactaggaatacccactccaacttagctacctggtcttacatgacttcctgttccattaaacatttctcacatcaagttaatcaaatactgccttttgataatatattataatatatgacctttttgttgcaaaattctggtgtttatcatatttctcaataaacaaactagtgtatctggttgcaagaatcaaattatcgttacatggatccgctagttgttggtgtttgtcaccctgctcccagaagtagcatttgtcaccagccttcctcctctaataagtggttgttgaactgtcgataatgcaggtggaccttcattctggtgacgatttacttcggggtaggtcccttaatccctcctttttcacaacaaaatagtttgtctctgcactgaattcatgaatctaatgattcatgtcgatttatctttacatcgaacacatctgaagaaaagtttgttttgtggaattgttcagctcggcacggcgttgtccatctatggatgcagcaagcttgctgatgagaatgttgtcactgaaagaacagacatggagctcggctcgtacgtcgcccatggagctggtactaaacccaatttgaatggggaagatgacacaggagagattgctggattctggggttacctgctccagatcatctaccaggtaaagagggattccatgcagccaaagaacttagaataaccatccacttgagcgcctttttttttcttatttgttattgaagagagttatcttatctgcactgacatttgcgtccatggagagggggtctgatctcattaggcttttcatacgcaattattgcactaacaactaaagtacgtttgtggtgtgctctgatgaattggattccgtttctaaagatcagatgtgcccacatactagcatctttgtccggtcacatttcaagggctctcacgtagccgccctacatgagccatcttgacatcttgttggtcctatctaaatattcagataatctctgcaaatctcacatttccttgtacctcaagggctgaatcagctttaaaccgctttgcgaaatgtagggctgactctttttagtagtggcatcaagaataaagacaacatgtttcctttgtgttgatttgcaaggcctaactgtacccaaacggtgactgaataccttcctaggctgaaataggacagaatggaactattgttctgctttgtgataagaattactagatagttctatggatggtagtttactagcgccatgtttagttccaaagttattcttcaaactttcaactttttcatcgcatcaaaactttcctacacacacaaacttccaacttttccgtcacatcatttcaatttcaaccaaacttccaattttggtgtgaactaaacacaacctagatctgtgttgggttactgtgtacactttgccaacaaaattttgtaatatatctcaccttttttagagaaaagaatgggtatattcattaattcataatcgttgtgaatatccttttaaggatttatgctcttattatcaaactttacagaaaactgagtaatttatgtaagttttacagtttactagcaatttttactgaaccagtatctgaccttttatctgccatgacagacaaatgcaggcgcagtgatgcttacagattgtgtgttttggttcatcatcttcccattccttacagtcaaagattacaatctaaattttgtaagtattacatgcttcaggccttccctacctgccatctcatactttgaccaatacagtgctaaaaattcagttactatgtttcgacagttgttgataggaatgcactcggtaaatgccgttttcttgcttggtgaagctgccctgaatagcttggtaagttgataactacttatctcgatcagtcaagtaattttatgaatgaatgaatggttaatttgacaattacccactgaattcaacatatctgcagagcttcccttggttccgggtcgcatatttctttctctggactgctctctatgtcatttttcaatggattctccatgcatcaactccactttggtaactttttttttctaactcccattctctcctaactactaaaaccatgactaagagtagtacttgcatctttctgttactgatcactacatttcatatctatttgtcaggtggccatacccatttctcgatgtttcagctaatttatctcctttgtggtaattccattacctccctacaatgatacttcctcccatatgtcttctcttgcaaagattacaaactgaaatcatcatgaatatcacaactcaaatcatcagattttcaatgaatcttttcatctacacaggtacttcgccgtcgcgatcatgcaattaccatgctacgcggtattcagactggtgatcaaactgaaacaccacctgctcacaaggtggtttccgggttcagtcgtaagaggctcatctacaccataagccaggccgtcatgcatcatcttcctccgccattgccaacagtttatacagaaagggcaatggtgaagatcacaagaaaagaataatggcagcctggtggtgatggactgatggtggcatcgatcaccgactccatttccattcctcctttgcgagattctcttattgcagcaggtgcaactctccgagcgaaaaaagaaaacaggagaggcacatgcgttttacaccaccgtatagtagttctgatagatgtaaattgaagcttacaggttcagatatgagattcagagagtttttctttttctttttggatgtaatggaaactgaaatgaacagagagaaaaaaaagagtgtggtggggttatgtatagcttgactcattgactgattggtcaaatggaggagatatttgttaacattttttttattttgtagagctgattaattaatggtcatttgtatatgtgattaatgctaatgagtaatgaatggatgcaagtgtgtgaatgaggttgttaaaatcgagcaaaatggtacacttatgcaggaagaaatatgcatgaggtgaagggaggaagttgagtacctgacagtgagaaaaaagttggtttgaatttgccatctctattgattacaccacaagatcgttaggtgttgttcgtgaaaaagcatcaacacaaagcatggatggcactagtgttttaaatagcggactaaaaacatttagctgttagtcttctcaaactactataacgggctaaataaagttatagcggctaaattatacatgagagtaattagctagacttttttaaaatagctatagccaaagatttaaaaccttagatggcacctcgactagataggtaaggtcgccggagagaggagctccggccgccgtcggcaataattctgatcgaagcaaacttgaaagaaatcttgtgtaatttcagagagagttcggcccgttccgatacctcaccttcccaaaccgatttatgggccgcaattctttactgggccgaggctggtgaggcccacgccaagggtatttcacgataatctaattctaaaattaagttttaaaattctagctttgattatggctgataagccaaaatccaaacgtctgatgctcaatattatcgatgctgtagctcgataatccgtggcaataatccactcggtaatataaatcaaacggggataaactttatcggattggcatgcatattgacatttttcagtgcgaagattccttgaacagagcttaaatatgtatataacccatgcgaagattcctcgaagcagttcagacttcagatatatctgaacttgcgtagtgtttactcctccagatatgtcaatctaggtagaaatagatcaatggaatggaattttgggaaatttgtggcatcgaagcaatgcttcatatggaactgaacaaatcagtagctcagtgtttccaggctaatatctgggggaaaacttatccaataattcatgcttccaacggcacatcaattccaagcattcaagtctccaactctttatatatatctcaggtttccatcacattcaagaattacaactacaaagagttcacatcagttagttagtttgttcttgtttctgacgaagaaaaaggccatcagttgtaagttgattccaaatgtttctgcagaagattcaatccatcattaaactaacaaatgtttctgttctttgcaggaagaagacgacgaagaagaatcgcatcaatggaggtgaagaaggtggccatggttgctgtctgctgcatgttcatactgctgtttccaggccagcagcagcaggtggctgccatgtccaggatctgcagatgctaccacgaatgcttgcccaactgcggcctgcgcaattctcgctccttctgcaaggtgttctgcggcagctgctgcgtcttcaatccagttcacaattgcactagcaccgatgcggcggccgcggcgccagcgatcgccggagacgactgcagaatgatctgcctgaactccttctgcggcgaggcagctacaggctactgtaagatgcccattttctgcaattaattttgcatgtcatcttttctttcttcattttggacttccctttgctacgcttcccaagtttctaaacggtgcgtctcgtgaaaaaaggatctatataaaattattttagactttagagtagttctcgaaagcaatatttttaacattggagtagttaattcattcgtttgcccttggatttcagctatcgcatctttagcttcctgaatccattacaagcctgcatatttgattgattagttaggagtatttgaaacaatacgctgaattttccatctgtttgattgtttgtcctttgtgtttgcattgcagtactaatgttggtttgtttcgcagcggggcgaaacgatgctgatgctgcagcttgtctcgatggctgcagcaaaggatgaactggttcggaggaagtttgacatgttgtgacgatgatcagtatctgctgcgattcttgaattgactgttagagaatggtcgacaacaactaaatataattaactatgataataagaacaataataatgtatgatggaatctcgatcgtgtgccaccttctctggattcgatacggaattacgtttgctgtaacctgcttgctactgatcattatataacgttagttgtttggttacagtgttcaaatattctcgtattctctgcgagcaatgcaatcttgtttacgaactgaaggatggtgtttagatcatactggatttatgaattttatggtttttgagagttaccgaaacgtaccaatggtttagtgcaaaattttacatgaaaaaattctcaagataagttgaagatatactagattatgtactatttcgcaattttgaatacctaaactctgagcgtactaatttgctaatccgtgccttaacgattaaagataatccaagaaataccattaacaagtgtccaaatcccataaataccatcgataagtgtgagttccaagaaatgttatcgtacaaatgactttatcccaaaaataccattgttgttagggtttcatccattttgcgccgttaagttctataggataaacagtgtatttaacggcgtaaaatggatggaaccctaacggtgatggtatttttgggacaaagtcgttaataataatagagttagctctggcagataaaaccgttgatacgatgagagcaactcaccagtcaccatcctcttgcctttggtgtcgtacaggaagctcgggcagccgttcatggcgacgagcagcacaccggcgtcgtccaggacggccttaccatagccgtggggcttcacctcgccggagtagtaatgtcccggcggcagctccacccggaggaggcgcacccagttctcacctccggcggcggcggcgatccagacgtccatgtacggctcggtcgacttcatcgccgtcaccgcgagcgcgccgtgcatgtcgaacatggggccctcgtcggcgtggctcaccggcggcggcggcgccacccgccggaacgtctccgacaccgtgtcgaacgccgacatctggccgcggtcgtcggtctggcggcgaccccagtacacggtgtcgccgaccgtcacgccgaccttgacgcagaagtgggagcacacccggcgttggtggtccgggacggggccgagccgccgtggctcgctggcgccggagccggtggagaggatgtagttgtcgccgttgcggtagcacaggacgcggtgctcgccggaggggcggtggaagtagaaggcggacgggcggaggcgtttccaccggcggcagatcgaccagctgccgcgtcgccgggttgcagatgagcacgccgccgtcgccgccgccgcccgtgttccgctcgaacagcaagaggccgtcgcaggagccgcggaggctgacgcgcatgtcgcgccgcagcaatatccggcgacccgcgtcgtcgccgtcgcagaaggctgggatcacggaggtgatcaccgtgaacacgtagctgtagggcgacgacgacgagtcaacggcgagccccgtgtaaccgagcagctgcagcggccggcggcgggagtgggcggcgacgaagtaggcggtggtggtgatgcggcgccaactccggcagacggcgcggcaccggagcacggccttcgccggcagccgcaggaggatctccgcccccacgtcgtcgcccatcgcggcgcactaatcttgacgctggtcaggtcaggtctctaccacgtctctagttaataagaactagtgggctgggcttcttttattacgtggactggccttcttttgttcactgggctggacttgttgcatcttgtggtatgggcttcttttgttatgtgtcctgggcttcttttattatgtggattgggcttcttttgttttatgggctggacttgtttcatcttgtggtatgggcttcttttattatgtgggctgggcttcttttgttaaagcgcggccttcgcgacaaacggg

SEQ ID NO: 65685 - DNA, 2931 bp, Oryza sativa
cgccgacctccgcctggacgactcgctcctcctcctctccttttcgctcgccggggaaccagtcgccctcagggtccccgtcccgagggtgctcgtcgacccctccgcccctcccgagtgccgcgacgcgggggaccatgtcgaggtccgcctcgcgctcgtcctccccgtcgaccaccccgtcgtcgccgccgccttcctaccgccccccggcgaggagccgcccgcgcctctctccctccgcgatggtgagctactcgtgtgttttactgtcctgtgaagttattaggtagtagggtttatgagctttctcgttgattcctggccaataattcgatccccgctagtcactccaaatcgtcgtatgcctctgggattttagtactaatgaaaacctaagtcgatttgcaatttaaaatgctagtaaaatgttactgtattatcttaatgtaatctcccctgtttatattataattatgaatttgtgattcattttcttggatgaacagatataaagaatctgtcttctggagatgttcacttgtactgcaaagcatgctcagcaagattgacaaaacagccactaaggtagagcataacagactttgagttgtgacttatagttgttttgcactttaccatgtctaatggtctgtttatgcaccgcgcatatatttctttaccaatgaaaagatacatgcaaatttcaacttgcttacttcttaaatcatatgtttgatgctctggggttcacatttagtagcaatgaaaccaccgcatgacatcttctttatcaagttaaacaatttgtcattgttcatgtcctcctatgcaacctattctgttcacatgttttgtgcaaataacttcaaacatgtcttggactttcatatcatcgcccttggttttaagttgggggaatcttccttggggggatggcctgtctgcttgatcatagaggtttacgaaagtatgataaaatgttctgacctctacagaagcagtaattttagggtattcaacttgtgtcctgactgagggatagtattgaaaagtgggaataggaaagaatttgtcccttggttgtttattggttctcttctggttctcagttcgaagagatataattcagtcgttagatgctggttttctgaattcctatagtggcatttattctataatcagtttgctgttatctgattatctccaagaaacccactaaagcagtatgtccctcagtggtatggaattcttattgcaagcaagcatgttatgctaaggttttggtcacttgcaagctagagtttaagcttttgatcgtgtttcgcaattagatcatagactatacttaaagaactagggaaaacctatgtgccaaagttcatatggtggagttctttttttatattatctttggtgattagtaaaatatacatgcatatgttcaggaacatcgaggaaatgccatcgttaaactgggaagatgtggctgacaattggtttggtggatgttgcacctcatttggaggtgcaagcgaaaagctagtatcacagtatatcaatgcatatgggcgtctagagggaacaagtctactaaatgctacctccattagcatagaaaaggattatcttgagaaggatttagcatctgggttagttagttcagtgcccagtaacgattgtgatgctctgcaggaagatatatgtgatgttcacataggagaagatcataccacggggaacatggaatttaatagttcagaagagaaagcatatcatgaaaagcagattggttgtaatcatgtgcaatgttctgttgttcctgaagagggtccttgtgtcagtaatagtgaaaaagatggagacactctttggactgatcaatctggcatcattaaagtgaaccccgaggagtctaaaaatgactcttgtgttgatgacatagagaaacctaccaaagagaccgatttgttgtctgtagatccatgcaattgctgttgtgacggtggaaacagcagaaaatctgaagacaatccttcgaacgtgccctctgggaacctggaaatgcaggctaaattggacacccaaagagattacaaattaacaaaaagtatatctcttggttgtagcttcattgtgaaagcatctaaccttgtaaatgatgttgaatggcttgaacttctatgtgctcattgctcatcacctattgggtcatacccttcacaacattcacatgctccagcagatggccgtgtacgactatttaaatgctatgcatcgtcagaccttcatgttgggggacctcatgatgtgttcaggtcagtatcttcacttctcattgaatattttgtacgcctctcaaaggtaaaaagggaagggaaaccagttcagtatagctaggcagctaaagtctatggtccttgctagtaaactgatttcatcactgatcataaacatccattatctttatgcagggggcatacattagaaagactttttgttaatttgttgcttgaagttgcagaagatgaaatatcttttcgtacattagtcagagatctgaaaaccaaaaggcccatccttcaaatagtcctccttagttcaaaagcgtggctgttttctggctactgctatgaaaatgatatggatggttcacatggggcagcacatctgcagccctctgttaagatcttgtattctaattgcagtaatgctttggaagaagacttaaggtacgtgatctgcttacacagctaatctagacttgttatgcttttcttctgccttttatccatattaaaagtgttttgggtgtttgtctttcttgtgctaaatttgtaaagatatattgaagtttgcattcttacatacaaagtggaacaaaaaaaactctgaaaaataattgaagggatacacaacccctggccatat

SEQ ID NO: 65686 - DNA, 10344 bp, Oryza sativa
tgatgtttcatctgtagttacagaatcagagggagaaaatattaacaaggagacggaagatcacaagcttggtcttcctgtgcatcctacacaggatgaaaacacaactgagcagggatttggtttggaagatacagaaaaagagtccatgtcaccagagaaggcactgcctgctgaaccagaggagcaagaagagaatcaagtaaccaaagaacaagatgaagaagacaggcatgatgcagaacttggtgatgcacatgaagaagatcacaaagaagctgaacaagattatttgcctgtctctagtttcctgatgaacctaatattgggaaaagacaatgatgatccaaagaaagattcagaaaccgaggttgaaaaggagcaagaagaaacaacgaaggatggaagttgtttgatcgcttctcaacaagaagaaaatttggtggcatttcctatagaaaaatcggtggatgaaaaactcacctttgaacaagaaaaagaaaaggtagaaggctctgaagaaacaaaagaaccagtaaaagaacagagttatgatgtcgagatggacgtccaaaaatcattggaaactgatgaagagctcaaaaggaacacttgtgatttggaagcaccagtataccaagataatgcccaggatgaaatttctagcaaactgatatcagccaaggcagctgatccgatcaaaaaaatggaagctagagactttgaattggatgaagagtcatttgatacagtttgtcaggaaaacgtggaagcagcaacagaaattgaagacggaagcttgaatagggaccaagatgacataacaagcccaaaggcttcacaagaggatgctttggaggaagtaggaacagaacttccgcatgagtctttacatgaaaatagacatggtgcaaaggatgagcaaacactctccttgatagaacccgatacaggcaacgctgaaaaattgcctaacgaggctgacagtgttcaaagccctccttgcacagaacaagaagagtccattgaatcttcctatgttgaagtgagaagtactactgagggtcaagtggagagtgaagtaatagaaacgaatgaggaggaccagcatacgaccgcaggtggacatactgaagaacagatagaaaatttacatgatgataagtcgaaagaaacatgttctgaagaaatatctgatgagcaggcacctgaaataactgaaccagttagccacactgatcgaaattttgcttatgaaaaggaaattcctgcaagttcgacatgcatggacaagaaagagagtatgatctcaaacaatgaagtcagcaactttgaaaaagcccttgagacacactcagatagtccaaatttgcatgttaaccaagataagaaagatgaaacagctgataaccaaactgtggtggaccataacaccgtgttagacaagcttgaagattctaatcggcaggaggagcaggaaactgctgcacagaagttaccaaaagaaactgaaggaaaccaggaatttatggcaataacagagcctgtgatcaaagaagagaatgtacatgaaacagttgaaggtaacactcaagcagtgaagataaaatctaatgaagagaaagaactttttgattcacaggttcaggaacgtggtctcaatgtggtttcacccaaagcaacttctgaggccgacgaaaaatttgtggagataacaaagccagaattcagcacagatgaagaacatagtccaaaggcggatgaatcaaataagccagacgagaatacttgtgatgagaaaacaaaggctgaagaggaaactaataatatcactgatgaagcaacagtgaaaatagaagaacgaggagcagaacagaaggtatcacataaaaaacataacattttgtctggtgttggatcaaaggtgaagcatcaactagcaaaagtgaagaaagccatcataggtaaacctgggcacacaaagtctgaatcaccaaaatcataaaattgattcaccttagagcatgtaattcttgtacaatatgtatttttgtaaggaatttatgtgaggtgtaggatattgcaatgggtttagtgaaccatctgtaattttgtatgaacgattcattcaaaggttgtgttcttaaggacgcttgtaaatataggcaggcagtgtgtagttcaagtttccataaactttgtaattgtttcaccaacttggtgtgaggtgaacaacatgtacatggcatattgtttttgttacttcctcattgatatgcatgtgttgttttgtggtaatcatgcaacatattctacacttcttcatgaaaccatgtgatgttatgtggtgttttgctctgaatctagctagtgctaaaacatagtaggatgaggttttacatgtgaatgaatacaaagaaatcacagttcagactccttagagaaagaagcaactactcatgttgctgacctacgccttcatttggataagcaaaatgaatgctggacagaccttcgctacagaaaaagtacttggcctctacagttagcattctactactacgagtagtagaaaaatgctgaagagaggaaaaaaagaagatattgtagaacctaacctgatgtgaggcgataaaccttaatttttcccattgccagctcaacattccacccacccaccatgacaatcccaaacgcaggaagcaactttggattggcactgcatctgcattgcatacagaaaacccatccatcgcggattctgcaggatccacggaccacggtcctccacgcacaatgctctccatccccgtcgcgggcgcacacccagcggcatgaaatgtgagagcgggcggcggagaactatcgtcgagcaggtggcgggcatgccgtggaggagacacacggacctgctaccgcaacggcgcttttggcacggggcagtgctggcggccgcccgccgtcactcgttcttcaccccggggtagcccccggtttcacattgcgctcgtcccctcctctcccgagcttggcgaaggcggcggcggcggcgcagccatgagagcgggaacagccgggaaggcgaaccaatcgcaatttccccattaaccttgttcgccatttacggcgacgcggcgtatggccccgtcaccgtcaggcgtagtatgccgctacggacaagagtgttttgcacataaattcaaatttcgttttcatattataggatgcattttgatttgcggagtgttcaaaaattagatttggtcaataattcttgtacaattgatatttaggctgcgtttagatccagggtgaaattttttgccgtgtcatatcggatatacggatagacatttgaaatattaaacatagtctaataataaaacaaattataaaatctgcctgtaaactgcgagacaaatttattaagtctaattaatccgtcattagtaaatatgtactgtagcaccacattgttaaatcatagagcaattaggctcaaaagattcgtctcgcaatttacatgcaatatgtgtaaattagttattttttcgtttatatttaatactccatatatgtatccaaacatttgatgtgacgtggtgaaaaattttgttaggggatctaaacaaggccttagtagggtataataactacaaaaccaacataacaaaagttaaatcctcacatttttcataatatatacttgcattttgcatgcactaacgtttgaaatttgttcgattttcttttagctaggccagaaactgaccttggtgaattggtacctactccctccgtcaccaaaaaacgaatagacatatcctagtacaacgaatttggacagggatatgttacaattagttgtacaagatatgccacatccagtactaggttggttttttatgggatgaagggagtagagaggaaaatggaagcacgggtgatccatttgaggccaaaactcgacttaaattttgaatttgaaaataaaaagacatgtgaaaagggagcttgtacattagcttcaagtacatgcacatttttctagaaaaaaagatgtaaggagagcaggggttcaaaactgaaaatgcggtagcaacaggtgcatcctctcgaaagctcttgcacaaccaaacttcaaacaaacagtacaagtaattccaaacgagcacccatattcagacttcggagtaacccattacaacgagaattgcagattttgtttcacgaacaaaatcaagataactcatcccttgtgtcttgatgcaggtattcggtcacacatctcatgaacagaatttgcatatggtacacgcagccagattctctcagaacatggctaaagaaagattgattaatcaagtattccccatcgctaacattttcagtttttcagactttcagttaatttattgacaaggccttgcaagtgactattcacgtcagggatgttctccatgttagctgagcaacttgaaagcactcgtgctcgtgtatgagtcgatgagagtattccaccacgacaccagaaaccaaaattgtacagccagcacacttgcgagctaggacactttgtgcgagatttttatgtaattcatgagcctgctcagggctttaccgctgtcaatggcttctcttgccctgtcaagtgcggacttgatatcctcagctccagtgcagcctaagaggtggtcaaccatggcagcatttaggactattctgtcataggctggtcctttctccccactcagcgctgccaaacccaactccaagtttttcaggacctgattcagtccggagatacagtaagtaaacattataactatgctaaaaatataatatcctactaacatgtcagggtgatacacgttaatacaagggtaatttggaacattttacaaagcattaacagacttgtatggatgactgccagcctctattggaagttgacggcatatagaaatatgaaactaaggtagaacaaccgcaggcatgggcaaaatggcttactgatctatcagttcgtggagtctcagtggattcaaaaccaagttcctgagcattcacaatgacactgaagccctctctagaaatgcctgaaagatgattgagacaagctcaggctgaaattatttcataaccatgttattgggcatttcaaaacaagcaatccagattagtcattcacaaaacctctttttttttaaaaaaaatatgaatcaacttccaagatgtataaatcttaaatttttgaaaacactgaacataccccatcatcaccaacaaacacatatgatcactatgaagaggaatatttataatcaataaaaagcgaaatatctttaccatcagtctcggagaaatctgtgctgtttggtatccggaaccctgagcaatggttcactggaagtccttttgatgcatgagcagatctttctttggttgtcatagaaagcgcaccctcctcaccctacacgcgcaccataaatttgagaaatgaccatgtttaattattggatttgcattccgagaataatagagaagggaaagaagctgtttgttcaaaagttcaggagaatgacctatctgtcagaaacggaactcaaaatgttaatagcgcaaggcggccaatttctacatatgtggtcttagcaacaagtgcacaaataaacccataggctgggttatatggggcaagacatctaaacagtaacataaagcttaaacccgccatataacacattaacacaagataatacctttacaactagtccagcatgaacagttctcctcctcatgagcataagcaatggatcttcatagcccacatgataaaatccagcaaccattgattctcttcctcgcgcctggtggaaaatttgaagacaaataagccaatcaaccagtagtatttatttaagtgagcagaacttgtgacatttacaacagaaacataattgaacaaggaaggacatataataataatgcattcatctcaaatttacaacaaattaacaaggattcccaaatagtaggtgatacagaacagttatatttttacattcaatgaatgtagaattacaagaaatatctccagtcttcttgacttgtagtcaaagagttttttatgcatacattatgttgaggaaacactctgaaaatgtaagctactaaactgccaaacattttactaagaaatgaagacagtaggttgtactaaatatttaaattagtagtttatcaaagatctgccagcagtgaaatgtgaccaattttatgttctacagtggtataatatgcacaaatgatctacaatgtatatataaacataaaggatgctacaaaagttataatagttgtacccattatggtgctcttatgatactgtcttccttacaataaaggactacaggtggatgagaagagttactcactctcacaaattgctgaactttctcagaggtagctagcggtggccgtttcttaatatgctccctaagcccaataatcgaatatctggaagaatagtgagtaaaaagaacacattttcatacattacaactttcaataaattgttttttaaatgaagacaaatattataaagcggcaacatttaaactgaaagcataagtttcctgcagttccaaaaaaaagtaaaggcagtgattccattttgaaaattttactgctaaacttcatggctgtgtatggacttaagtcagatattatgatcagttttcttcagaaaatcaggctgaggtgccattcctgattatctgaatgtctacaggaatactatatcaacaagacttggtcactgaagcacataattaccaagaaaatgtcaaaacttacaatggtgggcaagcttcttggagacccaaatatgcaaagccggtattctcatcctgaaagcaaccaaaacagttgatataattagatgcagtcagaggagagtgcacaaaaagggttgcaggaaaattaggcagaagttcatgcacacctccagtagtgttttggcctgtaatgtggacaaatgtgtgtttgcacccatgaatttaagcatctgaccttctgttatgcctccctgaaaatcttgatcattaagtaatacagagggttttcaaaattaagtgataggtaagtccatctcctaaccaaaacttccatagcattaaagaaaaacactagtgtatgatgattgttgatgggtatgcttttgtactgaccttgggtggcatccactcaacaccatggaggagacaagcctcaccatagcaggctctaacagctgcaacaaacagagtactcctgaaaaagcgtgtatttccatcatagggctcaccatagtgtgtcaatgatttgacatcagcaactggagttggacctgatataatgtggtgttaatgacactataatttttttatattcaatttgagaaagagaaactgacttgatgttacctaattcatcatcaaaggctagacaatatcctttgagctcgcgatcagtctccctattcatccgctgtccaataagaaatgctgccagcagtgcttcattaaccatagttgaatttgcactggctaattcaactggtagaacatcctttagtacaccctgaacttcctcataacccaaatggccaccagcaagaacttctctcaaagcactgacaagtctcatctctgcagtgctttgaccaacataccgaggtccagttaaaccatttgctcccatgattgttccttccggatctgctataaatttcacctcggggggaagaacattgacaagccgtggccaaaataagctcatggcacgacgctcaccctcactccattgggtggcttctggaaaggaattagctcttattgtcatgccagcgaagaatgcacccagttgtgcactggatactggctcatctttgagttctcccattcctacacaagagattataagtaacatatatcataagattgttatggaaggcaaagagtcaatgaaaataaaccaatcacaaatcagacctactgtaaacttgtcactcaaatacaaccttacaagcaaattgtaaaaatcagtatccaaagtcaataaatgtcccaccgaaagtttagtattacactccggagtacaattgagcataaatcgcgagctaatgtttcacaaaaaagtgctaaactctagaaagctccatttcaagcaaaattttgcattcctagataaaaggagatgagatgttactgcaatcatcataatgtggatcaaaactaaccgcagtctacatattagtgtcataggactcgagttctaaattccagtagtgacagtgaaagcagcagaatttcaatttcctgccgcacagacggtggctgcaacgcaggatccgatcgatgctagaaatcaccaaagctgaagcggcgagagtgcgaggccacccgccggcaaggatggcggtgacttgactcactcaccggagcggaggatggtgtcgaggacgcgcatggcctgctcctccccgagcgggcgcgtctgctcgggccccgtgcacacccgcgcctgcgcctccagcaccgtcgcgttcggccgcggcatccccggcggccggtacgagtccgacaccgccgggttccgcctcaccccctcctccagcaccgccacccccgcctcctccatccacgacgcctccgcccccgcccccgccgccaccaccgccaccccgcgccgccatctcccgcgcccgccgaaactcaccgccgagccaaccacccgccccctccccggcgagccccgaccaccgctcgcccccgcgctcgggagcggcctgagcagcatcgagttcatggcggagcccaaggtcaatgcagccgccgagccggaggaacacgacgactatattttttttacattttagtcctttccgaaaaacttatttataaataagggctctatggcttattcggtatgattgcaaataaaataatttataaataatatatatatatatatatatagtaaatttgttttgtgctccatggtgtccgggcaccattgttgaaattgagtatatacccaatttaaatgagtatgaatctttttcagttacttaggtattaacattaaccactttactaactagttcaaagcaagtttgaactgaatttgaacttgtttttgttagattttgattctaggtatatagcatctatacatataattagttaggtatgtaatcatggattgtgaaataaagttaaatttgagttgttttgttgataggtataggtatgaatcgaattattataactagatatatactcacaatttgaaaattttgagtgattttgtgcattagataccatggtgcccgggcaccatggtgccccatatgagtgtcatatatatatatatatatatatatatatatatataaacaaaggttgaaaaataaacctcgaaaaaaaacactctaaatttaatattaaaataaaaattttggtcagtaaatataagcataaatgaaaatgcgagagaataagttttaaaaagaacaaaaaagtaaaaaaaatacaagatcgaaccggatgggcccattggtcaggattgcttggagattcgtgcggggacgcgcggggtgatcgggggatcggacggcggggagagggggaggagccctcacaaagcgcggcgccgcctccatttcttcgtctcctctccacccatccccatctctctctctctctcgctctcgctctcgccgcggagcttggaggtttgggtgagatcggagcagcgaagcggaggcagccgcagccatggcgttggccgctcgcctcgtctcccgctcccggcaggttcgcatctcccttccccgtccccgtccccgtccccccgcgcgcgcacgcgcgccccgccgcggaaaccctagttttgaggtagatctgatccggcggcggcgccgacgattggttcggttttgcgtgggatctgtggttggttgcgttgaggggttttttttgttgggatcgattgcaaatttgcaatggtgggggttggatgcggtggctgggggtgggtggcgtttttttagtgcgcaagtgagtccggtgcatttcgtgttactgttgattggagcgaatgggatgatgcgatatccttcagattagaagggggaatgctcctctgtgaggggacaaacaagggaacggtttggttgttaacatcccggatcctctcaccacagttgcaatttcccaattcagcatcctcccacatataacatttcatgattcggtactggtcaacaagctatggaaagcttggcggggctgcaggaat

SEQ ID NO: 65687 - DNA, 16160 bp, Oryza sativa
catcaatatgaatgtgggaaatgctagaatgacttagggcccctttgaatcaaaggatttatgtaggaatttcataggattcaaatcctataggaaattttcctatttggccctttgattcaaaggattgaagctttccaaatcctatgaaattcctatggaatgacacattgcatgtagattttggaggaaatttagcaagagctccaacctcttggaaaatttcctttgagtcttctctctcatctgattcctgcgtttttcctgcgctccaatcaaacgaccattcctgtgtttttcctgtgttttgcaatcctctgttttacacttcaattcctgtcagaatcctatgtttttcctattcctccattttttctaccctgcgattcaaaggggcccttacattgtgaaacggaggaagtatatgttatgtaataaggacgtccatgttggtaaagttgtcagtacaaagctatatggaatgttttgttttagaaatctctagcttctctactttttttataactttgtttatgttaattgtcattggttaatgtctctggcttctggcagctatactctgctcaagctgccttggcaaatggaggtgccactcaagtccgcttgtatgccaaggaggcagatcgtactcccgtcaatggtgatggtaagcctcttaaattttaagtgcatttaacaatttattttgtgcaaattctgtaggaatttcaaatgcttttaatcctaactgcaaaactcctttccataagaccattgtgttgagctgtagaaaaaaatgctttctgtactttacctttgtccatcgcagtatcacaagtaatgttatgtgtttttatgtcattcaaaaaatgtttttcaatgcaaaactgaagagattacatatgttcatgagttggagtttgtttgattaaactctgctgtgtagttctgattacttctgtatttaagttgcacaatttactttgtattataattttggtggtctgattttttttttgtatgtatgaagacctattgaagggcatattttttgaggtaaagaagaaatttgagactgcccttggtgtacttaagaaggaaaagatcactattgatccagatgatcctgcagcagtttctcgttatgcccaagtcatgaagactgtaagacaaaagtaagatcacttataatctgtcacatgtattcatggtccttagtttattactttcctttgatttgtcattgtttttgtgtttattttacacatatttgtggtgattgtttctattctctagcgtaaagttcttttattaaataaatcagattttttgcggtttacgaaaccttgaattcattaagcactattgtatatttcagtatctatgtagaaataactcccatttgatattacttattacctactactgtttgccggtttgccctagtacaatttttcatcttccccattgatgtaggatgccccatcgaaaataaaaaaatattttacttgtacattaatgcatccatcctatgcagcaaaacatactctggcatatatatatatatatatatatacttctatcgagataggcttccactttattgctttcattttgtaacacttattctggatgttattgatctatttactcagttatggttccattgtgtaaatgcagggcagatcttctatccgactctgagaggattaaatataccatcgacacctttacaaagggcatccctgatgcacggacttacttgaatactcttcaggagatcaggataaagtacatctattatcattttcacaattttcatcttatgtttttctcagccccaaaatacccttgtaaagaattaaatcaatgtgatatttgcctacataacaattttattgcactatttgcttgtctgaatattcttctgttcacttaatgttacataggagtggccttatagatgatatgggtgctgaggctatgatgatggaagcccttgagaaagttgagaaggagattaagaagccacttctgaggagtgacaagaagaatatgggtctcctcttggcagagtttgagaagataaacaaaaagtatttatcttcatcattttgttatcaacttaagtttgagatagttcagatcatcatttacactgctcgtctactctctagagatatactttttctgaatatttcagtgagaataaaaatccacatgatagatcaaacgtgcaattccttaagctgcttgcatgataattttctggtttcaaaggcgattcagggcatgtatagttattttatctgaccttgctcactagcaagagttttcttgttcgctaacaagggttaagggaccaaatatactctcagatgatggtgtaaccaactgtagcttgttttttactccgtacttaggtgatcgagatccattattgctggcttgcagggaaatatattgatttttcttcctcctgtgcatgctagatgtgttatatatattttttattagttggactaacctttttcatgcttttttgctttccatttcaaaatttcaaataggcttggaatccgcaaggaggatcttcccaagattgaggaagagcttgaattggaaattgccaaaagtgagctgacggagcttaagaaggaatgtgttgaagcaatggaggttcaactaaagaggtacatctctctttatatactaattggttatctgcttgagttgggacttatcagaagtaataagagttgcagcttgctgcatgcaagctaactaatatccagtgcatatcatatcatgtgtgcgtctctattgaaaaaggttaataacacgttgacgtgctttgttatcagggaggagttcaaagacgaggagatgcctgatgtcaagaagttggacatcagaaacttcctgtaggccataaatctctcaaggcattttgaaatgctcggacactccataatggttttcttttccagtgacagccggcgctgtaagcataccaatgaatgttattcttgctttttgtaataaaaactgcaccgaagtacaaagacaagtcaacggttgagttggattgcttgttaccttcctgcgtggagaattttgttttttgtattggcaatgtgaacgccaagcagcttactgtctccctgatgatgcacctgtgttggtttctctgatgatatggacacaccaggttgaggcttaggcaatggtttactgttttcgattacattttgattagaatactttgtttcctctaaaatcattatcctaattaaccgaaggatgcattattcttaagacttgatacacaaattctcagggtgaatttaaatgttagtaggaggattaatctgtgcgcagcaatagcattgccaatcggtaaactgatctggaatgttacgttaaagtggatattatgcgttgggagaattggtaagtacggcctcgggcaggtaatcaagttcaggaataagttcacttgacgtccctcaatttgtcaaaaatattagatataagttctgaaatttatctctaagccaaaatacaagtccctcaatttataaaatttacaaaatcagatcatccaacgtcctagatagtattatgcctgttttaaacttttagctcacgtggtaagccgagtcggcgtgaaacccaggacgacagatgggaccttgaacatctgaggggattgggaggatgggagaagatagtgaagaaagcgttagccactgacatgtggggtctgtgtggtgtggggcccgtgtgggtctcacgctgactcagcttgccaaatcgggcatagtactgcccaggatcttgggtgatcctgtattgtaaattgtcgggcccgttatattggtatagggatgaattcagacttgctgacaagttgagaatcctaaagtgaacttattcgtcaagtttattgcgataaggcccagtatctaatgtaaacatacttgtagggccagatcaatcaaccaatgggccagttctaatccaagaaggcaaggcccagttatagtctaaacatatctgaaggcccagatgggacaaacaatggcggcggcccagaccaatccaacaatggtccagctcaatcttagatcctggctggaaaatacttagattctgcagaaggtaggtgcaaccatcttcattttcatcagccaagatgggacgagatgatcagtagttcaggagaagatgtctagagaagttcatagttcaggagtcatgcagtctaacaaaacagcgccagttttaataggcacaccgcgcacaacagttcatatcatatcaggctggtttgtcacaaactcacaggtacactgaaaatatgaaacgagtatttgaaatgttcaaaatatgagtactgtttatatttttattcatattttgaaatgttcatacaaaaaaaaattaatactcatattttgaaataattttaagaatttttagttatgtttttttattggcaatgtagatattgtccaagaaattaatggtcatagtcaaacagtctcatagtcatcgatagagtgtcagacaatgtgtacggagtctatattattagtgagccgggctaagagtcaaccctttcccttgatccaaaacattgggcgtgagtgatcttgtctcacgacgtcatcgatcgctgcaaattttgagttcgtatacaaagacttggcgtgcgcgatccggtcatttctcgaatcactagcttctctaggactaacctagtgtgtcggtgtaacaaaatagggggtgtgtttagttcacatcaaaattgaaagtttggttaaaattagaatgatgtgatagaaaagttgaaagttaatgtgtgtaggaaagttttaatgtgatggaaaagttagaaaattaaagaaaaagttgcctaagtaattttatcatctttaagaaaataccgaaagatatcatattttctaacataaaaacttggtacttcagagtatctcaagatatcaatttttttatgtagaatttaggtatttaggttgtgtttagtttcttggccaaatatttttttaagtatacggacacacatttaaagtattaaacgtagtctaataacaaaacaaattacagattccgcatataaaatacgagacaaatttattaagcctaattaatctgttattagcaaatgtttactgtagcatcacattgtcaaatcatggcgtaattaggttcaaaatattcgtctcgtaatttatatgcaaactgtgcaattgatttattttcatccacatttaatactacatgtgtgtgtcaaaacattcgatgtgatgtttttggtaaaaaagattgaatataaacacggccttgaggattgtaaaatttccctgataaaatacccataatatttgcattagtttgcgtgcttttgagtttacttcggcatacaaaatattcaaaacaatttggcaaaacggaatggttaaatccacatgtgttacactgacaaatttacttaaagtcaaagtaaatttcagaatagtaaattcggaggagtacacttgattacaagtacattaactaaattgttttattccttgacctgacatgactcatgcacgctagtactcctcccgagttggatcgtaattaaccacgcaactaaattaaccgaagtcgtaattaatgcatgcgattatcgttgatgatcgagattaattagcctaacccctgattaattaaggggttaattaattagctttgcgggtctcgagtccgaatccgaatgggaagagcgggtcgtagtgctcgtcgccgacgttcatcggcagctgctccaccgaccggaaccacgtcctcgccagcttcccggtgaactcgtagtcgccgaacagcacgtcgctgacgccctgcccctccgtccccggcagccacgccgccaccagcgcgtcgatggcgtccatgtacggctcgatcaccagcggccgcccggagaccaccaccaccacgcacctcacgccgccgccgcagacgttctggatcacgctcggccccggcgccgggatggtcaggttcaggttgtcgccgagcgtctcggcgtacggcggctcgccgacgacgaccacggcggcgtcgaacctccccgcgttccgccgcatgaagccggcgtcgggcgcctcggcgaagacgacctccgtggcggcatccacggcgcggcggatgccgtcgaggatggtggtgccgccggcggtgaggtcgttcccggcgaggccctgccaggtgatggtccagccgccgcactggctgccgaggtcgtcggcgtgggcgccggcgacgaggatggagcgcgcccgcttcggcagcggcagcagcggcgcgtcgccgggcttgccgttcttgaggaggacgagcgacttgcgcacggcatcgcgagcaaggtcgcggtgctcctgcttcccgagctcgccggcgaggctgaggtcggcgtaggggcgctcgaagaggcccatggtgaacttcacccggagaatccggcgaacggcgtcgtcgatccggctcatcgggatcgtgccgttcttcaccagcgccgccaggtcgtcgatgaactccgtgtacgtgaacgggatcatcacctgattgcacacaaacattcgaaaattaatcagtcaattaattatgaaatgttttgggtgtaaaggaccatttcttggatcgatatttgtctcttatttatcaatgaaatgaaaattttatgatgaaattagtttttgcatgtattaatgtgtgcactgtactgaccatgtcgatgccagccatgatacccagcttgatggacaacatgtagtctgcatgtgctggggtcgtgatcctgtcaagcccttgccaatccgagataacgaatccctgaaattgaataacacattaattaattttcaaacttaaacagatcacatcatatatgcatgaagatctcacacgtatgtactaccgtctagaaaatagaaatacaagtcgagtttgactaccaattaattttaaatctttgactaattattaaaccaataataatattttacatgcaccgatacggatgaattcatgttcaaaagcacataatctattttaaaatataaatatttctatattgtttagtggagaaaagttgccaagaaaataattgggtgcctctcattgaatgagtggtggttggggggctaaaataaaaagaaatttaaataagaggctattaggaattgcttatattttagaaaaaaataaatactagaaataattatattttaaaactgagactatttttgttatgaccatagtttatttttcataaataaaataacgaaagaggaatttactttcaaagtttatttttaaccatcaaaattaagccttatactctccatttcaaaataaaccaatttagttggagatgtgatataacctagtacgtacgacttatatccaactttagtgtattaagtttatttattttagggtgaagggaatatatatatttgtagacaaaggtatagcatatactacctccatcccaaaatgtagctatttctagcagagtgtcttgtcctaaaataaagctatttctccacatacctcctctcaaccaatcacaaccattattcttcacctactttctcttttcaaccaatcacacactttctccaattattctcatttactttcttaatacctgtgccaacctaaaaaatgactatattttgggacggaggaagtatatatatagtagtagtgcacataccctgaagcggagcttggacttgaggaaatcggtgatgaggaagtggttggcgtgcatcttgacgccattccagctggagaaggacaccatcaccgtggacaccccctgcgccacggcgctgtagtagggcggcatgtgcaccgtcatcagctcccggagcgtcgccaccgtgttgttctcgttcatgccgcgcgtcgtgccgccgtcgccgacgtagtgcttcgagcacgccgccacgctcggcctcccgccggagacgaaggggacgccgcggcggccgccgggagggatctcgccctggaagccggagatgatggaggacatgcgctgcaccaccctggggtcctcgctgaagctctcgtagcagcggccccacctcgggtccctgcacaccgccacgcatggcgcgaacacgtacgggatccccgtcgccctcacctccgccgccaccgccgcgccgatcctcttcgccagatccgggtccctggagaagaacgaaaaaaattgataatttgacactttcttcgttgcccaattgttttaattgatacttgtgatgatgatatgtgagccatctaagtaaatgaaagtgggtcagaatgtcaaataatcgaaacctattttaagaagtgttacactatcaaatctctcggagaagaacacaccatgttcatatgctctcactagctagctagcttatctttgtatattccctccctccggtgatgaataaaatccagtaaaacttttagaaaactattactattggtcttgtgttaaaataagattacgacattattgtatgatgagaaattttacgaacattttaaaacgtaactgaagataccaaagatttttacactagaaaataaaatttggtaacttaagctagctaatatttagatgtaccaaattttacaataaaaattatggtactttatttttcaaagatggtaaaattactcttatgatagtaggggttttttttcaagtcgaatctgtctttttttttccttttcaaattcagcgcgtttgagaaaccattaattagagtgacaacgtcaaaatattactagttggcgagttgggcaattagtaactctttcccttgtccaaaacgttgggacgtgagcgatcgatcgcgctaatttaaaatctcaaatcttggatctcactccatcatcatcgagcactgcaaattttgagagtttatatacaaagacttggatgattaattaatggcgtgcaatctggtcatcttcagtaaacttatcacaactagctacatatgggaatctacttaattcatgcatcattaattgagtttaattaagggggataattaatcattttattacctagtgcagccgaggccgacgttgtgggggaagatggtggccttgtagacgttgccgtggccatggacggcgtcgatgccgtagatcatggggatcccgaggcgcgtcgccatggcgccgcgctgcatctcgttcaccatcgacacccacgccgccggcgacgcctgcgccgccggcacgctgccgccgccgctcagcacgctccctgcaatttgagagatatatattcgtcttaatttaatggccggtttgagtagctagctaattttgattaattaattcattttgaatctgttttagtatttacatttatttatggagatgcatgccctcacttgtgcttgcagtgaaagctaagattcaaaccttgtatttacaaaatcattagtatcttataatatccatatttccatgaccatatcatacggattcagagtgtttgactcccaatctcaccaaactggttcgttagacatttgtctgcattacccattatcaaagtacgaattctttaagaaatgttattttgttatagctagcttaaacaaactcctggccgaatcacaatatagacattcgttcaaacttcaaactttttcttcacgaacgcgtaaaatctttgcatgtcaaaaatatatattagagaacttcagacttcaaactgttttagtttgacctgcactatattatagttttttttcaaacacgcaaaagctttcatcgatattaattagatattatatataatttcctgaggtgtttgcattcgcattctacttattatatgtgtatcttgtttttagatgcaagaatcaatatgtatctctgctgcaagaaccaagaagcaatcaagtataccaatgaagtagttgcgcatgacgtcgaaggtggcgttctcgcgctcgatctgcgacatctggccgatcttctccgccagcgtcatccgccggagtaggtcgtcgatcctcttgttcagcggctgcttcgagtccttgtacttgggacactcccctcctcctccgccgccgcccgccgccgccgccatcgccgtcgccgcaatgcagcctacacacaccaccaccacgagcacggcgccgccgccgctactacctcgccggagtagccccattgctcagctcaggctaagtgagatagagttggatatgaagtgatgagttgatcgatggaagcttaattaggtgtctatttatgggcgagtttagtgacccaagtgaccaagtgtgtgtgtcggtccaaaaatattcatcgtattaaatgtggggctaagatgaggccatcgagctagtttgaatggttttgagtttacttcgacatttaaattgctcagaacaagttggaaagcagggttgttaaatccacatgtgtattatgcagacaagttgcttaaagtcaaactgatgaacttcataattgattcgatcatggtcggtactgtagtagtttggatcctctgacagaaagaaaataaaattgctccatttaagtctctgaagctcctgcaacgcatgcacaaatccctaatttactgaaaattaagatttcttttgcttgtcagtttggacaaattcaggccacctcgcggcttgccctaaattaattatctcctagattcctaattagtctcaccggttgccattagaacatgtaaaatggtcattaacagcgatctcacctttactaattaagaatacttacttattgatacgaaggatagaaagaggagagataaaatatcgttattatgggtaacgactcttaacctctataatataaaagcatggttgcatatataaaggtgaaaaatgaaaaaaaaaagtaataaaagaattttttttagctaatggtgagagtgttttaactgttataaagatacgacttctaaataatcttgtattttctaatggatcatacacatatttactgttaaacatatacttatctcctaattaatcccacgctccttcattgcgtgcacaaatccctaaattactggtaggtttttttcgccggaggtgaagaagatccgaaccgaattacattaagatcatgagataggcttcagaagtcatttgccggttgccacaggctaagattatctcgtatgtttaggcggagctacataaaagggattagagtttctaggcacctggtcaagtggcggagctaggagctcgacacgcctagggctcaaattgaaggctaacaactatccatatcaattcgtacttggaagtgcagtacaagtacgaaaaaaaatgcaagactgaaatacaatttctaaatatgcaccaagtacagtaaaagtgtagaaaaagtacaagactagactaaaattttattagaatacctaatgcgacgtatattcatgattttcactcttcatcaacagaaggtagagaacctgaagatgaatatagaaaatgatattacataatgtaagtgatgcaaattatgagaacttaattatttgtagacaaagcaatgcatgacatacctctaggtaatttgtgcttgcgcgtcctcaaagcacgataatgttgtataatctgacgatcttcaatgctagtaaaaacatcccgctcaatatagcatatcatgcagtgattcatccattcatcattcatcttgttccgcatgtcagttttcataatgttcatagctgagaaggctttttcaacaggcaaatttaaggttaattcaattaagtgatacaccaatggaaaaattctctatcactttgaaccatcttaacagcaaggttaccaaggtcagagcaacttgagaaatccaaatcagatctcacatcagagataaatgtgttaagttggtctctaaggactatacaatcatattcagaaaaagtcatctgcataaatccttgccccgcacctgccgcaaggaggaggaatggaaaggttttttttttttttttggtaggaggaaacccattaattaattaattaattaattaactaatgagaaattaatggaggacaaatatggggccttcgtaggcctcctttctgcgcgctatggcccacacggcccacctagtatcggaaaataagaaatcgatcggaaagaaaaccctagaagcgaagcggagagaaagcaatggcgtccctgagcaagcgcggcggcggcggcggcgaaggggagggcatcctggcgtcatggatggcggcgcatgggcgcgaggcggcgagcagggcgaagaaggtggtgcggagcacggggaaggcggcgtggatcgcggggaccaccttcctggtcctcgtcgtcccgctcatcatcgagatggatcgcgagcagcagctcaacgaccttgagctccagcagcaggcgctcctcgggcccgcgcccctcaaatgatccatccatccatccttaacttctactaatagtgttcttgcctgtctagtcagacaaatcaaacttcttgttttcattaatttcaccattatgctgctctgatgagatgtcgtcgccgctttcctttcctgatgttactatttttcacgctcatcttatcatgccaactatatttcgttctgtgcgattcctgcgccttgtgccgtttattctttctcgtcatatgctgctgtgatgagatttcgatttgcatcgaccagggttacttttttttttatggattgacatctccaggtttatgaacaacagttactataataattaaggttttctttttgtaaaaaaacagtatggtctctgtaataaaaaggagaacattgtactccagtttataaagttggatcacaaatgggaacttatgaagatttcttattcataagagtatgactcgagcaaagcatatgttggtttgttacgcccccgaaactttggcaaacaacaatgtgtgatggtaaccaagcattttgatacaaacagcaccactttattgcattttgatacaaagaacactagtttttattgggtactccctcaaaattgcactcctaatttaatttgaagagtgcacttattttgagagggatgaagtatatatatgcttatctaaccaaaagaacttttacgttataaatttggattcgtcactaaccaaactgtcattgctggcttatgatagattttctggcaaaagaatgacattgctggcttgtgatagattttatgccagtattagcaacaaactgggcagcgactaattctcggttgataaattagaattaatttgagaattcatccactgacccacatatcatgggcacgactgggggcaaatcctcaatttctgatctaaacgataagtccgggtatatgataaactcggagcatcaaatcgatcagcatacctcgaggggaagcattgcaaacaatcacgcaagagaagctgagctgctgctcctgctcttaatgcaggcatggcacatcaaggacgggcatttgcatcataataaaacgtctagccaaagttggataccacacattcttcgtcaacaaactgctgctgcgacaaaacccaaaaccaaaaaaaaaaagcaacctaacggaacggaggaaacaacccagtagttcttagttatgcagctctccctcccttttgacggatcaaaacctcatgcttgcagcatatgcatatcccaccaggccaccaccatggggtggtgaaccatttagtttcttgcgttgtggctccccaaaatgcccctctcatggtgaggaacacgctggtagccatttgatggcctgccactaccacggttgcccgcatattcgttgtcgcctccccctctagcataccctcgccctcctccaccgaaacgacctctgcctccccttcctgccaatgccaaacacgcaccaggttcatatcatacttacgcaagtatatgccaccatcaactacaccatgaagctgtgtgtagtctgcaagcaaatattgcataggtgttggaaaaataaaagagcaacttacttccacctcttatgccgctgttaggcttccgctcctcaacatatatctgccgcccatttatttcaattggtgaagcctgaaaattggcaaaagatttagcatatgacctgtcaaaccatgattactaattcaagcgaaggatgaccatatagtgcattaaaaaaggggaaagcagaccaccaattaaacatcacagtaattagtaaatggtgaagtgaatatgcattaaatttgattttaaaggagtatgcacacacaaattggagaaggtatttaatgcatgtaaaaaaaagtgagttttgttgaacagtttgccaccttcaatgcattgtgaacaccactaagttcttcgaattccacgaacgcatagtagcctccggtctcctgccaatgtcatacaaacactaagtcaaaagaaaattctatcatatcacgtaataaaaaatacatataaggaaccaccttgcggcttctgatagcaacaccatcaggaatgagccgcccaaacttcttgaactcattctcaagatcagcctcagatacagaagatggcacgttcccaacatagacagatttgctctctatttttacgaacagaaatattaaaagtcagtgggtaatgtgcaactcaaatcagtgaaagggattatgatgctagctcaaactaaaggacaaccttcatcatcctggacagcaaattcaccataaacatcggtttttggcttctcggttgccacagacgaagtcataaccgaatgctgtgcagcctggtttgtctcggttgcctggtgaggtctagtcggggctggctgggctacagggaacaccagtggagcttttgcggttcttagctgcatgagttataccatcaaggttttaaatatgcatgagatgacatcacaaaaagaaaaataatcatgatcaaccaagtgaaggtgcaacatacaatggaggcataggtcttctttactggttcaccaacaggttcctctacatgaggaggtggaacaggtggagattgcactggctcctccggtgccatcgccattccatttgtaaaggaagaaattggttcttcaggaagaggctcatctccccaattgtctgactgagaaactacttgctgtggtggctcagagtaagtatagttctcaacagcatcactttcttcagatgttattgggacagcactttgattttcctcttcgtgaatgtactctggaacttgaggtagaaaatatatagttagtaactacataattgcaaaaattagaaaagcagcagcaataggcctattcatacgtgcaaggtattgacttttattttccatggcaacattacaatttgaaaccatcagtaatcaacgcatacggaacatactttttgttggtgctcatagacagccaacacagaaggcatgctagaagatataacatagttcagaacatacgaataacatggcacaacagtttagatagatcattgacagagaataagaaatatggatcgcaaataggaaaaagaaataagaaatatggctgaacagttaaaaagaaaattgcaggaaattatgaagctacaaagatatattataccaggttcgacgacggagttggatgccatgttggtctcgaagttgtcctgggcaataacaggtgcaggttgcacttgctcttcgtcaacgaaatggaaataatcattgagaacaaagtaacccttttcctggggagcaaggaaaaacatctggatgaatttcctttggtggctgtactccttggtctgtacaagaccagataccataactagcacaccatcaccccatgagttgagaaagttggctgttttgatctcgatttgggtgaaattcaaggacataatgagggagtgtatatcctgcaacagttagcacgcatgcacgcaagcattagaagaaggctatgtagagtaaatgcacatgacaggtcgacaaggaaggaaagacaacatcagatatatatgtacaattcaagtcagtaagtcagtcaagcaa

SEQ ID NO: 65688 - DNA, 6001 bp, Oryza sativa
catagttactctacaaatttgtactacgggggtagagctgggtttttgctgctccacagctccactccactttaaaagacacactaccctttaaaattttagtgtatttacatgaaaatgccactgaactacctccaccaacctccccctcccgttctctctccttctccgtctccctcccgagccctaacagatgcagtaggcggcatcggcgtcggcgtcgggctgcggcgttggcggcggcgccgtcgatggcggcggcaggctgcggcgtcgttggcaggcggcggcgtcgtcgtcggcggcgacggcaggcgccacggcggcggtgcgcggcaagcacgcgggaggaagatgggcggcgcgcggccggcggagggcagagggcgcaggggatggggcggccggcggctgggatttttgtttttatttttttttattttttttctttttttaaatctgaagctgaaatgtagccaaacacttttgatgggtgtccaactccaactagagttagctcccactgtagtaggagtttggagttaggagttgtagtttggagcactaccaaacggagcctattttagcgaagtgttagcgtttgattttcatggatcgtcgccgtgatgctcgggtgctaccgggaggtgaatccggccactattatagtacttaattgaagtcatcgaactcgttgccgtcaaaaactaatctattatttaaaccgattatttatccctcgtctgatgagtaacctgctctgtcacgtgtatcatagctctgctcggccttgtttggatccaatgaaaactcccagcttctcatgggaaatgggccggaatcccggtatgttagttaaggcctcatggaagacagtatgggatcatacactgacactggccagcagggtttacaaatagcaatctcgattctccggaaataaaaaaacacaatctaagattggccagtgaaagacgagccctgttagattgtaataattggctataactctttaagcaaaggccggaatgtttttccattatctaaaaagaaagacgagccctgtgaaacattcgattttttttcgcaaatttcaaacaatatacatgttaaacaaatttcgacacattatgaaatttgaataagacgcacattttcaagatgatcgaaattcgttaaagatgatgaacctgttggccaagatatattgagatggtgttagagatgtaatcctgctataatatgtgaaataaacagttttaaaaactcggtctagccatatacccctccatcctaaattacagggtgtcccttttttttaaagaaaacttaaactcggtagcttttgattaatgactatactaaccatacatttttttttgcggggaaaagggaagtattactcaggaataatatcgtcaattacaagctttgagataaaggtgcaatcattttcacaccaaaatcccgacaagttttcactgcgacttttattagctaacatatgactaactaaaatttggcttctatgaaccttcctgagcaaacactcccgacttccagcgaggagatccttaatctctctaacggcaaaggcaagctccgagcgctcaacttctttggcttggatcatttgtaacgctaccaagcagtccgtttccacctgtactgggagcagcgtccactgaagcgccaaggcaataccctctctgcacgcgaccaactctgcttctaatgcactatgacagctgttcagggttttgcaggaagcaaaaatcaccctcccctcccagtccctcatgactatgccaatgccccccttctctgacagggcatcaaaagagccatctatattaaccttcaaccatccggtttgcggtctcacccatttttgtttgcaagctggtcttgatcctggagggacctctttcccataagccaagacagattagaacgttttttcctttctctgaaccaactacagacttttgtcggatgttgaacagtgactgaatatagctctcaaggaatcttttagaagactcgatcgttggaggggttttctcatggacgatttcattacgaacaaaccaatttcgccataacaccaagagaagggccgcccgttcagattcggatagcctgtctaacagatcaaacagccaggctttattatccatacgcacatcagtgagcacaggaaagtgcccatcaccttgcatagccatcagcaaaaatcttgactgggaacagcgaagaagagcatgctgggtgtcttcagtttctgacccacataccccacaggtagctatccgctcaagcttccttttcgttttattagccattgttgcaagggagtcagtggcaaccttccaagcaaaacttctcactttctgagggacttcacacttccagatcaggtcccatctacgatcgcctgccatattcgacggacctgtatcctcttgattcttcaaattcagagccaagtaataagcactcctgactgagaatctaccatgcaagtctggatgccaagctataaaatcttcgtcctcccaatttgaaatacatatgctaagtagtatgcatgttatattattagatttatattttaaagtactttcatgtgacgctaatttcatattcgttaggaaaacataacattaaagaattactgatcaaaataatttgggacggaagaagtagtagtgcacacttttttttctcaaacttaatttacagctaagctgcttagaaacaacaacaagaagaagaacaaaaaatcaatgacgaatcacattatatcatccagagaacacatctagttatacactgacgacgaggaataactaatgcactactcagcaagcaataatttatcaaggctacatggaagcatcggcaaggtccttcctgtacggagccggctggtcctcgtcggcggcggaggcgtccaccaccggcgtcccgccggcctccacctgcgcctgcgcccgctccggcaccggcacgtacgtcgccaccgtgtccttcctgaacgtcaggtagacgacggcgaccaggtaggcggccatgagcgcgaacaccaccacggagatgaggccattggcatacttggggaggttgttgtggacgagccagtccacgtatgtccacactaggaagtaggtgttgacgacgatgagcgcgaagctcaggatccacgcgatcaccaccgtctgcaaaaattattggatcatttgccaatttatgtatctagcatggcgaattaatcggttttcgtgtttgtgtttgtgtgggtgggtgaatgtgaatgttttttggttggagaaatggtttaaggaagcttacatagatggattccttgaggggtccaactttcttgctgctgttgcagaacttgagtagagggatgagagcgaacggcagctcaaatgacaggatcatctgtatccaaatcaagaattcaggatattgttgcttttggaggagcaaagcgaattcctacagaatgttcaattggaaaaataaagctgaaaacaggttgatgagtcttactgatgacaggatgattagcttgccggcgcctgagggaccactgacaatggagacgatgaggctaggagctatggcgatgactcgggtgatgaggttccttacccaattcttcatcttcatgtccagaaacccctggataattatcataacaaaagttggctatatttactgaaatagataatactcaagagtggacaaatgatatgcaaggtatcaaatagtttgtacaaacttgataacacctcgatcaatagtgtaaacttgacaaaccctgctccaggtttactatcaagggtgagcactacggaactgaattacctgcatgatgacctgcccagcgaacgtgcaactgatagtggtgctttgcccagaagctagcagcgcaacagcatacaccaccgagcttgatctccccaaaacattctgaaagtaagagataatcaaaataaggcttgaattcagaatgtctgacatgatcctcagtgagctctggtctgtaatttcttccatattacagaacaagatgtctataagatgcttctgaaagtactatcttttatccaggaaatgaacattcgaacagttcttaccctgagtaaaagaggtgtggattgcagagttaggtcaccacacgtgttggcatcagctggagaaagattattcgcattgcaaatggatccagcaacaacaacgactgaaacatttatgaggaaagccacgatgaatgcaagactacactcaataaggaagtatctgcaagcagcctatcggaaacaagatagggtcaaaccattagccactcaacaacaaaccatagctgatcattacatcatctattatcaatgcaacctactctgatgcttttgtctgatcgtggggtcttccttgacaggaccagagcagagtgcaagaacaagttgtatctgcatgcatgttatgaaaactcctcatctcatgaacttgtaccatggatcaagtaaaaagtagctacgatcaccaaagccctgataactgattgggtttcttacggtgtgatgatagcgccaaagagtgcgatcgcattggcagcagcgcctttcccttggagagaagggacaaacatgcccttgaccacctctcctgcagacggcctcaaatagcttagctctccgaagaagcaagctgccatagtgaacatgaatgctgctatgatgaactccagcttccgagcctggtggacatgtcatatggtaaggtcaattcgtcagtagcccattctcagtgtaattcatctgacaatcatataagtctgagaaattctttgcgcaccccaaatctctgtactccaagaagcaagagggtgctgaacactgtgagaataactccagcccacactggaatcttaagcaatatgttgaacgcaaaagctgtgcccaacactgcactaacaaaagaacgtgttactcatgctaaatctagcacagaaataaataaataaataaataaataaataaataaataaataaaacatcgatcaaccttcaggaatgtcatcagaaatcaccgccaactccgcaatgatccataagaaaatgttgacatagtgcgggtactcttccctgcacagttcagcaaggtgccttcctgtacagaactcaacaaaagcatggacaacataagatgataaggtgatgatgcatgattagcatgcaaagagcaaggttaatggttaagtgaaatatacctgttttcactccaaggttggcagctaatgtttggatcagaagtgcaaagaccatcccaactaagatgacccacagaagctgttcattgtaaaatgtaaattgatgttaccagaagaagcattttatataaagaggaggcaggaaaaacgaaatagttaattttgtttttctcctacttttctgtttcttgattgaatttgtcttctttaaatattaggaaagaaacaaattattgaccaccatttactaggcatgggagactttgtttgatttcgtgtactactgctactattatatcatatatataaggttcatgtcatgatagagtcatctcaagtcaatgattgatattccaacgttcttatatgtgtactccccaaaataatccaattttctttcttcaaataagacattgttgcttatgctagttaacggggagtccttttggtacagtccttaggatagacttaagtttaaactttgattatttaggcctttaaggaaacatatttcaatattctgtaaaggccacaccctcagtggaaggtttagaattcttcttgttcagctatgaaatcagtgcaagaaaatctcaaaatattatttatatttggaattttaaagatatttcaagtcaaaacatccaggaatacctctaaaatgtttaagagtctgttttgttcagatttgatgcccaaataagtgttttcctgacg

SEQ ID NO: 65689 - DNA, 21826 bp, Oryza sativa
caagaactatgcagtgtacctcatacttgaagtcagctccagcttgcatgtcagtttccactgtcaaatcatgtttcagaaaaaagctataccacctcaacctcttctttttctttttttcttaatgagcgtatcaaaacaatatgaagctctaggcaaaagataggagcttacagttgctaggatctaggaagccaatggccaccagagctccaggcccaacatgagccaagaatttcctccatcttggctgttccacccagcaaaaagtaagcataggattgaaacaagcactagcttattgtggcattagaactccatgaatgcgcaaaatgtagtcgcttacctgcacccgaaactgcccatctttttcactgtcaatagtcttttctttgtactcatcagtctcactaacactctgcaccacacctccatggagagtttctcgtccaacctctctcatctcaccagtcccttccatattctatgttgctaatgcaccttgtctggaagatatgaaaaagtatgtcttgctctagttaagagccacatacatcctttgtattttatagacccagagaccagttgacgactgtcccatacagaaaccaaaacttcaagtacagtacaagagcagagtgactagctatcatgatggttcctgttgattcctcgcttattagatgcctttcagatctgctactcttgttgattgcagtaacaactgagtctgcaatattaaaatggaaattctaatcactttattttcagtattaaccacctcaatctagaatgtttaagctgctgaaaaatagcacttttagtcacatttcaacagcccccgccgcactataagttgtttagtccactgctacaactaaatgagatgcaaatatttttcatcggacaaataagtcatcacaaattctggtaaacttgggcaaacaaatgcccagtggcatgaggggcccaaggctaactgcagcataacacaatcacaattacaagctgactaccacgcataagaattcaaagctgcattacccaaacacctagacgtaaattcagcatgaccatcgatgttgtcatccgtcaaacctgaggatctacccaataggattttttaaattagaagggatttccttatctcccatacacagccacatgggtcgtatgggtcttcgctcctagatattttttggcccttatacaaagtttgatatgttcctttacagctaaacacctaggcttaggaaacaccaacgtctctacctaagatacaataaaatacatttgataaattgttaagaacattaatgccgccgatgtacctttgcttggctgttgctttccgattattttggagcctttcgggcagccatttttcggtgaaggcaaccttaagcagctcagacctggtgcagtccacatctctgtattctattgtagctattcagatgataagacttaaaaaataagcaacagatgaaaggacaataagcgtacagtcagattgtacttaaaaaacctcaaacctactctccattggaatccatattctactcaccaaattggaactagcagagaagagtgtgatgtgaccaccacctcatggaggatgaggtgcccctccatgcaccgaatggttagcttgctaacgagttgatacgcaggcgtgcgaaaatttatattgtcggccatggcttcatttggtcgaatgtggaagtcaagaactgtggatttatggcagtggacagaagaacaatgacgggaagtgggaactagacttgggaacggggaatttaaaatgctattaaaattttaaattaaaattgggaattgcattttaaaatttaaattgcaaatcgacttaggttttcagtagtactaaaatcccagaggcacaggacgatttggagtgactagcagtgatcaaattattggccacgaatcaaccagaaagctcataaacccctactacctaataatttcacaggacagtaaaacacacgagtagctcaccatcgccgagggagagaggcgcgggcggctcctcgccggggggctgcggcgacgacggggacgacgagcgcgaggcggacctcgacatggtcccccgcggcgcggcgctcgggaggggccgcggggtcgacgagcaccctcgggacggggaccctgtgggggacgggttccccggcgagcgagaaggagaggaggaggagcgagtcgtcgaggcggaggtcggcggcggagagctctgggcggaagaggtagaggcgtcgtcgccggcaacggcggccatttcggtcgcgaaggtccaggcggaggagtttgaagtcaggccgagctttaataagagaagcccagcccactctacataataaaagaagcccagcccactacctaatgaaacgagcccagccaataaaataaaagaagctcagcccactacataatgaaacgagcccagccaataaaataaaagaagcccagcccactctacataatgaagcgagcccagccaataaaataaaagaagcctagcccactaataataataattgtttaacaagcgtcagacgtgttggttacgtacgcggactcgtggagtactacacatatgtgtgcaggtgcagcacattgcgaccccgaccgcaacccaattaggcgcggccgcgatgaacgacgacgtggtggctgagatcctcttgcggttgccggcgaagagcgtcctccggtgccgcgccgtctgccggagctggcgccgcatcaccaccgccgactacttcgtcgccgcccactcccgccgccggccgctgcagctcctcggctacacggggcccaacgacgagtcgctgcgcgacgacgaattcttggtcacctccgccccggtcaccgccgtcccagccgtctacgacgggacgacacggagtgccggcgatttctgcggcgcaacgtgcgcctgtgcctccgtggatcctgcgacgggctcctgctgttcgagcaggtgaacgccgagaccatgctcatctgcaacccggcgacacggcagctcgtcaatctgccgccggtgagcactggcggcgtcgtcgtcgaccggaacgacctccggctccactcttccgccttctacttccaccggccgtccggcgagtaccgcgtgctgtgctaccggaagggcaccaactacatcctctccaccggctccggcgaggcgcggcggctcggccccgtccccgaccagcaacgcaggacttgctccttctccgccgtgaccgtcggcaagacggtcggcgagagcgtgtactgggaccgccgtgaggtcgacgatcggagccggataatggcgttcgacacggtgtcggagaggttccgggcggtcgcgccgccgccggtggagcatgccgacgaaggcccgctgctggacatgcatggacggcacgctcgccgtggcggcgatgccggcggagccgtacctggacgtgtgggccagagacggcggcggcggcgagaggtgggtgcggcgcctccgggtggagctgccggcgggatattattccaaggagttgaagcctcgggggcttggtagagctatcttggacgacgcgggtctactgcttgtcaccttgtcctgcagatggggcttggtgtacgacaccaaggagaagaggatgctcagctgctctcatcgtagcagaagcaatccgtggaatgcagcttaccgggagagcctcatcacggtgaaaccttgcacacccccgctcccgctaaactctgagccatggttaaatttctactagtggttgcagtgatatgagtagcgccccaatatctcaagttcaaatttttataggagcgaatttcagattggattatttaagagctaagttcctaatttaaaaaggctgcatatatagttggatgtaaaggctagataaaaaaaccctactaacaaaaattactgtccacgagcatactgtcgacacatcggtgacggagccgccggtgaggaagtcggcgtcgggggaggagagtacgcaggggcctctccggtgagatgccaacgtctccatggcggataccaccttgctcgtgtcgtgactcatgagggttttgtttttgttttttttccttttttgttctttttttttttaccgtggggttttgggggctaaagaagaagatggttacgtgtatgtacagctgggtccagttctaaaaaaaatacagctgggtccccgggtccaccggcagtgaaacaattccggtggaccaagtctatggcaaagctagccgtgtggcatagggcccacgaattagtagctgggttcacgtggaccagcaacagtaacccaactagagttatatctcttgaacagaggcacaagcgagaaaattgcacatctaccattccataagaatggcttcgctagaataccattatgaaaatgggcttcgctagaataccatcctcaatcagagtgtcttcgccaaaatgccatcctggacggaaatgcccctggctcttctttttcctccatcccgtgcgtgaagagctcgccggcgaccatggccagctccaccgccgcgccaccgatgctgccttgccgactgcgattggggtgttgctctccctgccatccccgccagtgccgacggcgggcgcgggctccagcggagggctgcacggtggcggcaggtgcgatcgacggcggcaagcgcgggctccggtggagggctggtcgatggcggcaggcgcggttgacggcagcgggcgtgggctccagcggagggctgcgcggtggcgacgaggaggcggcggccaggagcggcgccaccggctccccgtgcatgcgcgtcagccggatcctcgccgtcgctgccggagtccttccgtgatgacctcagctgcacgagcacaccactctaccgtcggcaaggcggcatcggtggcacggaggtgtagctggccatggtcgctggcgagctcttcacgcgtgggatggaggaagaagaagagccaggggcattttcatccaggatggcattttggcaaagacactctggttgaggatggtattccaacgaagcctgttttcataatagtattctagcgaagccattcttatgggatggtagatatgcaattttctcggcacaagttgaataacctaacctaaggctattgcttctgtagaggttagaacatttcatcacacttttctaaacctctatgatcaagcagaaccataatcccagaaggaagatgcccccaacttaaaaccaagagaatatgaaaatgcaaggcacgtttgaggtaatttgcacagatcatatgaacataatcagttgcatcgaggcacatgaatccgttgcatacagatgtaagaagaaactgacaacttatacagtatgccaacagacacccattccaaacttatgcaaagacaagagacgtgcaaatcgattcgtcatgaatcatgattcttacataggtaaaaaaaatggaatgcgatggtttcactgctactaaatgctaagtactgtgtgaagtagattgccagatggttgaaccacctaccaccggaaatatactgaaccgaattcactggtagctgggtctaccgttactccattttgatgtcacactgtcttttgacagcagaagataagctcaatgtcttgcagtttatcgagatggtcaatgtgttcactgaaagaacaataaactgtgcatggaaaggtattaggacattgggacatgatcacatgatctaagtttatcaaattttcaagtcaatgctctggagacgagaggaacattctctagagagaaaagcaacaaagtggaactttatccctacctgagcttaggcttccaataaattcatctatttggtgcctcatcatgtacaactcttcagccctacatttggatgatcactcctctattatcctgcgtgctgggaaaagcagaagttcaaaatggtggcagaataagagtaaataaacaatgtatactcatttgcacacaacagacttgcccaagtgcaacagttgccaatgaagctggccaaaattgatatcgaactatgatttagacaaagtatgacactgtgcaaataatcgaatgtactaacgttgggtttccccagaggcggcgcagatgaaggtcccaatctagcacaaatcaatgggatgtgcagctgtgcacaacattcatcatcaactgtcgcttcagttcacatcgaatccctatacaaaaataagcaagaacgattagttcagcattcagaaaaacttacattaagttgtatgaatcaagctgtattgcatatatattgttgcaaacatagtttcgaacgtctcagaatagtatagagctttaaaatcagatcaattgcatttgggcccaaaccagtaaaacttacctatgtatagcttaacacccattcacagggaatctgaaagtttagaatagagtattaaaaaccccacaatataactgaacgttgttgttttaatggcaaaagaaaacagggattgctctagtttcaaaagctgcaattcattgtagtacaccgacatctgaatgcccagtttaaaggtagatttgttttttcttatgctggattgtatgaattcgacataatttatataaagaattatcattcatttgccaatcataactattatactgttagtccaaactccaaagaagagtaaatataacagcacaatgcactgaacatgtgagatgttgagcgcaacaatagtgtggcaaacacatgctgctcatgtacttaattgcaaaacttaccagatatagggttagatcctttgacatgtctttcttgacataattgctttaatcataactctttctgaaaggtagcctaaaatagcaacactgcacagcaaaacaaaaaaaaaacctattatatgcaaaaatctactatatagtagtgctgtcatgtaacgatgatcttaaagtgccaacatacatgatatttagtgggttgtagaacaaaagaagtgcttggacagtatgaacctcagacaggtaatctagcgcatgtgttaacatatcagtggatctttcgatgaatagagagtacaacattcaaccaaagagtggttatgagttatcaatgaagatgaaatgaaatttgttgccttattatactcacctttcatatgttgcgatctacttatatgttaaccatccatattgaagcttacaacatatgtgctttcaagttgtattagctagttacaagcaagttctaaaacttattatcattcataagcttctactgtctgcatgtaatctagggtaaagagaaacttactcagccagtgttttctagtacataaatgtcatcattctgctgctgcttattctcataaacgttgcctctttgaccccatcctgtcttcactctcttggtgattttcatgactgtgcgagcactgtcatctctgttgaatcagcaacaaaatcaatccgttgcagctcaagttcgacacacaaaggtagaaagtgcagacctatttttctagacaggataaatttcatttctaggttctgagtacatatgctttatatactaaatcagttataatgctttgttgctagtctaaccaatgcaaaaacttgcacaagaaaatagactaaagaaaatgtcacaaacacatcagaactaaatttgtcatcacaatacctgtgcaaaagagcatgccaatcactttcagcatgcttgtcctgtccatgcttctgacttctaggcttaaattcgccagaaggagctgcaagaccattatcacgctctgccatttccatcattttttgtgagagcatatcaacatgttgcttctttcccctttcactcaatgcatcaatcactggcatgaatgctgctggatcaaatgaatatcctttaaccattaacagcttgagtaacctatgtccatgatccacctcatcaactttgcagagtccctcaataatctgcttatatgggaatctatggatagagatccttaattcaagcactgtttctagaatattcatggcttccaaccatctaccataagtagataactgggtgcacattaaactatagagcacttccttctgaccacatgtactcagagaagcatcaaatactctctgagctgcagagaaatctgaagttttgcagaaagccttaatcaacaactcaaaagaagttatattaggaacaatttcattctgtaacatttcatctaaaagaggcatggccttgttcaccattccccgttcacaaaatgactttatcaggctattataggtcatgacattgggacaaatccccttccccttcatttcactaatcaatttaaggatttcatctgaattgtgtttttcccgaaatccccatatcaacaagttgtatgtccttgtgcttggcttgcaacctttcttttccatgtccctcaggaccttaacagccagagaagtcttcccatgcttgcaatacccatgaataaaggtatcatatagaaccgaatcaggagagatatctttgcctatcatctcaagcaatttcttctttgcttcatcaaacctgccctctttgcacaatgcactcaccagtgtagaataagtgattcggtcaggaagacatcttttgctgctggaagaatcagtaagtaaacttaggaatgaataacctaatctgccaagagccaaactaccttcgttccacatgccatcgacaatgtccatggccatatccaatttgttgtttctacatagtccatcaataatgatattgcagcttgctgtatccaagctgtatcctttctcactcatcctctctaacaatcgttctgcctctgtaatcctaccagctttccacaaactttgcagcagaacattgtaagtaaatgaattcggggcacaccccttctgtgccatctcatcaagaatcctattggctgcagcagcatttccctctgagcaataagcgtggagcaaactagtataggtcacaacatctggtgtcatgacaccactcttcacaaaatcctccactttcctcacatcaaacgctttgccctccttgcacaacccatccacaataatattgtaggtgtagctattaggttgaacaccctcatgcgccatctccctcagcagctcctgtgcttccccaaccattccattcctcaccagccctgacaaccaacggttgtaactctcaacccgcctcaagaaaccaccgcacctcataatatccaccaggactcttgcttcatccaccataccagcctcacagaacccactcagcatcacgtcaaacgtcacctggtcaggcctcggcagacctctctcccatttttcctgcatgtcgttgaatatcctgtatgcatctagcacccgcccagctttgcagagtgcagagatcctcgcattgaatgtgaccacatttggagcaagaccctcatctctcatgcgctcaactagcctctcagcctcatccacctggccctcgcggcagaaccccgcgactactgtgttgcataccaccaaattcatcgttggcattgaatcgagcaccccaagcgcgtccatactcctccccgcacggcagtacccacgcgccaggatcccgaagctgaactcgttcctttccggcattgcgtcgaacaccctgcgggcgagctccatccggccagcggcacagagcgcctggagcaggatgttgcgcgtgaagacgtccggggcggcgccggacaagaggagatccttgtagagcgactcgacgaggtcgaatcgggcctcctggagcgcggcgaggagcaggcggttgtagacgggggtgggcggcggcggcgcggaggggagcgcgcagagggagcggaacgcggagagggagaacccgagcgggaggcgcagcggcgacgatgaggaggagaggagcgcgaggaggtgcggcgcggggtccgggagggagaggaggtggcggaggaggctcgggaggagggcggcgtcgtgggcggcggcggcggcgaggatgcgggcgaggaatgaggtggagtgcggcgacggcggggacgcggcggaggtgaggtggaggaagaggcggagcgcgacggcgggggaggcggcgttgcggcggaggagggcgaggaggtggttggcggcggtgggggaggtggacatgggaaggtggcggccgcggggcgacggcggcggagagggtttaaaccggcccgggccgactggccggtggggtacacgtctggtcaacggcccagtccactgacactgactggtgggcccggccatgttacattttttatgttacattttttgtgtccgtatttccacttgctgcttagagcagatactacagatttgtagccagctatagcacggactccaagacacaatgtgtgtatgataagtgggactagatgttaatagtgtagtacgtaactattgtatgaattggctattaagttgactatagatgatttatagctagtagttggctatactattaaacttgctcttggtatactccgtacctttttttttctgaaatttgcgcttaattagttcggtgttctgggttcctaaccctgcctcgttttccgaacacacgtttttaaactattaaacggtgtgcttttttaaacaaatctataaaaagttgcttaaaataatcaaattaatatattttttaaaaaaaaatagctaatacttaattaatcacagactattttagttcaagcttactccactccaaacattttgaaacagggtgaatatacaggaataaatttgttatttcacgcggctgtgaaattgtaagttggaaacagcagacgttacagagtatttcacgttacatgaagcagtgcagcacaaaccactgcagatttactcaacatgagatcattgccaggctatagataaagagagaaaaaaaaacataacctaacacacaacgctgactgaggtaaagatcagtaaaatgaaaaagaaaagaaaaaagaagaagcaagaaactaattccagttgtgagaagagatcagaagcaagaaacattctcggttctcatgaccaggttgcaagtcgagtagatggaagcggcagcagcttgcactgcccactcgctctcaggagtctccgagttcttcagtttcctgaaagacatcgtagtagtagtatttcagtaagatatatcacgcataaagtgaaatgacttggaaactactccctccgtcctaaaatataagcatttttagctatgaatctggacagattcatagctaaaaatacttatattttgggacggagggagtaagacatttagttgctatatatttgagtactttgttcaactaagtctcatctaacagaaaagggtggatcgaatcgaatacgttgagaggtgatgatgagctaaccataattcagccattggtcctactaatggagcctcgcaagccatgtatctgagccctttctcacaattcatttgcatttcttgcacttccttcaaccgattctcctgcaacagtaatttagcacggtgtcagtagtggaacactgcttaccagaatggatgtgcaattgcgcatgcacatatgcttttgtcataaaaggcgatattgcgagaatatgctagttttgtgcacctataatgaacactattatgaaaaaaactcaccagatgcatcccctcctcctgaagtgttctgtccatctgaagaaaaagagaccgccatcgtgccacatgcgcttctggaactgtttttccagtagatccaccatcagaagaatgtacaacggatggttcgttctcttggttatatgaaaattctgttgatattaggtagggcagttcagtctgaagggcattcctgactctcttcttgctgcgcttcaaagcttcaagaataaagaaagcatattaagcagaatgtatgggttacagctttgaattatgtttcaaactcaagaattagtaccagcaaggcgccctctgatgtcctgctgtagtagctccaaccactgagaagcaacattggccgctgatcatcaaaaaggcaaggcaactgtcaggtatagataattctacaaacagtgaacaatgcagttctggtgagagtgtatgattgacgaaataagagatcaagtataccttttactgataacacagtcatgtaatcatgattagatgcaaaatcatcggctgatgtactgcaggtcctgtctgaagccatagtgactgctgatgagagttgcagtttcagatcatcaccgtcctctggaaggaattgtgaagcagtaggcaacccttggtgaaacggcatgttgctacctttcatcaagaagtggcaattcatcatattacccccatatctctggtcctgagccttctcactaaattctctccctctttcgcctgtttgactagcatgaactgcctggttctctttctcaagattctcagagtgcaccatagcctttattatggagtaaacttgcttgctgtttctcacatggttaatgattccagggtttagcccagataataggccactcggagcagcaaccttcatgaacttgtttgtctgttccttctgagcaaaagtgttccttttggattcatcgtctcttttccttttgatgggtcgaccgcgcggcctaggacccactgcagttccttgagatgaagaaaggaacccattctgcttcatttctctccacttcctgtgtgactcactctctcctacagccccagttgtgctaccacactctgacggatcactaactttcgtctgccccaacttcttgtaaggaaagaagggattaagttctgcagcattggaagaatctactatattaagatccaatccaagaggtgcaccattcattctgttctctacatgtcttacatcaggcttaggttgcaagtctgtcctgatgttttctttatcacacaaattgttcacctctgctgcatcagaagaacggcccaaggtgaggcaggcagcctctggctgaagaaatgaaccagtctcaagcaatgagggctctccatcttcacttcttgttgcaacttcagcagtaacttgaggtgtatctttcttgtcacatggatgtagacaagattttgctcgatctgacgaatctgaaatccccactctcatatctacatgatatagaataattagtaagcattagcagtgcaaagattaagggaagtaaccagtaacacggtcaattaggataaatcatgccttggacagtgtacagtacataataggaattcagtggtgtgaattgaggctaaggatgtgtacagtacataataggaatcaggaatgcatgggtttatagccgtgtttttaaaaaaaagtgtacaaggccctgtacaaggatgcatacaaggaacgagtgacccaaccttgtaccgcttaagccgcataagttctacaaggtggggtgaccgcacgaaaccacataccgcttttcaaaacattggtttatggcaatagaaaagagtaacactcacgaattattaactttgcatggcacagaaatcaattgtcaacagcagtttcatcctgaatttatcatttgcacattctacacatccaggagtaatcttatgttggtagcggtacagaaatatgctgagtttgttatgtcaattcgctcctcaacagaagcaaacaagaattcttaattacagctacaagaaaggctaatcgaaaattcgatctactcatacgcttagatctgtagagaagcaccataatctaccgtcacatgtcgaaattctgtgctgccagcgaatgaagtactactgcatacaaagagttcaagaacaactaccacccaagaaagtaaaaaactagcatttccagatcacccccgcgccaagaatcatccaaccagcacagatcaggaaccaagacggcaagaaaagaaaatcaagaagcgccgagaaccccccacctcccaatccgaccgccgcccgcgacccgcacgacgcctccgcagccaccgcccgacccaattcctgcaagaacacacaccacaacgtcaaatccaggctccccaaatccaaaaccaagaaccaacgacaccaacatccaagaccaccccccccccaccccaccttcgtggtcgtcgtcggcggcggcggcggggacgacgcgcccgatccggcgggatccgaggccacacgcagccccgcggggtccatccgggaggccgcggcggcgcgcccgcgaagggggagggatcttggagctagggtttgggggggggggagcggggcggagggaagctttgcgtggatttgaaatggagacgggtgcggaggcgtgctgtgtggggtggggtggggtttttatggtgtgcgggttttttttgaattcgagcggaggtgggcgcggtttggatggggatggatggatggataatgagacagatggacggacggatgggtggatggatcgctagcctttaatcgcaggagcggccttgcggttgcggatgataggaggggagcccgcggatttattttcttcttctttttttcccaccttggtggtttgaaggtgattggtttgaattttggttgtatacacagctgtgggtttgaattttgaatggtgggctactgaccttgtgtgacatatggtgaacacgcttcaattctcttgatggagtaacgaggggaggaacatcaaaaggacaaaaggaacacaagccatgctataggctatagaaactagtactagacaagatgataaacattgcttgagaatgttctaacagggcacttgagacgtattttgtgtgtacatgttctttagtgtgcacctccaaagtcacatgccacatatatggttgtatgtctaacataaacgcaaaaagttgcacaagagtgcataccgtctaacaagatcatttgtgggatggaagaagtatatttttataattttgcttatgagcattgctacatatgcaagcctcaacacgagagaattcattatatggccctaggtttatcacatgtctacaatttaccactgacttgtcacgttgtacattatgctatcgacttttgcttaacttttacgatttaccatcgctatctggttagcctctgttagtattatacaatcttatccaaatgaccaaaatacccctaggataaaaactttcaaaatttgaacaaaatttttgaaatatcatattttaagtttttgccaaattttggatgtttacaatatgatattttggaaaaaaatccaaattttggaagtttttgtccttgtggtattttggtcatttagacaaaattgtataacggaggctaaccggacaacgatggtaaatcgtagaagttaagcaaaagtcgatggcatattgtagaatgtaacaaagtcagtggtaaatcgtagacttacgacaaactcaatttttttttgcggggacttacgacaaactcaatggcatatatataatagattctctctctctacaaaactcttataaacaataaccttagctgtttgatttaagtagataaaagctatagacaatctagatgtactcacgagtcacgacgtaagatgtagtgtttgtaagagtttggtatgacacaatttaggccctctttgtttaggcttaggcttattggcctagacttttaagtcagcttattggcttatatgatttataagccggtggatttaatgtcctaagtttagtagttgagtcatacatctacctcacataagccaaaaaagcttctccaacctagcttttggcttaatagtgttagagtggcttatggctttaaaaaggccaaacagaaaagctgcttgtttgtttaggcttagacttttcgacttataagttggtttataagcctaaacaaagagggccttaatatgtatagacttttcctttgcggattgacaaggtattagtccatactctcatatacaccccatattaaaacattataactcaggcaaataggatagagaccactaccaaaagtaaaattttacatcctaaaatatgattctttccgtctcatttgataccaacccttcactgaggatttatttagcaaatgggttataagaggtgagatcgggataggaaataagtgaaggaacaagaaaataaaccaactgactattttgttgtattataactatggctcgttgtatctccactagctccgactcatctagacggtcgttgttggatgaaggtctccatcttacgttatcatgactgaacttaagcattcatcgacttgtatgcagggttttacggtgccaatgcacacttgaggtaacacaaagtgccatgtgtcgatcagattgtaagttatgaataattttttcgtcacaagtgcggcgatatttggtaccaaacaaaatgtatggcatataatagttatagtaatcactttggctaacaaactgcggcaattctaagatttgatgtgacaatctttgctacaatccgaacaagcctaatattttacaaagataatccatcgcatagctagatcacaaggaaaaaaggctatcacgtgaacatgttccaacctagttctggcaacagttagagcacatttggtttttcagttcgcattacgcatcactcttccgcgccattccatccaacatttttatgagatacatgggcctcatggcccaaataggtgttgtgttttttctctttattctcaaacttgcttttctgttttcaaatacatatgtataaatttccatgcaatagttctatgtagaatatttctatgctaaaagtttctatgtgtaggtcctaattggttacacatattctctaataagtcaaaacgacttattagaaaataaaaattaatttataggtaaaattttttatatatgtattctttgcgacttaaagctaatgttaaaaaaactacgttgaaaatatcttaaaatcaaattcaaaattaaatttgaaaatataaattttggctttagctttggcttattaggacaatcaatggggctcgtaaactttctagatcaacatacttttcaaaacgtgggggcctgatttcaaatgaatatatccaaaacgaggaaggaatgcctatttctatctcatcttcattctaagtttatctgacacgaaaaaggaccatagacacatatatagttgactcgcgcaacttcagttcacgcaaacacatgttgagaaggctattgggcgatcagtcgcgcgcatccctccccgtgcgactggacacgtgtcgcgcgtggggagggagcggcggacgcgccgcgcgagagtccgacttttccttttttttttccgtgttttccgtttctgtttgtttggcttttttttttccgtttctgttccgtttggtttttccttgttctttcggtttcccttctgttttttttcggttttttaatgtatgaataccaagttttgtattcgtacatatgcaaagtttatatacacgtatgcaaactttgtatacgtgatgcaatttcttgtttttattttttaatacgtatgtatataaagtttgtatacatcgtatacaaagtttatatatatcctatataaactttgtatacattgtatataaactttgtatatgtgtatatattttttatgcgttaaaaaatattcataaatatatacacacacgtatatacatatgtatatacatatgtatatgtagtatatacacaagtatagtagtagatacagagaagagactagaggggaggcgactgaccccgcgcgcatgggggcgcgtggcttatcgtgtatcattgtatcagcgccccccaacacatgttattaaacccaacccgacacaaaacgcatcgcgacaaaataattatgacatgaacagtactgaatatcaattgtattttataattttctacttactgttaatattaggattttgacaagataaatgtttttattcgttttaataaggcacaaaactgttttgagcacttgtttaatcgcgtttgaactttgacgtgttagttttatgttcccattccattccaccatgcggtccacgccccctcgattctctctgctttccgcgctgctgctgaccgacgacggccgcgcccctgtcccggtctcctcctcgtccctcctccccgcctctccactcttccagaacatcgccaccgccaccgccgccgccgccgccgctcgccggccacgaccgcccccggcccatctacacctccgccggatctcgcagccgcgctccccccattggagggagatccgttccagcgcgtgggtaagcagcagctgccttcaacggttcaacccaacctgcgtgatagataggtggtgggtggtgtgacgcggggggtgttgcaggtgatttggttcgagagcccgcgtcgcacgcaccgatcagtttggggggagggggggggggggggtggtggtgtgtgatttggttggagaggagagtatagccttgggaggggaatcggaattgggatgtggaatccccttggattggatgaggtgatttgatgatttggtaccaggatatactagctcgagcacatgtgctgttggaattggattcccacctattgggtttggttgctgctgggttgagggagagtagcgttaatcattggtccccgtgtagtattcactgcagcggtatcagttattgcccgttgatgctcgttgttgaattcttgaacatttcaaagttttttgatgcatccaattgctaatttctagattctactcaacccaatgctgttaacagagcccgtaaatcagaggaatgttgtaggacatgcaagtggtgcagaagtaacacatactcatttattaacgtatttttctacgaatcacatcaattttgcttaaaagttcgccaaagcactagcagaaagcagccctagtgacagcacatgatcctattaccatagcttttggagtataacttatcaccttccttcccctgattgctaactgaagaggagggtactaatatccatacttcaaaccatcaggacgaaaccaattctgcgcaacttagtaatgtggcttgtacctttcttttgcgcagaaagagaactttcattaatcattaatcaatacccaaaaggagtacattcagctactattgttaatacaagtggcttgtattttatacagagtataaactgctataccctttcagctataaattgttagttattgttaggtttgttggtccttttgcccctgcaggatttaatttcaacacatgactggtgaaatgtttgcttgatgatgtccggacatgatttcagtattgttcataatgcagttggcatctcatgccactcaagcagatgaagcaacagagcttgcttccagctgtgattgtgcagaagtgccagcttcacagcagatagtttctgaatcaagtacagcaggaagctccacagagcatctagtttcatgtgaaatcaagccactgggtgttgatgaagacattgaaactattgatgctaacgaagaaacccaccttgtcattcaagactgtccacaatgccggatttgccttgataatgaaggtccattctgtgacttgaagtatctttcttatggagtgccataaaggctttcgattttttttttgataatattcatatttttatgttgagtctacatttgatctgatattttttccatatccactacaagcaggtgatgacttgattgcaccttgtcattgcaagggcacacagaaatacgtgcatcgatcctgtcttgataactggagatcaacaaaggtggattcatgaacatttgctctttatgcttcatgtacctatatttactgccatcgcagaatccagttaatcattaacctaatccagctctgacctagtttctatgttacatttccaccaggaaggttttgccttttcacattgcactgagtgtcgggctgccttcttacttcgtgcaaatgttcctccagatcgatggtggttgagattgaagtttcaacttctggttgttagagatcacacgttgattttttttattgtacaactggtacgagttccacaccttctgtaatctaattcaacaaactgttttttctttactgaaccaatactgaatacatctcagtaggatttctccaactgtttaccctaaaaaatgaacatgctacaatactgaactcaagcatgacatggttgcaccttattctgttaatgtataaagcagtaatgattttatggatttatattgatatcaccatttctttgaagagatgtggtagttagttcactgacttcttactaatacattgccatgatttctggcgtgagatccaaaagataaacgtttttgaataaatgcacaagaaagaggcctgaaaatggtcacgatgtgctgctgtaagatgcatctttgtttttgtcttacaatcttatccgttttcctgcctgataggttgttgctttattgggtatgctagtatacagattttatggagatgaactacgagaaatgtttggttatgaagagcatccatatgctttttatgcaatggcaagtaagttactttttcatagtgatatctggaaatgtcatgaactgcatcttatctagaaagctcatagagaactgaaaaacttatcgttttcttgtgtagcatctgttcatgttgatccagttcatgacatgtactgtcaacatggcctggcatttatgtctctaaagaaagtcactccattctattacatctttcatttcatacttatagctaccatttaaaaatatggtgtggaaccaaagtacagtgcaatttatgtagaattgcttttatgtattgtgaagatcatcgcgcagtttataatggcagctatagctttgggcctttgagatgaaagataacatatactacacttaatgttgggcgtccatgattatctaagtgctctctatgtaaatgcaatcacggaagatgcttttcagagggatttgtttccatggttcttttagaagactgcacgaattgtaacatagtcaaaacaaaagtctatgtggtcagagggaactaaaagcaactggcagattagatgagaacgccgatagcacatatctcctttgttggcatttaactcaatgcatgtgattgcacaggtcttgatgtacatatttttgccctgtgaatgttgtctgtgtacaggaataagaactatatcctctacttctacgttaaaaacttgttgacaaaataattaacgttttaaatgttacttaaattgcagtattggctattgttttggttggtttgctgtatggattcttcatagctataatatgtgggcagaggatcacagaacggcattaccatgttcttgcaaagcaagagttaaccaaggttggttaaagaacataaagatggaaacacaattttcattgactgatcttttcattttcaagaactacactgtgtcattgaaatattaatagtagtgccatcaactgttcaatctgtatatgcacaaaaacatgcagatttcttcatcttttttttttttacttattccaaccattacatgaccttataaggttgtgaacagactctctcatctctatttgcgaaaacaaggttggtttgttttagtgaaattaaataaataagttgtgggtgtattagtaataagggtgaaaagactgcctaatcaatgatttaatggtagaccatgatgg

SEQ ID NO: 65690 - DNA, 3699 bp, Oryza sativa
  unsure (1)..(3699): unsure at all n locations
tttttgtttcatgggaacaacacttggctaattcaagttacaatacaaagatttcccaccacaagggacgtaccaacttgatttgaatatgccatgagccatgaagagtgcatacattttgatggagaagctgtagatatatatattcatagcttcaccttcctattgagatccaaaactaaagtaactgcattgcaataaccaaatccatcaattgttgttgtgctggcataaatcaggctaatttctgattaatcttttgtactatttgcaatgctattacttggcttaagaaagagcaaataaaaaatgtgattaaaagacctgatgagatgatgagaaaacgggaaaaaattataggagaagaaaaacaatgtagtcggaagaaaaaaaaaactggaaggagaacaagagtgtgtgaaacatttttgtcaagcagaaatgtttgctgaatggaggaacaattacatggaaggtctgtggatcagctattatctttggagtagtccctagtgccttatctaaggttatgccctctattatgagattgcctcgggaacaagtttttaagctcccataagggtcggctcctctgttcatgaaagacctgctgccctgccctgctaggctgcttgcgggcccagtttcaggatgtcaaggaagttggtgaactgatgataggaaagcaaaagccctgtaaactatggccatagccataacatccaaaggtaggtttatacttttgttcctttagccgaaccttatccatgtccttagtattattttgttactgccttgattttattctatcaagtttctgctgaaaattccaaagacggataaatcttcaatattcataccttgtcactgttccagtaacatgcgggcacccaacttggcccagcaacacctgataatttgcttgccttgttggactagcccagcatatccgctgcagtggtgctagaatgttctagctatgctcaatagagcaaaaccataccaacttgcgttaaccttttggatgaagaacataagcaccattggttagctggtgtgctgtagatatacattgcatgttacaatacacgaaaaacagatttcttggaaaataaatgtccttttcttacctaccgttgggagcaatgtcagagacaatctcttggaattacaaaactactccagcacataaaactttctttgaactcacaaatcaagagcttgtcctgagtatttcagcagcacattttaaaataaaatattttgtttccattgagttcttgtgctctaatttgtaaagctgaaacagtagaggaatcgatcactgatcagtttctattggagcagctataatttctgattggatagcttaggataaaataaataaatagaaggagtttcaggatgaatttgcaagcctgttctcatcagttatcttcccagaaccaaacattctgttcccattgcccgctacttaagcgaagaatatattctcctatgcatataaatttggtagtcttgcaggcatctttctgaaagtagcagaatatatgggtagagactagagagtactgttttttgttatattgacatccactaataaagcatttctctcttagcaaacattctcttggcatttttttttaatcttgattgcgtgttcttgatcttctgtaaattcgttttacttgctttcctttgtcagttttgcctgatacagtaataccatccttcatttttccccctttttcatgctatacattttagttttcttatctgttctcctctgcttttgtttacttcagtgagcaaaactgtcaataaacgaaccatcattctgctgtagtacttgcttcaaaagattgaatttgcatttatatgtggcaacacttgcatcacctatgactagtgtacattaaatttgggcaagtcaaggctgcacttgtctgtaaattttgtcaatgtgggttgccaagttctctatgcatgttagtgtctcttgacaatggcttgaatctgcttcccatttccccacttttcaattttatatcctggctttgtcactaccagcctagactacatgggttgtggagtggagatgatttgccaattgtgagcatgtttttgccgtatcttctccaggtcacctttagcttgtttctttgtttttcagaaacacgacaaatataacaagaacactattgattgaagaaaaagaatgttagtgccatttatcaaccagacaaatgtttgattagccactagtgattactaacggaagtgcttaacaatgaccgcaaacttttggatgattcaagatctaggtatcataagttcacaacatcatatcaggatcatgccttcattgatttatggaggaaatacgccttgggtgaattacctcctctggggaccagggttcaagacaaagactcttcccttctcttggggataaaaaagagctcgatagcttgaattgtcatcatatggccagtgggatcgatttgggagttcaaaaaacaattagaacataagaacaatataacacataaaaaagggacatgcacctgagtcccttatcactcgtaactattttcagctgtgctctgtcatggtcggtgcaatgattgtgtagagaaggccatttattgctcttgagacaccgtgttgatgcatctgaaccaacaattcatgatgacatactgtttctctgttatgcaactcaatatgctatcacccagacaattgtgcaaggttgggtgtagttggtgaagttactgaaaatgtgttgggtgatagaagtggtactttgagaatcagttcatgccatgtatgtttccatcagattcatctctagtagccctaaatgttcttaccatttaaattcttgctgaatcattaacatcaattgcaatgcctaaccgctgtgtttatttcatgtgtgttacactagaaaactgtatcacaacatgtaatcaaaaggaattttgcttttggaaaaatgactgtcaatagcaatattcttagcacattttgttaagttatatggtgaattttacttttctatatgtttttcagctaaatgtcgatgctaaaatggtcatatgggaaaagctctgtttagatacaaatccataaggctgatgctgcacggacatcatccagaacttcagcacaaggcatgacaaacgggcttatctgcgttttggaagacatgtttgtctgaaggcatccaatagagtttagagctatttcccttttttccccatgtaggataaattgctctcacacaaaaaggagaataaggtgagtcccctcagactctgaatcgatgatgaggattatgatagaaatgttaggatgccatttcgaatggacattttattagatattacttgtctcttcatgttcacaataaacatgaatagttataagaaaatgaggtaaatagagacgtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 65691 - DNA, 8265 bp, Oryza sativa
  unsure (1)..(8265): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacggcgtgtaccactctcctgtaggttctgacgatgagcagaggccgtggtatggttcaccggcaatcctcaagcagtgggtacatcatctcctcagttgaacggttgatggctttgatgcagagaagctgacgatctgaaagtttgtagacagaaatgtattgcatgccgccaggtgagggttaggccaggggaaaactacacatttttcagtgaattagagggtagccaatgccattctatacacaacagtacaacacacatgcgatttttcttctcccaaagaatttgtaacagtataaatattgctcaatgtgcagaggtaattcatcacatacatgattgcaggttgtaatagctacacatacagtatgatctataacaaacttcattccaaagaggaataccaactcagatcattgagaatgaatattcacgtctcaacctagctggctctttgttccaaaacctgtacatgcaaataaccatccagttttccttttgaggatcaaatggccattgaattctgaagaaagcaataccacgaatgtgacaattaacatgcctgatcaatgaacacaagagcgcctcaaccaaaccagcatgcatacatacatatatgtagtatatgcctggtacaagatgccaatggcagattaaaaattgaaccacataaaacgcctgggatcacagtagtaggacgcaataaaatattgggagtgccttttttttttacatgcatcactgggaaccccggcctagatgttcaacgaagtcttttaagtcttaacacagccacatgacctaaaacctagtggaaccttggggcctaacatggatcacaaaagaagcatcccaacacaagtccgagcagtaagcactaatacttgctccatatgactggtttagttagctttaatgaaatgaggggacagcagcttggcaatctccatcatcccgaccttgtccttcccggcgaataagcttttaagcttatcgtcacagttaatctcccttttgtttgctgggttctgcaaaacatcaagcacataatctcatttcaggaacaaactgcttgcagtgaaatctacggcacatgaagagttcagtttagtacagcaaatgattgtgacacaagtgtaatcaaattaatttatataccatggtaaactagaaaggcagctaaagtagcatatctaaaacacggctaacactgctgcaggtgcagagcagacattcaagaacatgagttcaatcatgcctataacaatgtacagtaagttaataacagatgatcaaagaataactataatgcacgtcacactatatataaccacacaacagtgatcagcatacattctggacgccgtgctccacatcgctctaacagtcaagttacaacttcagtacaataaaactaatccaaatctgccaaataaaatgcaccgctgtcaaagtagattactgctcagcaaccttagcacatgtaaaatgctagaaaagaactttattgggtgcaattttgtttttattcccttattgacacccccccaaatagggcagcctttccaatgtccaaccacattaactagattatggcaacacatcaaatatttatttctgaaatagaacccagtagcttacatacagtgctgccgaaaatacatcaaagccttgcgaaaaaacagagaaactgactagaaactttactgaagtttcatataccacttaatagatccaatagatggcacgtgcaaatccttttacagtagcacaaatttcacaaatgaaattataaccaatcccaccaaaatggggcaaaacagtatctaaccaccacgaagctgtaaccaaatccgcggaaatgggattcccctctcctaaatcaatactacttgaaccaaaccccacgaaatcgatacttgaaccaaatccgccgagatgggattccccctcccaaaacaatactcgaaccaaaatgggggcaacagtatgcaatagatattccttcgctagcgcaagcgagacttgaaccccatggctcccaaaccctaatccaacaaaatacaaatcgcaacgcacagctagtagatcccacaacgagcgctgagaacaacgagagccgcggctgctgcaaaatgaacatgtgaacagtgacggggaagaggcagtagggctgtcgggggcgctcacctggaggccgttggccttgatgtggttccagatgagcttgacggcgccagcacgggacatctcgggggcgccgccggcgaacctgctgagggcgtcggagaccggcacgggctgcatgatccctcgcttctccttcgcctgcgccgcctccgtcttggtcaccttcgcccccgccgccgacgccgacgcggaagccgacgcgggcctcttgccccccgccgccgccatgaggaacctgcacccgcggaaaaccctagccgccgccgccatgggaggggaggagccgccgcttcaaattcgcgcttcgaggaggaggcgaggcgaggcgagggttttggggtttgggggttgtttgggttgcaactccactgagggagcattttgtatttggaaaattttgggggccaaccgattttttcatctaggtcctttgtgtttatttttcgttacaaatatgtccttcattgtcccgctgcgcagtggggccagtggcttttgttgtgcatccagatattccaggggtatatttataatttcgccaactactaatgcgaaaccaaccaagcagggtgagacatattacccataaaaaaaagagcatctgttttttttatggcctctttgtggcaacttaaaatgtggatcccatgctggaaatttaactatttgtcactcttgtgatatagcaattaacgatctgccactcactatctataacatgcggaccctcatgtgtctattaacgatctgccactcactatctataacacgtggaccctcatgtgtctatgacatgttggcctagtggcaaatcgttaagcaccactcgtaagagtggcaaatagttaaaagccccttacaaggacacagggattttataggattttttttgtaggaactagtttaattctcgcgaaaattctctaatccaaaggagggctctggtttgtcattccatgtgtaaactacgttttatctaagaaagaactaaaagtcttgtaacaaaatactgagagactagtaattatcaggaagagtgtgatgtcatatccatatggagaggaagaaaaaaaattgtgacatatattcaactgaatcagattctttgtcgtagcaaaatcacaatgtttgggacggcattatcattattttgattggtacagtttgacaacaataacacatttggactgagcatcacacgtactcaactttctctattgtcaccaactgaatgctcaaaattttgttagcttcttcatcttctgttcttcaatgtttaacagtctttcttttctttcatgagctactcgaagatgggtagatcaagaggcttattctttgacccatcttgagtgtctcttgaagatgatgagagagagagagcagagaaggcttttgtatcagattctttatccatgtccaggaagaaccgatgcctatcaagcaggagcagacagatccatgagcatcagagcctaaacaagatgcatgaaaacatgatatggtatgtaggaaaaggcactaaccatctagagtctgatgtcaattctgggtgaaaagcagtagcgaggatgttcccttgccttacagcaacaattacccgatctttcgagtacacttcttcctgccaaagtattgtattgaacatcagtgcacagaagataaacagaactttcaattagactagattcttcgcacaacacatcaatcggcagaactttcaattcgactagattcctcccacaacacattaatcatcaatatacatttgaactagacacggcagggaaatcagtaaaaacgtaaaacagtcaaactgacagggtatggtcagaaaaacacatctagtgcagcatccagaaaaggagaaatatcacagtacaaatcagaaaggaagtgagcatgtatatgcacttgcaatctaaggaaatgtccttaataaccaggagatgaatttagtttgagaatttgtccaaatacaatatgttcagtaattctcttctcatgtgtcattcaattgaaatgatcaagaattatcatgttcgagaatgatgatactagaagagccgatgggggagggcatatgaggacagtaggtgtaaatgtccacatcaattgacagagtttatcttggaattgttttccctaatagttatgatcagacaccataattactacagattcaaggagaacagatagtgaaagggccacacaaacatgatactagctaatgctgcctgaacaacaatgaacatggcatgaacagaaataactgttcatcacgcccatccataaatcctgtctagtttcaacaacaaaattccacttttactgaaagatagcatatgccatgatcatttgcagaagagtgttggaattttcaacaggggtaaaaggcaaacctcaacaccctctccagacgctattgtaatactgggtctatccgatggaacaggacaatccgccagtacttcaacatttgaacctacatccaagatagcaggtgctcgtataaatacgccacggcatgtatcgctccctccttccttctctgcaagcattggcactgaaagttccgtttcaaagctttgaagctgcaagagagtgtattcatctcaaaaataaaataaaattgaagagacaatagaaatgatagtgaaaactgctccggccatcaaacagagaacacgatcctcaaagttacctggctcccaaaaaagttccggtggacagtacaatctagtcctccaataagctcctgacctccggatttttggcctgcaaataactttcatcaattgattccaaagaaagaaagattaaaccaattgctgtggctcacatacctactgccttgttagctaggaagatgagtccagcacaagttccccagacaggccttcctgtaccaacaaattctcgaagtgcaggaaactgcatggtagatgaaataaatcgttgcaacattgtgcaacattaaaataaggtaataaaaaactatgagttataaaaaaggttaatatataattgtattcatgcagtacatgaagactcaatctccacgaagtagaaaataatcaagtacgacgggtgtgaatctggttcttatgaaaaggggaatgtactcgtcatctcatctacatgtgaaactaattgtacacttatatggatgtatactaaataatagtatgtgactagtcacagtttcacaatactcagggatggcggatacggacgaaggaatttaccttaccagcagcaggtagcaagcactggtctacttccaccagcaaagctgtcaagtctacagctcatcattccttatatataaaatgttggacaaagacattcgcagtttctagttatggccttgtaagcgaggctaaaaaacaacgggaatctatatctgcaacaagttgctctgatggagccatgggctactaatatcccataacctcatctgtttttctctagattagttattctgttctgaaagcttaaaagggatggatatgaaccataaattcgtataataggattaacaatagttctcgaacgtgcagccctttcagaattgtatactcactagtagtcagtaatcaacacaaacacataggaagaagagaagtctaatttgccttccatatattactttggttgatctaccaccaaccctcctccgtagtagacagtaacaaaagaaatgcacatatttggactagttttgaccaatgcaagggagcaaatcaatatttcatttacatggattattgtagtgtttcttcagtctgatcaaaactgggctagttgttcggaatgcaaaacaccgggtcacttttgagaactttcaacaattgcgacagtttattagtacacatatccctttcctctgttttgaggagaatctaaccaagaaggaaattatcactagtgcccaatttataatcctctcactgaacatcgatcgtggagattcatgcatcgcatcaattccaataataaacagatacaaatgatttgctaaaacgaaagaacagcaaccaaaagaagaatggggggagttaccaggttgtggtagttggcgagtttggccatggtggtgctctcgccgccggggatgatgagcgagtcgagcccctgcagctgctccggcttccgcacctccacccccctcaccccgatcctcctcagcgctgcacccccccgcatccgcatcaatcaacaaccaacaaaccaaaccaaaccaaaattcccaaaaaagaagaaaaaaaacagaagcagtgggcgcatacataccggccaagtgctcgttgaaggagccctgcagcgcgaggacgccgacgaccgccattgctgctgctgctgctgctgctcccctcctcttctctcgctcgcgttgggatgtgtggctttggctttgaattggggggtgggaagaagtggacgggagaagcacgttgccgtggcggcggccgccacacgcacgcgcctccacctccacctccacggagataggctaccgctgctgccacgagggaaaaaaaaaacagttactggcggtcggtgctgcgcgatcctgaccgtccgatcgtagcagcaggagcaatctcgagcgttggttgttactgccgtgtgtgaagagtggtgatacggaccaaccgaaggctttaccacttctttgggccgccaggtcgtacttgagaattatgggccatggaaatggaggcccacataccacattatcggatatactaaattattacagtatactccgtcaaaaaaacccatctaaaattaaaatgggacataatttattgtattcagattcgttgtactagattatgtttcgtcctacttttagataaggtctttttggaacggagggagtagataatctacctatcatttttctttgataatctactacgagaatgttgtaaaaaatgcacgaatatgcacgtcaagcataatgagatacttccttcgtttcacattgtaagtcattctaacattttccacattcatattgatgttaatgaatttagatagatatgtatgtctagattcattaacatcaatatattagaaatactagaataccttacattgtgaaacggagtgagtatataatactgtgacatttaatttacaaagcacactgtaacaaaaaggaaagcaccagtaggattaattaattataattaattaattactactactgtaattaatagcagggtcaaaagggcttcattgagcttaagccgatcgatcttagcattcacgcatgagagttcagttcagttcacagctcggtatgccggacctcgtcgtcgtcgtctttgtcgtcggggtggtagtcgtccggcgacatgccgccgcaggggctggtcctgaggcagtcggcggcggggctgacgcggccgtcgtcgaagcccatggcgcagttgcagacggtctgcacctcgccgccgccgtcctcgcggcgcaggtcgatgtcgctgagcacgatgccgacgcaaggcacggcgtcgctgcacgccagcctgatcgcctccgcgcgcctcgccgtcccggtgatgttccggaacaccacgccgctcacccgcacgttcgacgtccggttccggcacggccgcgtcgcgtcgcagtagaactggtcgatgacgatggggtggtcgacgccgtcgacgcgcacgccggcgaaccgcacgttccggacgtagccggcgccgccctgccacgtcttgatgcggacgccgttctgggcgcgcgcgacgcgggcgccgtcgagggacac

SEQ ID NO: 65692 - DNA, 8900 bp, Oryza sativa
cgaggcgcacgtcgcgggagcgcgacaccgtcaggtgcatctgctgcgcgttctgcaggcgcaggttccgcacgctcacccccctgcacgagtcgatggtaaagcctgcacgtacatatgctccccggtcaaccgttaataaaaaatgcttgtgtactatttcctccgtttcacaatgtaagtcactctagcattttccatatttatattgatgttataaatatggaaaatgctagagtgacttacattatgaaacaaagggagtattttcaggggctgttcagattgatggcattttaaaccataccattttttttgtaaagttatcaaaaaatgtctacgtttagtttgttgccaaatttgataaatacataagaaaatcctgttaaaattttaacaatattgctatcttgccaaaatttgataaggtttattttaactataatctgaacagacccccagtttatattataagggtttgtttatatttatgccatttcaaaccataccattttttttatagagttgtcaaatatatgcatacatttagtttcttaccaaggtttagtaaatagataagaaatcctaccaaaaattttagctacaatctgaacaagccctaggttgttttgattttttttaaatggatttgttagaaaacttttgcaagttttttccctaaaactttcaaatttgtaaccatcggatcacctcgagatttgtgcatgaaggaaaaaaaattgctagaaaaaattcacacatgtcacgcataagatcctagtgcttgctaaccaaaccatagttaaatgtaagttttatataagttatatcgtagttaaagtgtagttataattaaactgcaattaaaaaacttgcgatagtttttttagtactccatttttaaattagtatattatgtttaattaagtttatattacaacatagacattaaatatattttgattttattcgtgttgaaaatattgtaatattttttatgaactttgtaaaaggttaactggaaaaaaaaatcaaaacaacttaaagtataaaacgaggtggagtaataacattgtgattaattaagtgattaatcctgcttaccgtaggtgctcctttgcatggctgcgagatgaaagggagagtaactgacggtcagtaacaatccagtgatcagtgagctaagctagagataattagtgaatgtttaattaccttggagcggtcaatcttgcaggagttggcccaccatttggagccggagccgtcgatgagaccgccgccctggatgcgggcgccggcgagaccggagaagaggagccacagccgggggctcgccggatcccactccgacggctcatctggcgccacgatagtgccctggatctgcacaaaatcgaatcatcgatcactgcactcctggtggtgtttgagatatttttttaagaagggatctgcatccaaccgatatatgcaacatttttaaaattagaaacttaacctatcgaacatgtaacttagctttcaaataacctaatatatacaacattttctaaattagaaacttagccctctagtacgtttgagatatattaagatgaaaataaagttagaaggcgcaaaatgagataatattctcttgattaatcgagttttaattatcacaaatttgaaagcctgatatatttaatattttaaagcagtttatatatttttttttacgaaatataccgtttaaaaatttgaaaaacgtgctaatgaaatccgatgtaaaatctacatcttaatccgatgaacttgcagtgtacatgatggattcacctggatgatcatcctgttcttgcagggcccgatgaacctggcagcgccgaccttgtagcggcggccgccggggaccaagaacaccgcgttgttcagcgagcatgccttcttccaagcattcaagaacgcctacaacaccaatatttgataattacatgcattgttcagaaaacttaacaagatagaatgtctggttaattcagaagaaatcgacggaatatgcaactggattcatcaatagatcatgtcgttagcaccgcacaagtgtacatggctactacttgcaatgtgttgagttaagtgaagcaatgtggctaagctagatcttgcgtttcttcttggctatctgaatctctcaacgagattttcacgccttcattaagaaagacgaggatacatttttgcaatctttaaggtttggaggatgatttggttaagctaagcaactgcatgctcaggtcagatgcaagggggaatctacaatctagtggcatcgctatcgaatcttcctttttctcagtctcgacaaagaaaaatatatcatgtggttcgcgtcatcatcagttgatcacatataaagtgtggcttcctggatttgtaaggtccaggtccctgcttttcttcccaacatccaagtggttgccctttttatcctcaaagtaattaaagatattaattgctccatctctgatagtacatttaatattttttttctgactgactctggtgctgtttgtttagaacagtgatcttttcgactaatactaatatggaacataatatatactctgacacttaggtcctatttagtttcatggactattgtttagctctcaccttttagtgttaaattaaccctcaaagatccaaacagataggctaattttgagctaatatgaattagccccgctcaaaacattagcccctccaaggggtgctaatggggctacttttgtgtggggactataaaaaaaacagctctctctctccttctctctcctctctttctactatctctctccaccttttagccttgaattaatccatggatccaaacatgtcatcctaagctaatgtttaacctaccaattcatgactaaacattagctcttaaaattagccctgtgctaatctttcaaacaaggccttaggccaataaaggaagcaatgtgaacttttttttgtttttttgtcatgcgtcaaatttgattaaccacgcgcactgaactttttagagtaaaaaacatcccaaaaacaaaggtgcaatctatctacaggggaaaaaacgtatgctttttgtgaagaaacctcgtgcaatgcgccaatgcaagcacacaccatctaatctgcatggatggatgaacaatggctagcacaatggagaaaagagaagatggtggctgttcgaattcgtgcacacacctccgtgtcgtcggagcagccgtcccccgccgcgccgaagctgtcgacgttcaccacgttcctccccgccggcggccggcacttggccgcccacgccatcacctgctccgcctcctcctcttcttcatcttcatcttcatcatcatcgtcgtcgtcgtcccaattcaggtaatcttccttagcatctgctccgcctcttccgttccaaagcttcaagaattgctcatgatcatggtcatggtcacctccggcgccgccgtcatcgccgccgccgccgctcgccgtcttcgccatggccatgatcaccatcaacgctactagcaccaagaacagcattgttcttggccttcttcttcttcctcctactgcctccattgtttcacttcacacaataataacagaaacagtgtagtatgctctccttggcttgggatacaatacgaggtgtagcaaataattttataggggaaacaagaagaagaagaaactgaagaagcaggagcaggagatggaggtgtggtgttctatgctctttttgtttttgtttttttttgggtggacttgaagtgcaagtgaataatggcgatgtgtgcgacagggcaaggtgtagtttatgctttactcatccatataccctttttcccttggcatttttttcaatcgatgcatcatttcttcttgtccttttggtagctatgtaatgtaagtacaaattaagatgatgatggtgattagataatgctttggcttgaatgaacaatttagacagaggctgactctacaaacgttcttgtttaagacgtgtaaaggcagcagctttggttgagagatttcatgtcaacttcccagttgcaaactcttcatgtttgttgcatgtggttatcatttgttatggttctacctacgtagtatcattattattttccaagaacgggaaaaagattagaggtccctttacgctagctttctgtaaatgttgatggcttaattacgtctgattctaaccaaggtataagctgcactgcacgaatgccatcagcagttcatgattaccaatcgatgattcaaccccatcttccaacttcaattggatcataggcagcattaatcctcactaggcatcgtttggaacacaggaaattttcttacgatttccacaagaatcaaagaaaaaaatcctcctttttccgcagttttcgcatcatcattctccatagcattgagatgtggcaagccacgttcgatgttcatgtgccattgctccaggtgccagcaatcatgaaccttacctgaacggcatgcatgatgcgtgcaacagtattcagtactatctgggtgctgattggggtgtaacttcagatgcactcatcctttccgtttgcacagaagcccctgctttgcctgcccactcctccttaacattgcattgcgtgtgctgttggctgttgcacatgctcctcacattatttctgtttcagcaactgcaatgcaaccccattagcatatcatctttgatcccttttgcttccggaaactaaaggggaaaaagaaaatactcattcctcagtgcaaccaggaaacatggttatcattgtaattgccactccaacgttggcaggatgataaccttttttctgatatggatgtgacatgtaacagcttctaaaactatatatatggttatcaagagactctggaggaccatagcttccatagtcccaatcaacaaatctacacaccatgtaagaatgacaactggaagggggggaggggcagagagatttagctttgtatatacggcttcagtgtaccactgtctaagctgatgattataaggctgttgctagctatgacatgttgatctcaacgctgcaactcttggggaagcggcagacagggcacacgtcagcatttttctcgcaatcagcacacaagcagaggtgtcgacacggcatcaccagcaccgctgcctccttcattctgcacaacctgcatgctcccagcccaccatcagccatgctgttgatgccgaggaggcctgactggaagaaaaccccaggcacagcattgacattctgactggaagctgtgttgtccacttcgctgtcgccagagccttccctggtgagattgctgctatgggctaccatctgcatgagcttgcttttcatgctgttagcgacagactggttgtgcagtgctaccgactgccatgactggacttccaatgcaacctgcctgatctgttcgttcagttccttgctcttcctgttcatggcctccacctcgagttctttctccttcagcttctttcctactcctcgttcaagggatgcaagaaattcaaccatctgcctctgctttacatctttcatgcacttaaccaattgttccacctgtgggaaaagagacacatgatgagtgtaaaaaacttcacaattcttgtagtttcacttggcacacagcagtaaggggagagcagataataatgtgttgcattggaaaaaaaaaacctataaaactttaatatgtgaattccaggctaagttactttacagttgatagcaactgatgactgatgcaattgccacttgagcctaacatatacagatcactccacataataaaaatattaaattcttgtgatcacactttatacagtattgttggatatttacagactatgaggaacttgacgacatgggaaaaaccaaggttgatgcattcggaatatatttggcaatgaggtggccttgagattgaatgtttccatggagagaatatagtcaaacagcaaaactaccaaatcacatttggataaatctgagccccagactattccaaaattactgaatggcatagagtttccactactgagtaaacatttttccataaacaagcactaacaaacatctcaaatttggtcaatgaataaagtaagcattgaatacctgaagtccgaaataacagttgaactctttgttttctttgtctaattcagccatcacttcatcaacaaaggatgccatgataggcaatgatgacatgttaccactgccagatgtgattgaagtgtgctcattgttctcataggacagtcttagcccagttgatacagcacttggattaccaatacgtgctaaccgatcaagattttcaacaggaaagtagttcagggacatctgaagattgagttgcttttcatgaccaacatcgttgtttgtatttctttcttgattcatagcagagaggtggttgtttgcaatgtagttataataaccagtacttcctaccgcaggaactgcatagatgattaaatacatataaattagtttattttgagcgtaacagctgaaagataaaaaataggtgacatggcaagaatacagcagtacaccacaggccaaactactacaataggaactacagatgcctccgtgtataacggaaaaaactagaccgcaaggacacaaagtgataaagcaaaaaagccagtcccacctatcaacgaaacgtgtaaagagaaaaaaaagatgcaacaagagaattattttcactgtcaaatgagacttaaccatcatccctgttggaccaaatgtggttcctctaggcaccgcacacaccatcataggatgctgcacaaaagtaatcaaatccaaacacaacctaatactacctccatcgctaaatatattacattggttagttcaaaaatgaactaataaccaacgtcatataaaaggaacagagggagtagtttggtatttacattatggtggatgatctctacttatcctttaggatgctttagaattcatgagacactagttggagggtgagagcatgaaagcacctctccacaatttaacctactgggtagtgaattgggacaagatgacacggtgagggttaattatcgctgcaaatcttaatgtgctaatatcctacagtgagaatctgcaagcaacatcttaagggcacatacaagtataacacagtttaacatgtcaacaagctagatcaataaatctcacattagagccatcatttttcttttatcctaatacaagacaaggaaatgaacgtgcagattccatctggcacattattgagtagagaaccaaaatatctacccagcaatgctggcttagtgctcaacaactcaagcagtgaattcaattgcactaaatctgaaccacatatgcttaaagacacacaagcgattgcctccgtgaagctaaccaactagatcatcctaccaaagcgcaccaagcaaatgcaagacagtaatcagcgctcgcatcaacagattcatctcacctgcggcgctcccgaagagctgcagctgcagcggcgaggccttggcatcaaacacgaactggctctccttgggaatggaggcgtaggggaaggaaccaccccagtggccactcccgaacatctccccgtccatcctgctcctctcctgccaacaacacgcagaacaaaacacagcacaaatcacgcgaatcccctccaaaataatccgtgccaggaagaacaaggacccgacggattacccccgagacgacggcgacgcgatctctcctcgatcagcgacgaacccgatccgatcctgcgaaaccgtaacctcgtcaatgcgatgggggaaaccagagacaggggtcaaaccacgcggcgcggctgcgggagaatcgcggaagggaagctgaccggagactccgccgactcgacgcgccgccgccgccgccgccgcagaaaccgccggcggtttagggttggggaatccgcgagaggagcggcggcgttgggaaatccgcgatttattggtattttttttccttttttttatttttatttcaccctttcgctttgctctctgcttggttggtttaaaaagaaagaaagaaaccgcaagtgaagaaaaggaagaaggtgtgccagagtgtgaggagacggatgggcgggccttgattgttggctcggcccatttagtttcggtccatctgtgtgtcactacggcctgttttaggttcaaggtgggcccatgcatcagccaccaaatcagcccaggaaaatatacgtgtggcccatgaactaaaccaaacaagtagtcatcatactacttctcctaggcagggttacaatctcgattagttagcgaattttgagccccatcaacacattttgaaccatttctacaatctcgattaatttcgaaaattccagccgctcggaattcgttgagattgtgaactctgcttttatgtaattactttatttagaattacacagtacaacgcaaacactcacaacgcatttgcactcacccttataaacacacgcacgcaaaccctacccctatgagcatattcgaagattgggcctcgctgtcgacgggtacgtcgcctaccaccgaaagcaacaccgttaaatcttggaaaatttgctcccataaggagtcaaacccaggacctcaggtgctactgaggctcttataacctctaggctgcagggcctttcgcctatgtaaccaattttgttcctctggaaaaaaaagcaaagcaatcttcttatgctaattaagggcctgtttggggagtgtaagattatgagaagcagatggttggtagccagcttctgagaatctggaaaag

SEQ ID NO: 65693 - DNA, 709 bp, Oryza sativa
aatcaattccccaggaaagcaacatttctgtttctgaggaatctaatccagaagatagtataacagcaagtgaaacaatttccaacactcaagaactaactattgcaggatcaatagaggccagtgaggacaacatagatacaaaaactggagaaatcactgatcaaagtaatgaggtttttgctggggaggcagctcaaggagataacatacctgaaagtgtgtcaactgctgatacacaatcaatgcaggagctggaatcagaagaaatgaagaaacctgaacttgttgatttgagtggaacatttcatcaaaaggatgatgccatctctcagaagcaaaaccaagaagataatccaaccacatgtgagacgaatgagattggatcaaccgaagtgagcagtgttgaagcctctgaagatcaagcaattgcccaccaaagtaatattactcaatgtgaggagcaagcaacagaagaaagtctaacagaaagtgaaccacaaattttggaaatggaatcagtccaggatattaaagacactgaagctactgaatctgaaaccattttccagaaaaacattgttcctacttccgaggagtctgtcccagaagaaaatgctacaacaaaagaacctgcttttgatgacagagaaatacaaaatgatggagcagaattaacaaagcaacatgatagtgtgaaggacgaaga

SEQ ID NO: 65694 - DNA, 6428 bp, Oryza sativa
agaaaggagctagtgtttttcttgagagaaaaaaaaaaggaaaatattggatgaaaggaacaagagtatagaatatatctgaccttgtgattggaaacaaacatgcaacagcacttagggaggcaccggccgtgcaaaagccatcttgtcatgttgtgccgccaaaatcataaccacctaaagattttttgtttttccttttttccttctcaatccatccatccatccatcagctgagcaatttgagtttggctgggaatatttgataatgacacataagacaaggaaaatatacacactaaaggcagcatttacaaataattagcactaaaattgcactaatatatatgtggagggagatagaaagcatcttgttccatggatggccagtgtttgatcagctgatgcctctacctgtttctgccatgattagtttggccagatcgacaattaaggcagctgcagttgtacgagctgtgcttttgtttcgtagctagggagagatcaatttggctcgcaaatgtttgtaccgtatacgcatccaactacgtatttgtttgcactagagactgactgatccagctacgtacgtatagctattgctttgttggcttatgatagatatttttcctcgcattttgttactctatcggttttctttcataatatcataattttattgggtctccaaatatatttctttcagtcaaaattaacggttatattggagactgattatatggtcaagaaggttggtgttcatatatgtagtataactcgttggttgtgtgtatctcgtgcagaggttgggcgggttcagttcgattatattatcttggtgtaattgactgagttttaataaaacttgaattatctaaatatagtataactctcactgtgccttttgtttcacttctgcatttccaagtatgtgtgagcaattcaaagatcaaaattccacaacatgtgtccggattggatagttggatctatggcctttcagagtgtagggtaggttggttgattggattgcaatataggtccacttactgttgtgctttccagccttgtttgactcaggaatcagaatagaacatgctctgccgtggattatttgttacacgcttttaaaaacatgttattcttaaaatagtttgttttactatgtttcttagatgacttgttgtaaactactcccttcgtttcgttttttaatagatgacaccgtttacttttaaacacatgtttaactattcgtcttattaaaattatttatgcaaatgcatgaaatataaatcatgcttaaaataattttaggataaaacaactaacataactaatgataatttcataatttttttagtaagacgaatgatcgaacatgtacccgaaagtcaacggtgtaatctattaaaaaacggaggtagtatttgttgagtttatttcttaaaatatttaatttatcgttgtaatcaagtagacaaatccactgtaacaaatctcgtgaataatctgtttcaaacacctccctaaaaaaaggaattgtcttagctttcatcatcactgcatgtttcaaatgaatgtttggattgccacaaatttttagccatacttgttgaaattctagactacaaaagttagtactatcaatacttgccaatgttttagcactaccaaacattgaaagagaaaaaattggcttcaaaccaaccaagacctttcacctgcaacacaggtgtactgaactgaatatactgctcctaccaatctcagacagatactgaagattagctgcttactacattttacagatcagacaagctactacgaagaacttgctaccaaacacggcatctaggtaggatggagaaaggggagaaaagaaggctttttggaagcaaaagcttctgcattgcaggctggctagtgctcatgtgggcacatcaaagacagctttttttcccctctttttttttcttttctttttttttaccatgatcacagagcaaaagaaagaagaaaggttgcttcaagaggcaggtgaatccagcgaagtgaggacattttcctgggccccactcttgtgctgtgtcactgacatgtgggcccccagtatctgcactcctctatccattccagaccacactagtcacttgcaatcagactaacagagtaacagtagacaacaaatagctgaccagatacatctaaagaaagaatttttctcaccagatatgcagataaacagacaagattagttgagtactcatcatctctgtatgacttcaatctcatcataattctgtttcaagttgacaagattagcactaagcagtttggtagccatacatacattgcatgcaggaaggcaggcaggcagtatcgatcaaaccttgtactgaaaactctgaaacttctgaaaactctgaaagtgaggctcgcggtcgtgtctgcctgcctgtcagtcttctcatcgtctcctcgtggttgagctgtccctacgcatatggcgctgacgtcatgtgggccccaccaaccgcccctactacaattaggtgcctaattttttttctctctctctctatcccttctaagcaaaataataatcatcattggggttctagattaagagatggattatgatctgggattatctgtattatatttgccaatttgccaaaagcccaaattaaacggtaggtacacagacagacacactcaccagaatgtgcagctatccagctgggagcccatgtcatcactcactctcatgcagctggatcatcaaggtgtccatccaattagtccaatcgaacacaagaggagcaagaacaagaagtactacacttgcatgatggtttggtttggcttgctttggcttgaatcatcagcaaagaatcaggagttcaggactaaagaaatcaaatgagcactattgtctttgcagctaattagtagacagaattaagattctgcagttggcaattgcctgtctgttaacaacagaaagctgcagaagaggctagggctagggagaaagacatcaaggcaggttcaggctcttcagaattcatgcggtttcaggatggtcacaaacagagtgttgcacatcaaggactctttggaacttaggatttttagaataggaataggaaaaacgtaggatttgaataccatcacatgtaaaatcccataggaaagaaaacagaaagaattatttaatacatatgtttggatatatcacaggaaaaccataggaattttgagagaagaagccttggaaatctcaaaggtttttgaaacaatgaggtttaacctacaaaaaggggaggaatttttcctatcttttgattttcctttgaagcaatcctacaatctaaatgactcatataggaattcctatcctttttttcaaaaagggtatcagtgtttctgccaaattgccaaaaacagtggagttagcaattgagatgtattactttgggcctgcccaaagtgcaattagtgatatatatcaccaataactactacaagcttatttgctactgggccttgaagcccatgaagacatgggcctcaacaactactgaaatctctgacaagtatcagtatgcatgcagcttcaataattaggagcctaatacacaagtacaaagcctatcttaatactaccagctttccatctcaaacccagtactgcacagttagccaccccttgcctttgacaaaagaggacaactcaaaaaaaaaagttgtaaaggctcacctatttaattagctccctttcttctgttgctctctacactgtcactctcactgcacttcctagcttagctgttcatctctcacctgactgaaagcctccattgccagtttcttcacctgctttgcttaacaccaaagcttaattcagtaattcatcagctacactagctgctgttaattaagcagcagaagaagtagcagcttagctgctgtaattcatcgcatccatggggatccaagaagtgaagaagaggctgcatctccatgtcgaagcccaaccggagagctgcaagaagaaggagcaggccgccgtgtgggtgctcgccggcggcggcggcggcggcggcggcggcggcgagatcacggtgtcgctgaagccggtcaaggtcagccggccacagctcggcgacgaggaggaggaggaggaggaggtgacgacgccgagaggggaggagtgcagattaccggcggaggcggcgacgtgcccgccggcgcccaagaagccgaggacggcggcggtggcgatcgtcgccggcggcggccggcggtgcaactgctgcgacgacgacggcggcgactcgctggagttcttccgcgtgccggcggatttggaggccgtctttgccaaccgagttgcaaaggcaaattagtagtaattaatttcatagagagataaattcgtcttgaattttaagtgtaatttgatccaagtctagctctgaagatcagtgcaattaatggtgtgtgcatgcatgggtgagtgagtgagagatcagtgcagctgtaaaaaaaagtttctctttgtagcacatgatagtgtgagtgatttccatatgattccatcccttttgattgatcatttcttcaagaattaatcaagaggcatttgtaatttgctctctcgatctcttaaattgtgtgtgctcagtgatttcccgcgtttttttttctttcatctctctttctgtatggcatttggatagagtttggatatttccaagttctttagcaaatggcaaaattttcaagtgcacttgagcttggtgattgtgaatgtttgcatggccatgcatacatcatccaccaatcattttttaatttttggattttgtagatttctttttcaatatttacacaagatatttttccaactacaatgtgtaattaagccataagtattgatgagattccagagtattggcatcagatttccttcatgctttttttaactattgctggtgacgatgaagatgtcttaaacacacacgctaaccctcaacctgggatctaaataaacaaaacttcgcaaaatgttttcgggattatttgattatgtagcaattctcaatggaaatcatggggggattcacatatcttgttgtgttttaaataaataaaattgctgcaaaatgctaacatatgtactcaggacagcccatgattcaatatagcaaagctctaacccgccaaaatttgaaaatctgacttcttagcacaaatctaattaattaaatccccgaaaacatgcaagtcacttgtacatttgatataatcggttgttcctaaagtgatttactttctcgagcttcgagaagaaaaatatactaagtatgatcccaattggaggtactatttatattttacacaagaactttagcaaagttgccaattcccgtacatgatacacaaaaatgtcatccaattcttgtacttgaaaaacctaataaaagaggacagtagtgctttttttagaggacaataatgcttagtgttggctatctcaaacaaaatttgtaagtccatcatattacaggattaatccatccaagttgtataaatcaaatcctacatgcaaacacaaatcagacactccaaaacactgaaagaaaaaagagtcaaagtgcagtggttaacaatacatgcatgcacactatcaacttctcactgatttttcttttttttacaactactactacctttgaagtgctagtagcttctggtcagtgtaggtatcccaatgttccatggaatgttctaatcctttaaacattaaaaattcagatacaactgctgctagatggatgcaggaggcacacacacagtatgtagtatatatgatcatccaacccagttggactggactgaactgttaacttggcaatatactattactgtataaacatttggatactagtgtaacggctcccactaggcctcagtgctatctactataccttttctcccttggatccctctatgcatgggcccctacattgctcaaaggcaccggccttgcaatgtctgtcttcccgcttctactggtttgaccctgcacagtgaaaaggtgtttgttattacaaccctaaaaagaaagtaaaaaaaatatacatcactgctgttaactatgtctttttactaaagatacattactagactagatgtgcccttttgtttcatatgattcttaatcagtttaagatgtgtgatgatggataaagaaattgattcatcttgtggaaatcatctacaagcatgatcactaattgctgctgtcaattattgttgaactgttactgtcttataggatcaagattcaagaggttttgttttatttccaagaattgtaatgcacatagaaaagagtaaaaggccgaataaagtcc

SEQ ID NO: 65695 - DNA, 2579 bp, Oryza sativa
cccatggaatggtgccatactatgttgtcttgtgaggaaaaattggctgcacttaaactaaaatcagtatgcgttattctgacatttataaatcaagtcactgatgatgcatcctgctgcacaaactatttggaggtggttatatgcttaacaagaaataggatgaagttaacaaaaccaaaaggcatgttcagcatacatcttatatgacagaacaaagttatccatgtaacaggttaagccagaaacatgaacatgatccttaaacaaagtttacctcattaagcatcctgtggagttcatcccttgcctcaaccacacgatctctgtcgttgctatcaacaacaaagatgagaccttgagtgttctggaaatagtgcctccacaaaggtctgatctgtagtttagaaaacataatgttatgagaaaaaaagtttctaaaaccctagagctgtggccatatattagtatgaagttcatatattccctactgtctgatgtgtttaaaatagtccaatacagcacaatggaaaatctactgctgattgcagaaataccttctgaagcgaaaagtgattttggttacaaaaagcaagaacgaattggtttttaccttgtcttgacccccgacatcccagacagtgaagctaatgttcttgtattcaacagtctccacattaaaccctagacatcaaagaaaaacagtaacttgatttgctctctttacaagcattatttcaaaaatgaaaaactatctctcatctgtctaacagtaatattttgcacttgcacatagagccatacaagcgtgcaaccatgtttgttcatatttccaacattatcaggttgcaatatgaaaatggatacaaaataatgcaagtgagccactaaatacaattgtaaactaagacatccaccaagccaccaatggaaggaatccagccgttttcatacaagggaccttacttctatgtgatctgtttttctttttgactacactatagtttgaacccaacttaccgacaacaaagtaggagtatttgaatgtacttaacagacacatccagtcaaaacatataaaatatcaaataggtttttacctattgttggaatggtggtgacaatctctccaagcttgagcttgtagagaattgtggttttaccagctgcgtcgagaccgaccatgaggatcctcatctccttcttggagaagaggcggctgaaaagcttcgtgaaagtgaggcccatcttgccgcagttgtgcaagaccttaaacaatcaagaatcaatatgagatatgatacaaaagcacatgcagcaaagttcttaaatctcagctcagataatgtaagaccaaaaccaaaatgggctccatagttcagttagttaaatcacaattcattcaaacgaaccagatcttttgcaaacgagaaaagtatataaggatatcgacattaagaagtactcccgtcatgccgttgtcttttaacatgacgtttgacatcttactaaaaaaattatataaataccataattttgttgtaacttgttttatcataaaaaaactataatattaacttagtacttttacatatttatactaaatttttaaataagacgttatgcgaaaagtcaagagcgtgcgttatacataaaaacctgaggtattatttgaaacggcaccgtgatccctcaggcaatgcaaagaaaacagcatctacagactatgatttcacatcccacgagtaaacaaaattcacagaccagtctgctgtgcgaaggatctatgcaatgcaacgcaacgcaacacgatgccactggaattaaaatgaacaatatacaagtctaacacgtgaaaaggggtcggcaatggaaacggataggcgatcacctcagccaaagcaaacaacggatcgccgaccagaagctcatctacggactaacaattccgcaccccacgcacgaacgaattccgcggacttgtagaggcctcccaaggatctacgcaacggaacacaacacacagcaccacgccattttctcgaggaaaaaaaattctggatcgaaccgaacgagatctacacacgcgcgacgccattggaagtttacgcaccacacgctacgaactcactcggctacacagatctacgcctccactccacggatctgggcctgggcagcagcagcagcatcgccgattcgccgccagcgccagcgccaccgcatccctccccagcaatgccccgagggcgaggcggagatcggagaggagaggagagagggaaaggagttgggcgtaccaaccttgctggagatcgatctcgtgcgcgcgcgtggcctctctcatctcctccccacctcgtcgagccgaagaaaaaggagacgacgcctcgacgcgcggtggttgcagcggagggaggcttcgagccgccgcggtgggtggacgcggtctacgtgagccgggtgtggtggactggtggtggtggtggtctaggtagagtgcggtgcacgtgagacgggtgcaggagagagcggtgcttctcatttgaagcttcaacgtgcaaccgacgctttctcta

SEQ ID NO: 65696 - DNA, 3793 bp, Oryza sativa
aattcgattgggctgtgtacccaaaacgttggggcagagctgcaaatttattgtgaagatgctgttgttccgctagtttgcagtcacaattcattcagacgacccagatcttttgctcgagtatacaagatgtacacatataaagtcgtgcagaattcaaatgtttaaggtcagggtacttgggatgtaaagtgttctctagcacaaaatatatttggcatgtgcgcgttggaaatacaaaatattcactctgctcataagataaaattaaatcaatcaatacctaaacacatgagaaaatagttcaattctccaacatcacttccccacaccttgaaaactaggaaaataaatacatacgatctcctaaatatcaaaaagaaaaatagatacattctcctctccctaaactgtagttcactcttttcatttcatctcctatatttctacaacatactattataaaatataaaggcgacgaagagacgaactgaagaacatgaatcaagtcttcggactgggattcacagcatcagaatcagcgaccaggccaatctgcatagggaagatgccatttcagtcaccagggtgctccacagcacctcatatatctgtctgtatggtataatcctgatctttttgaagaacttatgatatcaccaaatacttgcaatccaataaataagatcttgtagggttaatgctcctgctgacgctatctaaagccatattgccactaaagaaatgaatttactgtcttgtttgcttctaacgccgcctcaatatccggcaaagcaacagaatagatgtgctactattcaaaccctagaattggccccaagaaatgggaaaaccaaacaaaatgcagcatgcaaagaggtcaacttttccttagctcattttctcttgattttcttgcattagtttctccagttccttctgcccagtagatatcagtgtcttcacagtatcgaacgcagtcagtttaatactgcatggattgaggaatactgtgagcaatgagaagttacgtgccagtaaacatactattacctatcagtgttgccataaatttaaatatatagttgaccaccactgtgaaaagaaaaggcacctgctatttggtagattttttaatgcatttggaacaaaacctctgtatagtccaattagaccatcacgttccacaatgcctgcattcagcagagacaaatttaagaaatgcttcagtttagcccataaaggacaagaccaagctacaagtgagcatgtagaactggcatctgagagctgaagtgaacgttatgcagtaagtaaaagatgatgtttatccaacaccagaaggactatatataaatcagctacctggaatagcatccaaaaccgtgttgtagggtgatcctttcatttgcatctgccttctaacagtgtccagaggataacacatcaaagttgcaaatgttgctgaaagaagagcagttgccagagatgtctctggtctactcttatacttctctggtacagatttcttcattcttacatacagaaaagaatagagggtgaggtgaatatctacttttgagaccaacttttttatatgatgaggtagaaagaatctcacaagtcaaaaacacagaagttcacagcaatgtaaggggcgattcctataagagacggacccaggcctccatagaaggaggccaaaccttcgtctctcagcatgttcatagcaacctaaaagttaagtcatcaggttacattaatttccagaaacgaaactcaagcttataaactagttacctgagacatagtactatgtccagattgaactgctagcctcagccgaagaacatccagtgggtaagttacctatcagcaagtagccaagtatatatagaagtttcataatgatcagaacacaaacaaacaaatcaaactagatataaggacaattgctcaggagtaaataaataaattacaagtgtagatgtcatgcccgcacaagcaccagcagcaagtctcccaaacacagtaagctctccgtcctttctccggaaaaatttctgaatgcaaagcaggtacatggaaattgaaatgacaggaatccaaaataggtaattgactgatgataaagagttggcgttatcaccttgtaaacttcataagaaaacagttgcaccgcactgtaaggaactatgcggataaccttaagtagtttataaagaaactaagtgagaacaggaccaacagaataaaataaaccatgcatgagccacaatctgcatgatggggaatatcaagcacctgtggaagattgcctttccagtaacccttcaagccctcttccttccctatctctgcaatagcctgcataattgtagatgtatcagattagttatgtagtaccagatatacaactctaagtaaaatctatgaaaaagatagctatgcttctcctccttgtttgaaagtggaaagtgcaagttcatatatccaagagaaattagaaacaattatgttaagaagtcagaccgcacatagaaacaacatgttaaagcatatgcgaactggcagtactttgtgtctaactcatcaacacatgaagcaccagcatggcagcatctgatatcatattaaaaacatctaaacgaacaaacatcatgaagccataagtaaaacttaatggcatgccactgcctatttctgaaaaccattgttaccctcatttctgaaccatacaagaagcatcatgaattcaggacacagtgagtatgttacagtgtattataagtatattggaacaaattatggctttccctcagatagcaaccacgaattggtagtggtgaaacacatcagtttcatgactcacaggttcttttttaaagaaaaatgctccatgcctcacgaaagcctttttcatgatatgtttcccagaatagttttcaaatttctaaaacgtaattttgagattgtgtgttaatttttagtaaaccacgagtttcattgttccatatcagttcacatacaaccgcaagaccagaatactgcatatttgtagtggagagaagagtaccccattgttatgttcaacaccacacacacagacagaactcggttcgttctaacttatccctgatgtattcggaagctgcacttatgaattcagggaatttatcatgcaattgcaaatgacaggtactaaaatagacagggttgggatcaactccatggctagatggaaggcattttatagcaacaacagattgacattgttgtcatgaaaatcgcagacgatagtattaacattactaaaatagacagtgttgcatcagctccatggctacagaaaagccattctatagcaacaacagaattacacactcttaccaacttagaaatttatagcaaactgaagagaagaggtggaggacatcatcagagttacctcgaggaatccgatccctttcttggtgctctcccccaccacccgcacgctgtgcgtctacaaagaagaagagcaggaaatgcagtgggttacagaccacgcacccacaggccaccccacagcaaggagagggagagaaatcagaaacccccgggacgggaggggcggggtcatggtgtgccctacctgcatgaggagcttgacgcggtcgagcggcgcggtgatcgtcttggcgacggcccccgcggccgcccccgccgcgaagagcgcgacggcgttgggcaccagcgccagcatcgccagcgggtgcctcaccagcacccccgccgccggcagctgctgctg

SEQ ID NO: 65697 - DNA, 20475 bp, Oryza sativa
  unsure (1)..(20475): unsure at all n locations
acctccccctcctcccctccccctcccccctcccgcacggtgagcgacgcgaacgccgggccacccccacccccacccacgcggagggcgagcgcgcggcgggcgtggggaggcggcggcgtgggtgggggcctccatgagtcgcacgccgccgcatccactcgccggtggctcatcgtcgtcggtgggcaggcggtggccggatctgcttggccgcgagaggcgaggcgaggcgaggcggaatggaagagagaattaatgcggaggaagaagaagaagcgaagaaggaagaggggataagggggggaggaggattgatttcctccccgttttatgtcgaagctcgagagagcggtgaggaggggggttggttgtttaaaccctcgcgcacgccggacacgcgggcaatgcactcctctctcttttttttctttctttttcgttttcttttcttgagaggattaatggtgtatgagtgtggcacaatgaaagggacgtgtttcggttcttgccacaatgtcagcaagtaaatgcggttttggttgcccgtctgttcggcatttgtgccgtacatggacatgggaaccgaatcgtggaagaagggacagctaattgggtccgttttttttttttttgacaaattgacccttttggaaaacttatttcgaaactaacccctgccaaaaacttcaacaaaaaataggccgtcgcctcagcgacgttggccgtgtcagcgccaacgggactggcgctgacattgtgccaccgtggcggccgggccgatccccagctgacgtggcagctacctcagcgccaaccggactggcgctgaggtgggacttggccgcaacccccaaggcccagaccagcaagcctgctggatggcttgcgggctgggacctcagcgccagcccacctggcgctgaggtgggacttggccgcaacccccaaggcccagaccagcaagcctgctggatggcttgcgggctgggacctcagcgccagccataatggcgctgactattggaaactcagcgccagcccacctggcgctgaggtgggacttggccgtttcggccgtggcccagcccagcaagccttctggatggctgggctgggacctcagcgccaggtgagccctgctaaactttagcaaaactttgcacacaacagaggcaaacatcaaatcatagaaatttacaggcagtaatatatccagagaaccatacaaaacatacatccatccatcaatcccaacatcattccatacatccatagaatccatcaatacatccatatatgaagtccatatatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatctggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtaccccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgcagcaacaaaaataaaacacattgaagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagcctcatccacatccaaacctgcgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataataacataaagttagcgacaatatatcatatacaagggttgtggaaaatacatcatgcaactaggaactttaattttgggattgaccaagaaaactgaaaagaagatctgtgtgtttacatgctctgctttgaggctcctgaactttgatttgagatatctctatgatggatgatctatctgtacaaactaaaatcaaagaagaaaaaataaattcgatcataaaaaaatggaatattgttgatgctaacctctccgctggcaatctgtggggcccggtgcttctcctcgtagaaatcctccaaccccggaaagtgctccatcctgcaaatgaaaatggaatcattagtaattgaaaaaatattaaatgaaaaaatcacaatgagaacggaaaggaggacaacagaaagtaaacattgatgcaacaatatgaacttagcaaatgaatgtcatccaatcccacctgtgtgctaccctcaccacctccccccgtcctacggcgctttttcggtcgatccttagacttgtctcgcttcgggcacctagttttcttatggcctagttcgtggcatagcgagcatctattttgcatgaccggctctgaatttgtattgttcggcttttgtgaccgtcggttggctgagcctttgtatgctttgtccatatcgttcttgaaccttcttgtccttcttcttcctcgtgtgttgttctttaacgacaagtcgggcacgaagaactctccatcataacttggccactgcgatggatctaggtaaggttcaaacctaggggagtacgagtcctgcacagccttattggaagcttcataacacattcggggggccacctccacatccaaacctcgcaacttacaaacggttatcatgtgggagcatggcaagtgatggagctgagggaactgacaactacatgtgttatctctcgcaaccacgacgtagtgacgtccaccccattgaaccccagccgccgtgactccgccttgctcgctgacctcatacttcatcgaagggaaatcaaaacatgctgctctttgccccaaggttcgtctttgctgctcctccaacatgtccttaacttttgtgggccacttctttccacacaggatatctacagttgcctctttgtgtctatcgacaaaccaactattgcacttcgaaaatgtgtatgccacaatagctgtaaccggcagtttccgaatgcctctcaatacattattgaaactctcggccatattactagtcatgatgctatgacgacgcccgttggtatcaaatgctcttgcccatttgaccttaagtggcatatggtcttctagccacttctttggcctctctccgaccacacccatgaggcgttttatctcatctaggaacaatgctttctcatttatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcaacttgtttctcaacatgttgatgaaccactcccagttggatgtattctccttctctaccagagcaaacgctaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccgatagtgccatatttgcccaattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaattttaaacccatgcataaacattaattacttgaaaataatatgtaattaccattgcaataccaatacttcaaaagctaacaacatgtctaatttttccaataaataagtacattactcaaatactacacattattgataaaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacttccacacttcatccccacccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaacagaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggccgccacggtggcacaatgtcagcgccagtcccgttggcgctgacacggccaacctcagcgccaatgcgcttggcgctgagccgacggcctagttttggttgaagtttttggcaggggttagtttcgaattaagtttttgaaaagggtcaatttgtcaaaaaaacggtaattgggtggtaactagaaccaatacgtacttcatatgtacttaaataatacttttaaatattagaatctacgatactatttaacccatcctataaacaaaacctccatacaaatttataggatggtttaaatcttgtagtaggttgcaacattttgagacatggatagtatagtaatatagtagctggattagacctaacctattactaatcttatctagatcttgttatacccctctaaattgatttgaagtactaaattgtgtctaatctggtttttcggtactaaattgctatattttagaatgagattcattcaaattctaagtaaatacaatccaaaaaataaactaaaaaccagaacagattctcaaaaattaactaactaccaaccaaatgtttatcagaatttagctccctaataaagaagaccaaagagttgttgggtggatggttggattgagcgtggtgcatagctgcatatcaaaggctgacatcatttgcagcaaacgcataccacaataatactatgcatgtacgtgaagtgtttttttcgtgaggattattaaaagtttaagttttttttcctgaatgaacgaggtttattaaaagttgagttcaattatactagcacgcatgtagttagtctatattgagtaccactagagcaatgatccagctagccaagctaaaacgacatctagatcaccccaagtaaagcatataggtttagaaaccattcggatacacagcaaaacaaaaagaaaactcatgtcccagctattctttagaaagtccatgggataaattggagcaagtctatttgcttttcccttttgctcttggaaatttgcagatcaacggtaagattacatatagggcataaattagttgactttctttgccaccttttgatgtttgttattcacaactgagcactattaaatatgatatgtccacggtgtgttttgtttatttcttctcatttcaggttttctacaatactgctcagtactatttaggattctcgtgtcatattgattggccttcttctaattattttagcatttcaatacataaacagttgacaggtatgtataccgaattagaagtatttatctatgtcaaggttcttttagtaattgtatgatgtccataatgtttctttcaaaatataggatcatgtcctgtccccccaacacacacacaaagagataaaaatagaatgtggttattcttaggtacccctctgttccaaaaaaaagtctaatccttgctaatccttggacacatgtgtgtcagattcgtagctagagtttgcctttttatgggacaaagtagtaggaactacacttttttgttgttttgcaagtttgaaatttgacatttcattttacatttattattttcatgtagagggattgaactttatttttccaagtctttgaaatcacttcttacagaattaagcatttcatgttcatacattctttcgctctattagctcaaaagatattttgttgcgatggttcctacaaaatgttaagagttattgcacctgcttcaccttttgtaatatcacatatattgtttatatatgcgtgccaggcaaattatatgtgtcaaccgctatttatgtgatatatgctcctttttttcgttatatactattgattagggattcttatgtatgttttatatagcaggttgttaacgccaaaatttggtaagattttgtagtggattcggttaaggaaaaaacacaatcagccgatggaaagcttatccagaagagtccaagttcaaggagtcatgaataccatggcgtggcagattaatttctatctattaattaggtagagtttagttattttcccttatctttaggaagttttgtctagtgtccgattaggacttgtatctttccttgtctttaggaaacatggtgtcgcgtccgatatgaactactatctaaccatgggtgtttctttgtaaaatgtaatctatctcttgatcaatacaacttcagcgcatatcattggacatctacttcaacatattatcatcggtcgattggattgattgtctttatatcatatttatctaagcgttaaaatttagatcgggcatataacctattgtttaagaccatatcgacatcggctagtactgatacattggcttaatggttgatcggttctttgaacatcaatttatctatcttgtcaattacaggatcaaactgactggcacacccaaacctgatattttaggacttgcactggagctaagcaaatctcccatgacttcaagtgtcacgaagaaatttcacgtcaacacatgcccatatatagatggatgtttgttcctcctttttgttgcaagttttctgtgcattatattcttattagacactctccaggcccattcatgaatgatcctatgtacatgtaagcttctctattgcctttatgtgtacatgaagattatttcgtataagccttttcaagtcttacttcgatacctcagttatcttgtatagttaggtataattatgatcaataattatttaaaaagtctatgaatgatatcgtccattcaaatatatgatccaaatgactacaattattctaaaccacaatagaaataatgatgtcggtatatatatatatctctactacctaaaaaaatcaaaacgtttccttcgtccatcaaaacaaaaaaaaggaagaaaataactaaaaaaaagtctgactcccctgcgttcgtttgccagggctggccctccggtatggaaaacggagcgatccattagcgcgtgtttaattaagtgtttgctaatgtctttttcaaaaatggatcaatatgatttttaagcaattttcgtatataaactttttgtaaaaagaaaagaaccgtttagcattttaaaaaacgtgcgcccagaaaacgaggaagaggggttgggaacaagcgggaacgaacgcagcctaaatagatcagattcccccttaaaaagagggaaaatatgagaaaaaatagcgaacaaaacaacaacaaaaaaaatatgtttcctttaagtggccaaacaaaaccgtagatccaaacgggaaaaaaaaatacgattcctataaaaggcaaaaacaaaaaaaaagtggtgaaaaaaacgctagatccgattcctataaaggtgaaaaaaaaatccaaaacatctttaaaaaaaagttcgtccgattccctaagaaagtggcgaaaaaaactgtttgtaaaaaataaaaatgggttcgtataaaataaaaaatacacacgagaaaaaaaaagggcctaaaaaagtttgatttctattcgttttagtagtcagtatatatatcttctttatctctaatctaatctaactatttaaaaagagaagttttcatcgtacaactgaaaagaaaaaatgcacaataaaataaaaacagttcaaaaaatacgggagaaaaaagtcataaaaaagcgcaaaaacacgctaaaaaggttttccatcttccaaaagaaataaaaaaccgagcaagaaaaaaatatttccatcgtcggtaaaaaaataaaaaacatgcgaggaaaaaactgtcagaaaaaacgcgccatttcaaaacaatggtttgaaaaaaccgcgcaagaaaaaaacaccgtctattaaaaaacaagccgctctgaaaaaattatcagaaaaagcagtaaattgatgcacgcttgagtcggaaaggatccatcgattttttgccatctaatacacggcttttgtttcgtcatctattctcatgtattggaataaaggaaaaagaacattcgaaaaaaaagagcaaacgtgcgagaaaataattgtcagaaaaaagggcaaaataacacgcgagaaaagaaaagcaaaaaaacatgagagaaaaatacggttttcgtcatcagtaaaaaaaaagcaaaaaaaaaacatgctaggaaaaaactgtcacaaaactgcacaagaaaaaaacaccgtttataaaaaaacgagtagaaaaaacaatcgggttcaacacgagaaagaaccgatgtttctaaaaacggttcgagaactctaacgtaacgcgagaaaaaaaaagcatcatttctaaaaaaaggttagagtaaaccatccgaatcaacacgagacatacaaaattgttgtttatgataagaaccgctctggaaaaccatcggactcaacgggagataaaattgatggacgcttgggttggataggatccatcaatttttttctatctcctacacggtttttgtttcctcatctttctcatgtattagagaccctgcacgtctctgcacgtatctgtatgtagatatcaatatttgaataaagtggaggaggaacctatagaaataaacatcaatatttgaataaattgatcaaatatttaaaatattaggatgagataactaatttaccatttattttagttaattacaacactttgagttcacagatatcacttgaaagtaaatagataacaggatgacaaaaacgaataatccaaaataagaattaacagatatcacacctaaaaataaacttacacaaataaatataaaaaatgcattatcatttctagtgtaaggatatcaaacttaatatgaaatgcaatccccagcacaagacgtagatgtgtacatagtccatagtcctaacacaatcagatgtagagtacatataccatcctaatcctcaacacgagaaatacgtgtacatatagtactatgtatagttttaaaaaacctcctacttctcggcacgaggaaatcagggcatgagaaaatcgggatcgatccataacatgtctagtgacttgacaacgctagaactccaacaaacactgctagcacagatccaactaggaaccgtgtgcactcaaccacgcttatgcaaagatcatgctgtctagcaagcagggcagtgcttaaggctgcaattccccccacctcacatgcaacacatgagcacatgcattaacatagatataacttaatcaaattagggagcgtttgttgagggggaaatgagttgtaagacctcatttgcatggccagcattgagtcccatataaacaaagcattaattaactctatccatttccaaaatatagtcagttttataaataattttcatgaaactgttccaaagccaagtaccatcatccactgttgtttaaaaatgtatttgctagtactacatgatgaggaaagtagtaaaatgctagtagtgctttactacttcatttattgccaggcttatttttggtccattattgattggggagagatataaggaaaagatattaaaagaatttcattttattctcaatttttgctacacaaactagtaatagttgtaccttgaaactgagagtataatttattgtttattgtcatgctctatgcatattaatcaggagagtataaagggactatatggcacagctccagcttcacccctcctagagctagagctcagccaaatgtttcagctccacaaaaaataggagtggagctgggtggagctctctcacaaaatggtctagagttgtagagctgggtttaagagctggtgtgctaattcaaggagcaactcaggaactccaaagcacctcaaaccacatatccaccgagcaactccagcatctccaaaacaccgcaaaccatatatccaccaagacatacctacgcatgattctttgtagacgagcacagcgcgaccaactgctacgagtagcgcctcttctatcctgccctctccgcaccgtcgttgcaacgatgtaatggagcgaagcccacaaggaggcaatgggggcacatgcccccttacgctcatagaacaaagcgtaccttatagtaataatagttgatctccatggttgtgggttgctcatcatcaccaatggagcttaaactaaagtggagggagaacctatagaaataaacatcaatatttgaataaattgatcaaacatttaaaatattaggatgagataaccaatttaacatttattttggttaattaaaacactttgagttaacagatatcacttgaaagaaaatagataacaggatgacaaaaacgaatcgtctaaaataagaattgatagatatcacacctgaaaatcaacttacacaaataaatataaagaatacattatcatttgcagtgtaaggatatcaaacttactatgaaatgcaatcctcagcatgagacgtagatgtgtacatagtcgtaatacaatcctcggcacaaggagattatttgagccagtgaacatatcatgttgatcatgaccatcgtgataagtagggtagtggatatgtgtctcacgccacaaaagaattggtgtgctaattggagaagcaactccaggaactccaaagcacctcaaaccacatatccaccgagacatctctgtaagacaaatccagcaacccgaaagcaccgcaaaccatatatccacaaagacaaatctccataaggtcggtaagcatatccatcaagacatgcatacgcacgattctttgtagatgagcacaacgcgaccaaccgcgactattagcacctcttttatcttgccctctccgcaccgtcgttgcaacgatgcaacggagcggagcacagatgggggcacatgcccccttacgctcatagaacaaagtgtaccttatagtaataatagttgatctccatggttgtgggttgttcatcatcaccaattgagtttaagctaaaatggagggagaacctatagaaataaacatcaatatttgaataaattgatcacacctgaaaataaacttacacaaataaatataaaaaatgcattatcatttgcagtgtaagatatcaaacttagtatgaaatgcaatcctcagcacgagacatagatgtatatatagtcctaacacaatcagatgtagacatgtgtacaatcagatgcacataacagtacgagacatgtgtacatataccatcctaatcctcaacacgagaactatgtgtgtacatatagtactatgtatagttttatagatcctcctacttctcggcacgaggaaatcaggatccgagggtccataatatgtagtttcttgacaacactaagaactccaacaaacaccgctagcatagatctaacatgatataaaaggcatcaagtggaaatcctctatgttcaaatttgaaatcaactagttattgagaggatttacagcatgtagttgaataaatttggaattcttgtaatgaaaagaggtctatattgataaatgcgatggagaatgcaaatgatgagaaaagggctaaacagatggaacatgaactgggatagtgaatacaaatgggaaaaacataggtggcaaattattcatatcaagtttcgatagagatgagccaagagaagtttggagtggagggaatgaagtttttgtgtgctcctctttttggcctgatgccgatggatgcaggttttatgccctagcttattttgtagttttttttagtcgatctggtcgcacctgaaccaatgagaattaggccaaaaccttttaatttttttctcctgaacttaatttttttattttttttctcctgaacttaatacttccctaaaaatacttccactgaactaaagtatataaggagaaatggtgatcaagctaataaatgaaacatggtgtaataaaaaaaacataaacaaacatgtgagattgtgataaaagcaactgtgactatatagcagctcatccctcatgcggagagagagataagggggagaggggtgtttataacaaggataagcatgcattcatgataatcttaacaacactaaacagccttgactaacctggccaacagttcttgtgtgcacaatccagaggaaggcactaaatcactacatgtcaatcgatagaagagacaaatacttgggatgagcccctgcaatatgtccacaggcaaaaaagttgacagacttgcttaggagcacaccaaaagccagaccaagtaaatacaagcaccaaacatctattttgttttgtattttttatacaacctcccaatgggaataaactaagcatattcttattgatttagttgattgacatggatgagttattgaaatatttgttaaatctatattactttcaactgaaagtataataacaaaaacaaggaaggaggtttccgcatgtaaaagtactaaaaagataattcaaaacgtgttcagactttagtagtacctcaagatacatttcatcgagcagtccttgagcaccaaaaacctctaatgcgttcctcctcttccttgttctctttgtatcctcctattctctggccatagcagcagtgcacagcagcacatacatcatgaggtcaacgtagagcagaagcaaatcgacaacaaatcagaaagagcaatgcggtggcagtaacataatagcagcagcagcagcaacaacatcaacagttgtagctgtagctgtagcctgtagcggggcagcaaatcgtccctaccaagcaaagcaagagcattgaactcattttttttagcagacggtaggagcaaccgcataggagttggcaagggatgtgaagacctgaaaaaatttgaaagccttggcaaatcagttacagcaactgtcaggcgactcaagctcgtgctgccagccgttgtcgctaccatctctccccctttgtccgcaggaaaccaccgctattgtcgctaccatctttcccctttgtccacaggaaaccgccaatatccccatccattgcatctgtagtgatagatggatggggatgaacggaagacgatggataattttataagatttcatctcttcctcctcttatggtgacgacgttgcgatctactatctaatcccgctttgcttgccctagggtcgcgctcagccctcaactcatgctcactgccttccttatggcgaagatgcagagttgaggatgacgacaaatcgacagcaccgacagcggtgggcaggcggcgatgtcgagcggagttaatgtgtagcagccacagcgcactgtgttgaggggagatggcgacacgagacgaggcgatggtggtgggctaaggcgcacggtggtgggcctattggcgagccggcgatgacattggctgggggatggcagtggcgacgagccacctgggaaggaagaggggtggttcaaggcggcgacgaagtggaggcgtggggtgctcgaagcagggaggttgtccattggtttcactaatcctgctactaatccatcggctaatccaactcacaacgtaggtcgttagatgagaggatccaacggttaggaatgatctgggtatattttgttaattcattttgactttttccgtagtcaaacttaaccaagtttattaataacatatttgttttgtatttaaaatgctatgctaacttgattaaacttaaagtttgattagtcaaaacaacttataatatgaaacagagagagtagatgcctactaattgacttactatactagtaatatgaacgtgctaatgctatggcgatatttcataaaacaatggtgatagacagataaatagaatcatgttgagaatcaaacaactaattatacttgttgctcacagtatactgatttaatacaagacttcctaattcataaaacccattgcatgatcagtttcacttgagctatcaaagcgtaaggattctttgaaaaacaaaaccacagacaacagtgggagaccatagtttacagggtcaacaatcatgttttctccttttctagcctccaaaaataggaacattgattcaatagttttttaaactcccaagttactctaggaaggttgactatgaagatcgtctgagttctaaaccagagatctaccgctctttacaaactgaccaaaatcaaatctatggagctttcccccgaatttagaatggatatgttttacacactttttcaagaacacacgaatgtattgcatgtccttcatacaaaggaagatagggttagacatatcgttactatggggtagtttggatacagggttagtctctgtcacatcggatgtttggacactaatttgaagtattaaacataggctagttacaaaactaattacacggatggaggctaatttgcgagacgaatatattaagactaattagtccatgatttaacaatgtagtgctacagtaattaatcatgaattaattaggcttaatagattcatctcgtaaattagcctctatctgtgtaattagttttgtaattagtctatgtttaatactccaaattagtcagagcgttcgttcgttgggtgattggagagaaagcacatcgttttccgcgtgcacgattcccaaactactaaacggtgcgttttttgcaaaaaaaaaaaaattctataggaaagttgctttaaaaatcatattaatccattcttgaaatttaaaatagttgaaactcaattaatcatgtggtaatggcttacctcgttttgcgtgccttctcaatcttctcttttcctctcctcaaaagtaaaagagagctgaaactcactgattctaaagtttggatcactgaaggctgcaatatggactgatcacttcagaaaagagtcgacacttcaaatttatctacattgatcacacaacctaatagattcactggacaccaatctaatgacatatattttgacaaaatatgtagcagagaaagtactaattattcataaatcacatcatgagctacaaaaacaccatgaactttgcttaccacgtagagcaacaatcgacagaaagctaggcttgcactgttgtttccagcttcctatagattttcctgcaaaacctacaaaactataaaactggtgaattttcaacaccaaacatggccaatgatatgtaatcatgaaaaatcggtataaatctaacggccttatcttgttgcttatgcttatgcttattagccaaaatttgatttttcaaccttaaatttggagttgattttgtggtttttttcatcgtagtttattttttagcctttgcttttagatcgttaggaacatgtatataaaagttttattcacaaattatttctcgtttgcaaataagaataagccaaacaatgggatgtaaaaggctaacctcaataaatggaaatcttcattgatcatgatgaataaaaaacatgaccagagctacagtactatacattaattaaaaacaatattttttgataaaaaaacagttttaattactgcatccaactaacattaataggtaactcggtaaaaaaataggaacattgattcaatagaataagatgctaatagctctcccatccctactgtcccaagttactttaggatggttgactttgaagatcgtctgatttctaaccagcatcttttaaggtgttggagaggttgttgtaaaaccacagacattaaaaattacatgatttagtataagatattcaattgttaagcatccctgtcacgaaccagggggctgctgcaacaccagagtcagcttctgctcctaatctcataccatttgtcgtgatctatgaagtaaaaattgtcattcagataattaatacgaagagaggaaaccttataattccttctagtggcaggccacacagttctaatagccttcacctccacttttgcagcaatgtggaagtaattttacaaaattttaactaggttagtagagtgcagatgttcagtgcaaaattactcgtctattttaatgcgcaccagttgtcttcccataaaacaaaaaaagtagttgagccttacaaaataaaaacttagatgcagggtgttgagcattatcggtgattaggaaatagttccagttctaaactagagtgtttacaaactgatcaaaatcaaatctatgnnnnnnnnnnnnnnnnnnnnnnnntggatatgttttacacactttttcaagaacacacgaatatactgcatgcccttcatacaaagaaggaagatagggttagacatcgtattactatatctgaataataagaggatgatatagttaaagcccttcatcatgctcagaagtaaaagagagctgaaactcactgattcagaagtttggatcactgaaggctgcaacatggactgttcacttcagaaaagagtcgatacttcaaatttatctacagtgatcacacaacctaatagattcactggacaccgatctaatgacatatattttgacaaaatatgtagcagagaaagtactaatcattcataaatcaaatcatgagctgcaaaaacaccatgaacgttgcttaccacgtagagcaacaatcgacagaaagccaggcttgcactgttgtttccagcttcctatagactttcatgcaaaactataaaactggtgaattttcaacaccaaacatggccaatgatatgtaatcgtgaaaaatcggtataaatctaacggcctcatcttttcgcttatgcttatgcttattagccagaatttaaattttcaaccttaaatttggagtcgattttgagttttttttcatcgtagtttatttttcagcctttgcttttagatcattaagaacatgtatataaaagttttattcacaaattatttttcgtttgcaagtaagatgtttggcttattcctcaaataagctaaacaatggggctgtaaaaggccaacctcaataattggatatcttcattgatcatgatgaataaaaaacatgaccagacctcaattaatcatgtggtaatggctcacctcgttttgcgtatcttctcaatcttctcttttcctctcctctcaaacactccctaagaggataatatagttaaaacccttcatcatgctcaaaagtaaaagagagctgaaactcactgattcagaagtttggatcactgaaggctgcaacatggactgttcacttcagaaaagagtcgacacttcaaatttatctacactgatcacacaacctaatagattcactggataccaatctaatgacatatattttgacaaaatatgtagcagagaaagtactaatcattcataaattacatcatgagctacaaaaacaccatgaacgttgcttactacgtacagcaacaatcgacagaaagccgggcttgcactgttgtttccagcttcctacagattttcctgcaaaactataaaactggtgaattttcaacaccaaacatggccaatgatatgtaatcatgaaaaatcggtataaatctaaaaggctaacatcaataaatgaaaatcttcattgatcatgatggataaaaaacatgatcagagctactactatacataaattaaaacaatacttttgataaaaaaaaaaacagtactaattggtgcatccaactaacattaataggtaactcagtacaattagcccagccgccatttttcctagccacaactttcaccacaatgcattttctacaattggcctcatttctgttttg

SEQ ID NO: 65698 - DNA, 31424 bp, Oryza sativa
atcgacaattatattctctagcgtgttcagactttcgatatacatattgacaaggcctcacataaatttgaaagtgagtattaaactaagttcataagtgatcttaaaacaagtaaaaaaataccatttggagtgcatcttttggaacccctgattgcctagctttgtagcatgagtcttcaaaggagcaatcaacttcaaatgtctggtccaaaatttcccctccggtattcataatatatagaaattgtgttcatcaagggataaacctagtgaattactgttgaaacacaggaaacaaattatctccagagcataaggccaatctcacagatagaggtacaaaaccttgattgagtctaacattctacagtgcggactcaatatacacacatgacagtccatttctattttagagagaaatcaaacttcattgtaaattttcattgatgttaaaaatgaaaaataaacaccagtttacaataatgcacatagaatctatgttggcaagaaataaatcattgcaacggagaagaaaccaagtgtcattattatttccatacaaaaaaagagttagagaaacatcagaaattcattgagtaggaccacatcaatatctttacatttgatgaataatatctttacattgttaatgaaagtacatcaatatatattgtggtaaaagcagttctcaaatgatttgcaaaaaaaaagagagcatatagcaccctcaaactatcaccaacatggccttgcatgacacacttctgatgttcatggaagtataggcaaattatcatggggtgtacaatataccagcaccctgaagcaccatacatagcccttgcacactctggaaacaattgatcccaataaatcccaaaagtatatgggtgaagtgattccacactaattaacagagttgtattgtataaaaaccaaacaataatcaatattgatgcagaagtacttaatagcaccaattgtggtatacatggttttgagatctgcagttaaattacagcagttacaccaattgagtttcacaaataaaaacgacagacctagctacaatgtacatctagtgtaaactaaaatgcaatcttaaaataaaatcatgtttaccttcaagccagggcagatggattgaaattcaatctttaagattcataaaaatattgcccctcaaataattcctagggtgacaaatacattctgtatacagaactaaaaaactggagtcattgcctcacatcttttttgagaaggttgaaccaacttaggagcaatttaagtaaacaatattcattcaaactcattttcttttctgaatctatgaccaaaataaacacggtttgttgaagtttagtgatccagcaatgggaacaatatttatcatgtaaacgcgccttaatgaggacaaagtttgtgcctttcttatgagcttctcatatcaacctgccataccacaaaaaaaatgccatacaaatgacaaggccctgagcttatttattttccaagacataagaaacaaagagtgatggctgaaatgcatatataatttagtatgaaactaaagaatgtagaacccaaaatttcctagcactggtgaggggataaatgtacaggatacttcaaaatttatatcacgcatagaagaacacaatattgataaagatactgaaaaatggcaagaacaggagaggttttatgcgatctttaaatattgataaataatacatggttaattgaaagtactaagaataaattaactcaacattctgatagtcctgatcagatttgtagccttatttagcaaattttaacttctttgctatgagcaagcattgcctggtggttaaagtcacagattgcacacccgtataaaaataaactgcaaaggagcagcttaaatacctctgttcatttggtaagttcaccgtatgctatatgtagtaatctccaatatgggacctttcatgatatccaaacctgaacaattaaaaaacagaagcctcccaattagctcctagaaaccacagttcacaatagtacactgaaacaacacggaaaaagttgctctttttttcctaaagtaattatttagtaaaagcttgtaatgcttcttctttacacattccacaataattggattgtcacatgctatagctaacaaattcaggggagtgtacgtcttatgggacaaagggtctatgggagcactattcattacatggtacagtcgacatgtaatataacagctataatgataatgaccttatgatagtaatgaaaaacagatgtatacttcaatgaaaactcatgagcaagcaaaataatgaatagcactaagcatggtttctcaatttctcttctgtccataaaattcctcaatttctcttcctctcccacagtgaggatgataagcttcacagcagtcccagaaagtgaattttatggcagaaaaggaaaaatcataatttgccctgaaagcaaatgcaaaaaagagcctatgtgtatattatcatgggtaaacatatatgactattcagctgaacccgttgtgtgctggaactagttttgctgaaagatggtagtgttggttatgggacctggcattcttcactaaaattccatttaaggttttataacagagtaaaaaaaaactgatgttagacactatactgaaccgatcactgcatccggcaagctgtacacggagccaaccaaatgaaattattcgtgttggccatttcagttagcctttatgtacttgaataataacaagcaacaagagctaatgatctactgtcagatgggatccaaaccgctaggcaattcaaccagtcttatcagaaagcttgtctttatcatggattgactatacatgttagcaatttctgttgcatattctcaacttggacgtatgcatcacatatcaccaacttgaatgcctacaccacagatctatataaacaacgaaatgaggataaacaggtcttaccttcacaacaggggcatatgaagaggggaatgggatcagtgcggcgtcgtgcgatccggcgcaaagaggaccaccgtggagatcaacggagacaaacggatccagaagccagacaccttgtcgattgcagactgccattgcgcgtggagaaggggagtcggcgatgtaggccaccgcggagtgcagtggtgggcccaactttttgaacctgtgtattcgaaatgggaagggttaaaaaaattgttcatacacctaaaagcctaaaaattagcttgtatagttctgaaaattaaacaattatggtaatatggtatgaactaagcaagcaagtatactaaatcaatgaattgtagttcccaatcctaaaatcttcattacaagtatcaaattttgcgattttagtcatagagacaaaaaaaggaataatgagttttatatccttactgtcgatgctaagtatatttaaacatagagaccattataagtcagtcagatgatataatactagtactctagaataaaatgtcatgaaaacttgggccaagaacaattctgttatataatttctagatgaatgaataatatagtgtactgaaaactatgatgtaccaatcaatcaaaacataaatgattcaggcattggattactgaaggaattcctgaaagttgaaaactcttgagaaataatctggtgaagtggtgatgacatgttgatatatcccttctcttttgctgatcttttcagccttcgggaggaatatttacctgctgaggaggtgctgaggaggtggccgagatggcgtgccggcgccctgcgtggcactgcagcgccgcccgagccgctgtggcgctgccgccggtgcgcccctacctggctgcctcacgagtcgcgccgcgcggccgcgccgcagttgccactcgccggctcgccgcagccgcacggcacgaagcgccggccggtcgagcccgcgagccgccgcctccctgccgcagccgcaccggcacgccagagtactggaggtagttgtgaggtgggtggcggagggaggccggcgcgaagaaggggggagagtcggcgaccacgggatggaggtggttgtgaggtgagcgggggcggggagatcggtgaggcagagggacggcagcgcgagtgcgacgcggcggaggtagcacctggcggcgcttcgtggaaggagatcggcggcggcatgtgagaaggagagaggattagggcgtggaggagagagagagagacggcgagcgtgaggaaggcgtcacacgcagaagagtagccgttggattaagatgttaccgttaggtggccgagatgtaaattgtactccttctatccgttggcacgcttgtacttaagaagtatcgtatttgtttatttattcgcacaattatacaaagtacgtgagtatataataaaagttttttttcgcccattaaaaactaggtatctgttggttactccttcatatatttacaaaagaaaaatcagaaatcatctccttttccgtaggacgtttccggcctactccttcccttttgttcctcgtgcatagagatggcaacggagaattcaccgtctggggttacatccgcgtcaccgttcccatggtgatgaaatttcaccgtccctgtccccgccaactatgacggtgctacattttatccatccttgaccttgcacggtccgtcaccgcatgtgctcatcttgcttcgtcaccgtcggagctaatgggagaggtcaaagccatggccagtagccggcaagggagagaaacggtggggtggcggcggagatgggttgcaataggtccctagctacaggacacgcgggtcaccgcgggggacgaggacggggagtggagcactgtccccgcccccgcccctgccatccccgatggtgatgagttttgcaccactagatttcctgtggatggcagatatcatccatcctcatcccttaggccttgtttggttaatcccctttagagagggattggaggggatttatttcacacctattatggtgtggaattattccccctcaatcccctccaaaccgaataaggccttaatgtgtgatttcaccgtggggaatcgatgatcgtccccattgccatctctaatcgtgcggcccatccggcatgcctttgtttcaggctgtgccctgcctcgtgttgacaagtagggttgatgggaaggcggcggtgacggaggcagccctgcgccggcggcggagctccacatccttcgatctgaggtggggaggagcggcgaacttgcagtcggatccagtgtcgccgccaagctccccgctatggtcgccgcccttgagttccgcgagctcctccacactgacgacctcctgctccccggctccccatcgcctgcccctgctcgcccgccgcgacctcttgcttcatgccactggctcgacaacacttgcaagctccaccaccatgaccttcgccatcgctgtcgagcgacacgaggtccttcgaacctcctcgctaaggtccaagtcctccgatttgcccgcgatgcagaaatgacaccagtcgacgtcgcttgctgctccccgcgctagcgaaccccgcagcgtggccgtcaccgttgagggccattagctccatcgcgccgaaaccacactgttgtcgtcgtctccatgcgacgtggggcaaaggtcgatgcggcgccggtgcccatgcgaccggagggacgactggcgctcgcagccaagtccgtcgccgccgccgtaggtcccattgccggcgtgcggagggggagagggaggacaagggggagagagggctggcgccggctctgacgcacacatcgcccatgtggtgagggagggacgacagcgctctcgcggcgtggggaagagatgggacgggcagggaaggaagtagatggatagagtttggggataggagggaaggggatagatttggttgtttttcggaaaaaaaaaaaccttgtgtttttcatgtttacagtgctgcccctaagagcagaattttctcttcttcgtgtcgcatttctttaaaagctaggggtgtactgtataaaacggaacatggtgtcagtcggtggaagtacgtgcgcgctattccgtccaaacacgaggagtctttttttttataaacaccaccatgcgtcatttactacaagaaaggttctgcgtgacacacatgcaggacgagactggcacaaccggtggaggaaacggcgcaaaaaaaatcatgtcacccaatcgaggagcttctgcacctgcaaattacataggacaactactgaggagccaaaaaaaatccaaaaagggagaaaaagggtagctctaggggtttaatatattaatgattaatgatgtaggtgaagtattttctctccttttcttaataaatttatatgcaagttacttacaatttaactcaatatatacatttccgtgcctaaccaaaataaatattctataatgattttgaggacttcacagagagagagagtgtgtgtgtgtgttttcttttttaaaaaaaacctgtcgcgtgaatgggactgcattatgtcgctgtttatgtgttgggtttggtaccacggaccacggcgatggctgattggatatgcatttagggcatacaataggaaatgtatatatggaaatagatatctactgtacttgattgtgttgtcggtagttaggacttagtacagtgtttagttgttcacttgtttgcatgaatttcacataaaaccataaaaaagaacgtatagagttacggaattgctataaatatggcgtcatatttatagcaattagtttacagtcgatcttttaccgtacaattagttcagcgatttgtgcatgtccaaaactgctaacaccatcattactactattgttgatactatacatcgatatacactatccaggacatactaatatctaatcattacggagtaaaatccaagatgccatgcacagatggtaggcaaaaggacaagaaaaggagaagccaaggaagatagagagctcacgtcaatgtctgtttttaaactgcagttacatatgtaattatagtgtgattctattgtagttacatatcacttacacaccacttacatatgtaattaatataattttaggatttacatatataattttagaacttacatatataattttgggacttacattgtaaatacactaaaattacatattagaaatttataatataaatacatgccggctatttttttataaaaaaatatggcgtcataaatatagctactccctagagtatatggagagtctataattataatgtgtagttgcacttgaacagtgcctagaagcactctgccagtcatacttgtcactgcagcacccttttgtccatctaacctagcatgctttttgttggaggattttggtgagttggactgggccattctatttttgtaagtgtttggttgaaaaactccatgggttgagttagacccaaaagggaatactatgtatatatccaggttggcttgatccgtggaaaaattggtgaactgttttgacccacctcctttagcgcagtacacatgaggcgtatgcttgtgaaaaagaagaagatagtgaaaatacacgaaacgagatgagacgttatcgcatcattaagtattaattattttaaacttaaaaaatagattaatatgattttttaaaacaactttcttatagatcattcttttataaaaacacacatacttcgggaagcatgtgcttagaaaacgtgaaaattttctactccgtgtggtgctggtgaacttgcttgagctttttcgtcgacacataaaatgatacaggagattagagtatgattaatcaactattaattattataaacttaaaaatagatttgtttgtttctttaatgaaatatatgatatttatttatttttaaaaaaacaccatttagcaatttagaaagcgtgctaacaaaaacaagaaactttcaatttggagttgataaaaggaacgcagactaaatgaatgatgacaatcaatttcgcatcctccagaagtatctaaagtatcaaacctcatgacctcatcagacaaaatggtcaagcctgggttagcttgagccttagaaaatcttattggcatgagtataccaaattagtataacaatattcacaacaatttcagatcacattctctatcgaatatcgatcccataaagattgcatcccacattcctttgaattctagtgaataacaagggaccaaaagcatgccacattcctctgaattctagtgaatagcagaacaccaaagaagcaatgctggcataaacaaatcttccggttctcttctctctccttttttttaataaatccccaaagggacacgaatagcttgtttgttagtccaaaatatttgtgccaattgtttgttttcactctgccttttagcgcctaggcaacttttctattttatcaatagagtatcagggaaagcttcttcaacttcagccaagttattaccaattatttctgccccaagggcatcaatctcatagcgcacctcctccatgtgctcgtttatgctggtcactgcctcttgaacaccttgtatggcctctttaagagcaccatcatactcagcatctgcctctgcatcctccgtgccagcagcctcggttatctctttgacatgcacacagacatgttgagccatattgcttgacctgcaatctgcatggttcaccaggcgttccgaaggacgaccagctttcttcaacacctgaattcttgccgtctgaaataatcagagattaaaaaaaaaactttgttcagtgaattgagaaatttccaagctgagacctacagatagattgtgcgtcagatcaaaccaaaacgtgattagccacaacagctagaaacaatcgtttgtcaggcttctggactagttttgagtttaattttatttagcagcaatgccatgcgttgattaatgaaattacttttccctcacaaagaaaagatgatgaaaacaaaagtatatcagaaaatagttcaatattaaatcaaggtattgctgctagttgctagacaagcaattcaaacaccctaagtaaacataacaggctaagtgcaaaatatttcaggggtcatcagtaagagagtaataggtgtagttttcaagcaggaatatgccatcctattgcaattgatactatcatgctcaaacagattagtcaatgtgacattaacctttgaatgcatatcaattactattattgctaaatcagggaaacaagtttatattacttcctctgtttcataatataagtcattttgactttttttttccagacaaacttctttaagtttggcaaaatttatagaaaaaaatattagcaacatttacaacaccgaattagtttcattgaaaccaacatttaatatattttgataaaatgagtgttttgtatcgaaaatattgctatatttttctataaactttgtcaaacttaaaaaagtttaactaggaaaaaagtcaaaacgacttataatatgaaacagagggagtattttatttgatcttagagcaaagtataactccaaaccagtcagcactttgaattcaggaatcgggatgcatgttaaatttgttaattgaaataggttgagttgctatttgtaaaacggtcagaacgaaaccataaaaacaaaaaatttagttctttgtgtgattaatcattccgacatagtagcttccttacgccacaattaaaagcaaaaaatatagtaggtaaccaagtaatttggtttttgaaaggaaatcagttttcagttgaaaataaagcataaggctgaaccatgtcaaatttcataacaacacaatggagtcatagacaggttaccagatgcaacttctctttctcgtgtgcctgcacatccttcagtaagttggcaagatcgccacgacaaatttctggcgttgataggagggctaccatttcgagaacctatagggaataatatgaaatatataactttgtatgataaaaggagatgagtcaggtgataactgcctaacttgtttcgagcaatcattgaactccgccgtaacactcgcgcatagttgttgaaaagctaattcacctccattagccatgtattcagaaaaacccctgcataactttcaaaatgagataacaaaaagaatggtcggaaccctcaaatatgacgatgctgttttaaataaaagatttccatcacagtatccaaaataaaccatgtatgcgatacaattagatttgagcgttgattttcagcacttcaagattgtatgcttgtgagttgtgagttctactttttaagttacacttcaacatgaaacagctttgctggctcaatgtagtgattatgattttaattctgtacaaaagatgagttaggttaaccagcataccaacattatttaattgctgttagcaaatacgacagtcagtgacatctttccatatgtgatatcgtattttctgttcaacatgccacttgaagcatataatgagttcagtaataccgacgcattcctttcgtttcgttgccataatttcagttattttagcgttgcataagggtgatactacttccgtgctccaggaaaaggttttatcattttgttaataacttaatatctccaatagctcatcttttctagtttaaaaacttacatacccaaaatggcttgctcttcatattcaattcatcgcctcaaaaatcacattcagagtgcaatttatcactaaaaccacaaagatcctgcctacaggaatcacatacacagcactctaacctcggcttaaaagttaccagggcaatgaaaaatccccccctgattctaaaagttactccaatcctagggttttaggggcgggactgcacaagttgcacggacccagcaagcagcgagatagtataatatataccttcggagcgtggagtacgcctcggcgcggcgctgctgcacggcgaggaacccgcggagcactccggccaccctcgcgttgctccgcccgccgccgccgcagtccatggcgtcgctgccctcagcggcagccgccgccggagggcactccgccatcgggtcgccgctggcgctggcgctgacgctagcaggatccatctccgccacgctacggccgcctccgatctctccccccttgatctcagctcttcacgaggtgagcgagatttttgcgtgctccggccggcgtcccgccctcccctccccttcccttctctctctctctatctttttccggcccagagatcgggtcggttcaggagttttttttaaaaaaaaaatcagttaagttaggaatcgaagagcaaaccgaatggacatttaacttgccacttttaacatgtgctaattaattatttatacttattgtatatgacatgtgggtccttatatgtatatgatatgtgggttcagtgacaattcttttatcaccactaatagataggagtgacaaataattaattattccgaatcatttctctcggttgttaaaaaagaaaaatcagtctctctccttgttaagccgtttttcttcttgttatgaatttcgcgtgtcaaatagtataagattggggatttatttataggagtataaattactactgtacttgtaagtttcactagcctggtccagacttaggctgtgttctttcctggttgatctgggtgattgtgagtgagttttgtttcgttttccgcgtgcacgcttcccgaactactatgttttttttaaaaaaaattatataggaaagttgctttaaaaaatcatattaatccatttttgaagtttaaaatacttaatagttaattaatcatcatgtgttaatggctcacctcgttttgtttttgtgtaacctaccaatctcctctatctcttctcctcaaacacacccttagactattaaactttatcacactttatactttatgacacagttgcttatttcgttgtcacgtggtggcttgccacagtttttttatccttcgacctgcatacacattcttgtgcaaaaatttaccaaatctatattcactaaggccttgtttagttgaaaaaaaaaacttttcacccatcacattaaatgtttagacacatgcatagaatattaaatgtggaaaaaaactaattatacagtttgcgtgtaaattgcgagaaaaatcttttgagcctaattgcgccatgatttgacaatgtggtgctacaataaacatttgttaatgacaaattaattaggtttaataaattcgtctcacaatttcttaacgaaatctataatttgttttgttattagactatatttaatacttcaaatgtatgtccgtatatctaatgtgacaactattcccaactaaataaggcctaatttgttagccacaccatagtttagcatagagaatgaagcaggggcaaaatttgctacgggttaggtcatgtttaatgtaggttaatgagtggattattcaaatgaattatgtatttgattatagaataaattaaatattttaagaaataaatatagtaaatactccctcctctatataatccagatttataatatataatccagatttataatggtaggttatatctattttaagacggaggatttgtactgatgggttatctatttttgagactattggagtagctcaaaacaaatactagtctaagtaactcagagcgtgaaataaataatccatttcaataatccaataaatgttcggtttcatatgcaaaacgatcacaacaaaaatttaaacgttaattttaggccctttttttggggtgtgggtgcttcgtgttagacttttaaccgcttgtaagacatatatatatatatataagtgctaaaattattcttcgttgctctttcattttcttccccgcagcttatcgccttcactcaaccaatcagagccttgttccgtgaggatcgaaatgagggtataacagaaattgcttcatctgctggtcctgaacatctcacgattagcaaaatgaatccttgttacattggccagtcccccaaatgataatccagcggtatacagttcgcaagtgccatggaaaaaatggctgcgtcgctgccgttgccggcttgccgcaacaacgtcgcaactcgttcacccgtccgatggaacaccggttcctcgttcctttctgggcggatgtcccatgtcgcttcttcatccatgcaccgtttggctgaccccattcctaaagaaagatgggatggatatgcatatgctggagtagattatctggcaaaccagcataaaagcaaacacaagatggaatttgcgtgacaaaacaatgtcctcagtattataacttgacctggttaaataattggaatcggcttaagtaaacaagcatgagctacatgagtttctgtcgttaaggctagataaccaagctaagataacaagctattagacaactctactatcccacatggtacaatgtcatgaatgccatgaactctaattcagtgcattatgatgcatccatgcaaaagagggaagcaatttctatttgcttgcaacagcaatgaggtgcttagcaggcaaatgttttgcctcgctgaatttcaccaatagaagccatattactggatttaacttcaaactattacagctagaaagataagtgataacagcactgagtgacagatcactaatctgaaaatgtcttcaagaataagagaaaagaaaaaagaatggaaggccggctagttaggagtttaacagaataaacactaatcgatgttagaatagaacacaggtgcaacagttcaacacaaagggcggcatgcatggcaacatagccaactaccatagcacagcagtgcaatttatgaaggaaaagcacagtttcatctgttagaaagttctaaaatgcaatatattcctgtagtcaagattacctgtatgcagaacaataatgacagactgggttaaaatactaaggttactctacacaatgaaaaagatcaactctttgtttagaaacatgtctgcatgacactcccatgcgggttaggataaaataagtttcgcaaatatgtaaaaaataatagaaaaggagctctgtacataaagcatgtgaaaaggtaacctgcattgggttcacaggtcaatttaaataatttaaaaggtaacctgatcttatgctgaaaatctgcacttatttagccaaaacgatgtagaaaagatccatggttctttaaatccacacaagctcttttacaataaggtcacaagccctgatggccattcgaaaatctaaatagttgtacatactgcttaattttgaaagataggattgaggaaacaaagttcttgtgaaaactttgaccactagagtaatcgatttgccagaaacagcttaaaacagcaagtttataagtgcgaagcaggaacacgtagaatcatctggccacagtaaaatagttataagcatcctgtaaaatagcaaggtgaataaaaataagtgaaatgggtctgcaaaaagttaaaatttgtatgtacaaaaaataagtttctgaaaaaatgatatacatgtactatggtgatttactagcagttaaaaaaacgttatggaagggttatgaaataactaatatgttacaacctagctgaacagttgcactgcatacgcatcaaaataaggttaggagcaaactgagtcacatgagaatgacaaggcacaacatgaaccatgcatgattgcgaataattgtgaatgactatggatagtgcatgtaaatatctttggatacttttggtaaatccgagagccagacatgataaagaaataaaccagaaatcaagcatcatttaactaaaaaagagaccagaaaagcacgtgatttcacctctagcaaccagcctacgcatatctcctattattatttagctgtacttcaatttcttttgattaatagaatatcaagcttcccaaatctttcccaagctatgcctaatatagagtatgtgcaatagaattattggaaacgattcaactaacactaacataaggcattaactccctgaaattttgattgcaaaatgcagacttcagattcttatggcaacaattgtggcattaaagaaattaacacaagatggcatgttatcctaactttcattgtgcatgcgaagcatctacctaaatagcaataccataaaaagagtaccttggctcatgcaaaagcaaactcagtttaaaagcaaccaagaagagataaataatatagcgactcataaagggaaagctatttctttaccgatgtaaaaaatgcaagatcaatttcttggcagaaaacacatgtgaaaactatttgtaggttcctatggttgggacacaatcacctatccggatcttacctaatgacccatgtaatttcttcctgggcctcctggtggagtactgccatacccaccaccacccccatagccgcccaaataaccaccagcaccaggcatcccaggcaaaccactactacccagtcctgcagaagcccctgggttaggcaaccctgaaccatttgcaccaactcccaggatgttgttcagacccaaccctccaccctgggaggcaaggatagctgtcaaggcctgccccagagcaggattcacccctgggccaccagctacacctggcaatgaagtcaaactggatactggagatggcatcacatggcccccaacagcagcaccaggcaaagaatgactatgagctccataaccaccagcgcctttcctcccgcctgaagtgccagcaccatacaaacccccaagtcctccacctttgttgggctttggtccatcaattgccttctggcagtgcagcacaaccccctcgaattgcttgtgtggctcctgaagcgctttcttagcactatcgagggtcttgtagacaaatagagcaaagcccttcggcttcccggtaaccttatcgagcccaagaggaccctcctcaatctcaccatactttgaaaagaactgcagcagtttctgcgggtctatgtctgcgccgacattgctgacaaaaattttccgctgcgtgtactccgacactggcggcaatgccagctgcgctggggctggggctaccgctggggcagggttagtggccatgccgcccggcggcacaggaccaacagaggcgagctggcaggccgtggtgcggttgccaatcttcttctggggctcacggagcgccgcgcgggcgccggaccggcggctgaagaggatgaaaccgtagcccttgcacttgcccgtggcgcggtcggtgacgaccctgaggtcctcgatctcgccgtaggcgctgaacgcctcggtgagggtctccgcggtggcgtcccagccgaggccgtggacgaagatcttccgcagcgccgggtcggcgtcggccgcgcggtggacggccgtgagcacgtcctcgtggctgagcgccgcggcgctgagcagctcaacgagctggtccttggggaacgaattcagcagcgcctggatcgagtcggcgtccctctccgccgcctcctcctcctcctccccctccccctccccatcctcgtcctcgtcgacctccacctcctcctccacctcgacctcctccacctcctcttcctcgccaccgccagcctcacgggacatcatcctctcccccgcgccctcgctggataggcccaggggctgcgacgagggggccgggtcctcggctagggcttcgggctgggaggagggctcggcgacggcggcggcggcggcggcggcggctgcggctgctgcggccctggcggctgcggacctagcggcggcgggggatttggaatcgagcttccgcttcttgcccatggcgacggcgagcgcgaggcgtgggggaaccttggggctagggtttcgacggctgtggaggggaggggaaaggggggctgtgtggtgtggagtctggggctcgcgactcgcgaggccacgcggtcgtggggctttcttggttaacggcgacggaacgggggctacacaccgtttcccacttccgtgtgtggccagtttcggtcgtttttcccaagacaacaatgccacaatgatagatccaaactataaacagtacttgtactattagaacgtaagttcatcttttctttttctcaatatataaacttgactttttgagagcggtagatatcactatacttttgtattgttaattttgtctataatttttaacaatcatctgccttgaaccattttttttttgaaaaaatatatatacaagagaatatccgaatccattttcaagaatgaaggtgttcaacaatcatagcaatataacaatattaacaatagaatatacgcgagtcgaaaaattgtgcttctttagatttatcgaacctattagtgtacatatttatctttctaaattagcgtggaatcattgtaataattaagtacggctttgtgcttcttatttgcagcggccggtttatccattatgtaaaaaacttccgtgcacttaaaatagaaaacaaaaatacaaaatatccagcaaagttgattttgccccaacgtatgtacagcagtgcgaagaacgttgaaaatcttattgtcaagaagtgtccaatccaacaagagatgtaaagattaaaagtaaaccgtataaaatatcagtaataatatgggtttagctttacgctattttttctataatggaaataattccctagcttggtgatcttttttttatttagattttcctttatttctattaacttaaatggagatatccaagacgtcagacaaaagcatagatattggttaatagaaaccattggagtggagataacgaaatcctaatttaagtttataaaaaaacaatcttccaagctccatttaacacattccatgctgtagtacaccagcaacgatttcaggcggtgaacaagctggaagctaagagcaatagttcgtctaacatgtcagtttggggatctagcttcaaaggcttcattggtcaaagtctgaggcaccaaaaaaagagtaatctggatcagcagatgagccaagcaaagggatgtactctgatcctctcacatgaacactgaagcaagctgcaaaatacataaacactgtcaaacgtctacaaacatctagcgatatagtatcccagacaactgcatatgtcaaaaaggtaatactgtactaatcaactgcggacacatgaaaaaaaatgatgctagcccatatgtaaatattttcacaaatgagtggaacccgattcacacgatacactgaaataatttattttccagctgtaatatcaagtttgtgaattttgtccatactaaaacattaaacaaggtagaacaattgctatagttcaatacggtaagccgaggcaaaatcaactactcaactacagtctaacatgcaccccccccaccccccctgcaatcattcacgaggttaagaaatgactgacgaaagtcatgttaagcattttctattttgaactagaacatttggattccatcaatccatcacattaaacacttaaacttgactagtacatgcttccaagttccaaaaaaacttaaaatcaacttagttagctagttcaagtgggggcgtccttagaaaacaaaggattcaacaaaatgtcagagttatgaggttctccgtgcatagagaactaagccggttaaaaacgggattcgatatgtcagttgtaccaaaaagaacactagatcttggataaaggaacacgtcatcaaacaaaagtgtgccattttaagaatcgggaaaatatagttagaatttagcagatatagaaaccacatctttggttggcacaaaaattattaacagtcatttactagtataaatgagcattagaaatgaagatacctctgaactaaggaaagtgcatgttaactactaatctatatagcatgttaaagagtacaagtctatataacatgtctgtatatagtttcacttaaggaaaagataatatgtttcatctattattcatgttgtgataagtattgatacgtccaaggattttatgtattttcaaataaaggtcataaatgaggactctggtataaagttgatattgttgggcatcaaagaagtgataccattctcaattttcactacactttgcagcatagtctccatcttcttcttcatctcactattgtcatccatcagaggcaccacaagggtcagctccctgtatatatcacgtacaaatgcacaaatgtttttggcatattcaacttctccatcagatatacggccaattgcaagcctcatcagctctcctgacagatcggcaacctaacatattgacagcacagaaataccctcaacaacttcaagcagacaaagaaaaggatatttagcagaactaaattttggacagttgcatttacccctaaaacatagtcgagtacatttatctgtaagggctcaacagatttgtcacccagctctagcaaagaatcattgatttcagcaagacttaataaagtgccagtcttgcaaaatctgcagaatgttgcagcttcaacatattcttgtacctgaaatagtcatgacaaacatattggatccgttacaaacctagaacagaaccgatgtaaaggaacaacatttatactaacaccaaaggtataggcccttctgagcttccagaagtcggtcccttgcagttcttttaccaacttcccaatgtattggttaaccacaacagtgagatcattttcagcttttgaaagaacctcttccttgttattcttacttatcctgaaacaaatcagttcagttataaattaagtatagcagcaaataaaattgcaaagcagtataacagagagtaggtcaatttggttattaactatgaaatcatgaaagagacttttgagatgagtatgtatagttctccaatgttgtcagatgaatggacaattttgacactaaataataacttgaatgtatcatttgcacatacagcttttatcaattgccaaaggttgagactagcaataacttctcacaacgtgccacgagatgaaaataagttcatctaaaatcttgtttctgatcgccttcgatttggaggaaacaaatactccataaagcttagctcatggagagttcctgattgtccgtacagtgagagtaataagttttgcaaaaccagaatgacgtttttacactaagaataaactagaatttactggttcattgacattccacaataattttagtatcacatggcatactaattcataacaaactaaggtaatgaatgatacaaggggccctaagaatcacattatctgtcaaggaaacatacatggataattctcttcctttatttaatgaagcaatgtaatgccactagcacaattgtttgcttgtcaaattacctgtgaacctgaaagatggcctttttgctgttcattgtcaaatcccgacttgctttcacaagcctttcccttttatcattctacatatggaaaactgatgagataatataaaaatattgctaacttaagaaagatacagcctgctactaccataactgctttcagcatgtacaaggggaaaaaaatgttcaactgaagaattacacactaagagtagcagtgccgtccatatcacacactaaaccaaatatacatatcttaagcagagctacctagcatctagttcaagcagctttgaggatcagtttggtacaaatgtccaataacaataagttttgcagtgtccacaccccgtgaggtcagtaatctttacttgtcaaaacacttctcctaccctacaccactaaccggcactccaaagtgatcgacaaggctatctcgtcaataatgcactcattagcagaagccagtgatcgcataggctcaacgggaatttctccgagcacctggcccgcacaagatcttggcaccagatcacaccaacagtttccccaaaaaaaaaatcatgcctctactctactctaatatacgacagcgtcctctttgagcgcgccgctgcaggggggaggaaatagctcgagaagagagaacgtcgtcgcacgccaaggaggcgagggacgagcgctctaacgcgtgcgtacaacgtaccagggtgttgaggtactcggcgtgcttggcgaactcggccttcatcgcggagcaccccgccgaggccgaatgcgccgtcgccgccgcgtcggtggccatcgtcctggacctcttgggcgccgagccggcggtggaggctgcagaggagggggagcagagagggtgagaccgcggagaggggagaagaccgaggaggagagggaggggagtgtccagagcgtacgcggaggagggctcgcgcggagggttttggcggggtgggagtgggactggggcgccgccatggacgtggtgggggtggtggtgatgggaggaagaagggagggggcggtgacgccgcgcagggagaggaggcggcggtggcagccgcgcaggggcaacatctgtcagattgtgggccccgccccgtctcggcacttccgtttcctttgcctcacttggtgcgatttgtatttgtaaggcataatatgcttttttttattattgtttttttagaaaactaaaaaaaaattcgaataaggccttttttaatggtggtgtttgaatcagggactaaactttggtccctgtcatatggatgaatttggagtattaaacatagactacttataaaactaattacataaatgagagttaattcacgtgataaattttttaagcctaattaatccataattagcgcatgtttattgtagcatcacataggctaatcatggattaattaggctcaatagattcgtctctcgaattagtccagggttatagaatgggttttactaatagtctacgtttaatatttataattagtgtccaaacatccgatgtgatagggactaaaaagttttagtgccatctaaacagggtcttagttctcaaaaaaaattccaaaaaacgtcacatcgaatctttggacacatgcatagagcattaaatatagataaaatgaaaaattaattgcacagtttgcatggaaatcgcgagacgaatcttttaagcctaattagtccatgattagccataagtactacattaacccacatgtgctaatgatggattaattaggcttaataaattcgtctcgcagtttccaggcgggttatgaaattagttttttcattcgtgtccaaaaaccctcttccgacatctggtcaaacgtccgatgtgacacccaaaaattttctttacgcgaactaaacaaggcctatgattaagttcaggagaacccacccaacccaagtacatcgacgaagagatacacggaaagtattgaaccgtcttatcataaaagaggctaactgaattaaagaaacaaactttctaatgaaactgaagagtagcataggagcagatcgatagggtattgtgtcatttgtcgcaatgattgcgtccttaggccttcgttaacgtgcaatccgcttgacatacaggtaatttccttctgttgcctccacagaatgtacacgcattagaggtttgttgttgatgttgcgtggtgtggtgttcatcgttaaatctgaagagcactaatcgcaaccgcttggaccaagggtgcacaagcagtctatactcaacccgaacaatgaaccctgcatggttaccgttgcatagaaaacgtcgagaaagatgttccctaaatccaaccaaccttaatcaagagagaacttggacggtggcagtagaacatctgtcttgctagatcaagctggagtacatcatatgaatattgagagaaattaacctttggaaaccttaaaccattaaatgctataacatgtagacttggttcaccacattcagttgaacaagcatgaaatccacaccaacgtcatagtcttcgttaagcaatacctatctactcacctactccatcttgaccaccgaccatcatccgtagcccatccatcaatcgagggagctagccaatgagcagcaggtttggatcaagcaactgttggttcgggcaaccccaccaccagtggaagggcgcagaagtctccagccaaccccatccaaatcaccgaaaagaggaacctgaacctagcattgaggcatcggatccatcggaatatggctgcaccgaaacaacagcttcaagcctccatgatgatttagccaataaagtcgatgaagggactatccaccatggtctagcatgcatgacacttgagatgtcctgcaacacataccgccaccatgggtcctaccaccttcagcaaacgctatggacatgacaccaaaacaggattaaccttaaaacacaagaggacttgacatggaactcgaacactaaactatactacacttattaaagaagaaggcccgacccctcgtttgaccatcaccgacggaaagctgtcggaagcaaggtggaaaaggggtcatggaagggttttactgtagctctctctctctcttcacctttgatgttctccagaagcctcccttgtaaggtaggctgtttaaatacaagaatatgggtgtggaaaaagacacaagatttatggaatatataatattgtttatggagtttttatattgaatattgttcagaactatattaactcatctgtactacctgtctaactccgtccatactatattaactcattaatactacctgtctaactccgtccatacaccagtgtatagctgtatagccataagtaactattaattatcccacaaaatgtaacgttgagacaattttctgtataacagcaatagacttatgccactttttttttataaaaaaattgtagcattataagcacccaaggaactatgtataatttacttaacaatataaatattttgcaaagatacacaaattatgagttaaaaaaacatgtgcttttgcgattttgctatatatttgtcgacaaattttctcccaaaaatttaacagatgtaattacagtacaatcgtagtgtaattacactgtaacttgcatgtaattacactgtaactatagtgtaacttatatgtaacttgcaaaaatctctacgtgatatgttatttcggtaaaatagaagttgtgggaacaaatccttacacatatgtgtgtgccgtgattttatttttcttcctcaccaaaacaaatcttttaatagatctaaagattcaaaattacatgaaacttatatacaagttacaccgtagttacgtgcaagttacagtataattacatataagttacagtgtaattacactataattgtactataattacatctttcaaatttttgaaagaaaatttatcaataaatgtataggtggtcccgtgcttttgtattgtgtttgcgtgaaaaaaggacacggtaaaacaagacgttggaaacccagtcacccacggccacagcccaacaagcccacacaggccacaggagggtccaaccgtccaagggacagacgacgacgagcacgagccccagcgaaaacaccgcggcagcaccgcagcagccgccacccgtgcatccctacccgctgctggccccacccgtcatatacaccctcatccagccggtatttcctccccacggtcggggccccacatgccagccagcgctttgcctttcccacatcccctcctaaacacaaaagtccccataggtcatctccccctcctctctctcttacctcacgcgctccacgcacgcagagtcgagacgcgcacgccaccctgtcgctctctctctctcgctctcgccctcgcctctcccctccccatcaccacccaaaaccctagttacccccaccctctcaaaaccctaaccccacctcaccaccctccccggcggcggcggcccttgtggctgtgcacccatcactccaccggataagctctagctatctatcatccaaagcagcttactagtctgtgctctctctgtgtcggaaggcggcggcggcggcgcggcggctggtggtggtgggcgggggaggcggcggtagagcggtggtatctgggcgttttgtggcgggggcggctcgggcgtcggcgatggaggagccgaatgtgggcggaggggcggcggcggtggtggcgcctgagggggcggatccggctggcggcggcggcggtggaccgggcgcccccgcgtctccctggaggaagaccacgccgccgcctgtggcgggtgaggcggtggtcatgggggccaagtcgtggcccgcgctggaggaggctaggcagaaggtcgccgccgcggaggccgcggcgaggccgggggcgggcaatgctggcggcggtggcgaaccagcgaagggggcgcaggcgcagcagccgtcccctcccccgccacagtcgcaggtataatctggtgctcgtggccagccatatgcttgtttgctatggctttctatttttgttagtttagttcttaaggaaattttagtgtatggtaaagtttgctcacttcggtagatgtttatagtatttgtctctctatacgaaataggtataggttgggtctgggtatgcattggtctactggtgagtagtaaagtaaagcttggctgtttttggaaccacgtatttcaggttcaactttctcgagtgtgttcaactgtccatgttagtttttttgcttgacaagaccgcttgtccgcttatgttcaaagtaggttacacatgcattttgcattatgatgtaagtttgctatttgtcttagaagtaatgttctctctcaagtcaaccatgccccgacagcaagtggttgatagattataggtgtcatattttgatacgtaggatttgtgcattttttgtaacctattatcagattttgtttccacacaagttgtgatccaattggatctttgtatgattttgtccactgtgtctgtagccatcacattattttaggtattgctgtttggtcgcaaacttgcaatcattccaatgctatctagacggttattcaatcttaactgaacatgccttttatagctatctcctttgtaagactgctgggatggttacctaactgactcccatggaagcactttcttgggtgctatggcaatgcagtacatattgaacttatttatcatcgtgggggtaaatataagccttgcatttgtggcagttttgtaacgatcatgatatacatttatcattgttaagatgcatgggtggtctatcccatgaaactgatttgttccaaggtccactcggtaagatcaggaaaacatcattcttatttggtttggttccttgccttccctgtaaaccaaatagttgtcaaacaggtgttttgtgtttcacatgcagactaaggataattgtatgcttttcatcaaatggtttaaagtcccttaggagttattttttttattttaatgttttatgagctgaatatacattattttgtcactgttctacacaagcattttttttgctgatcatataagcattcttcctgttctgatttagtctgatgcaaagggggaaacacttgtttgtaggcacctaatcgcacgcacaagtttgatggccatggaaatcccaacaagaataatcaagcataccatagaaatggccccaagagacgttctcctgctgcgaatgggactccatcttatcctgccgcgatgccatatcaccaacatccagggcaacctttttactaccctgttattcccagtccagtgatactacatgaatatccttacccaccttttgctgttccggttccaagtcatgacccgcatgctggaaaatctggatatgagaattctatgcctgcttatgttccagtagatcaagctggtggcaatgaaggtaaccggccagtgcctccacaaccaaggggagaccttcatgcttggaggcctcctgttggtgcaagaccccagcctggccttgaaggccgtggccattttaatcacaattggcagaatccccagatgttcggtaccagggaaaacacaagtgtaccacaaggtgctgggccaagagctttcatgagaccaatggcacatctgcctcacactctgggatacataaatggtccaccataccctggtaatgctatgctcactgtaatggcatctcctttcatgcttggtattagagctttttttgcaccaatattaaaaaatgtgttgacccagggccaatgcctcccatgtattattacatgcctgctgtacccatggagccgatgagaggtccaccacgttttgtccaaaaccaaccacctcctcatcctgttttatctcctgaattaagagctaaaatactgactcaagtggagtactattttaggtaaattcttatttcttctattgagttgggtagctattttatattgggttaagtctgatttactccccctcaattatcacaaaagtacgatctaccccccttaactctaaacaagatattttacgccctcaaacttttaaaactgtacgaattaccccctttgcactatattgggtagtttttgcataagtggtgtctatgtggcaacaaaatcagtggaccttttttttaagacctatggacccacctcccattctcctttgtctgtgttctctctctgtgttcttcctacacgagcaagagcaaccatccaaatcggagatctctcaaaaccacatccggcatggcagcaacagttccatttctgtgactcgcctgatgcaatcaataactggctttgcttgaagggatgcctcccactgaatccaaggccatatgtcatcgaagtatccagctgcatatgactgattacttcctgattgatctctctgttgagctatgatgcacacctagatggagctgctgcacatggttggagctcgtcaggtgtccttttcctgaaagttcgcgaggagatcgccagcagcttgaatgggcctggctgtggatagatcggggaaatcactagcagcttgggctccgctgtcgctcccgcctcataccagtctgccactgttgtctccatcgtgctgctacagtggagataggggcagggagatgcgactcggttgctgctcagaaccagatgccatcgcgcctaaagtccaaaggttgcaggagggagaggggagagaaataagaggggatgaagaaggtagggagaggctgacaagtgggtctgattccacgttggatgccatgtaggcttaaaaccaccatatggttagcagaagggggtaaatcgtctggcttaaatagtactttttccccaaggaagcatgatggttgatgactagaaaacaggcatttgagcatttacactacctgatagagttttcatgcaatttcagaaagcagtgacaagttagtcccattgtatgtctattgaactttggaatatatgaactacaatttgattttgtcaatttcattgttgttatcctatatgcaaacactgacatgctgcactactaaaactattttgtatgtatgtgatgcacatgggttatcatatgcacttttatcatttgtcattcataaggtcttttatttacccattatgatgcttttcagtgatagtaatctggatcatgataattttcttaaatctttaatggacgaacatggctgggttccaatttccaaagttgcagactcaatcgggtatgtttttctcagtacttaaacttttgctatttcacctttatattatgccatataactactctgctagtttggcttgtttagttgttttgcagcttaagaaaattatcaaggatatacatctaacaactctgttattgcttggttcatttgcagcttaagaaaatgaccacggatatacaactgattgtagaagcattggcaaactcaagtcttttagaagttcaggtacgtttaatgcaactattgttgcttagatccctcttagaatgtcatctctcttatttatcttatgccttttgtataccaccaggatggtaatatgaggcggcgttctgactggtcaaagtgggtttccttgtctgggacatctcttccgagtccatcttcaaccagtatggataacactactggtgaatgtaataaggatgcttattctgaagatgaaaagaagcctcatcctcgcagcgtagattgtgttggtatgggggcttctgatgagccatcacatgatacactcagtagttcagtcacttcactgaataagggcttatcaaacattagtattgataataagcctaagagcatttctgcatgctctctgaactcacaaaaacatgaagctgcttttaggactggtgatgttaaagttcagaaagtaaacacaaagatcaaagtgcctgattctcagagggaaagaggtttctgtaatgatttcataagtgactctcctagcttcagcggcgatcaaagcacattcttgcttgatgaggaattagaattggagcatgcagagctttcacatgatctctattcgcacaaaaggtgaattttaactagtttatatatgatctgttacttcatttcatgagctataatttgttgttttattagtttgttattcatttggtagtttatagtgttgttattgtgatttgagattaaggcgattttggttgtaatttaggcttcctactctggccgaagtgattattattttatgtattcatttgtacagttttatgaaatgaaagatgtatccaggccacttatgtgagatgtgtgctatactgctacaccctccttttccatcagttaatgtcctattatttgatgaaactggatattcttctgtgttcacattttggagtgttaggcacatgtattctcagaagttcaaaaattgattatatattttttcatgtaatactgcatcttttatctactacactgcagattctagaaatggtatgcatataattgattctctttatgtttgtttaagcagggtcgatgatgaggaagatgatttttatgttgatgaccaagatgtgaacaggctaataatcgttacgcaggttagatttcaagtagtattttgtattgctagctctgtgtagtgatatacctccttcagtttgcagctccttgccttcgtaatctgaacacactgggcttgcctttttttatgcaccatgcaccaataagttttgggacagtttcaatggcgttggatgtttaactatttctaattttcatgttatgatgatttacctgatttcttattttttgtatttataatagtcttgctatttcccttgctacgaatcctatttgagcagattatgttcatgcttaataattacataacaaataaatagttgattgctaagtgaaattttatgctttatagggacatgccctttttatttcatgatttttgacttgattgagatacatttccatgtactgtgatataccattattttaacattatttgcttaataatgacttgaattttctcatctctaaatattatatgttaattagcaccttagcatccatcaagcaaattttgcagcacgctatcttgtatgctttcaccatgttaagcaagtcttgtcttggtaatagtgcaataaactcttgtcaactatctgcgttacaggacggacctcaagcattttcaaaagaggaaatatcaagaatcaatgaggggttatattactatgaggtaatattttagagcataaaaagaacaagattatcagtaattggggttgtatgtgcattttaggggccaatataatgttgacacagtgctgtgttgtttgggaactgccattcactccaacgcttgtatttattattttattttaacaattacatgctcaattttatgcaagtaaataagctttattttgggcatgcaattcaacccagtaggccagtatcctgttttatcatgaagtatccataaaattaagtaaaattcctgctcaatttaatacaattgtccaggctctaattcaggttttctgttttttagattatcatcccttttctttctcaagaattgcctgcatttgatacttgatacatattatagctttgagttatatgttagaaattagaaatgtcccagtagcatgaatctttccatgtatagtgctggatttttttttttggtatggctaatcaattctttgaatttttgaatcatttgtactaaactgagtgttgggaaaaaggtacgagacaagggttatcttggagctaaatcgaatttaag

SEQ ID NO: 65699 - DNA, 848 bp, Oryza sativa
atggacaaataatagagcctggagttaaaatgacacggcattgtcgtcttgccgttgcttttggaaggtttatcttaggaagtttcttcacctgtggtccggaggctggaaaccaagtcacggtcatattgcctttgtgagcttctctccatggaccatggtccttttcgaagtctctttcacttctctggtggcaatgcctttatttttgtcgtcggccgcacgttatatgtcagcacaaagtgccatattctcgttactggagatccggcgtactggcacgacgaggttttctcggtttgtgatgccttttgctgttgcagtaagggcctgttcggagaagtttccagctgcagcttctcccaaaatctctagctcacccaagcaatctagattgtcatccagattttaagaatctgtagttgtagaatccagaaaataaactagaactctagaactcagaagcttaaaaacccagctcatacagattctcagaaattggtcaccaactagaaaattcttaaaatcttaaactcccctaaatagggcctaaatcgtttcttaataagtactagtgccatgtgtctggggttggaaatggtaaaggaaattttcgattgacggagcacagtttccgtataaggggtattgttactcttttgttcccaaataaacactatgtttatttatggatagaggaaatatttcaaattcattaaaaaaaatcaacttctaagaacgagataaatgactattcagatttattctcgtaagttggttttcaggaatggaggatatgtacaagtttttcgattttttgtttgcaaaccgacataatggacgttgga

SEQ ID NO: 65700 - DNA, 13891 bp, Oryza sativa
  unsure (1)..(13891): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaaaagatggaaaatttataatggattttttttattaaaaaaagaagatggagaggaaggagttggaattgttcatttgtttgttagtactaaatgattctggcatggctttcaggtggaactttcttccggaaaagaggttgctgatattatccctaacattaatgaaattaaaaaatgtgatggtagaggagttattgttacgggaccagcacctgctggatctgattatgacttcttttcacgattcttctgcccaaaatttgggatagatgaggtatgccgattctttccacccaacaaccaagttttttatgcagacaatgtggcttgttaagttaaaaatggccattttagttccagaatatgtagatataatctcatatgtggtacactttttagtcattgcatgggtacagaaggattctctgctgtcacgatgttaccaatgttgcttgtctaaattcaaaattgttaaatcatcacaagctatttttcatcaatcagagacataaattgattacaccttgcatgattactacaatacttaactcctttcataaaagaaaacaatacttaactctatataatatggtgttttttatttgaagtctctacagttctggtttatgcgtagttttaatcttcctagttcctaccacactaggtgaaaaacattggcattgatgcagagatgactgatataatctctccaaagaatcagaacctcttaatacctcaaggtgagtcaaggggttatcgacaactagtaattaaaaaaacatcattttagatagacttgtgaagtgaccaaagtgtgaatttgactgagtactgaaatttattttggtcatgatttcttgtgacagttccataaacttgttatcatgcatttgatagttttatgacgattccctgtatggctgtatcgttccttgagtgttcagaaacttttggtataacttggcaagttaatctctatgccccttatcgaccaaaatttgaaacttctcgtagtatattttttagcacaggcttttaaaacactaacaactcggatatactcttacaggatcctgtgtgtggaagcgcacattgtgttctggcaccttactggggtggaaagctggggaaacaaaaacttacggcgtttcaggtattatccttttgctaccttcttgtgacaagtagggggtaaacaattgttgccaacattatacttttctgaaaaaaaaaagataagtacaaacggcacaataccatggtcgtcaggcttcgccaaggagtggaacattgtacttggagctggacggcgagaacaggagagtccggatccagggagaagctgtcactgtgatggccgggactctcttggcgtagcatctctctctgtcagagtgtctggcgatctgcttgctcttgtatgcttgagagttcagcggagaaattgttgttgttcgacgcgtaccgcgaacgattgtaattgatgttatatttgggaataaaaggatctgcaatgtttatgaagcaatctggatgcgggaactgcattgtctgaagaagcaagtgcgtatttaggttaagacttcagagcgaatcgtgatggtttttgagacggaatgaaaaagagtggagaactagtgaaagaaacgagtgaaggagaaaatcgatgacaaaatgacatgaaaaacatccaagaatcacttcgtatatttacaaatctgatctcaaaaagaacagtacacaacacatgcctcgttggcaaccaaaaaaaaggagaaaaatagagaaaaaaaactcaagaatagaattttctttttcttcttctccggcgagatggcggcgacggatgctctaaggccacatcacgtcgaccgcgatccgggacacggcggcgagatcctcgaacgactcctccttcttcttctcccccgctgcctcggccgccggccgctcgcacttggccaccgccgccgccgccgccggagcagccgccacgggccggaactcccggaggctgtgtccgctcatgtaccagtcagccgccattacgctggtgctctcgccgccgagcagctccgacagcagcagcacgatcgacgccatcgaccaaagctcaaaaaacctcacacaacaacgagatcgatccgagtggggggaaaagaaaaccaagcaagcaagaaattgcacacaactgttgggggattcggctgtagctacctccgattttgggtttggatggattgggaattctagctcaagtgggggttgctatatatcgcaccgcgactgcagcgcgcgcgggtacggtgggcgggcggcgggtggtattttggtgccgccatgaatagccgccggcttggttggtcaggcaggtcagctggtggcggcactgactgcggtttcgtctgtacgacgcatggggcaaggccagggtcggtcgccgctgggttttgggacggaaacctgcgggccggggtggggtggggtgggggtggggcacccgggaaaacggccgcgctttggctttgccgagacagctttattgtctgtgattagtttgtgcggcaaatttatttttaagtatatggacacatttaaagtattaaatttatactaataataaaataaaataaattatagatgtcgtatatatactgcaagtcgaatctattaggcctaattaatctatcattagtaaatgtttactgtagcgccatattataaaatcatggtgtaattaggctcaaaagattcgtctcgcgatttacatgtaaactgtgcaattgattttttttcgtctatatttaatactttatacatgtgttaaaatatttgacgtgacggaaaagttgaacgtttgaagaagaaaaaaaatctaaacacggccttagctgctggttttctcgatgaaaaaatgggcagtttgggcgtcaattttgccttttcggttggggacaggtcaggggggcctggaggtgcaggcgtacgtgctaacgtgcagctgctggtttatttacccgttgacggctgcgctgcggcgtgggcgtgtaccaacaaaagggacacgtctatacacagcacatggttaaacagagcgaccacctcatccgccgtgtgtcaacgagtaacccttcctaaaaatagcaatatattattctctcgtactatatctttttaaaactttttaatgatttatatttcctaaaccgtatagtatttttaagagctatttgcactattacacttcactcaaaatatataacaaataaaacaagtatagtgttgagtatatctaaacatatatcaattttaaagtaatttaattaaattatagaagtagcttagctctgtaatataaataactctttatagcactacaaattattatatcgtgaggctatttacagtaaatttacaagtaaaacgtacggacgattttcaaataaatacatatactttcttcattcaaagtgatctctatgttatttttaaaaatacatatataatttagcatcatgtacggagtaatttttcacgatcctagaagtaactacactgcttacaaaggtaactttgaaagaacagaagtaactttctatggtatttgaagtacctacactggtacagcctacagggaactaactcttaaaattagaaatatctctataagatattagaagtaactctactgctagagaaaagtatctttttatggtgtgcagaaataactacaatgctacaaggtcttcaaaatactagaaataactgtactgttggaagaaagtaactcattaggaagtaacaaaatttaaataattttaacatatttgatattagattcgttttgtcacatattttaagtacagtataatggttcaaacatattttaaaaataacatattgtctagaatatataagtaatgaaagattctataaaaaaatagtagtgttaattgacgtgataactggcggatggcatgcagttctctttgtctgacattggaatagactcgcttcttagatggtcacgtgttcgtaactcgactaccattaactaattggacggcttacgaaagggtaacgggataagggcacgtacagcgggtctttttgccccgtctttgtgatgccttttatgcaaaaaaaaccccccggttgagtcaagcgacgggagctgcgtcctctcgcgaggcgacggcgacgacccgtgctccgaggcggaagaggcaagctcagcaccgttgtacgagctcgtcgtcccgaggcgacggcgcggcaggatcccgcgcggagagaatctgcaaatgatcagaaaaggaaaatttaggaaataaattcagagcttgatcattggaggtatatactgggagctaaatattgatttgattgtggtcatggctgggaggtatacatcctgggagatatatacatcctgtgaggtcagttggagtgccgagaggtctcattcagtttcagtttctgaattaatgtgaatgtgatttgtaaatgcgaatgtgcacttcagtttctgttggaatgtgaatgtgcatgcttcagtttcagtttttgttggagtgccgagaggacttatttgcttatgtgaatgtgaatgtacccttcagtttctttctggaatgtgaatgtgcatgcttcagttacaggcattatgtatatgtgctcctttatgtgaatgcttcagttatgtgcatgcccgtttctgtgaatgtgaacgtgaattcaagcctcacttttatactataaaatttgctgaaggggtgattgaaaagtttggcgacgaaattagactaaaggcattgtaatataattattatatttatggttcctaaaaattattataatcatgtatcttattcatgcttgatagtattatttcaaatatatagccacacaatggtatacacaaacgtatttgcaattgatcaaagctacatgcaaaagcattaaacagcttacagacagatcctctgtctatgggttgtatgagctgtctttatatctgtctggatgataacttcgaggttcttggagacgaacccctatctgtgggttgtacatgccctaaggacaaatagtacgcgagcactatttagattttacccaacggaaggggtacatccatgttagggtacttccgtagtactccgtatgaaacggcgtggcagcgttttttttccttttacatagtccacaaaaccagggtggtgcctgagccgctcaatcgtactacaatcatagtgttaatacaaagtcattatagttttgttttaaattaaatatgtgtatatttgtccactaatatctaaaaaaattatatagttcaatgataagatttatgatttttagcttcaccatatgaaatattttcgtaatgtataatttacatgatggtaaactatacgttttctttaaaaaaaactatactagttttgaaaaatttgttgtcaaagttagaaataattagctaaggacaaagctaagagataagtaacatgaaaaaaggagggtgtactccgtattctcgatgtcatatattattaatacacattgatttgttatgccgccaacattatttttattaagtatactactccgcactggctaaatgtcttggacactcaacgtcatattgatcagaggaagtacaactttttacactaaatttccatatagataaaccatccaaaattaatcacgaacttcagtatgtcaaactgcaatgttaaaggttaatttggaacgagggattttcataggatttctaaggattcaatgccctttggtttgtaggatttgatggttggaaaagtttcggacgaatattttttttcctccacttcttggaggatttcaagcatgagcttaaacctcaagttttgaattccttttaaggctatgttcgggagccggcacacaaaacgaagcagcgttttagtgcgtgattagttaagttttagctatttttttaaaaaaatggattaatatgattttttaagcaactttcatatagaaactttttaaaaaaaaaaacgcaccgtttagcagtttgaaaagcgttcacgcggaaaatgagaaggaggagtcgggaacttgtactaccgaaagtccaagataccatatctctatctctcttctattaactctactctacttaaatgatactttttctctaaagtctttataagttttatgtggagtatccaaacgaccaatttgataaatttttgtttttaatttttataggatttcatacagaatgaccttttatcctgtgtttttttatttgtatcttttattttatgtttcaaaggagtcctgagtacaaagtgagttgagtaaatttcaaaaactctatgtacatgcacaaagtaaaagaaaaacttttagtcccctcctccgcaatatcaacaaaagtaggctggttgaatattggcaattttgcctttttcaattggtttcaaatggtggctggcctggccatcaggggcctgctggtgcagctggtttacccgttgacggctgcggcatgtgtgggcgtgtaccaacaaaaggtggttttcgtgcttcagctgatgtacggtccatgttaggtagtactcccaccgtattttaaccgtattttaatgtatgacgccgttgactttttaatcaatgtttgaccactcatcttattcaaaatttttatgtaaatataaaaatacttatgtcatacttaaagaatattttatgataaatcaaatcacaataaaataaattataattacataaattttttgaataagacaaaaggtcaaacgtttgtcaaaaagtcaatggcgtcatacattaaaatcttttttgaataaaacaaaaggtcaaacgtttgtcaaaaagtcaacggcgtcatatattattaaaatacggagggagtactactccagtactagagaggaaccggcgtgttgtagcgttttcttatatactgtacttcattttgtagtccacaaaaccgggctagtaccggtgttcaattcatacggacaccatgactttgttggagcacaacacttcgtattctcgattccatatattactgggtacacttgctcatataaacacacacaaactcaccctataaatgctcacacccacactcatatacagactgagccgatatatctttatatcaatgaagtcaccataattaacttgtccactgagtatatcgtctagcattaaaacaataaatagtcgtaaatgcaagcacttgaatccaggtgggcatgttatgccaccaaacatactttttctattccagtcgaacgatattttctcaggtgcaccaaccttttctcattcccccctctccttttcccccttatggaccaccttctctcaccgaagccactcatttctctccggactcatccaacgcgtggttccaggtcgtggcgtcgttgttcctgagctgagacgcgatgagaccaccggaacctctataggtcacgcacggcatcgcaagaccacggttctcactgtcacgagcacacgaatccgacgtgaaggtctaagaccacactccacggtggagcgttgtacaaggcctagtcctccgcccgttgtggccaccacccagctcctgtctcgcagccgctcccccttgtctccgctacggcacgtatctggtgacttgtccataaaccctggcggccaacgccgatgtccattttttttaacggaattaaaccaggtataggaccatttgatttgctcaagtcaacttctcctcacgagagcatgctgtttccctatgtatgtttcgcagcttcactcgcttcacggcttcaagttagtcggcaactgctcggtgctgtcacgtacacacgcaagcaaacaaaatgcacgaccgtctcagctaaaaattactggcgcctctgttctgaaaaaaaaaaacatttctccacctatcccctcctctcaacaaatcacaatagttatccatttaattattttatcttattttgtcttatcaaccgatcacaacaatttttcaatcatttttttaatatctatatcaatttttaaaaatgcttatattttttgatacaaaatatttatattatattttaggacggagatacaccaagccgatgaatagtgacacggatgctgtcgggacgaggccaaagtcagggtggtggctggtatgcatggtgtgacagtgacgccgcaagcagatcggtcatcggcgcggcgcatgggtcgtaagcccatagccgatggattgaaagtggactttttccataattggatgtggatgcacgctcgacgccaccgcggcatcgcacaccggaacaggccgagcagtcggcagaaggcccaatcgggcacgcggtttcttctctctctctctctctctctctcgttctcgattgttgatcacgcatgtcttttctttttggatttagcaagagcacacgcatatgctcttggatgactacagagtgaaaaggagtgaatcttacgccctgatctgtccttcgttgatgtaggattattttggattgatactaaaatgtggagtaatccctccattttaaattgatctacatatttcataggtacactaagatcaagaaaaactaagaacttttttatactatattaactctagcaacaaacttaatgtatgcatcacccccactattttctagccaatagcaaatcaagatattgcatgtgggttataaatacttgtgtgcatggatgcatgcatcaatgtccatttactccaatacacaaataacgaatagacttaatgaatgatcacaaatgtatagatcatttaggaataactaaaataaaactatatgtagatcaatttagaatggagggagtagtaaatatgatggtttggtttggagcttgctcatgcttaatttgataaaacttggctctcaattagtatcaatttaaacccacttcacttacttagaatgctacggaccctactaaaatattgatagtgccaaaaacatgtttaggtgttgatattggtattggtacgactaaaccaaacaagcatgtacatatagctgttgattcttttacgcatctcttcttgttaacactagaaaaaaccttgcccgggcggtagattgttaattacttttgttgcagatcacaacttccaaacgtccaaaccatcgacaaatattcatatatgtccaagtccaaactgtgcctaggtacgttatcatgtatgagatcgtactttcttaaagcgtaacaacctgcaactgcactgctgtccgcgtacgtaaaccaagagttttgctgcagcacgttctgtttcgaacaagatagtacggggctgggaggtgaggtcccgcacgcaaaacatttgacacattttcttataattaattaaatatttattattattagcaaaatgcccgtgcttcgctacggcgtattaaaactaaaaatatttgtttttaactgaagttattttcacactgttttggtacttttgttttttgtttttttttttgaaaaatgacgttgtccaattggatatctgcataaaacaagtcttctgccaaaaaaaaacccctaaactggatatattaatctgtctatataaataatacaacttaatataaaggatatgcggcccaatagctaggtggcctgggaacaacgcccgacctgacgcgggagaaaccagggccatccaatctgatggacggtcccgattgatcccgacctagataaatattcggcagctcaaaccctaaccttaatatcatttcccccgatccccttgctctctctctctatctcaaaaggcgatggtagcgacctccccctcccaccgcgagcattgccggcggcgccctcccccactgcgagcgagtgaagctgcgccgtcccccaccgcgagcagcggcgccctccgcggcttcccacggccggatccaacagcgacagcgacttcccgcgagcgtcgtcgatggcggatctggcgccgacggcacgcggcttcccacaggccaatccgatggtgacagtggcttcccgtgggtggatctggcggtgacaaagattgagataagatttatgcgggtttttttttttccattcgttttctctttctttggattgtctgattggatctcaatcggatttacagacaaaaaaattgatgttacggatgaaaaatgatgtgatgaacagaaaattacaaatttttaagtagttaagataagatttgtcttatgttgtgatccgtaatgtctcgcggcgttgcgatctgtcttacctgtttgaattttgctttatggagagaaaattgtatcatcttacatatgtggggacgccatataataaagaacgtaactaaaccagctaccactccatctataataggcatcatctacctatacttcaaatataattttctctcaaactaatggaggaaaagaaaacagattaggatatgttgtgactgggtgcgaacgtatttgggcattttgggcttgtactggactccaggctagctccggactctgtctaggcctgcgcgcatgaaatccgattaaaacggttaaacgcgtacggatttacggaccaaaaatttgtgacgaaaggaaaattattaatcttttagttagttaagattaagatttatttatttatttttgctctggccgttgtacacgattacactcgtgcgaagatggagggcgccactcagtcggactttacagatgaaaattttgtgacgcacctgtagcccattaaaagtgttgagtgttggcaccagtaatattttatatatttttttaaaaccggtatatatatatgggatatacgtgtccgttttatctgggatatacgcctctccctctcccctgcgccgcggcaggcgcctctccttccctctcccctgtgcggcgaggcctctcctctctcatgaggtggagaaggaggcgcggggcggcgggggctagatccaacagcccccgagctggggaccagcacggcggcagggagcatggcgaggacggtgcgatggttccacgaaggaggaggcgcggggcgaccggtccagatccaacattgttttttatgcctttcctcctgctttcactcgagcacccttgcttctcttcctccatcaatcgtgggatggttagtaagaggattcatgagcgatgttctttggaaatttgtggccttttttatggggatctttggtgtttacccgatttgctctccattggtgttgtggagatgtttgggctgatttggtcacaattggatttgccgcatcgcgagctgctgcaattggtttttttagggatctaggatttgtttgtgtgtttctgcttccaccttcataatttttgtagtgttgatcttgtaatagtgaatgaaaaactgattttctaggattatcggttggttttgatgttgtgatttgtcatacacgattaggattttgtatcctctttgattttttctttggccaccgtacacgattgcgttcacgcagagagggagggcgccgctcagtcagacattattagggatggaaattgggcgccgctcagtcggacattacggacgaaaattttgtcgcatgatcggacaaaaacagcgatcattgagaggtgacgacaggaaaaatccaaatatttatattagttatagatatatattattattgaaaatggattaatatgattttttaaagcaacttttgtatagaaattttttataaaaaacacgtcgtttagccgtttgaaaagagtgggcgcaaaaaacgatgatggtgagttagaaaagtcggggaaatagctctaccgtcgacgagcatgttcaggttcatgcgcactgcacatcattcggaccccgcatgcaaaatcagtttatgaataacttacaaattaataatctccgctcagtttaataattctaggtcgccaagccggttaactttgatttttactgtttttatttactactactaattactctcttaatctcataaaaaaccaacatctagatttaaagtcagaagttggtgttttatcgaacggaggtggaggtagtaactggagaggaagggcctgttcactttgatgtcattttcaaccttaccaaattttgataaagtgacaaaaaaaagtggctacatttagtttgctactaaattttgttaactatataagaaatcctgccaaaattttgacaagttaccaaaatttttacaactataccaaaattttggcattgctaaaatttagtaaggtttttttttggcattaaagtgaacaagcccgaagaaaaaaaatggtgataaaagacactgcggaatcatgagcttgggtactatggcctcgaggagaagacaagtagctgacattaacgcacaggaccctcctccgttcagcgtcactcttttacacccccatcgccgtccatctgacgatatatatgatggacgacggcgatagacaatgaacagctacggacggccgaacacacgcactgatgaggtggaattatgaggggatgaacccaaacgtagaaacaacttttgtaatggtttcctgaaaaattcctatttaaactgtctccgttgaaattcctatttttttagataagatctcaaattatgttagtatgctaaaacagggcgagactaatcggttgcttgagttatgtttgtgactttttttttgttgtaaagataccccaaacacgtaaattaaaaactcgaaaaagggccatgtaaatctaggatgtcgccgtgtaaatctaggaccataccgaatactccctcattttctaaatgtttgatattgttaaccttttaaaacatatttgaccgttcgtcttattaaaaacttttgtgaaatgtgcaaaattatatgcatacataaaagtatatttaacaataaatcaaatgataggaaaaggattaataattacttaaattttttgaataagacgaacggtcaaatatttttaaaatagttaacagcgtctaaaaatattttaggatggaaggactacgtgagaatcttgacgatgtatatactaaactagtatgtgccccgcgcgttgccgcgggacataatgaaaattggttattataagcatggagtgaagcacggaaacaaaaggtattcatgtagattttgaaatataaatccaacgtcaaagctgatatgattagaaactgcattgtcgttaatataaatgtgaatgcatatatttttaatatttcacatgacaacaaaaatattactggaagtttacttactaaaaagcatataatatatgtaagatatgttatttcatcggacaaaagaattgatgacggtagtcagttggcaattaaaatagttatattatttacatggcaggcatacaggtgagtgagacaaataatttatctcgtataacactcttgcaagccaaaaggtacataatagggcatagaggtgcattgatatgttttctagcagaacacctgctgatggaaaaatgaaatttataatgatcattgagatggttggatgcttggttcttcgtatgatggcagcctgcattatagtatcattatgagcatcagccataa

SEQ ID NO: 65701 - DNA, 11788 bp, Oryza sativa
cttgtttagtggtcagaatgcaaaatataaaaagaggaaaacaaacttacgaagaaaccatggataccagaaggcatatattagaggaaagttgagtgtgaagatcacataaaatagacaggaaagaactgaaccattgtaataataccaactgcgtgctgctttgacaaggcagaggtttcagataaagaatcctgcaaacaatgaagataggtaaatttgacattaagtatcaaaacacaaagaatataatcaggtcaagttagtaggtctgagaaaaaagaacctaggactcacattgggggcaaggcaaccaaacacaacaaattactaataggtagaacacgtatgcttgacttacctgtaatcatgtatgcattccttgttgatccagatcgttaaatatttctttgtaaacaacattgtgagtgctggtcacatgctcagttggactattctcaattagaatacgaagaccatcaggcgatgttacacgtgagagtgcgacataaagttgtccatgtgagaagacagggctaggtaagtagacaccaactctactaagtgtttgcccttgacttttatttatagtcaatgcatatgacacacatacaggaaattgtcggcgctttaatttaaaaggccacttcttatcaattgaagtggttactatccttggtatatatgccttggatcctttagccttccctgtaattatctccccttctatcacacgacaagtcaattgagtcattataagtctggttgggttcagattgcgcagcagcataatcagcactcctatttttagttgaaggtgatggtctggcaaaccgctgatttttatagtgttcaggaactcagttgggtaaagagcatcaagagtggcacgattacttgtagtatcttcaattgtgtctgaactatagtatgacatttcttcagtagtcagctgagcaatcatttgggaatttatacttgcagcgatttcatttgttggggctagaattgctcgctcacagagataattggctgtgtgagaattgattgaggcatcatatacaaaagagataaggcctgaaaggtttcttgtgtcatctggcaaaagcaaatactctggtatttttacccaagaaacatcctctcgatcagtaggtgaagaatctgctactgctccctcccctattgctaacaaccattctgcaaattcttgaaggcgttgacgatgagtattagacaatgttggggattgaagcctcatattttccgtaagatgcatgagaatgcagtgctgccacaaatgagaacgtgtgatggatgaagataagatttcctgtttttttcatagggtagaaccgggagagtttgcctaaaatctcctccaagaacatctgtaatgcctccaaactgtttgttagcaagtgatggatcattggatgcaagaatatctctcaatgttcggtcaagagcttcaaagcaatgtttgtgattaacaggtgcctcatcccatatgactaaggaggtttgttgaattaattgagccaagtgagtgttcttcttaatagaacaaactggatgctcttgtatgtccaatggtattctaaagcgagaatgaggcgtgcggccaccaggaagtagaagtgatgctataccggaagaagcaactgccaaagcaattttcccttcagcccttacactatttagtagggtattccaaaggaatgttttccctgtccctccatagccatagataaagaaggtatgcccaatgtcactatttaaagaattgagaatagcatcatatatatgtctctggttcagatttaacttgcctaactgatcagccgcttcaatcgatatcttctctagatcatatgcttgttcatctattagcaacctattgccaaggatggatgtgctttgaatagtaggctcaggtaaatggaaatgtgccaaagtacgaccaacatttctaagtatgctatcgatctcggaacgaacataggacttgacatattgtatgactgaaggtgcagaagaatttatacctagtgtggcatggttaaggtggtaggctgcatcttgacccattgaagacagatgctcttcaaataaactcagtgggtttgtaacatcacagaaaagaagcaatgttacaaataactcacggagttggtagggaagtgcccaatgagtcgcatcagtcattgcgaaggaccattcacggtcatcaccaagaaggcctagggcttgacatgcagattggaatgtaggatatacatgtccttcaatggtccggagatcagaataggattttgctcctttgacaatgtgcagcaacattctaaggtagtagacatctccttgggcaggacaaacatgtgctatcctttcaattttcttgcggcaatttttccgtggagcccaatatttgccattaccatgccaggtaaagtattctgggaactctgcatatgtatatggagcagcctgagagtattctctatttgcagcaaaccatgctgtaagtttcgtaacacgattgcgtgggttatccaagatctgttccagattatcatcctctgtgaatgtaacattattctctaatggcatatgtacatggagacgctcaatagcaggatcagtataatgaatctcaaactaaagcaaacgccatgccgcctcattcggcgctatacatctacattctaaatagtcatgaatctcattagttccagcacatgcccgcttgcgcttgagaccaaccctcgaacaatcaaaacccttagcaacatatttgaatagatacttttccattccatcacgattaactctttccacgttgatatgcgcctcatatttgactaataaatcgacgttgtgggggacaacatgccaattatcaagagaaattccatttttcgcaacaattatatcattttttggccgagcataccttacatggccatttggcaggattgttgttttctcataatattccttcgggtaattctttgagcatttaccgtcaaccatgcatgaacaatgcggatttgcatcaccacaaggtccatgcatcatgaatgccgcaacagcatcataaccaactcgatcaatggatggatctggaagctgggccgatattagtctgtcaatatcagcaggtgtcaatggaccactcttatctaaccacaatatgatgtgaacatgtggaagtccacgcttctgaaattcaattgtgtacacaactacataaaaggaaaaattatgtgagaatgacacatacaaaatatttgaatatatgaagtgtgcagtatgttgtgtcatgattcatgaacaattaaattactacctgcagtgacagggccaaaaaatttcttctttacgatgtcgtccatgaagagatgcagcttaacatggaatacacgattaataatatcaggcctatctgctgagtgttgcccagggatgatagccaaagcttgtgttacctctgaccataaggaatttgatgtgaaagtgataaacaaatcagggcaaccatattttctacatagagcaactgaatctaagtaattttgatataaatatcttgccccccccccaatataagaagaaggcaatataacttgctgcccggcatctgatgcttctgtgatgcctgaatggaccatagtggatacctcactaaatgaagttgttctatacttaagctgaaatgtcttggatctatagtgactcaggcgagattcttccatacaacaataggcatctatgacataggcctgggttcctctcttgcagcgcataggagtattgaagtcatcagctttgtcatgaagcctatatgcaaagtattcaaccatagtagacttctttcttttgatagcttgtaatcgagcacaacgtcggtatgtgatattttcatgatagccatcctccccatatggaaatagaattggatattgcattgacataaatttacaatgcttttcttcaactttttgtaaatgacccgcttggtcctgcacaataaggtcacggccaacatcacttatacctacatcaccaacaactaacccaacaacctccgatgcaactggagcactaaatatatcaccatgcttgtcgggatcaccaaataatcttatgatgtatcaatcatcaccattttcagccaatctatcacgagctgtcctaaataggtggacaataggattgtgggtgttgaacatgtctataagtccagccacaatatcctcattaggacgaaaactcctatttgcataggttccaacatttatcctattcctgatctcattttctgtgtcaaagatatataagtgagcatactctggtcgtcttccttcttctggtatgagtgacccaatgcgatggcagagctggccactaatcttgaaaacatatgggcctcgtccatcattgatagaatcaatgacatttacacccatcgatgtgaaggcaaacatcgaattgtagaacctaatgttctaaaaaaatgggctgacaatgatctgttaactcctgtgagtagactatgcaaaggttctgggggtggcctatatggaggtaagatgacactcccacctttacaacatgtattgtatattggtgatgagctgtgctgttctcggcggacacgctcctcaaaccaaaagaaagccccacaatatggacaagtgtgacatgggggcccaagccttgatggagagaaaatagtgcctagtaattaaaagaaaatgacataagtgtgtgtaaaaggtgggaattttttttcgtgctattgattgacatacatcaggtcgagcatcagaattacattagtgagtcgaacagcaagtcgagcatcatactgtatgagtgatctgatttgacatgtcgagcatcaggtttacatcagcaaaaccgcgagaattgatgagcaaatggtctgtacattattagcattgtagttgtcatgatttgtaaagggtgaaatgaaatgatagttgtagagaactaatatatgactaaacttacgttgatgtgtgggagatggagacaatagggctgaagaggtcgacgatgaacatgctatcattggttacatttgttgaagaattaggagagaaacacagtaaaataagtggaaataggaataggacagacctccatcgacagttgcaaaaggttgtgtatggccacaattgataggaaccaaggtggatgactgagacagaccggttcgttgtcgaacattccgttgtagcacatggatatgcgtccgatgctctatcatttcagtggtactattaatttctagagaaaacaacatgtgttagggaaaaaaaacttttgtataaggcatgaaagtgcacatgtagataaacatgtgagtggataaagaatataatcaaacctctagatgatttggcagccatagcaagcttacgctttcgacgtgattgagcagctgttacaggatccgggtggggaaatcctgatttagaatatgagcaacaatttttggtcaaaaaagaattaggataataacatgggaaattgatatgtaaatgtggactgcggtaggttgaattggtagtgatgattatgcataataaatggaaagaaatgccatacatttggaaaacaacagggtagacaattagaacggaaaaaaaaatcaaaacaacaaatattataccagcagactgagtaagtagtcttcgacgtatagagcgccttgatggcaaatgaaaacttgtagggaaatcacaaacatgggagagggcgtcatcagccagcagaacaacgccatcgctaggaatattccctaggaaatagatatggcacaacagaatcatctgttgacaaataggagagctcaataggaaaatggtttcaaatgtagaaataagcatttatatggcttggagctaacctgaaggtataaaagctctctcgggttgcctgcgcttgcaagctggtttaggtgttgatggcccagaagagactgacatcattcaaactgatttatgaaagtaattagtggtttactggaactataataatgaaagtaatatattttttatagcagccaaaacatcattatatgtgtagcaatcaagtagtatacatataaagagaaatttatgcatccataaagtggcacattaggtactggccagtttgctatatcaggtaatactaattaaactatatgggaagagccataaaagaaagcagataaaatgcactacacatctagtcataattaatctttttgaccaattgatatggagttctttaaatgtgagtgtacttgcaaattgtaatgaagaggctataatgcattttgtttatgaaagaaagcaccaaaccggaaagaaggttaaaaaaaaagatatgcacatagggaattgataggcagtaacagagagttcaaaatcaaaccaccaagaccaaatgccatgctgaagcgtacatatattctaaatcgacccaatatggcaagccaaaataaatagcaaaattagcactgcaataatccaaatgccaagctgcaagttgacggcctacaaatatttaataaactgacaggcaaaatgagaacatatcaaggaaaagcgcatatctatctttcgttcattagcattttgtcatatagtgtttaatctgaaaaaatcgcaaccttggtagtattcactcagcctaactatcgcaaggaagcatagggaaatagattcatgttttggctgttaacaacagcaaagattgatcagcctgggcattgtctcggtgactcaaactgaaagaaagcaagattggcatccaacagcaacaaagagcagtatagagaaaaaagacttactgaagaaaaccgaggatggaggcagctgtccagagcagacaggctggcagatggcagccgctcgaccagggcaacaatcgggagccttgatgggtgcggccagcgcgccggcagcctgaccgatagagatagctggacgacgactataaccagcggcaaccaccacggggcaaccctacaatcacaggcggtgggtggggaagaacgcaggtcggggaagagaaaggcagccgccggcgaactggtgatcgatggggcagaggggatggcgtcgatttctccgatggattagggatttatcttcatgaattggggatcgatgggtgtgtggtggagagggcaagcagatggattagggatttattttcatgaattggggattgatgggtgtgtgctgtgtggagggcaagcatatcgggttggcaagcggacggacagatcacagccacgacagagcatcacacggcaacgcagccggaaggaactgttgctctgtagcaaaatactggcctatggtggagcaagttactgttggtagtggcttaggaaaactaaagatttaatatgatacgttgtccacatgatgttcatttctagccttacggataggttgagtgtcactgatataagaataaggcgacgtaaagtgatgttttaggaaaatactccttccgtttcaaaatgtttgacaccgttgattttttagcacatgtttgatcattcgtcttattcaaaaaatttatgaagtatgtaaaactatatgtgtatatgaaagtatatttaacaataaattaaatgatatgaaaagaataaataattatttaaattttttaaataagacgaatggtcaaacacatactaaaaaagtcaacggtgtcaaatattttgaaacggagagagtatattgtctttttaaaaatggaaactcgtttgtctttccgaacctgtctgatttcctttagcaaattaaagttgctttcgtgaaatgaagagagtgatgacgattcgtgcaggccatatgtgcgtgggagtgggaacgtatttttcggttttttccttggtagtacgagggaaattaaatgcacggggattgaagggaaatgtttttttcttctctttgtttttgcaaccgacaaccgaatcaggtggtgtttggatccagagatttaactttagtctctatatttagacactaatttagagtattaaatatagactacttacaaaactaattacataaatgaaagctaatttgcgagacatatttttaagcctaattaatccataattaaataatgtttactgtagcatcacatagtctaatcatggattaataggctcaatagattcgtctcacgaattagtccaagattatggatgggttttattaatagtctacgtttaatatttataattagtgtccaaacatctgatgtgatagagacttaaaactagttttagtcccttttaaacagggtctcattgtttgtgaagtccatacttggataacagactagcttgtgcgaaatatactgcaaaatcaattgcaagggtctgtattaaaattatactataatttagcatataaaatctctcccataaaaagttattccctccatatcccaaaatatacttaattagtacttaatttagggacgaagagagtagcaacatagtagataccacatagctcaacgattctaaataaagggacctgtctatactcgtactactaaatattagtattaggtggtgtctattcgagcacttggttgctatattttagtaagaagtgaataaatattaaaaagtatctgcagagtaattaaaccatgcttaggaattcattgaaaagaaaatcatggtcaggacaaccaatagtcactactacgaactatggggtttatggctcctttgaaatggagtatttctataggaatttcaaggatttgaatttcaaaggatttaaatcttaaggaaaattttctatctagcttgtttgaagcataggaaaattcctttgaattgtaatcctatactccaattcctaggaattttgcacatgagctctcctacctcattttaacattgctttgagaagtccaatgcttcctctatttctctctcttctctctctaaaatccatccaaatccccaagtttttactatgagctatctaaacacattgtcttgcaaattcctgtgttttgtatttcatgggatttgcttacatatggcatctcatttctatttttttttttctattcatgtgtcccaaagaagcctttaatggaagacgttgacatctttttcaatgtgatactaatttatctgagattttctaaaaaaaactactctctccgtctaaaaaaactcaacttaggaggcaatgtgatccctcctaatacaataaatctggacaaattatatgtttatatttatcatactaggagagatcgtatctctttctaggttgatttttttttgacggagtgagtaactctttatacgacgaataggagtagtagtatattgagagggaagctagacacaaggcagcgtggcgtcaccgttaaatcagagtgagtcacatgcaggactgatccccttcttcgtcgtcgtcttcgatcgatgtgaattaagatgtccgaggcagggcaatttagcgagcaagcaaatgcctaaaccatattattggttcttgatcagtggcaacgaacattgaatccaagcggggacgggacaaattaaatcgtcgacggagacggcgtacgccttcccaagcaaaacacccgcgattttgatagggaacgtatgatctatcgttgcatattttgcgtaacctcttctcggcgaccgtccgacgatggaactcaccggctctgtttcaactttcacggcttcacgcggtatacaaactgaattgcccgtccttagaggctataaaccaactgtggagaaaagagaatttaaaaaataaagagggttggctctcatcaatagctagctattcatatatttcaagataaatacattaaatacataggtaagagatagaaagaggaggagaaaaaaaagagataatcttatagctcatttattattaaacttgctctttgttttccctcatcagatcagacatagagccttattggttggtctaataaaccaaagaaaaagctaaaatttaactttttgaatgatttttaaatattttaaatgtaatttacttttagtgttagcttttaagtcgctacgaacaaatatatagaagttgtacttataaattaacttttattgtttaataagccgttttggtttattcgaaaatatatgtgcgacagaagaggttagtagttttttatcaatcggttgttacgttacgtccctcttttttaggaagaaaaaaaagatctggctgctacacagtagtagtacgtacaactcagtacgccacagtaccaaacggcgatggatatgtcgcctgccggccatatgcaggtacaccacctgtaggctgtactgccacggcagttggggaacggctatctttttgcttattaggatacaaataaaaaataatttataaatttcttatatatatatacacacacgtgttcttaacgatttaaaattttaaattttggttgataactataaacataagaaaaagaaaaagataaggttgtttagcatgcgccctcgcgggatcgtgttgaatgctgatatgttttggtcgtcgtggccgggccggtcgccgcggcacctgatctctctgcgcttcggtgccgggtgcgcgcgcgatcgagctgcacctgcaagcgggaaggaggatcacattaccggttgaccactaaattttaagtctcattgatatcacgattttcgatgattttcaatcagtttttgataaattccgactgaatttcgaccaaatatactgtttagccttcgaaattccaattaaaacctaattttgagccgtatcgaaacgtcgaaatttcgaggaattcgatcggttttcgtcggaattgtgaaccctgggaggatatatcacgcccgcgaggttgttaggatgccggtccggatcatactatgttagggcttcgttctgttctgatttctgacttaagatcattagcacgttctttcgaactgctaatgatcttaacaacttcggataggggcgcacggtcacggatagctcccccgtttgggcggaaatgcggtgggcgcgtacgtgcgccatgctacggccgcgccacctgctggttgctgggcaagttggccttgtcaacttgctacgcgacggaggattaggttagcttaggcttatggctggctggccttcacagtcactcactgtactactatttggagtactctcttagtgcctgttcactttaataaaaaaaaaaccttactaaattttagcattatcaaattttggtatagttgtcaaaattttggtaacttgccaaaattttggtaggatttcttatatagttaccaaaatttggcagcaaactaaatgtaaccattttttttttgttaactttaccaaaatttgataaggttgaaagtggtatcaaagtgaacagacccttagttaggaaaaaaataaataatttagaaatggatttgacatcatctattacaaaacaaatctgaactgttctgttcaaatctgttttactccctccgttctatttgacttttttacttgcattatttaaaaagttttgaaattattatttattttatgtgtgacttaatttattatccaaagtactttaagcataactttttgttttttatatttacataatttttttgaataagatgagttgttaaatactacctccgttttttaatagatgacgccgttgattttttctcacatgtttgaccattcgt

SEQ ID NO: 65702 - DNA, 5044 bp, Oryza sativa
aaaaagtcatggcgtcatctattaaaaaacggaggaagtagtataagtaaaaacttaagatcacttgtattatgaaacggatggagtactaaatagtgtcaaatagtgtcaaatctacttcaggtacttctagattgttttttactgtgatggagaaattactactgtaggggggctgcataatcgtgatcgcgatggaccggtgttgtcaactccggctggctggctggctcgctcggtgacaccgccacctaccctaattgcattagtctacgtgctttgcacactaggttaggtcaatccatcgatttgctgtgatattatccaccatggagcggggaattccaccatggattgggactccgctgatcctttgataatggaggatggatcaggagaaccgatccaacgaattacttcctctttcacgatcccagcaaacttattcctattattaggtggtatctaatccatatttttaattaaattgctcacaaataatatattactgtttcctttttgtgttttctgaattggcataacacttcatttctcgctatatatatacatcagtaggattgcaggaatgaagcactacttctacgtggataaaatattttatattttaggatagaggtagtatttgtatatgcccagaaatgaagcattagtgggacggggtgtggtttgcattatgcagcgttttctcgtgatgaatgcatatggccatgtactcgtgtagtagatgaaagatgtacggacgatccgagaaatagtagcaggtgaggcatcgttatcagtcgctgatatttaccgggagagagagcaagacaggacaggacagcagccagcaaccgccacctaagcctgatcgtcttttgcactaatcaggcaatccgtcccaaaattaattagcaattaactactaaaaaacccctaaaatatgaaaaaacagagagaatactatgctaaaaaagacgtgaatattagataaagatttagtatcaaatagctagaaagaacgaggcttcaaattcaaatcgtctagcctatcacctcgtaaagctagccaaaagatccctgtgtgtttctcggcttctctcgtgtggcagcaacaatggagaattggagattattacattactttacatgggccacctagccagatcatcttagattacattagattaatcaagcaatcagtcccaaattaattagcaactaattactaaaaaaaactatgcaaaaagaaaccaaaaaaaaagaagaagaaaaacagagagaacactctgctcctcggcttctcgcatggcggcagccggcagcggcagcaatggcgattattacatttattacatgggccagagcgcgacgccgtgtgggtaggcgacggcggcggcggcggaagtggtggtggtggtggaggaggtgatggagaagtcgttgaagccgaagtggacgtcgtcgtcgtcgtcgtagtagtcgagcgggaagctgcgcggcggctcgcacggcggcgggaggaggcagtcgcggcagagcgggcaggtggcgcgcgggaggacgagccaggcgtcgaggcaggcgcggtggaagacgtggcggcaccggagctcgcggacctcctcgccgtcgtccacccgcgacaggcagaacacgcagtccacgggagccgcgtcgcgcccgcgccggtacatcgccacggcaaggcggtcgcagcactccgccgtcggctgcgcctcctcctcgccgtccgccccgccggcgccgccggagacggcggcgcggcggcggcgggcgatgcggtagccgaggaagtcggagcgggtgggccaggcgtagcggccgccgcggagcgcgagggaggcgaggcggaggccggcctcggcgaggacgaggaggaggaggaggcaggggagggagaaggcggcgaagagcagcgacacgagcacgccaccgatctccatggcgagcgcgcggcgcgcggcgaggcggcgagagcgagccgaggcgcttggctttgggctggaaaatggcgcgagcgagcgggagcgggaggagatgataataataataataatttagataagggtggtgtttttttttattatttttatttttatttttattttgaaggggttggtttgttttgtcatggcgtccagagacacagcgatgtgtgggaaagccacgcgatgaaagggacgcggtggccggcggtggcctcaccgaatttatatcagattttgcttccttttcgagtaaatttcatgggcctcagcaacttctaaccgttctaagcctgaagtggcatattactaaaatggcaaatgagaacagtatctagttcggatggtatgataccttacatgtattgtctgatatctagtagatatcggctgataccccattcgaacggaataatatctctgaggtctcgactgatacctagtaggtatcggctgatactcaagtatcatgcgatacctagagctgtttgatggttaggaacgtttaggtacatggaaaattgtgtgataatcctagttaattctcatgtatattacaatcatacggatttctagttaggtgtttgcacgaaaacacgggagcacaccgcagccaagccttccggtgaaacatgccgaatcggaagttccggcctttgaaatggaattccgaacttgcacaagatccgcaagaaactatccgattcaagcaattgatagtcattctcgttttcgtggagatgcatggatggtttacacgataaacgacaaggagtgtacttcaatttcgtcaaggggacggatttacatgtgaaaatcacttacttctagacttatattgaaaagctaaaaaattgatttgtgatgattgcttgggtggggtttcaattgctcttagggcctgtttggatgagtttgagattctaagaagcagctgctgagaagctagtttgtgagaatctggagaaactgggaaacccagcttctggcttctagttcattttccagattctatagctatagattctcagaatctgggtaaaaagctggacagttttagggagcgtctggtaactaaagattctaagagaagctgcagctgctgaaagctcctcaaacaggcccttagcttaggagtggtcttgcctcgtacctactccaaatgtttcatattataagagcaagtttaatagtatagcctactactagcttcaattcatctatagccaatctaatagccaattcatacaatagttgcttactatactattaatatatggtcacatacgtcatacacacattacatcttggagtccgtgctacagctggctatagatctgtagtctgctgcttttctctctcatcttttatcttagtaaaatatgtttacagctggctaatagcctgctattgtatctgctctaagtcgttttgatttttcttatcaaatttctttagttttcatcaagtttataaaaaaaattcaacatctacaagaccaaatttgtttaattaaatatagtactttaaatattacagctattaatattgtctttgtgcaaacaaatgctccctaaagtttttagagtaggtatgttttctttttaattttctgttgcttataatgtctgcttgggcgacacaattatacatgtacgttcatatctttttctagcattatgagccttggagttgatcttaataagggatgtgtccaccatataatcaacctgagtaggtgggattgttctctctttaaaagcattattagttggtgggaggcaacatgctaacatcctcactcccatcactaacaacactattgtagcgttagatatatggtaatactctatttagttaactctaactgagagtaattacacgtcctaaatacatttaatctatagtattgactattatagagagctagtttaaattgatttcaaccattcaccacatataaacgatgcattttttaaaaataatatataaaaagtttactttgaaaatcttactaatctatttttttaagctaatacttaattaatcttgtttttcctgtgaggggaatgagttatcaaccagtactccaaagtcctaacacagcccaagaactgttttggacgacaaaaatcggggagtaaatgtttgtgtagatacacacagatacttcctttgtccaaaagtatattaagcacattcccatttatcttaaaatacccacatcaccgtttatgcgatttacatgaacaacggtttacgattatgtacaacatcatgaatagaggccagaaattattatttcaatattaaaaaacatgaataatcgtttttaagaatacactgtacttttaatgatgaaaatcaatcaatatccacgtcagtctgtatccggctacgtcttattacaaaaatattggctcgttttagaagtaataaatattggtggtttagtaggcgtttttcacaatttgccaacttgctaaggtcacatttcgattaattacgcaataacggctttacagagatttttaacatttgaactcccaagtgagctggaaaattatcggatctagctggggcttgtcgtcactcgtcaccgtccatgtgtgagctgttcattctgtccatttaggaatgactcgtagcacaattatgcagaggttttaggtacacgccaacttagttactgttctaattaaatctagggtcagatgtcttctatcatcaaataattccggaactacagtagtagttagttccgtttggggattgggtaggaccaatctctaaagttaatcatcgacgaattattagacacgttttagagagcgaccaaacgtcttactagtaaaggtggagagtgaaaaacagcaagcgaaaaaaagttgcaatacaaaatttcttaactaaatgtacaatgaatcacatgtgacaaaaatattttcactccaagaccaccacaacctatatagaacaccggcctttggaaacaagaatgacaatatcaaatgacttctaagagagaagtgaaa

SEQ ID NO: 65703 - DNA, 1601 bp, Oryza sativa
gcgccaggaatgtaatgggaaaaaatgcgagaggaaaatttcctggacaaggccacacaagtatcgtcggcaggggagaacaaaatctgcacaggtgtctactcaaatccttaagtttttcaccaaacaaaaacggttttgctactttctcctttttgtgggatgaccaccaaaatttcatgccatgctaggacctacttcgcatcagccttgttatggcctgcggcggcagcagtactgctgccagtttctttctctgctgccttccgtgccttgaaatcctcgatggttcggaactcctcctttaggagcctctccaattctggatgcttgataatggggctgctatcttgatttcggaaatggtggaaagccctggttcaattagcaaaaagcagatctgtcagcaacaaagtatcgcaaactcaaaaatcttacaactgctaggttggccaattccactagtccagcataattttaagattcattttcagttacccttttcagggcgtacccaggctatccaggtctgaaccagctttcatgtaacaatagcgtgtgttataatcaaaagaagatttggttcagtgccaccacaaaaaaatataaattggaaaatacgatctagtgtgaggttcacatgtgggagaagggaggtaacgtattagtgacaccagatggtatttcttgttgatgatctttgtgctgggactgagcatgtacaactttatcatgccaatactccacagcataaggttgtgaatatttgatattggaaatgcaccattgagttgcatactgtttggtgtttgctcaggtgtaaatagctctgtgctaaatatttccccaaggacagtagccacataattagattactaggggacaggaagtaacagagaaatgcaaattaccagtatttttcgagtccataaagatcacccttgtgatggaattcgagtgtcagctgctcgaaatcttcatacacattgcgttggaagtttttctccaaaccataactgtaaatacaagcaggcagtgaacattgctgctatattatggaatgcaaggaaaaaaatgggaatattactataaaatttttatgtaccgtacctataaaatctgaagagacattcaagtccatatctgtaatttgctgccgcgtcatctagtgcaaacttcttaaaatgtttgtacatatcatcattaaaattatctcttagataatacgaccaaaaacgatataacgaattcatttcctgcattacattggaagatagaagagcatcagtatataatcaataaacagaacaagtattcatgcggcatataatcagtaataattgccaaaacaatagtaacaccaaatgatttcacatatgaagaaaatgattcaaagagagtaataaatgagcttggtcagatttatgtatatctagttagaacgttgccatagaaagagagatgtgcgaggaagttgcacctcactgcaaccgatccctaacttcttgcgttcagcgatgcatcgatttttgaacttattgtacctttacatgcagaagaaaacattaaaacggatcaatttactatgaaacaacgaataa

SEQ ID NO: 65704 - DNA, 1259 bp, Oryza sativa
atacgcaaggatttcgttttttatcatggtccgtcggtttaattaacacagacaaacgttgtggggattagaaatttccatatcaatcggagaatagtccatatatatcacaatgcaagattaaattaaaattcaaaataaaaaataatttctgaaatgacaaaacgaaaaataagaattcaactagaaatacaatttataaataactaaaattcgtaataaaaaataaatactattggaagaagagacatctagaacacatgacaagattaattaaaattccaaataacaaataaaataaattctgaaaatagaaaaataattataagagttcaaataggagtataatgttgtaaataaaaaatatcggaatgaaaaatatggaatttttttaaaaaaataaaatctagaacacagatgacaaatgtcaataaatatgggagaagtaacatgtttgtaaagaagtagagtggtgacggttaatgggacatctaaaaactattaataaaaccccaaatagaatcctactgaatattaaaaggagagatgacggacataccgttaaacaacatgatcacgactgttggcgggacttctaaaaggtaaaaaataaacccaatgataaccatgtttgattttaaaatcttaacgacaataaagaggggaggctgtaggcgagccgtaaaggaaagtattatagtggcaaagtcacttatggtttgacagaatttctagaatgtaaaagaatccaaatgataattatgttctatttttaatatcccaatgtgacaataaagagagaaagcagcggacaggctgcggaggagtatagtgtcagtatttgacgggactttaaaaattataaaaataaaacccaacgagataataaactctaaaaagtaggttcggaacttctaaaaagtaaaaaaaaaacaatgatgataatgttcgatttaaaatctcaatcacaataaagaggagaggcagcgggcgagccgtagaggagtactgtgacatagccgctggcggtttggctggacttctataaagtaaaaaaaataaacccaaacaataattatgtttgatttttaaaaatcccaatgacaataaaagcggaggcaacggacgggccgcagaatagtataatggcagcatttaacgggacttctaaaattataaaaatggaaccaatgagacaataaactctagaaattataaggcttaatttttaaaggttctgagagaatgaatagaaatag

SEQ ID NO: 65705 - DNA, 14917 bp, Oryza sativa
  unsure (1)..(14917): unsure at all n locations
nnnnnnnnnnnnnnnnnnnnnnnnnnnnnnnnnnnnnnnnnctttttgacactagcatagcgacccttcaggctagccgctctgatagagttgcgtgaatctggttagtcatcgatgaggcgagggccctggtttttgtagtttccacacattcattctgttggctcacaatcgcagagaatattaagactttatgctcgtgcacagtataatatgtatgtagcttatatagggcattcggtccatcgtcttttacagttctctgatgtaacggacgaatacatgctgttgcaaggaataaggtaaggtaggggaaattctgagaataaagtgtcactctctagagaggcttattttctaaggcacaaaagagatgcatatgacttaggccgcgttctaaactgagtttgagctgagctaatctctcattgaacattagcatgtttctcaaactgctaaactatatattttatgctaaaacggtatataaaaaagtttctctaaaaaatcaaataaatcaatttttacagtatacaatagataataattaattaattattacgacctccgttttttaatagatgacgccgttgactttttttcacatgattgatcattcgtcttattcaaaaaatttacttaattataatgtattttgttatgagttgttttatcacctatagtattttaagtgtgatttatatcttatatatttgtataaaatttttgaataagacgaatggttaaatatgtgagaaaaagttaatggcgtcatctattaaaaaactaaaggattatatgctaatgacttaggagtacatcgcttttcatgcagctaactagctaatcctaacagctatatagaacgcaccctaaacagccttttggaacaactagtttcttgttctctgttagcacttcttaaactttgaaatagtatgtttcgtgtaaaaaatttctataaaaaagtttcttgaaaaacaaataaattattttataagattacaataattacttaatttatcatgtgctgaggcttgtatcgtttcacctgccgtcgaaaattttagcctaaacacttaaacgaacttagccttaccaatacaacacatccactacagcatatacacctccagactcctgtgcacgggaaagggtcgtttcacttaacgtgcacgcatataactctatgtcgcgttcaaactaattgtttcacaagagtatctacgagataaaacccaattacctacccacgccccaacacaaacacaaactcgatcatctgactatatattcggcttttctataaatatatttatgcaaatatataaacataccagggatataatagtattgttttcactttcattagctaagtgaataaatgttatttgttgaagtttgagaaaaaaagacatcatacattaaaaacagaactagtattaaattataaatgatgaggagatttttgtttatgtttagctagcttctcaaataaccatagaaacatagagaaaccaataaattaattagttttttaaagtgaagtggggaaaggaaagtgaagagagtttttttagactgttcggattgttgttgtttttttttaggaagtaggcccggggaagtaagaacaagtttaatagtacagtccactactagctacaaattagctatagccaatataataactaatttatacaatagttgcttactatactattaataactggtcccacctgtcatacacacattacgtttttggagtccgtgctgcagctgactacagatctgtagcccactgctcttctttctcttcatttatctctttaaaatatatttgtagccagcttatagcctgctattgctctaattgacaaaaaaaaatgcaatagtttgtccaagtacattcacccttatgtggataccaattcatcattgaagctacaccgaattttgcatattttgtaaattgggagcaatacattcctaaattcattttttatgttattcctgacgtcatgaaactctacaggtatagctttgcatcctacgggctcttctacagggttataggcgtttgccacttgaaaagaatcggaatataagatttcagttgttttgtgaccctttgttcagttaagttggaccatcaatacaaccaccgaatttacaacgtcactccactaaatcctaaaacaagacatagatcagcttcggtgccattgtccgtcgccagaatctgaatctagggggggcatccctgattcagtcctcagtgttgtgaatatgcagtgtcgcattccagcttgggtcttcgcagtctcttcactgcattgtcgtcgaacagaagtaagtggctacagccaagggcactataaatggatggtttttagtatgtatctctttttccttagtatgtcacgttaattcccaagttggcaagaaatttgcaagatgcaccaataatagccgttgaaactttgttgtttgaccacaaaaggccagcctaagcaaacgaaaacaggaatggttataaaaaaacaatactatgtgagtatgtgtatatgtatatcacgattaaaaacaatatagtcaattaccgaggatgattattaggtcgaaaggcatatctttcaatagaaacacatattccctccgtactcgtaaaggaagtcattttggacagcgacatggtcttcaaaacacaactttgatttttttttctataaaaatatttattgaaaagtgatatatgtatacttttatgaaagtatttttcaagacaaatctattcatataatttttacattttcaaactcaacaacttgagagttattcatgatttatattatcaaggtttgacttaaacattgtcctaaatgacttcctttacgagtacggagggagcaaaagggtaaatatcctctatgttgaatgtgtgtttgtgctaccgcataaaaattctgagcatcggttgtcgagcgggccccatcaaatcatgccggctaacacaagccgacatggaggaggatccatgtcattcttcatttaatgtttgtagacttgaggtttgtacgcaccgggaactctgtcctgggcgctgcgcctcccgtcatcttgatgggacagggcatacctactgcactccgcctgagacccgagcggaccgcacgtggctttgccaccgtcccgtccgtcggtcaagattcggtcaagcgagcggcaggccacatttaatgtggcgaggcacgctcgttctgcccgcttcgcccgcactaaatgcgattaggtgggcgtggagggggcgtccacgaatcgtctttgcatggtggccatgtggtgaccagcccgagggttcggggccgacccctcaggttaggtacggacggcttccactcgttcacaggcgcgacccctcggggtgagtgccacgtggatgccaagggcgactcctcccttgtaagttcggtactcccggtaaccccgggcacatatcaccgacaaccgtcttatcttttaagacaccaaatttatatatacctatatacttataaaaaaatacgtaaggcttccgtttaggtttttgttagtcgtcgttcgtcactccgactctatccgcatcacgttccatcctcacataattcttttgtgtgtagccaacacccttgtcgacagccaatacgaaacagatactcccaccgtcatattttaagtgtagctgttggtttctctgcttaatgtttgaccgtccatcttatttaaaaaatataaaaaattaaaaaaataagtcactaataaaaaactactaattatgaaaaattttaaataagacgaatgatcaaacgttaaatatagaagctcatagctgcacttaaaaatacgatagagagagtacaaaataggatcagattctggttccaaaccaggactgtgggctatttccatggattctgctttgttgatcgagcccacgaggactagacccaccacggtccccgtttggaaactaaaaggctgatgagaggagaaaaaaatggggaagaaacgcaatcaaagcaaagatttatttactaagtacagtcccaaccctccacctaaaatagtttctatggcattaactatattaccatgtagaacttttagtttatgtggcactatattaattaagagagagagtgaagagaggaagaaactgggtctcatgtaagacccagcttcaacacaagaacctatgcactaaacactatcaagttttgcattggaaaagagtagtgtcttcataatagatgaagaattaatatgattgatagaaaagagagatgatgtatttattaatggcccactttaagaaatcatgggttgtggagtgtggtttctattgtgatgtcttattgatatggcaccatagacactgcttatagacactatgggttgggactgccctaatgagtaacaaatccatacacctgcagtctcctctgccacatcttttgacctcctaatccaccttctatccgtattccaggccagcattctaccacattagattgagtgattaggtagagaagaaaagtgaagaaagacgatgagccacccctaaatcaagaggcaacctccacataaatttcaagaaaagtgtgagagcattagagatattggtatttgtgtactagagatgatatattgtatggattgtctcttactttcttcgtttcacaatgtaagtcattctaacatttctcacattcatattgatgctaatgaatctagatagatatatatatgtctagattcattagcatcaatataaatgtaaaaaatgttaaaatgacttacattgtaaaacggagggagcagttcatgagtaaataaaatagataaatttgaaggtaatggtcatatctaccatagcacttaccattagtctcttccttcactaccatgcagtccatgctcactgagacaggagaaaaaatgataatttttggggattagagcgcggaggagggaagtgaaaggataatgacaccacgctagacatggccaatcgccactgatggaattatcgcggatgacacgaacagtcactctgccaaatcaccaacacctctcttgctcggtccaaaggagtcagaggacggtttagaggttagactgggggataatttgtctaaagtcactagctattatgactgatcaaatggatctgatggctctcagcgcaccgatgccgactcgggctatcacctgccactgggagtgctcgtagcatgtgaatgagagagatgggccacgctcatgtgtgtaaacaagctggctcgttttcacggcacatattttcaattacgagccgttttcttcatttcccagccatgttaaattggttttttatttattaaattagttttagcactctttgagtcattaaaaattactgaaaatcgaaataaaatttaaggctaaatttagttaaatattttttacggtgcagaattatttttctaaacaaagttgagttttcatgacattatgtttaatgacacaaatgtaaataaggtgtataaatttccaacatggtccttagcataatcacaaaaatatattttttcaaattcatgcaacctttaacgtaagcttatatttttcccgttacaatgcacgggcactattttctagtcaacataaagaattgaaaatccttgaaaaaattagacgtgatataacaagtaacttttgtaacatttgcggtatatttttcatacttcgaccgaaagatatggctgcctaatatccttcaattatccacgtgttacttgtatgcatgtaaatttggtcgtacatgtagcattcctcaccggaacccattcggtgccctagtccacttgttgctgacgatcgtgatgttccatgacgaaacaaaaaccatgacgggaaaagggcacagcaagctcgatttggaagcgtcgaatgtggaagcagcagtacgttggtgcaacaatttgggtgaagaatgggagattctagcggtcagatcctacaagctatacgtacgagtcgatcaatcaagtctaatcacccacttcaactagatgggcagatggtcgtgtggctcttgcacgttgcacgtctgcttgattggttggtctgacgccataagcgcatgatgatgtccccaaacatcaaaactgcgtgccaagaaaaaagaccgcgtacatgcgaggtatcacgagaagaatatgcatcagaaattcccaattccgtggtggtgtttggattcgagtactaaagttactttagtacatgtcacattaaatttttgaaaactaatttagagtattaaacatagactatttataaaactaattatataaatgagagctaattcatgagataaattttttaagcctaattaatccataattagataatgtttactgtagcatcacatagactaatcatgggttaattaggctcaatagattcgtctcgcgaattagtccagagttatagaataggttttgtcaatagtctacgtttaatacttctaattagtgttcaaatatccgatgtgataaaggactaaaaatcctatcacatcggatgtttgatattaattagaagtattaagcgtagactaataataaaactaattgcataaataagagctaattcacgagacaaattttttaaacctaattaatccataattagcacatgtttactatagcatcatataggctaatcatgtattattaattagtctcaatagatttgtctcgcgaattagtccagggttacaaaatgggtttttgttattagtctatatttaatatttctaattagtgttaaacatccgataaagtactaaaattttagccctgatccaaacagcccctcaggggattagtattgcactggtttccgattgatcatagttgaaagtggattagtattgcactggtcggtaccatgtgctttcacacttatgttaagcgcttgtgtatatgtccctcgctacaaaaatatagttatctttaaattttaaatttatttcaaatataactacataggattataaaaagttgatttttttcacctactttcccatcctaccgctatcaatctacttttcgtagtattatgttatatccaatcctataatgagttataatgagttgttatattttaagataaaggtaatatattacacaaccgcctagccctagattataatgagggttatttttacattgcacagtactccctccgtttcataatgtaagactttctaccattgctcatatttatatagatttaataaatctatacatacatatatctagattcattaacatccatatgaatgtgagcaatgctagaaagacttacattatgaaacggaggtagtagtttttattagtccttccaagtatttccctaccatgtgttggttttcttatagtccctccaagtgcttccataccatatgttttgtttgggaatgaggtgagataggttggactcatatgggatggtatctatccatttgacatgagaaataagatgattctactttttaagagaagacccatatgctagcgagagaaaaagttgggttgattttgtccgttagttttttatggaatatgtcaacccagatcttaggaatatcccctatcagtaaccatcccattccatttgttcttaaaccaaacaccatgaaaaataggttcaacccaatctgatctataccaacccttcaaccaaacatatgcttagtagctactccatccttttcaaattgatcatcatataatagaattcaaaatttttcaaattgataatcatataaccgcatggacacgtatttcatcaaaatacaattaatgtagcatgagaaaatgtgtgcatactaaggtgtagtatttggcatagtgttttaaacgatacatgcattgtgtgaaaatgtgtgcatggtatcttaattgatgtgatttaaattattcttggttttggtgcataaacatatcccctccattccaaattgatctacatatttcataggtacaccaagaccaagaaaagttaataactctctcatactatatttactctagcaacaaactcgatgcatacaccatccccactattttctagccaatagtaaatcaagatattacatgtgggttataaatacttgtgtgcatggatgcatgcatcaatgttcatttactccaatgcacaaataacaaatagacttaatgaatgaatataaatatgtagattatttagaaataacctaaaaaaaactatacgtagatcaatttggaacggagagagtatatgatatgatcaatttaggaaggagtgagtatattttgacactgagaggatagtttttcttttaagtagatgaatagaaattcggcatctatatccacagccaaaagttacatggataaaaaaattcaggccccaaaactaagaagcaacagaatatagcaaagaaaagacgagaagactaagcttcgatctttagctgcctcacgaaccctgtcgcgctaaaaaaccgcccgcttcacgtaccctgctgcgccaaaaaaccgcaccgtcttgatcttgatacacaactctcatccatatttcattcgtcactatgtccctaaaatcggccgaatccccatcgattcagatctgacaatttccagtccctagtgtcttcgctcaccgacgctatccagtggagacagagaagaagcccctccaatatagttttgcactgaaagacctacttgggatacttctccaggctactagtttttacattttgtttatgaacgtttgactaatatatcataacatctcaatcgatcatgaaaacaagatatcaattctacatgttacaccctttatttctctgaactacacgccgcaccttgcaaaatttagaaatacacctaagcctattaagtcaaataggtggcaaagtgaccacccacctttctttctttctttaatattcagagatacacggctgaacaaaatattcacagttttaaaattggacaaagagtccaacttacaagtattcagttgacagaagaacacgaaaccttcgaggagaaaagcaagcaagccactctggtacttagaagcagaacctctttttctgcatataatggatgaacacatatgaattggctagctcagtgttatgagatattctttacattttttttcctaatactatatgatgttgttgacttttagatatatggttgaccattcatcttattaagaaaactatgcaagtattatttattttgttatgatttatttttttattaaagatacttcaagcataacttatattttttatatttacactttttttaataaaacgaatggttaacgtatgttaaacattaatggcgtcatatatttaaaaacagagggagtacgatagaacagggatgtgtgcgaaccaaatcatgaagttccctttgactcaatctagtttaacttaaaaaaacacacacttagcaacaaagaataaattcatttttatataaactagcgggtcaataggtacttctgggtgaactcactcacatccataactaaagagtagttggcatcaagaacaagcatttctcaaaaggaaagagtaattcataggaaaaatccacaacttacccgaaattgaatattcttttgctggtcggcgtatgcaagcagttcgtccagcctcatcaatgcatcataaagcatctgctcatgggagaaacaaaggtcaatatggaaaatcgcaattttttgttcagttcttagttcttactatagcgaacaatcaagaaattcggtgaactgccaattcttgggtgtaatagtataacatatagaaacattacctcagaacagtagttatatccttgataccactaagcaataagctatctaacgagagtacatcttccttgtcacacatgcacacccacagagtgcatatgatatgtcaagactcaacagtaccttctttgtagatattagctcggcttccaatgcatcaacacggtgaatggctccattgagcaattcctctctatccggtggcatttgagattgctttgcttcaagctcctgtaatttctcctccaattcaccaagacgtctcaatacagacgaatgtgtactgttttctgtgaatccgggagaagatggaggtcaaaactcttccaaaaactcaatttcttgagggaactcagcactatagttaccacgggaaatggcctggcttgatagacttgcagtcactctgcttgggacagaacgaagcacggcaacaaagctcacgattaagactatcaaccacgcagtaattcgatttcgaagtcctcccagttccatcgttatgtttctcaacgagaacgaatctgtgtaaaacatgcaacaaactcagtcaaaatcactccaataaactcttggtgggcttaccggtcaccactcactacatactataatgtaatggcatgtttggtttgaggaatgagatgaccacttgatcttatacaggtcgcttggtttgaggaatggaatggatttgtccatcatctctaaaaagtacatactaaatgagaaactgagaaatggagtcattccactagatttgagagatggtcccatgatggatcacccattctagatagtttgattcctcaaaccaaacggccaacaaaattcccagtatctcacatttccctagttgcatatgggggtacgaatgtttgaaatcagcaagtagacaacttctcaataagaggtacaagtatgaaggtgtcatataaagacctgaattaaaagccattgagctggttgatggaccggcgcatgtgtccacagccttgtcaacaacagggatgtcctctactctgggaggggcaccagatgtggaagtatttcccggcaatttggactgcagaaatataaaaagatgcatttatgatcatatttaccaacataaagattgattaaggaggaagaaaattaagaatgccacatcattgtttagagcgagtactaatcagtaatctgagctcagccttgtgcagttgaaaagaccaatagaacgagtactaatcattaatatcagcctcgtgcagttgaaaaaaccaaaaggtacaagatcttgcctcgtcaacgggtgtcaaatgagggtttatgatggggttaactgaagctataggagatgaaacatcttccatttcagaactagactcagcagaggcatcgctgcattttttctgcgaggggatagaatcaagcttctaacggatagttgttattttaagatgatgtatgagtaatctccattcaaagcatgcttacagttaagtgtctagggttaatataacatattttcttcccatcaacgcttgatatagcaagaattttccgtccatagtttgcttcaccattaaggaccctctgaaaatcatagacacattattttagtgtacaggatttcttttcaaaaaaaaaaaggtgtacaggatgaataagaagaagggtagggttcaggaagagtggaagacctttattatgtcaggatccttccaaggacctttatctgattttatgcaacctccatgttcttcacacctgcatttgccacccagaaaatctggaagttcactgaaaacatgaattaaacaaaattattaggataggaaccaaactacagtatttgtgacagtagaaaagacctaacctctcatcaatagtttcaagtagcttattttggtatttgcttccaaggacctaggtgaaaaaagacagataaggctattatcacatactagaagtaaatattattctgaataacaattttcaatacttacatgaatcttcgaagcagtttgtggatcaagaaatgattttattgtaccccataacatcttgaagccttggccagcatttataatgtacaatcggtgcaaggtctgcacgagcactagaaaggtattagataagtcctttgttatgaccccagataaaaacaagttctatagaaatgtatatagtgacaaaaaacgaagtgaaagggcaatagtgaaaaataacattaaaacataatggaatcacctacctctggatagttgtcattgttgatcttctgaagtcgcatgattagctctcttgcatcttttgagaagttcttcaaacccttcacataaaaaacaagttaactactaatctacccagaaattttggcgatagcaagattggctataaaataacataccactccttgcacatccaagatagtactgcacgaatctatgtgcctttttgcagcaatggagcaagctggaaacctcatctgcaagcacttctcggactccttgacatgatactttacatatctgtcaatagttgtgacttgtactaatttgttgggatcaacttttccaattagttctatgtagacaggccttccctctttatccacaccatggtaaaattgtggatagcactccagaacatcatctaattcgctatagtcaaattcctaaatgatccagatgtcaaacttccagaagttacatgaagaaagactatcactacctacgtactggagcatatggtccagtctctgctttacctctatgttgtcagccccgaactccttcctccatctaagcatttccgaccacatatgttttgctttatcaatatcaaattttcgcgctttcaggaacctacatgtgtaacatgtcataggcacatgaagaaattttaaatcaaataagcaacgctgaataatctgcaggagtaaggagaaatccaagtaactgtgactctgagatcagaaaaaaattgcacctcaacatcacgtgataatcatcatgacgttctggcaacaagccctcatcatgtaagcactggtgaaatctttggacagcttccagctccttgacatcccttatgtcctctatagaggctacatggtcgccgaccctccttcttctcttccttctcaaggaacgcctaaatttatttccagcactgatagctcggttcttgaaggagactgccttggcctttttgtcaccttctgagttgtcctcatcggatttccactctttcttatcatcatcatgcacaatgccttcaaaacctgcacctgctatatagtttcaacgaaatgcccctcctcctaatcaggttgaaatggtaacaactacattgaaaataatcaatacgagagcagagtacataggagttgcaattaactgaaagcagcgcaattacacgcacgttaaaaaaattagggaggtgtgattataatctctacaggtgctaaactactactattaaaatttcaatcccactcgaacatgaactatttgtctatttccgagtgatttgccatgttctccacttgccccaatgaaccccctcacagaatcaatctctctgcaaccgcaattttccggtgttcgcgaatgacaagcaggtaagcattgcataaacgagaacgggcaacgcatggcggcatggagaaacaacgaatcatcagggaacacgcagtcgaaggaagaagggaaacagttcgcactcacagggccgatcgatggaccccgccatcttcgccttccccacccgcggtccgacctcgattcctcgcagggtaatcgagtccccgagcctcgccgctcgccgatgaaccagggtttccggcggaggaatgcgcggagacaagaggggcacgagaatggagagagatggctcgtttgaaattgattgtttttcttttgatttaagaggaatattttgatgcttttgttttgggggagaggggaagagaagcttctgttttcttttcatcggtggaggaaggggacagggcaagaggggagggggtgttacacgtatcctctcgtggaccgggtccataggctcgcaacaaccgcgacgctgcatcagcctgcacgtaggcgtgccacgtggccggctcacatcggctctggtccgtcgacctggcgagcgcgtgccacgcgtcgcgcatgggcgcacggtacgcccgtaatatgaggagatcgagccggtgtagagcggctagagcccactatggtgaaccagctccgtttgatctgcagatgccgatgcttatgagccgttgatttctccttggaggttctgattggcctgatcgggacacgctcgcaggctcgcagcagtggacggcgctggtgatttttttttccctttttttgagattcgctggtggggtttcacgtctatggagtatggacaaggttcaccgaaatttattctggacgtgacggttcgaggcttttgggccgggctggaacttgagagtacagttgttggttcgggccgaaacttagttcggagcaaaacaggtattcaccgcaaactaaataggcatacaaattcaaatcagaagcacgaggattcgtgtaaagcaatttgcttaacgttttgctaaaatcaatcgtgagtgacaaacatgggcaccttttgagtcaattttactaccaacgccaccacgaattgaaagcacccaaaatcatgttctagtatgtatatgtatctatgtataggttcttctgtaagtatttacaaagttcttcttgatgtttggctttatgcacttcaggcgggactagtatgtacacctcccttcaggaactgatcaagaaaagtgaattgtcatcctgtcagtttgatcgagctagtgtacgtgaaagttgacaaagaaattgactatatgaagatttcaagaatggcatgggcgactgttacctgttaaatcatgttctttttctttgcccggaacatgaaaagctgatctctgtattgagctgaaacagatgataccagatattag

SEQ ID NO: 65706 - DNA, 10306 bp, Oryza sativa
  unsure (1)..(10306): unsure at all n locations
cattttaagccaacaagagcttaccagcatctttgtagcgttcctcaacagcagcgaccagcatattgcggaccaaatcaaactcttgggcctcaaagcaaggttgatcgtcaggccttcaaatggtacgggatgcattagcagtgctttaaaataaacctttctttactgaaacctatgaagctacttttgttacaaacctgtcaagtcttgtgtattggaattggtctgagcttacatagctctcagatggtgttggttgtacaactttcaatccattgttatacgctatacgcctattcacttgtataggaacctatgtaaagttagaataaattggaatgagtatcataaacatccatttagcagcaaaacaccaagaagatcaggatttttccacattctttgactgctgtactcaaatcattggttacgaaaatttcctcaaatgatttaaaaggaaataaaaaggagtacctctagaagtattgcatgcaaatcatatcatccacaaataacaaggttaagcaacagcaccaaaaaatagatcacttttctgacaggacaagggaatcctgtttgctggttttacagttttgtggctagcgctcaaacagatagatgcatgttataatccccaacatgcaactaagtcacagcacttccaatattctgggattagcagccttaaaggaaatatggccagcactcagcaattaatcagaagcacagctgcacaggagatgaatgcacaccttacaccggaaagcaatgttgatggcatctgatggcttgagatctaagctaatagtctcctcttcattgccaatctggatatcatgacaccatacttcagacaaaagtaaaatagatactccctccgtactcgtaaagaaaatcgtttagaacaatgtttaagtcaaaccttaggaatataaatcatgaataactctcaagttgttgagtttgaaaatgtaaaaattatatgaatagatttgtcttgaaaaatactttcataaaagtatacatatatcacttttcaataaatatttttatagaaacaagaagtcaaagttgtgttttggagaccgtgttgctgtccaaaacgacttcctttacgagtatggagggagtagttcatgtgaagtcattttaccttagcaagatacaatcgagaatagtatgcatcatggaccatttctgtaatccgcaccaaacgtacctaaagggaacagatctgaagtaatcaagtaactgataaatgaacatattatatgacatttaagagaacagatctgcagaccgtgaactctggaaaacagctttccactaggacactttagaaaagatgtatgtattgtccgagtgcatgataaccagcatacattaagtaataaaactaaaatagtaacacacataagcacacccatgaaacactaaacagaaaacctaaaccatgaagccacacgaaagttgcaaaagaaagtctgcttataagatctcatcttaaactcaccgcatatcccatcctttcggtcatctcctttaccacattataaatagttggccttggctggaaagacagaatagtcatgcaaatcagatatagtacatgaaaacaatttaaaaccagaatcatgtggatgcttaacatctaacatatatttattaaagctacatccaactcttacaattcgaatgttccgaagggcagccagcaacataatacttggtgtttccactggaaaaaagtaatgtgagtatatcacacaattagaaaagcatctgcataagtggaaagcatgcccaagcaagaattaatacgtactgacgataattggaagcaaaagatcacttccatcttccatcttcagaacaatagcatggtgaggtgcagaatcccgcaatcttaatacccgcgggttgttttggacacatctaaggtttttgccatcacgcattttaatcacaaatccatcagatacacttctgagctcaactgcaaggacagataaaaccacaagtttaatctcagaaatgtacaatggttgtttggcaatcggcataaatgatatactagtgatatgtaactaatactgcaacagtagcttggcataaacggtatgtagctgatcaaacaacagcaactgtttcaaaggctcacagcgaacttcccaactcccaacaaacagtgggccggacccggacattgctcgaacgactatgcatcaaaacccaatgaagttacaagttacagtgtaacagaagtaagcaattaccagcctccatcacgctggagttgacgaactcctcgccgctggcgtcgtaatccgcggcagcggcgccgtccccgtcggaagacgagccgtaactgcaacaaacaggccagacccagccgcttcgcgcatgccgctcggacgggaaaccgaagaacctgcgcgccgcccggtagtggtctccctgcaacccacaggctcgtctcctcaggtgcacgcgcctaagcagctgcccgctgatcttcgcgtcggaggtcagggcgccggtcgccggagcagcatagcgcgggagaaccggcccgttgatgatctccatccttgaatttttaccataaaccaaaccgtcataaacgaactcaaaggcaacagaaacatcagaactcaacttggagaaaggaatcgatgcgattttcaccgaacgagaggtccaattagcgaaatgagaccacagcgaattggcagaaaccaccaaattgaagagttggacgttctagagattgagggatgaactagcttaccaccgatcctggcggggagaagggcctgaatgcctgatccgagctgaaagacgcaggaatttcggaggattttggtaaagtttttggctcgaaaattttttagccaaatgttaaaacccttatcgctaaacccgacggcttttatggcggatgcggttgnnnnnnnnnnnnnnnnnnnnnnnccttagatatttatggcagcagcggacgctttttaagggtgttttggggaatacggatgaccggatggagtggccatttctgtccgtttgactgtaatggagagatcgctccatcaggatattttttctttggatagaaagcgtaagcgtgatgtggaaaggcggaagatatttcatactatacgaagaatatacttcctccgtttcatgatgtaagagtttctagcattacttatattcatatagatgttaataaatttagacatatatatgtatttagattcactaacatctatataaatataggcaatgctaaaaagtcttacaatatgaaatggatggagtagctatttaacccaacaggagttctattttactattgttataaaatgtaacatatgaaggttgtatttgccaagtcccaagttggccaagtaacatcaacaacatgctacaatttttagtgggaaaattggaaccatgccattataattttgcaaaatttgttatatgccatcctgatccacatgtcattgactcatctagcattacttatatttatatagatgttaataaatttagacatatatatgtatttagattcactaacatctatataaatataggcaatgctaaaaagtcttacaatatgaaatggatggagtagctatttaacccaacaggagttctattttactattgttataaaatgtaacatatgaaggttgtatttgccaagtcccaagttggccaagtaacatcaacaacatgctacaatttttagtgggaaaattggaaccatgccattataattttgcaaaatttgttatatgccatcctgatccacatgtcattgactcatgtgggtcttacatgtcattgagataccgataacatatctcaaactttacaaagttataatggcatggtaaagtttatttcggtccttgaatttggctcaaagttcatttttcaccctaggtgctaaaaaataattgattttatatatacgtggtgcaatcgatcgcccaaccaccaaaaaaaaaagatggcatgtagatcatcacatgtaattgtgacaagtttgtggtgtttgagttcaacaaacaaaatttacttatattctagtatcaagatattttcagtgaaaagtactctctccatctcaatttgatcatcccctaaggtttctaagatcttcctaaaatgatcatcatttaactagtgtcttttcgtttatttatgaaatgagtaaatgtacatcattgcatgtgttgcatgtaactaaaattgattaatttctattagtgcaatatcataatatttaaaataagagcagttcacgggatacgaagcgatggaacaccttagcattaatttaagaatgatggatatgttggtgtccttggtcttggtacgctttgcttagaggatggtcaaactgggatggatggatggaaggagcattgaggacattaaaacaaatggatatatactatctatatagttactgaaaggtgaagatgtagcttagagggtgtagacccccgattttggaaatcggaaatcttctgtgtttatccgtaccaatctctggatcagtagttggtacacacatacatagttggatcacaacatatcacgaatgaattcaggctaaaagagttaaatacttacattagggccaggtaggccaacaactatcagagaacatcagcggaagacaaaataatataagggcccggttaacatgccacaggcagtcgactggggaacgagacctagaacaagaccgcactccgatcatcttgttggatacgcaagcgtaccgacaagggcttctcttcaacactctcctaaaagatatataaacagcaagggtgagtaccaaccatactcagcaagccaccacagcaacgatgcatatgatagagggtatttcaaggaatggcttcaggttcctttgcgcaaagcaagttttacaaatcttttcacaagcctaagacctagcatagactgatcaagttttaataccagtgttcacattaaacaacgatggttctgtccaccatccattgtaatcccaaggatagcttcccgccattgagtcgtcatggttttctgaggacgtccaccttccctcctctcaggaagtggctccatcagcataaaattcatcatgcaatatcccatcccacacaagttaagaatttagagtctagcgaagtgtaatacatgtcccggtgctcaataaccgtgagcacggctattcgaatagattggtttactcacactgcagtggatgtacactttacccgcactccgcaactgcccaatacatgagcctcgtcccaacacatgagatgtgtcacggcaaagcttttcgataacctcgcattggcagtacccgctccatgaacttttacatcctcatgcactctaggcgtatacggtttctagcagtaagaggagttctggcgcaccttggaagggaagactcacacatgcattaagttataattatgtttagattctcacatggcagtcctaccgatggcgacaccactgtagacacccgcctcgcggtcctaccaatggctgccccaccgtagagcccctgcctcacacatcaagaaaccactatgcatggatactgcctccgctcagctatctactccgctaggtctatacccatacgagaagtgcggttgtacggggggtcgtttcatacttaacttcatggctcggtccttaattgaccagggacggcactagccttttccggacaccacccaaatcctccagccgccccagtcgaaaacagttgtttcactttattttcctttcacaaatcatgtcatcaatatcatggcaatgtggcgctcatgtctccacatgccgcatttcaattaccttcccaaaggtaattgcccaagcatatagcatttgacaaatatgagtatacatgattctagagtggcatctctaagcatttgtcatagttgactagagactcatacgtaatcatggttacaagggaataaggttaaacaataatcaaggtatggcatattcacaaataggatgttcatcattgcatgcaatcttatttgtaaataaaaataatttcgcaattgggatcaacatgttcaaggaatagtgatgacttgcctgctcaggataatccttattattgatataatcttgatcaaccttcacctcctggaagttgcagacgttgcctcacgactaaccgatacacaaggtctataatacgcgagaaaaaccaatattcaaacaacaatcaaatatgcgcaacaaaatgtactattcgtgtttgctaatggatcccaatcatgctaaggctaaagtttcttaatctttctattgtcatcgtggcctatttaggagttaaccaacatagcatttatgggatacatatatatttggctaatcggtggtttagtctatcaaatagctatggaaggattatggctacgtatgcatatatctaaatagcacggttacatatcagaggttctgttgttagatggatttaggatcaatcaaataattacagtgaatcatttgtattattattttattgatggaagctttactttaattatgaacatattttacttgccattataaattataaaagggctaataattatccatgctctatatgttaaattcgggaggtttataatattatagttacagattatctcttaatgaacaatccggagttacaattgaactatgaacatatgaggtcaagatttataattagtacttatctactatgcatgtttgttatatactccccagtttaatatatgaaaaagataaattaattgtataactataatgggatgtccaatatatgtgtgcaacaacgtataatgttttggtcgcctactgtacatgagcttatttagaaagtgtactacccaatgctccaagtgattcctgaatatattgtagtttaattatacattagctagtttctatgagtgatattgtatatgtgatgcgacaagtttaagcactggttctattgggttactaataagtggtaatcaatttaggcatatatatgctattctatatggtattgcatcgattaatttacttagtgattcctccacatttagctctattattattctcctaaacagattcatctatgtgtgtttatattttagttacataatcataaggctacacttgatttaaataacctataagccatggatttaattatatggccatcgaatattaaataagtactagtattttccaatacatccattcatttgagacatcacataaaattagtttgtgtggttgttacagtggcaagacatgttagagacaaatattattacatctactctaccgtacaatactaattttatttattaacatatttttaagttgactattatgcatcatcttgatattaattatttaatatttataaatatattttatcaaatagtgaattatatatcattggaaagcttatgaatttagatgaatttaggttcaagtttcactcaaatcggagctaaaatgaataagttatgctagtgtaaagattcaaatttgaataaatccgagaaattgtaaaaaggcactgttcctaattcatttatttataatacaaccttatccacaagctatagtgactgacaggtggggtcttcctattttctttttcttttcttttatttttcttcctaaaggaatttataggagcaaatgacaggtggggcccactctaccctctcttctcttttctccctctccctttctctgtcttctcctctctctctcacggccgagcggcgcgtcgcggctaccggcaacgaagggagggggcggaaggcttaccgacggcggcggcggcgacggtggcggcggcggcggcgacgcacggcgcggcacacggcgcggcgcggcggtactgagggcggcggcgcggtggagaggaaagaggggaggaagaggggaatggggaaatggtgtggggtggaaagggggtggccggggggactttatagggcgcagggagggggtggccgggcctaatggcgacgcgacggcacgcacggggctcggggcggcgacgtgacgcgcgcggcggcactgggctcaaggcgcggcggcggctcctggcttggcgacggcacgcggccgggcgggggcgcggggcgcgaggcggcaggcacgcgacacggcgacgggacggcggtgcggcgacggaacgggcgcgcggcgcggcgatgggacggtcatgcggcgtcaggcggcgatggcaacggcgcgcggcagcaggcggcgacagcggcgacgcgacggcgcggcgcggagctcggcgcggcgcggcacggggctcggcgtgacggcgacggcgatgcgatgacgacgcggcgcggggcgcgaggcggcggagcgacggaccagcggcgcgtgggcgcggggcgcgaggcgacgatgagacggacgagcggcgacgggacggccgacggcgacggcgcggcagcggcgacgcgacggcgggcggcgtggcgcggggcgcgaggcagccaggcgcgtgcggctgaggagggggaaaatagagccagggaccacgtcgagcacctagagtgcaatgaacagtgccattttctatttaacccgattttagtttatcccttgtataaatttcattctataaatcctaatttttacataaatgaggtttacccaatatatgttttaattttagatgaaagtttaccaaattttaatattacccatattttattcttatatatatttttctattgtattatttaaatgaggtctaattctaaaattagcctagataattttggaggctttgagggttctaaaatatcctagtgtggcccttattattacaatagcacattgaatgaacttatagcaatatattttacacggataggttgaatctatttattctataaatagtatattaagactcggtacaacattaatctaattttaaacactcacatattcttgtttatatataaggattaatttatttatatgaccattattttatatgagtgattttcatgtcatgagtaactcggcgacatgttgcaagtatcgatctatatattccggtgaattacttatttataaacacgatcactatagtggtgatcatcatttcatgtgttcttatatttcatgtgagattggattcaaatgaattggatttaatcttactatttctttagctaattgtgacatcaagctatcaatcatggttcgaatatttaatacctgatttgtaatttgtaatagaaattaatatttgactttactatcttttgcataattatttgtaggattaaatatattctcgtaaattatatctattgcttaaatatcgatcttttcttttctttctttgtgatcatttacggtttggcaagccatagcaatcataacaaccagcatgatgcaaaagttttaaaaagtttgaaattttagtgatttttattgttagggattttcaggatgttacagaggggggtgaataggctaacctgaaaatcactaaaaaaatcgtaacgatcaaatttaaacaggacccgcgaacttcctagtgatgaacaccggaacttcctggtagctataggcagctcggaacttccggagttcaagaacaggaacttccgggtactggaaatactgagaaaatacttcaaaagagagagaacaacaggtcctattaggtcaatatggttcacagtagactatagcagtatataaaacataggggcaagcacaaagcattcacggaagagataaagaggatttttttcccaaagttcggatgcacggatcctactctcctttgaggagcttcaaaaagctgggtctcaattaaacccttgcctctcttgtgcaaagatcctagaagaggtccacagccttcaatccaacacccctagatccttctctagaagttgagtgaccaccaagatccaactcaaccttctagagacaaccacaagtgaggtttgctctactaggactacctctaaaaactcggcacaatttctttactcacttaccttgtttccttgcggaggtgaggaatacattcacaaacttgcccgggtcaatccacaatcttgacggaaactcgcgggcgacacctaaccgtctatgagatgaatctccaagtgtcggtgacatgggaccgggggtatcttgactagaggtttggggcagctgcagtcacccacgtggcctgaccccctcggggggggggggg

SEQ ID NO: 65707 - DNA, 23277 bp, Oryza sativa
gtaggtagaagtggtgcatgtagtatccccttgagatataaaaggaggaccttgcccaccaaaaagagaggagggagggggagtgagaggggttctggagcctgaactctctggctctccggctctctgtaaatccttcacacacagatccaccagaacacaggactagggtattacgcttctcagcggcccgaacctgtctacatcgcccgtgtctcgtgcacttgctctctcgcgaacattctccagatagatcgagggcgaagaacctcacttagcgcccccggccgaaccggcaaaggggggcctgcgcggtctcccggtgaggagccccacgctccgtcatctggcgcgccaggtagggggcgcgtgtgtttttctaagccctcgtcctctttcgtgtgcgccaagcttctcccgctcagcccaatggccgaacgggcagtggcgcacaatctctctccgagcgctagcggtgaagacggggagcagaacccgcgccgtcgagctcgtactccactgtccccctctcgccgaagtcttgggcgggaggaggcgctcgaggaggtcgaaagatccgcgacttcgccgcacgcgggcgatggagaaggacggcgagacggggagcgtcgtctcctcgtctacggtgatggcagcacgccccagggcgcgctccaggctgcgggcgcgctcctgcgtcacccgcccgtcatccctgatccagagactccaacccgacgttggctagatgacgtggccaatttggtcatgacggcgcagcagcgcctaggcgccggctggtggtcctccgccaccaaggccactggcgttgctactgctggctccgtgtcgtcgaggcggagggcgcggcgagcggcggccgctacccgccgttcgtccgccattccctcgtcaacgcctccaacccaagaagatgtgcgtagggggccagatgcccgcttcaatatcgagcgccggtgcaatgatcgccgtgctgcccacgcatcggagggcgcttcctcgtccggagcgccacttcggtccgggcacgggggccagccccctgtgtccccagttggcggtgccggctgtcgagcctttgtggcgagccttcggaacgtccgttggcccccaaggttccggcccaccatcaccgaaaaatacgacggaagcatcaacccctccgagtttctccagatctacacgactgggatcgaggccaccgggggtgacgacagggtcatggcgaatttcttccccatggccctgaaaggacaggcgcggggttggctaatgaacttgccacccgcgtcggtccactcttgggaggatttgtgccagcagttcactatgaacttccagggcacatatccgcgcccaggtgaagaagcggacttgcacgcggtacagcgaggggacgatgagtctcttcgctcatacattcagcggttttgtcaagtccgcaacaccataccgtgcatccctgcacacgcggtgatctacgcgttcagggggggcgtgcgccacaaccgcatgctcgagaagatcgcctccaaggagccccagaccaccgcggagctttttcagctcgcggaccgtgtggctcgcaaggaggaggcctggacctggaactcctccggttccggtgtggcagcttcggccgcccccggatccgccgctcggtcagggcgacgggacaggaggaggaagaagaggtcggcccattccgacgacgagggtcacgtcctcgccgtcgagggcgctttgcgggccacccgaaaggggaggcctgcgagcgacaaaaagaaggaggccggcgctcccagcagggagcgcccgaccagcaagtggtgcaccgtgcacaacacctccctccacgacctcgcggactgccgcgcggtcaaaagtttggctgagcggacgaggaagtgggaggaggagaggaggcaggagcgccgtgagggcaataccccggcggctcccgccggcaaccggcgaggtgaggccaagcagaaggcccccgccgaggacatcaacgatggcgacgatgacctagggttccaggagcctgaggccactgtcgccaccgttgatgggggagcgtgtgctcacgcttctcgccggagcctcaaggccatgaagcgagagcttctggccgtggcccctacccatgaggcgacgcggcgggcgcggtggtcggaggttgccctcaccttcgaccagaccgaccacccaccgtgcgttgcccggggaggacagatcgcgatggtggtttcccccaccgtttgcaatgtgaagttggggcgtgtcctcgttgacgggggtgcagccctcaacatcctttcccccgctgcctttgacgccatcaaggccccggggatggtgctccggtcgtcccagccaatcatcggtgtgacgccggggcacacttggccgctaggccatatcgacctcccggtcaccttcggtggttccgccaacttccgcacggagcgggtgaacttcgatgtggcggacctcagtctgccctacaacgcggtcctggggaggcccgcgttggtgaagttcatggtggcggtccactacgcatatctccagatgaagatgccgggccccggtggccccatcaccgtccatggcgacctcaaagtcgcgcttgcttgcatggagcagcgcgcggaccacctcgccgtggcatccaagcccgcgggtggcgacgagaggctcagcacctccgtcccagccgccccgaggcagcggatgatcacgtgcgacgaggtcccgatcaagcaggttgccctgggcgacggcccgtccaagaccacacgaatcggtggtcttctggacgacaaataggaagacgcgctcgtctccttcctgcgggcaaacgccgacgtcttcgcctggagaccagcggacatgcccggggtccccagggaggtgattgagcaccgtctcaccgtacggccgggcgcaaggccggtccggcagaaagtgcggcggcaggccccggaacgtcaagccttcatccgcgaggaggtggcgcgacttctggaggccggattcatccgagaggtcatccatccgaagtggctggcgaacccggtcgtcgttcccaaggcgaacggcaagcttcggatgtgcatcgactacaccgaccttaacaaggcatgtcctaaggacccttaccccctgccacgcataaatcagattgtcgactccaccgcggggtgcgaccttttgtgttttctagatgcatactctggttatcatcagattcgcatggctagggaggatgaggaaaaaactgcattcattacccccataggaacttattgttatacgacaatgcattttgggttaaagaatgcaggtcctacttttcaacgtactactcgaatttctttgggtagccaaataggacgtaatgttgaggcctatgttgatgacttggttgtgaaaacacgcaaccaggagaccttactcggatctagcggaaactttcgaaagtctccgcaccgcccgcataaagctgaaccccgacaagtgcgtgttcggcgtgcctgcgggcaagcttctcgggttcttgatctctgcccgaggcattgaggccaaccccgagaagatacgagctatagagcggatgcgcccccccagcaagcttagggatgtgcaatgcgtcactggctgtatggccgccctaagtcggttcatatcgaggctgggagagaaggcgctacccctatttaagctcctcaaacgctccgggccgtttatctggacggaggaggctgaacgggccctcactcagttgaaggcgtacctcagttctcccccagtcctggtcgccccggagccagatgagccgttgctactctacctggcggcaactccgcaggtggtcagcgcggcgttggtcatggagcgcgacgaggacgaccctcgctccgcgcatccccaccctgtgtcgactcgacccgggagagagcagggaggagaggcccccgagccgaacggcggcccgaggcccccgacgaccggagctggccctctgcccgcttgtccgacggtgccaggcgcccccgacccccaggatggccccggggccactgcgggaaggccgcgcctgtcgccttccgaccccgaggtcgtcgacacagaagccgagtgcgccccgcgcggcctctcggacgaaaagcgccctatagatgcggcccctggcgaagaggatcggccccgacaaaaggtgcagcggcccgtctactttgttagtgaggccttccgggacgccaagacccgataccctcaggcccagaagatgctttacgctattctgatggcttcgaggaagttgcgccattatttccaggcgcatcgggtcacggtggttacgtcctaccccctcggccaaatcttgcataaccgagagggtactggacgggtggtgaaatgggcaatcgaactctctgagttcgatttgcactttgaaccacgccacgcgatcaagagccaggccctcgccgactttgtggcagagtggacaccggctcccgagcccgtctccatccccgaggccagctcgggcccttcgcagctgcctcacaccgcctattgggtgatgcagttcgacggctccctgtctcttcagggcgccggtgcgggggtcacgttgacctcgccgagcggagatgtcctcaaatacctggtccgccttgactttcgggcaaccaacaatatggcagagtacgagggactccttgcgggactcagagtggcggctggactggggatccgccgcctcctggtgtgaggtgactctcagttggttgttaaccaggtctccaaggagtaccagtgctctgacccgcagatggatgcttacgtgcgccaggtgcggcgtatggagcgccattttgacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgagcctgaacggcccccgaggcccgtcggagtccaggcctcgggacccgaggggggcgctcccagctcccttagattgattgcttggatcgctgagatccaggcgtacctcgcagataagactctacccgaggaccgcgaagggagtgaacgcgtccagcgcatctccaagcgctacgtgctggtggaagggaccctctatcggcacgcggctaacggagtcctcctgaagtgcattcctcgggaacaaggcgtcgagcttcttgccgatatccatgaaggcgagtgcggagcccactctgcctcacgcaccttggttggcaaggcctttcgccagggtttctattggccgacggctctcaacgatgcgatcgacctggtctggcggtgcagggcgtgccagttccatgccaagcaaacccatcagccggcccaggccctgcagaccatacctctttcatggccgtttgctgtctgggggctcgatatcctgggtccgtttagacgggccccgggcgggttcgagtatctgtatgtcgctttcgacaagttcactaagtggcccgaggcttatccggtcatcaagatcgataagcactccgcacttaaattcatcaggggtatcactgctcggtttggggtgcctaaccgtatcattacggataacggcacccagttcactagtgagctcttcggtgactactgcgaagacatgggcattaagctctgcttcgcctctcccgcccaccctagaagcaatggccaagtggagcgcgccaacgcagaaatcctcaagggcctcaaaaccaagaccttcaacatcctcaagaagcatggcgactcgtggatcgaggagctgccagcggtgctctgggcgaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagcatcgcagagatgacctcgacttcttggaagaacgaaggcggcgcgcggcccttcgagccgcgcgctaccagcagagcctgcggcgctaccatcagcgtcacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccatagaatatcgaacaccttcgtcgcttctacccctagtgggggtcgggtgtcaggtctcgggctcgggccaaccccgcacccccctcgggcgtgcagggttggccgggggctaccacatatgcatatacttatcttttttctcttccgtatttcaataaaagctttttcgattttctaaggattgtgtctgtgccattgtttccttttgaagagttttggcttgaattagcacgctcgtgctcgaccctgccctcggtggcccgggccggcggaaatcgccaaagggggcccagaaccgagccgtgccccggggcgtggtgaactccgggggggaatcggcaaaggcccacaatcgggtccccataaccctcggtcaccgcgctcccggcctagccagtctcgacatgtgcatctccccaggcactagccccgacccgcgccgtttgaggctgggacctgggcacgagcccttgttcaagccaagacacagaaggaccgcggcacagaccatcctcgtctcatacacacaacaaataaaattgacacagaaatttcttctttatttgattgcagattaaattagtttatacaagaaggaggcccgaaggcctcggaagaagaaaggaaaaactatttaagattggcgggggcctgggggctcacttcgaggctcccgggtcaccggcctcgtggtcgctgtcgtccacaccaccgtcgccgccctcctcgtcggagtcgagggcgaacgcgagctgaggggccgtaccctcgaagctgtggacgatgtggtcggcggcgtcccggacctgcgcgcgcgcgcgtcgtcctcggttccgggagggaactcgtccagcgctgcccacggggagaagtccgggtccctggcctggtagcttgccagtacaagctccactactccccgggcgaggtctctcgaggatgacttgatcgtctcctcgagctcctcggggagccgctggagagtcccggccatctctgagaggcgctgggcgaggcccccctggttggcggcgtacttcgcggtccgctcgccccagaggcccgcttgccgcccggcgcggtctagacgggagacggcgtcccgaagcatgccgggccctacctcgcccgccaagcggagggcctcgacctccccggcggacgagtccagcgcgccctgcagatcggcgatggtgtgttcggcagctacgaggcgggcggctagatcgctgtcgcccgcggccgccccaccgctgcgcgccctcgcgtccagctccttcgcccgcgcctcgagctcagcggcccgctgatccagtgcggccctctcggcgcgggcgccttccagattacggcgcgcctgctcctcccgcgctgcctcgcggagggacaggctgtccgccagccgctgcgccgcggcctcggcctcctcgagagctcgctcccgctcggtgagcgcatcctcgtggaggcggagtgcggactcctcttcggcgcaggcggcctcgtgcgccgccagcgttgcctcccggatagcgacggcggtctcgcggtccgccaggtccctctccctcgcgcgggcgcgctcttccagcgccgtggcgcgagcctcaagggccacttcgcgccgccgggacgccgcctcgttctccgtcgcccgccattcccgtgcagtggcggcgtcaaggactccccgggcggcgtcgagtttcttctctagctccgccacccggctcccgtattgaaggcggagatcgtcccgcgcctcgttgagcacggcggtggcgatgagggcagtctcccgctcctcctccacctccctggcgatctccgccagctccctccgacgggcctcgagctctgaggcgtgccggcggtatgccttgcggcccgcctccaccatggcctccaccgagcgccgcccctcttcgacgcgcgcccacgccgcgtcgagctccgcccgctctgcttgcaggacctccatctgggcacctaacccgtccagcaccgtcgtgttcgcggcggccagggcctgcaggaggggctctgtgttcaatggggcggcggaaggcagaggggagagccgcctcggtgtgggcgctgtgcggctcggcccgccaatcgacgtgccggactcaggggcgtcccccgaggctggctcgtcccgaacatcgcccgaagggtcgggtccgagcggtgcgcccgcggcctcgtcgtgggtggcctcggaagtcgtcgtcgcctcgggcggagtcgggtcgggggcttggcaggccgcctggcgtgcgcacgtcgcctctgcctcccgggctgacttcccggcccggtggagtctggcctcctcccgagcggcctcctcagcctggcaaacccggacggcttcctgggcagcctcctcagcttcccggaggcggtccgcggcttctcgccggatagcttcccgcctccgggcctccgcggtcgctgtctccttggcctcagaccggccggacttggaatggcgaggggggcgcgacggaatctcgctgaaagcggaagaaaaaccagaagacaaaaggaaacgggtaagtgaaaactcgccttgggagaatgaatacggccgcagtgggcgcggggacgaacctgcgaggaggtcggctaaacgaccaccttgggggggagatgaggtttccccggcatggttcggtcccccccatcttgcggagccgcttcttttttcgctccctctcgggctgcgacgtcggcacagcaccctccgggcgcctgctgctggcacgcaccgccccgccccctcggggaggagatggagagggggtatcctcctgtttcctcttcccccgggcgtcggcagggcggctgccccccgggcccccgtcacggggcccagaagcatgaccccctcccggggtagattgttcccccctgcggctcccgcccgtgccatcgtggcctcgaggagcccactcccctgacgccccgaccgcctgcatgatggtcaggatgttggcgcgctctggatcgctgcagagggggaggacaccttgggggatgagggatgcctccacggagctgagattcagcacccgttggaccaccatcttgaagtcctcaggggcccagtcccatctgcccccctggtgggtcctcatgtagtccttagacccggtgtactcccaggcgccccgggcgcgccgctggagtggcgcgatccggcgatgaaggtagtcaccgaacaccatggcccccgtgagcccctgggatcgcagacccgccaggcagtcaagaacggcgtcgtagccatctcccagatctaccggcgcccgccagctggaggcctgcgctgggggctggctcggaagtcggaggcgcgcttcgtcggcgagaggggtgtagaaccagtcgctcttccagtcgtcccacttcttgcgaaggacgcagggaatgtagcagttcagcaccggcccccgcggctggaagtagcagccaccgactaccgacggtggcgacaccggctgtacggtgaagaaccaccggaacagccggagagatgggcgcaccccgatgaacatctcgcataggtgcgcgaagatggccaacgtcattaccgcgttgggggtgaggtgcgccatctggagatcataaagctccagaacatccatgaagaaagaagagaatggcgggaccagccctgccattgcgaaagagaggaagaagacggaccgccccgggtaatgcggcgccgggcgtccctcgcccagcgcgaccacctcccggccggtggcagattccggcatgaatcggcgcggcagcccggcctgcctctcgctcacgatgcgggaaggcggcagcacgctaccctcgagcggtgcggagccccgtgccatgacgccggcggaggaggagcttgagagcgagcgagtatggcaagggtagggcgccggaaacggagagtcagagcacaagtggcaaaggcaaagggaagagtgacgagaggaaggaaacaaatcccttccttgatgtcttagtacccttgccaacgctatgcccggctcctcgatccccgcgcccactacctcgccccctcgtctctcgcgcccacgcctccactaatcccgctcgcccgtttgcggcgcacgaggcggatgtgcggccatggcagtcgagatgggacatatcgtgcgcgcgttaactacgctcgccgaccgatgcaccgtcatcacatctccaggcgaaacgaaccagctcgtcccggttcgcgcgctacttaagtaatgtagcggtcttgaaggaagccgctcattattgtcggtcggttttttccttgacgatgtgcgcgatttgcgaccgctgggtttctgccgcctgtggagaccggccccacctgtcaccaggtctaaggagtggcgtcacgcccgagcgcttccctcgggggggcgatcgccctagcgtaacgccgggggctactgtcggtgacatgggaccgggggtatcttgactagaggtttggggcagctgcagtcacccacgtggcctgaccccctcgggggggggtcgggcccgagggtgatgtggccgcccctccctctgtctccccgaggggtcgggccgctcccgtttcggccccgagggctggggcgccccggccccctgtgggtttggcgccacgtgtgtgggttaggtgagcacagcggcgctcacctaaccgcgtttattgcgggttggacgagcgccccatgtcgcatttaatgcagcgcagcacactcattcggtccgtgacaggtcacagtgtgtgaccggtcacagaccggtcagatcgcgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctgaactgacacgtggtggacaagaatgaccggtctatgactggtctgacgctggtcacgtcattggcagacaactgtgctcccgcgatgcatctgcctccggtggagtggaggtaggtatgacccatctcgtcggatggtcatttggaaagcagccatggcaaatctccgcccattaatgagggagtaacagggagatccccggtgtcaggcgagagacggcgctgagcctcactcaaggacaagttgtgatttagcttccaggcgaaggtgcaagccaagttttggtcaagatagggtaggtccccacccagaagaaaagtaggtagaagtggtgcatgtagtatccccttgagatataaaaggaggaccttgcccaccaaaaagagaggagggaggggaagcgagaggggttctggagcctgaactctctggctctccggctctctgtaaatccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgcccccggccgaaccggcaaaggggggcctgcgcggtctcccggtgaggagccccacgctccgtcaccaagagtaagtgctcaaaccatcctagccttcaaaaccttctccaatccttaccttcaccctcaaaatcactctcacacacaagaagggctcaagattggggtggagagagcaaaatcacattgcgaaaagctagaaaccactaaggaacagaagagcaaaagtgaaatggcaaaagagtgagttagggtcgagtttgatatatataacggctagatgatgtcatctagctgttactcacatttttgaaccggaatgttgcccggaagttccggtccttggtgccaggaactttcggtcatcatttaggaaattttcttcatttctcctcggcccggaagttccggacatgggggcctaaagcttccagacatgctttgctatcttgaggaggctatttccaaaaatagctcctaaaaatatttcaactgttggatatagctaagggcacttagagtatctcagaaccacacttgaaacccctcttaatagtaaggtttttcctaaactcaaagtgaaaaattaaactagcctaactcggctccaattcttttcaccactttgaatttgatgatttgggggctccaagcatcctagccacctcgtaagcaacctgggactaatacacctgcatttactcagtaaaatcataagtcccttaatcattttgtcattaatcaccaaaacccacataggaggggggttaggtgcacttttagttacaacccaccacattctaaaacttaacatgtaaagatgtcacatcatcattcactggcaattattgtatcttcaagttgtgtttgtttcctaaggttcccaacctccagtatctcgtttccgcacgcacagttatgttttttttaaaaaaaaatacagaaattgcttaaaaaatatattaatctattttttttaagtttgctatgttttccatgcatgggattagtctccactccgcactaaagaatacaggcatactacgttatttataatttgttgtattttagagatttaaaatattagcatgttaaatcatcattacacatcatctacatagcatttcaatatatatatcaattcattatatttctacgatatccagtatattgcatccccacttaattaattgtttatctcttctctcattaagccacgacactttaattgtttctatcccttggatgactactctatgctttaagttatctctcattttcttctctcatgaagtcacaccaccttacttttgcttttggtcaattattaatatatactagaaaatcggcacgccttgctagtataatccatgctaagatccttttcaaaaaaaatattgaagatattttgctagccttaatccaatttctgtaaaatcctttaatttgtttcaatcagtgtcaaacgaacgatgattgtataaagaaaatactccctccatctcattttgatcatctcctaagcaaatggtaccaaaaccaataacatcaacgcattcatcattctaaaattaatccgcatcgatgaatgtgctatatcccctcgtgtccaacataaattaattcacgctttaaatgttgcatgggttgaaccaatagaaattaatattggttgaccgaatgtgtatagttgcatgcatgcatgcagggcattccacgatgtgcatttactctttgtacaaataaataaagagacactttgttagatgatcatcattttgagaaaacctcaaaaacttaggcgatgatcaaactgggagagagggagtatgtttgactagctctgttacttgttcttacaaaaaaaaaactcgagttatgatttactaactcaattcaacctaatttttcaataaattcaattgaacccaagttgtgtgtcctcttaaactccacaactccttagatttgccattgcgcaacaatagctcgctgtccagcacaaggttagcgttgctgtgctctcagctatcaaccattggcattttgtctcattggtatatggaagtagcgagggcgtcaacgtgagcttgacaggggtttaccatcaccatcaaggcgacgatggtgtcgtagccgaaaggcaagtgagactttttttccacaatgtttgatttcttatagagtttttcttaacaatggatttatatttgatcgagaggttcaaggaatgcaaatttatttgattgctaatgagaagataattgttttgtttttcagcacaccaatgatccctagatttatcttaatgtctatgtgtgttgtgagcagggaagatactaaaagttgaaaccctgtttatctcgatttttaacttcacacacatcaggatctatctagatccttcacttcaagggtatctgtatccttttgtcgacggggatacccataaaccggataaatagagtattagggtatgttggtacgaggatctacacgatacaacatcaagcaaacgaaaagacaaggattatactggttcgggccctcgtaaggtaatagccctaatccagtttatatatatgagatagatatgaaaaaaccacatattacaatagaagaccaataatcctgggattatcggcgagacccttgtcgttggcgagacccttgtcgttggcgagacccttgtcgagatggtttcaacgagatctcatggcgagtaggcttcacgtcctccggattgtaggctatggtggtggtgctggcgctatgattcggtcatctaaacccctcagggggtatgccttttacaccgtgaatcaccttagtcttcaagtagaactcggagactacggaccccgcatgatatagtataaacccgattctctccaagtaggactctgctattcacttgctgtcacaccccaatctggcaccgccggacaacggcacctgataggagcgtgtcataggaaaaacggcgcgaactgcttcctacgaaactgcgatcacagtaccagtcccaggacttagcactggtacccacggtgacaaatatgaatcattgcaatccttaaatttaatagagaacttatttaccttaacttaggttgcagctcaggacagcctgagaatacaaccgacgacgcggacgaggaaacatcaacagcagcagcagcagcggaaccaatgaactaacacctaacaccacaggcgacggctgggaaccaggacgaaaccttaatcttcacttcacttcatcttgacttcaaggcagaggaactatatttatatagagcaagggtgagtactttcgcactcagcaagtcacgggaatttaggtgtctgatgcaagcttggaagagaggcaaggttgttttgcaaatcttttgttttggaaatcattttgaaatcactaagtgatttatttctttctaagtttgggccaaaaagagatttgtgtctcgattcgactttaagagatgtttttcaacagctcatttggtaatgtaccgacctcccggttcagatcattacttctcggctcccagagccatttcacttgattaatcggctcccaaagccttttcattttctcggactcccagagtccagctgcccagcagcacaacaatccgcttccactcaggaagcctagtctatgatgcccgtagacatcccgaatcacacagattcgtttcttgaccactcaggtcatccatctgccacataggctgattctggtaacgattcccaaaccacaacaacttttcacaaagcacaggcaaacaaatctacgctacaggaaacacctcacatccgcccatgaccgtgggcacggctgttcgaacagttagttaacctctgcagaggaggtacactttacccacacgacattactaacctggatcacccagccggagaccctaaggccgagataacgggccggccagcctaaggagacacggcccattagggcgcgcgggaggcgaggagagagggaaccgatggaccgggctcacctcgcgtggtcccgagtgggacccgcttgttagcggctcggctcaccgtgagcggggcgcacgcggagcgcgctagggtttgggagggggagtcgcagcgcacgtgcggtttgcggtggacgcggatgcggcgggcccacgagcagcctcatggctcgcggtggaccgcgcgcgcgcgagcgggggtgcaggggagcgttggaccagggtcagccttgaaccggtcgcagccgagatggcgccgacgtggcgccttcgtggcagccacgcgggccagcgggaggaggaagaaggggaaggccgagatggacggcggacggcggccgagttcaccggagctcgacaagacgactatggtcaagggggagcacaccggattggcgagcggcacaagagaggacgagccaatggctcggatcgcgccgggagaggtcaagggcggtggattgcgacggcggcggctggcggcgtgcaaaaggggaaaaactggcggggcggcgagggttcgattcaaggcgtcgggagcatctccgttgttcggggaactcattctcggggtcggatgggacggaggggcctcgagggaggccgacgagcggcggctccccggaacgggtggcaatggtggcgaggccatgccgggcggcggcggggcttcgtctacgcgcgttcaggagggctaccgagctaccacgcgagctaaaagagggagagggcaagcgagaagggagaacggagggaggcactaccgagccgagacgggcgctgtgacgagcggccgacggcgcggggcatgatcgctacggcctcgggccggggaagaggaagatgagggtgcccggagtccgcgttagctcctcgcgcgcacgccggcttcaccagcacacacggcggcggagggaggcaaggacagcggcagcaaggcggcgagggtggcaagaacagagagagagagcaggcgagcggcttggctgtggttttataggcgtggggtgtggagcttcgaggggaaggaaccgagcacgggcagtcaaggggagctcggttgggtcaaggtgggggcgacagtggaggtgacaatggcgctggtcagggaaaaagaagaaaaggggagagaaagggagctctgcccatgccattttgggagaaaggaggagggagagagcgcgagctctggctccgcgttttggaagcatgcggcatgggggcgtcgggactgggcgatgacagcggcgatgactgcaaaaaagcgagcggggttcggcggctgcacggcgtaggcgtggcagggctgacgcggcggcgactgggcggcagcgcgggcacgggcggcgaccgggcgacggttgccaccagggcgcgcgcgcgcgggggaaacggcggccgaccgaaaattgaatggcggagagcgggggatttgacgccggtggaggagctcgacgagagagagagagagaaacagagagggagagagagaaagaacgagagggcgagagctctctctctctcggctcggctcagctcggcgcgtgcaatgcacgtgcgaggctgagggaggagatgggccaagggaggaagaatcggcccaacgaccaagagggagtcaaaatagacttctgcttagaatttgaattggagagaattgcagcttggatttgaatctaaatttgatacttgtgcacaagggttcaaggagatgaggaaggaaacaaagcgggagtttgatacttttgggaacaattatttggagaggattcaaaggaggggattgactttaggaatttgatttcggagactcgaatcggaattggaaacttgaggtgggggattttgatgaggcgatttttgaattcgacgagagggatcaaggagatttatatcgagatccacggcacgacttagactcagcactcaaagaatgaaattttcgcatataggattttgccgaaatagtttttaacgcctcacgaaatgcggagcgttacacttgcccgcgagggtaatttccataatctcttgataattaccttatcgtatacggaaacatatcatacatacgaaaacatgccgtatccacatattccataagtcataggatatgagatatgccttatccgtaaccatgacagtagccccccgacttcaactcaaatgagtactcgttgtcatccgagacttcacagtcaacgttgtcatgctcactaggtcgttctcgatgaaaatcgagaaggacatggagtatgcggcatcattgaaagaaaatttattctaacccacagcacactgcatatctctagatacttctcttgatttattttgttttacagagcctagcaattttttacacttattaatttccaattatttctcaaacattgttgtgccacgtggaccaatcaacaataggcaaaactgccggcttgagaaggattgattgatattgtttaagttatcataaacaacatcaatttaatggtttatagctttttttcaatgatcgatcaaatatgatgattatataaacttatattatttagttatcttatacgctatttctactattatcataccaagctcccgtaatattgtgcgggatttcatgtagtttcgttaagaatgtgcccttgtcaagtaacatggcattgctagtattttgtgcatatcttgtgccgttcttgtaagggacacaaatgcaatatgttggaggaaataatcaagacttgaatcctgacaagttcttttagggggagaatcttgacaagttggaccatttgaattcatgcttctatgattttctaaacaactattgcccactccaatcaggagggcaaataatatattggtagggtagatctccatattcgatctgctgatttaaataaacttgagtcaatttccggcaaatataaagcccgtaagccagctatgttcttagggttctgtttttttacaaaagttcaggtatgatagctggccacgtccaactataaacagggattatctatagagctcaaaataaaatcccatccaatcacttttattctctctcaattttattattggttgctacacagagctggtttcttcgtaagaaatgatttcttcatcttttttttcatctcttctcattaactattttatcgcctctttttacttatgtgactgttttttttttaaatacgcgagagacgcatctttatattaagaaggaataaaagtatttacagagcgggccgaaaaatcaaaaacacgaaggggacaagatacaggagggggaggaggaagaaaataaaagtctaatctcccaacgaatgtgacgaacttccatccgacataggtgactgtatatttaacggtatgtaagctaggtgtgagaaagagggtttggactgctctaatgcctttgctctaatcctgagcactagctgttttgcatgctgcgcgcgcatgtggacggatccattatctgctgtctggtaattaagcagtactggtgacttaggagtagatgccaggttatccaacacgtgagctcgtgctcctcactacggacatactgatcagaaggttgaccttggcgtctataaattgcgggattatgtgaacagagtagacacgaagcagatcaaccaatcatcagaatgaggggacggtcccgagtttttctcctcgccttggtgctcttcctcgcgctgcaggcgccggcgtccgcaggcacaaaggcaatgctctttcttcacttctctctcttaccctctcgatctattcatcatacatgccctcaatattttttaaaaatatatccgccaaagtcattttgttctttaattgcatgtcctctcgtttctcttgtatgtcattcgaatatttatgaaaaatatttttttaaaaaaatgtatttaatggattttttaatcatacatggagattatatttttaaggggatgctcttttacttcttgccactcaaatagttttacaaaaaaaaatggcaacatatataacatattcatatgtgatttaaatttgatcaattataaatcaacaactaaattcaatgagaaaatcaaactaaactgtaacgtgtactacttaccgtcgtatttatttatttatttctaatttagagttacaaagagtgatatatcacatattaatttgtgttgttaaatttatttaatttttataactatttcgatgatatatgacagaaaacagggtatatattccttaaaactgcaaaaatgtttttccatcgtatattcgtcacgtacaatacaagcaagtcaacaaatataggactgcgattaaatgttctattgacgatctctaatccatgaagcggggtactttcgtgcatgcagacttatgtgatcgtctttgatggcttaccagcttctccttctggtttgcttgctacagtcgtcaccaggtcagaaaatactagtgtggccgttatggatgtcggtgctaccgtactaggctactagctatgtactcctacatcactaatgtgttcattttgtgccgtaaaaataaacagctttcagttactgtacgtcttgagccccatccaagtgatcgtggtgcagatcgatgagagtttcgtaggagtcatcaagcgtacgccacatatatcatcatgttatagtgtgttccccccttggagtttgcagttcatacctgtcactgacgagcgcgttctttttttcgcgtactttggactcagagctgcccggcgtgctggccgtgatccccgacgtcctgcacaaggtccacacgacgcgttcctgggatttcctcgagctagagcgaaatggcgcggcgaccggtgcgtggaaggacgccgcgaagtacggggtggacgctatcatcggcaacgtcgacacaggtaccactacttgaaaaatgatattcgagacgatcaaaatggatttcacgagcgactggtacaaccgctagcaaccaaaaactaatgaaaatcgaattttttaaattaatttttcaatggatttttttttaaaaaaaacgcactaagagcacccacaatagtaaagtaaggtgctctctataaaaatgtacatctcagcaatagactagattgatagtaaaccacctcaatagtatgtctacatgggtatctgtagctctctcatccattgcctcgtttttctctataaactatctccagtttagtagatagatttactctctctctcttcatttaatctgttccaagtagaaaaatatgctgacatggatctcttgtagagagtctatagataaccattgcgggtgccctagaatatgaggaagtgaaattgagaaacacagccccaaataatgaacacagaacgatcggagcgaatcagttattccgtgcatcggtacatgcttcccgatgagatacatgcgcgagataacttaaaataatcaccccaagatgacatgaggttaacagaatcaaatcccaagaatacgggaactaaaaagtcaattcaaacctcgcaaaatggtagcgtcgccatgggcgcagtgcgcctgtgcctctgttggattacgggatccctggtggcctggttcagatgtgctgtcgtcctatctgctgtactgaagtgctgtgcagttagccatagccggaacctgttctgattcctgaactcctgattcttattttctgtgcgtgcacgtactccctacaaatgaaggtgtatggccggaatccgcgagcttcaaagacgacggctattcagtcccgtcgaggtggcgcggcaagtgcatcactggcaacgacacgaccttcaaatgcaacaagtaactccactgtccacagctgctcatcaagctgcatgcaactaatgcagtaaattttctggcgagaaactaacatgtcgtacatgcagcaagctgatcggcgcggggttcttcaacctcggcttcctagcgtcgggcttgctgcaggggaagccgccaagccaggctgcagagctgtacacgccacgggactacatcgggcacggcacgcacacgctgtccaccgccggcggcgggttcgtgccggacgccagcgtgttcggccatgggaagggcacggccaagggcggctcgccgctggcgcgggtcgccgcctacaaggcgtgctacgccgagggctgctccagctcggacatcctcgcggccatggtcacggcggtggaagacggcgtgaacgtgctctcgctctccgtcggcgggccggcggacgactacctgtcggacccgatcgccatcggcgcgttctacgccgtccagaagggcgtcatcgtcgtctgctccgccagcaactccggcccgcagccgggctcggtcaccaacgtggcaccatggatacttacggtcggcgcgagcaccatggacagggacttcccggcttatgtcaccttcggcggcgtcacgagcagcatgaccatcaaggtttgacaatacgaccgaccaaatcacactgtagtttgcgcacatgagaatacggcgtacttttgctcatgccattgggatttgggcaatttgcaggggcaaagtctgtcaaacagcactctgcctcaagggcaacggtacgcgatgatcaacgcgaagaacgccaacgccgcaaacgtaccgagcgagaactcgtaagaaatcaaaaactcagatatcatctcgacttgcaccgatcgaatcgaaccgacgtcgatttgcttgcactgctgcgtgcgtgcaggacgttgtgcttccctggctccctggacagcgacaaggtgcgcggcaagatagttgtctgcaccagaggggtgaacgccagagttgagaaggggctggtggtgaagcaggccggcggcgttggcatggtgctctgcaactacgccggcaacggggaggatgtcatcgcggacccgcacctcatcgcggcggctcacgtctcctactcccagtgcatcaacctctttaactacctcgggtcaacagagtaagcatcgctcatcagcacatagtactacttttcaggtgcaacacatcacagcatggttatatactatactaattaacgttactgctctggttcatgtagcaacccggtcggttacatcactgcatcggatgccaggcttggcgtaaagccagcgcctgtgatggcagccttctcttcccgtgggccaaacccgataactccccagattctcaaggttggcacattgctcatcgtattcctacagatactcgagagagaaagcttgccccttccaaataggaccagcagctgtgt

SEQ ID NO: 65708 - DNA, 6418 bp, Oryza sativa
ttttgcagcctgacatcaccgcgccaggagtcagcgtcatcgcggcttacagcgaggcggtttcgccgacggaactctctttcgacgaccgcgtgtcccctacaacataatgtccggcacctccatgtcgtgccctcacgtgtcgggcatcgtcggcctgatcaagaccaagtaccccgactggacccccgcgatgatcaagtcggcgatcatgaccacaggtgagcgagaaatgcagatcgcgatcaatcgagccagcgcaaacatcacataaactctgatcgatctcacgtccttaatatgcctgtgcattgcagcgatcaccggggacaacgacagcggcaagatccgggacgagaccggcgcggccgcgacgccgttcgcctacgggtcggggcacgtgaggtccgtgcaggcgctggacccgggcctcgtgtacgacaccacgtcggccgactacgccgacttcctctgcgccctgaggcccacccagaaccctctcccgctcccggtgttcggcgacgacggcaagccgcgcgcgtgcagccagggcgcgcagtacggccgccccgaggacctcaactacccgtccatcgccgtgccgtgcctgtccggctccgcgacggtgcggcgccgggtgaagaacgtcggcgcggcgccgtgccggtacgcggtcagcgtcaccgaggcgctggcgggggtgaaggtcacggtgtatccgcccgagctcagcttcgagtcctacggggaggagagggagttcacggtgaggctggaggtgcaagacgccgcggcggccgccaactacgtgttcggaagcatcgagtggtcggaggagtcggagtcggacccggaccggaagcatcgcgtgcggagccccatcgttgccaagacgacctgcgggtagcacggacggggtcgattcttttcgagtcagaactggaaactgaataactgttggtgttgtcacgccaaggtccacaagtcgttagggctaactgcctaaatcctaatggcaggagacttggttagagaggagaggatcgatttcgttttatctggcagatagatgtgagctatcgaatccagatatttgttctgattccgacggtcaagttgtttttgtgctactcgaatagtgtaatgcatcaatcttcatcttgttacgataattatatacttctcgtcgggccggcgaagcgccggccgaaatatataattacgataattatatacttgttcgttcttttctgccagagatgtgtcgctacatttctccatggaaatcagtcaaactttgaactgtataatttatactgtgttttatgctgtagtgttgcttggtttctcttttttgcctcttcacggaggagtgtaatttattttcctaccataaactgtgacgaacacatgcaacccctgaagctagtgatacatgctgacgtcttatttgatatgccataaatattaaagtgtaaatgagaaatttaaaggtgtaagatttgaataatttaaaatcgactgctttttagtacaaatgggctgtttggttaggtgccacatattgccacacaacatgttaggcatgccacagattgttagcttagcgtttggttacttgcttcagttgtggcaagccacactttcttgttccatggatatacatgtcatatacttattttctagccaaacattgtcacacttgtggctaacaaattgttggccacactatatttgccgtgccatacctatgataaattaagttgtggcaatgttaggcaacaaccaaacagacccaaaaattgtagcgctatgatatagtactcccatactttcttctagtttcggctgggactatttggtgggattcgtggcccaatctcgcgcgatggaaggattgtttttttttttttttgaacttgatggaaggattgttaggagttaagaagaaatggaaactatggaacgattggaaaaggaaacgatggaacgattggcccagactcccattcgaaagctggcaactgggccggcctaaatcacggaaaaccaattgggcctccgaacatacaacaatgggcggaaggcggcttgagggctgaggcgacatagggcggaggaggacagcacgcgctccgctcgcccgccgccccacgccccccgcacgccgcggcccttcgctcggctgccggttgctgccgcgcccctccgctcgtccgctccactccgcgtcgcagcaccggggtgggagccggcgcggcgagtccggccggcctcggggaagcgctgccgcgctcttcccgactccggcgactgcaacggctgctccacctccgcctaacgtttcccatcgtcagcctcctccctcttatactcctgcagttttagctctccgccactattcattcctttcctttcctagggcttagctgaaatttctccgtagcgaagaggaattgggtggtgggggattaaacccgatccatctgcagtgaggattttcccccatgtgtcaaacaagcatgctgtggacttacatataggatgatagaacttagacgaggtgcaggtgcagtcagtggctcaactgaacccccttgtcccgcgttaatttccgcctggttttgttgtgagtgccatggcttcgcattaccaggctgccaccttgatcgcgtcgccgtcgtacccaaatgcaatcgcttggtcgactgagaacctggtggctgttgcctctggtcaccttatcactatcctggtatgtgtggtttcattgcattagtgtattcgaaccatgttgtcctcctcaggagttatgactgttcatcttgtgtttttgattctagaacccatctgcactggaggggcctcgggaactggttgttcttcgtcctagcgacccatttcccataggagtggttaacagagaaggtacggtttccagtgaaacacatgaatttgtgctgcattccttttgcttttcacgtgttatcagtttagacggataatatgattgccgaagtggagtggaagagatgctcggtgttaagtttctttatgttagcactgcatagtaagaaaaaatgattgggacagcttgagtttagcagttactttagagttctgtcaacaacttaaatgttatgggtggctgttgtgcttgagatcacggtggacaactccaaatgatgataaatatcatcaatatgtacactttgctttctttaaaaattattaagcaatgccttaggctaattgcatgtgaagatgcaattcaacaatatgcatccagaagttacgctttcttaaacatcaattcagcagtgtggatttgagttcctacaaaaataaaattgtaattttaatatgtaattatcttgattacatgaaatttttggcagtcaacttctcttgtgacaaactgaaaagtaacactggacatcgatagaaggtgcgcaccaggaatcagtttttattgcttattttgcagatctctttgaaccatgtataatgcccacttccttagcacgtgaaactgaattatgcgctcgatctatttcatggtctcaacaagggttttctcctaactccgggtatgtctttttttaagtcgtttcatcacatcatttttgtctctctctagatttattcttcagcactactaggttcatttgcttatctggcctctgtacttttttttccctatatggattcagttgtctgttggctgtttgtactgttgatggtcatgtaaagctttatcggtcaccattttgtgaattctgtgatgaatgggttgaggtaagcatgttcacctaatgtattattaatttagtttattgactaacttaatttgtataaacattgatagctgggcagcttgattggcctgccaaattcctgttatgcaacagtaatttgttccatgtaggtccaatttgccatgtcccatgcaaccatgcagccccctacattattttttcactatctaagaatttgaaaacatattggacaggcaatgcagttaaaataagcttaacaatcactgcaccacctagtagacattcaaccgtttgttcagtactacttctgacttcgattacagacaaaagaagatattctttttggcagttttgtttgtatttctctgtgtttttcttgctgtttgtcatgtcccttccttttccttttgccattagataaaatatttattttcattcaccacttgtaatcatttgaacctatcagttacatatgcttaggatatctcagggtgtatgtgttctttagttttctcatattctgcctgtcaacttaaatctattggtctaggttgcagatatatctcgattgctgtttaagttttacaaaggtatagaatttggggaaaatgatggtcctagttcacttcctcaggtattctcccatccatccactctatcaccagtgtctccctttcattggttgcctcagaaaattttttttttgtgaggcagaaatatatgttattgagttaacttacagaaagtttgtcttctgtgtcaggaaaaagaaaatactgaacaaaaccagcaagtcatgtgtattggtaaactgcaagagcctcttctgagcatgggtacagaacggagaaaaaggaaaccagcaaggtgagtcacactcttctgtttgctggccatcaaagtttaagataacaagatggtccaaaggggttagttcaagaaataagatgatgggttctatgcttacaatttgatgtatgataatgagtgcctagagtcgttcaaaaaaagataatgagtgcctagaagtataaaatgtatttaccagagaaagatctatgcttaacactggcagactggcctagtgcacttacttggtttctctggtggtacattgtcaatgggtaaatattctgcatgtgctatttgaatcaggtttaattttagccagggaaaattgaagataatctccaacaaactgaaaatggcaatgatagcaactcagtttcccctttcctgacagtctttgacttagacgagcagacaaatgtgtcaaggattgcaaaaaggccattttattttctatcattaggtggcgagaggctgcttataatgtggttgtataaagtaattcttttttcgtttggcacgacacacttgccatgtgtggttttggaataagattgataatttagaggctcttgtttgctaatttttacagttgaagtactgaattactgacgattactggtagaaaaactgtagtaagtatttgctatgggttgttgctaagcttattataggatgccaattgttcatatgtcaacctatccgccactgattaatgccttccttttcgcactaactttattttgcaagaagctatttttggcctataatcgtatgttaggtctgaattattttgtttcattttttagatttgaaggttttgtttatcatgaggataatggtggcgtagatgctccaatggatgcggactttttattggatccaatctctaatttaaagaaaaaaacattgaagaagcgcagtgtagatgctccaaaggatgtggactttatatcggatccatctaatttaaagaaaaaaacatcggagaaggacgatgtagatgatccaaaggatgcagacttttcattggatccaatctctaatttaaagaaaaatacactgaagaaggtaggatttacatgttcacatttaggttaaagtccccagtgtatgcccattagttgttaacattaaaagctaaaccttgtttcataactaaggagagaactatttgtgctgttaaatcacactcgcacatagcctattttatatgatttttttttctttggcatcctgtatcttttacctggttgtgattgtaggtcacgagacctggacttgacgatgctgtcagaaatggtcagggcaacactcaaaatattcagacaccatcatactgcaatggagaagacaaatctctcccacttattacggcaaaacagtattcatgtcgtgaagcacttttgtcttctctcgtagttgcatggtctccagttctaccatcacctgacagaagttcttatttcacgggacattggtgcattcttgctgttggttgcaagtctgggagtgtttccttttggaaaatacacaaacctgaatactacacaatagacatcggcatggttactagagatccaatgctgatcggggttgttcaagctcatttatcatgggtcactgccataagttgggaacttttttcctcaggctcttcaaaacctttgttgcttttggcaactggatgctcagatggaaggtcagtacaacttccgtcaccactgtaaaggattttacatttttgtcatactatgtgacagctaactcttgaatttgctcttccatgg

SEQ ID NO: 65709 - DNA, 3206 bp, Oryza sativa
ttatatcagattccaaataacaaaacaaatcaagtcaaacttacatatggactgtcattaaatctctaccattaaaatctagtcatatcacaatacaacggttaatatttttctctttttctccgattaatgtgggaatttctagcccccacagcgaacgtgatgcctcctttcaaagctatcttaataatataatagattgaaatgcccatcttgcactttctagttccagctaatgcctttctgttattaaatatactgctccaaacgttgtactgtcaggtcactactgattcattagcaccagtctcgtcaatctcattatctgcaccagctcagcatcaagactcagttaatctggcaattggaagagcatctgggtcactagaagcatggtcgtggaacatatctggtaacaaaattcagaagattcatgcatgtgacgctcatgatcaagtggtaaaatttcattttaccttagtatgtttacatcttgataaaagaaaaaaaatatctaacatcaccataggtgacaggtctgtcatggggttttcatgggcattgtttatacagctgcagtcaggtgtgtttatgtcctcgttgcactttgtaattaattctgattttgtttttaaataaaaccaaagttccgttgacagtatgttaacttttctattaaagtgtaaactattttctatgttctcagtgtattcacgatctctgtctttgcaatattactagctgctgattacaaaacgtgcataaataactgatggcagattgacgggagacattgatttctgtagtattttggagttgtgttagttaagacttggaaagctgaagttttctgaaagttatattttatgttctgctgctggatcataaaatcctatgcactgtgttgacttattttcttgaaccttcaaaaaatcctgcgcactgtgttaacttattttcttgaaccttttgttgctatgcataaagccttgctactttgtcaggataattctgcacattgttggatgttcaacgaaaaacatctagaagaaattcctctgcacacagatggtccggagctgaaagagtccgtagatgtaaaacatatactcaataaccctttatcctgaacatgcaagttttttcttctggttgacatctgaaatgtgcatgcagctcacagaagtatccgatcgatgttatggccttgcactagcacctggagaactaatgattgctgtggtatgctttaggctatctcttatatctgacgcatattgcttaactgtgcaacatttgtacttgagctttcatatataataagctaaaacaatttatgaatgttatctccttcaggtgcgcagcttggactcaaacttgttaaatcagatgtatcaggccaggtaattttgtttgggagttcggtatgggaagtagtgaggtctgcttggatctaattaatgatttcttttatctaacatttagaaaatccactgtcatcacaataattttgtgaataaaaacaacaggacacaaaaggcagtggttgagttcatttggattggtggtcagttccttggtattccattggacaatagcgttatcctcagtcttcagtctgccgccttatctgagactaatttcttgtggtggggatccaacattttttggtcactgaagaaatatgagaattgtgaaacagtgcttgtcttatgggatctcattgctgcactacaagggtttaagaaatctgcacctacctttcttgagacattgatgcataaatgggtgtcaggtttgttttcagatgatccacattgtgcttctatcgacatcccatcacattcaattcacaacatgtccaaagtcagctcgcggaagttgcacttgctgaatatcgtatgtaggaaagtaatgcttagtgatcaaccgcagtattctcctggtgcagaaaaaggtaatgatgtaatggctgatttgtggaacaatcttctggtaagaagtgaaagggagctgcaagagaggcttgtggctttcacttttgctgctgtcctcaaccgaacagcatatttgctcaagggtgcccctgctgaaaacagctggtttcctgttggagttgcccagatggactcttgggcatccatgaacgatggagaagtgagggatgagctcaaatttcttagaacgaggatcaatgatctaggagacaggtaaaccatttttctaacatcatttcacttgtgaaacggcatagagcatatgccacatgatagttcagtagaattgccttgaaatggcttcactgaaagtaaaattggatgttgaacctgttcagtaactgttttgcgccatgcaggatcaactcagtgtgcgagtactcagttgaagaatactgcacctactgcaatgcaccagtccccttcgagtccgcagatgttgccatgtgcagtggtagcaatcctgctactcccccagctgaagctcacaaattgtcaagatgcacagcgtcgatgcggctgtgccctgttcttcaaccaacatggcactgcgcgtgttgcgggaggacggtcgacaagctgctgccggaaatattcttcaccatgcccacatcattttgggatgtcactcatggtaacgaatcgcttgatttatcagcgccggccgtcccattttgccccttctgcggcatactgctgcagaggataaagccggagttccttctctctgtctcaccggtatagaagctagtgacactaggcagcttccagctgtaagttgtaatactgaatacgtcactaatgcactttgaatttgttgttggtggggggctgcttctaaaaacatgtgcttaaaataagcatggctggtttgcgctaggtgtggtggtgccatcataatgtaacaacccgtgtaacatgtgacatctgtaactcttggcaataaagcgggcaatatatactacttgatgtgagaatatgagatacagggtgtagagcataatgtggcaggccagatgttgtttgctgcatgtacacatgacccacaccagggaggctggaaagagcaaacagacagacaccgatgcttcccttgcaggttgcagcaacgggagcacctcgaaagcgaagcacttgcgagagattgtggaggacgaggcagtgggtggggtccgacccaggaacctttcccggatttgaccacatgat

SEQ ID NO: 65710 - DNA, 8453 bp, Oryza sativa
caaaccggccaacccgtgaacctactaatatgttaaataaaaggtaatccgtgggtattcatgtcatggctcggcttgccgcgtcgtaaagatataagtggatcaatccataaagctatttataggtcaaattagtaggtaacccgcgggttactcactaacagtggcggaggcagtgtgggggctggggttctttagaccccccctaaaatttaaatccatatatctattgcaagggggctaaaataaactttgtctgagattgttataaggctcaaaagactaaggagcccccactatattttatcctggctccgccactgctcactaattttgcctataagcgggttcatgggtcggcccgcttgcatccctatcagtaggccttattaattcacccactacctttataggaggattactaactaaaattggttacttctgcaaggaactgggtgaggcctatcaaatactcagtgatcctgtaagaaaggattcttatgacaagcatggaaaagaaggccttccacagtaagtcttgaatatttctgtcactattctatcaacctagatagaaattaagctccaaattctttgtttctatagaattggatcggccaaattgtaaaacaaaattcaattgcacaagcgatttgaagttttagctgcatgctgcatgtacattgtattagttattatcaacataaagctattgaacttttaaaatggcttttttagggataacatgattgatccaactgctgtctttggaatgctttttgggagcgactattttgaagattatgttggtcagtttgcactggcatctgtagcttcagtagagattgaggaagaatcagataatacagaggcaagggcaaggattcaagataagataaaagtatgatgctccagtaatgctctgtaaattgcacaacagatgttatctagtagtgctcccagccttctagtatccatctcctcaaggttggcagttcataattcatgcttaggccttaataatatctctggattacaggagttgcaaaccgaaagagagcaaaagcttgttcaaagccttaaggatcgacttcaaccatatgttgatggaatgcaggatgaatttggtgattgggcaggtgctgaagctcagcgtctttctcaagcgggtattgccctccatcttcatactcatttgcactgttgtattttttgataagcatggacatttcattcaacttttgctgctgtatgtacagtatatacactcataccactgaattttctattatgccttatactgaattgctgattgcatttgttttaattccttggtgtctgttatgaattgatttttcagctttcggtgaggctatgctccacactattggctacatttatgctcgtcaagcagcaagagagcttggaaaaagcaaaatgtatatgggtgtgccgttcatagctgaatgggtaagagataagggccaccacgtaaagtcacaggttaatgcggccgcaggtacatcataggatgctgtactaccttttcctacatcacctataatacttcttaatgagtctgaccctcggtgttctacatccctcttttgttaaagatgagtctgatcttttactgtaggtgcaatttctctgatacagctacaagaaggtataaaaaagattgagggcgacgacaaggaaggccagcttatgaagagtattgaggagaaaaaagacgcaatgttgaattctctgtggaaaatcaatgtagtcgatattgaatcaacgctttctcgtgtttgccaagcagtaagcattgtccacctcagtttttacctcatgttttgcagtactgtaccgatatgcttgaattttgagatatcttagaaataacatacaaatatggatgatcgtggcaaccattttgacttcaggttttgagggagaatactgtttccaaagatgttctgaaggtgcgagctagaggactgaaaaagctggggacaatattccaagtaagttttgcttcatctttctatcttctccagctactatggtaggtcaaaggaggattgctctaatcaccaggacttgataccgatcattctggcaaatcttgtttgcaaaccgtaaaacattgaagtttgtgttgaaactaatttggaacaaatatgtttccgtggcctgtttctgtggagaaattttgtaaagccgttgtaaatcgtcacagaggtggcaatttatataggaaactagttcagagaactactcggagtttttgtttggagggtgagagatgatgattggcatatgtaacatgtcggaggttacgaactatatgaatggtttcatacgcgtcttctctcttttcttgatgtccttttctattttgcttacctttcaaactcactgcgcgttctgctttcatgtaatcttttgtatcttcatgtcaagcactcaaactaattgctaatgctatattgccatgttgatttgaaaaacatcctcgtatttttccattggttaacaaggttgcaaaatcataatgagatttggatcccgttttccatgtgaaaccagggtgcaaaatcgcattgccggcgcgagaacagcctgcgtgttgaggctcgcgatgcagaagcaacaccgtcggattgatcaggactcaggagcagcacggcagcatcgctacaagggacaccactccgccgaggcttcattttgtgattctttttgcttttctgtaggagcatttgatattcgttgcgtccagcattccagcaaagatgttacgatgtggatagtgtgttgcaagaccgatgtttggtccatgtagccacgcaatattcttcgatattttcgagcctttgatgctttagaggtaatttggatagttataatcaggtcttgagatcttcgatggctatctgcccgggcaaagtgtacccttttactgttcacccggaaccttccagagatcaggccgcaacgtggcgcgcccggcgcttacgtgcccttctccggtcacgcgcgccgtccttacgagggcacacgtggcttgcctgcagggctgcagataccgcctgtcgcctcctgtttcctcgtacaaatacgagtccgcttccgcttcatcatcatccaatttcccatcagctcgatcgctcgtatcactcatggctcaaagagggtaaccgagttagaaactgaggaggaagcaactcgacgacaccaaccaatggcggagcacgccacgggagtgtacgggcacccgtacccgcgcgtcgaccagtacgggaaccctgtgccgccggtcgaccagtacggcaaccccgtcccggacgagccggcgccgcgcgacacggccgcggggtacgtggcgccgccggaccccgcggtgtcgactggcgactacggcctcgccggcgcggaggcgccgcacccgcacgagagcgcggtgatgagcggcgcagccgccgctgccgtcgcaccaggaggcgaggcgtacacgcgcgacggcggcggcgtagttcccccggccggcgagaagacgttcgcctacgagggcacggtcagcgccgccggcgtcacgggcgcctccgggcagctccagcccaccaccagggaggaggggcacacgacgctcggcgagacgttgcgccgctccggcaaatccagctccagctccagctcggtaacttctctttctagtcgttgtgttcttgattaattttgtcgatgggctgactgacttgatgagcgcgtgcccagtcgtcggaggatgacgggcaaggtgggcggaggaagaagaagagcatcaaggagaagataaaggagaagcttcccggcagccacaagcaggaggagcagaagcaagctggccacacggctcggcggccgggacggggacggggacggggacgcatgcagcggggaagcacgagaagaagggcatcgtggagaagatcaaggagaagctccccggccacggccaccactgagcgagagctcgcgcgcacgcactttcatcggttgacgttcgtgcaactgtccatgcatgtatgtataataccagtcgtgtttcagttcgttaattttacggtcgatgtgtggtctcggtaaaactaggtggtgtacagtgcgtctatgcatgtacggtgtatccaataatccagagtcagatctcttttaattatcctttataacgagtcacgagtgctttacgtttcgcaccaaaaaattgtcacctggcgaatcgaattcctctgagacaaccgtgcgcataactgatgatggtgtgagacaaaacgaatgtactatatgatacgtttaggcaggaccgccgattgatcggttttggtcgatcccgacgcttcacaccatggacggtcactgcgtcaagtggtcaagccgaaacaggagccgcggcggtggcgcggtgcgacggacgggaggcgaatcaaaacaactactggccgcagccgcagcccgcaagtcggagtcaagacgaactggtgggccgtaaactgaacaaccaaacaaaccgccaggaacgaaacacagagtgcgccaaccacattgcgcgcgcaacaagagactgagcggccccggcccaggagaatttgacacggcattcactcacaacttcacgccttccgctgtttcccagcgttggctttcggtagacaagtagtggctttccgtgatccgcgtcgtccatggcgacctctgtccggtggacggcaacatcgttctcggtcacagggtaagctcatgcagaccactcatggacaggttaatacccggcgtcaggcgtgcaaggaccaaggagtaatggagtatacagcgatgcactgaccgcagtatgcaatgccacaagtgtgtacggtcaaatgtttgtcacggaacgttgtcatgtttttgtgttggtactcactcccgtaaggagtacatgagccggccatgagtgtaggtgggaacacctaatttgcctcgtcttataccgtatttgttttgactgacgtgcgttaggtcgcgagaatctatccctggaaatccgttgtgtggaatttattttagagaagtatctcattctcaatatttgcttggtttacgtagagcatggaggacgcgagtggagcacacggaattaatgtgctgtaaagtatgtgaatcagaagcagcatacagttgagttacacttgatagtaatccctccgtgctcgtactcgtaaaggaagttgttttgaacagcgatacggtctccaaaacatactttgacttcttatttctataaaaatatttatttaaaagtgatatatgtatatttttatgaaaggattttcacgacaaatctattcatataatatttatattttcaaacttaacaactcaagagttattcataatttatattcccaaggtttaacttaaacattgtcctataaatataaatataagaccccctataaagggattgatcgaatcacaattcataaccagagccacattgagagataatccaaagaaaaccaaagcctagttgtcgtattctactcatctagacgtactcgatggattctatttggcatgttagagtagcctacagatcaccggttgtaacatgtgcgatatctttcccagtaatacatataaactagagtagggttattactcatctcaatgacccgaaccagtataaatcattgtcccttgttctcttaatatgatatcgtgtatattctagtaccaacgacccctatactctagtacggataccattgttgtatagcccctcgagataacaaaaaatagtacaaaaatttccacctttcaaccaggagaacatgccactagtttgtcttcgatccgtagcggctatggtgcagacggctaccggaactatggccgatgcaacggcgtgccccggcagccagctacgatcaagccgatagccagggcgcgcggtgcggttgcgcgcgacgtgacgatcaggattgcgaccgacgttgtggccaacgcggtgacacaacagtcaactttacggtccacttggtacccacaacgcgtggtccgattacacttagcatgttggctaggacggcagccggcgctacggccagcgcgtgcagtgcaactactcaacaacgacgggacggttcagcggcagtgcggcaacacagcgactgtcttggcttttggtgtcccggtagcttgtggcctatagcctcatcggccaccacctccataggccgcacccccccccctcccccaccgtcactgtcacctcagccagccgttgcacccaccccactcgtgcctccgccctttgggattgagctgagccaaatagccaagaaacccactttcatgtttggttagaataaaggacaaatttctaccatctaacaatatagattatacgtttctttaggggaaaatacttttttttcataggaatttaacgatcaagtaatgaaaagggtatggaagagattcgaattaaatttaaatttaaggatatatatggaaataagaaaaaacagggatatatggaaaaggaattaggtaaatatacacgcgtatggattttgtagtcgaataccaatccaacgcaaagattcgcgagcgcgcacgtgtttgcctcgtggcggcggaggcaaggatccaatccaagggccaccagcccagagcccagcgccccagatacgtcgccctgctacatagccgccgctgttccggttcaatccccaacagcatcacaccaatcagatcgacaatcgccgccccaccccccggccaccccacagcacggagcccttgccagtgccacctccagtgcagcttctgttcaaggaccatccccgaccacgtcgcggcaacgacaacgccgtacgcgcggcggcctctatcgtccctcccgctgctgcgcgccagggctgcgcttcaatgcgccacaggggcagcatgcatatccgtcggccgccgcgacgccatctttattcccccgttctctcgtcgcgcgcgcgcacttgttcactgtgatacgtcgcaccgtgctgttcactgttcagtcgtcgtgatcaatcaatcgatcggtcgaccccagcaagtggacgctacggtgcacgtagcgcatgcaggcgcgtatacgttatgcgagatctcgccgaactgtgcccccatttatgagtcaggtccactcgctgtctggtccttttttttctgactgctgatcagccggtgcaagacgccaagacggatcagacgtgatcagatcgatcggatgtttgcagggttcgaagctgggccaccagaaaggggggaaaaaatcgaggccgccaacgtgctgcgcacaagaaacggcggataagttttgtaagttttgcctgagccgcatgcaggtaggtgtgcaaaagcttgatcgaaggttcaaatcggatcgaactcattcatagtcataacgagctaaaccatgttagaattatagttcgtgaaattaacgagtcagatcgtgtctagctcacttgtaataaaaaaaacgtaaaatacgtaggtgatactacatacaacttataagatacacgaaatttagtcagtcatctcgtaaaattctcaaacaagttttagtcaaaaaaaaattctcaaacaaatcactcatcttgttttttttttcaaatcacataagcacagtggtggagtcaggataaaattatagcggggctaaactaaagtggaaaataaaaattgaaatatgtctcatataaattggctatatttctaatacaaaatataaatatatggattagaattttataaggtattatgggggctctaatggtacattagggtagagagtctaaagaccccagcccccaagttgtcactgccgctgcataagtacatgtgtcaagttcgctattaaattggatacatgttgatttatttttgtaagcatgaccacactcaatgaaaaaacaagccaacttcaatatgattgatactaaaatccaatttaagatgattttgttattgcttgctaagtttattgaaagcatacaagtagcaactaacataaatgaaaatacgggtgctaatatttaattttattgcttgcctataaacatgtcaacttgtcctgcccatatcactactagaaaaagtatttttactaacgtgagggccttatttttgcaggctgatatgacccttagagccaaatgaccgtctacaaaaatataaatcggggtaaaatttgatgcccgcttgcgaaaatagattttcgcagacggaccacttaagtggcgccgcttaagtggtccgcctacgaaaatagacttgaatataaatagacttgcgggccctattttttttttaagtcctcacacctctcagtcctcccctcgctccacacctctcctcccttcctcaccggcctctcccctcccctcccctct

SEQ ID NO: 65711 - DNA, 5936 bp, Oryza sativa
gtccgggcggcggcggctcccctccccctccctatcagatctggccggaggagggagggggaggccggcgggggcgacggtggcggctcccttcccccctccctcccagatctggccggaggaggaaggggggaggccggcgggggcgacggcggcgacgactgtgcaaggcggtcggcagcgtctcccctccctccctcacagatttggccggaggagggatgggggaggccggcgggggcggcgacggcgacgaaggcgcggggcggcggtgaagacgacgacgacggcagcggctcccctcccctctcagatccggccggggagggcggcggcggcgagccgcgtgcggcgatttttttgttcgttttttttttttgcattttcgcaggcgggccgttgccccgactgctaaaatcgatgattttcacagtcgttgtgatgcaggcggacctccctcccgcctacgaagattagttttggccacctgcgaaaattagttttctagtagtgtatgcctcacacatgtatttatgttaggcttgtatggcttctaattgagaaacaaacaatacatgtgatgtattttacatgattttcaccatcggaacaagatggcgactcatttaaacaatttgtaagataagtgactaaattgcacttatatcacaagttgtgataccacagaatacattttactcaaagaaaaatcagtgtctttatatgcataatacttcctaactattctatctatcctaaaattaactactagtcatttaggattaactacctagttatagttatattcaaatttgtaatactagataacgatattttaagatgaagagagtatacatattttcttaaattagtctaagctatttatatctgttgagttctttactactacttccacccaacatttcaaacatttcaatttgaagattgtccaagaatataagcattcatacactactgcttactctcagttaaatttatctcatcgtactcccaaccaccttttcaccctaactctctctcgttaaatgtgggccgggcactaaaatcttttttcttcaatcttaatctttgctaaataatctagaaatgttcgatgaagggagtagttagtttttgttgttatgttaacgttgataaaatagtaaattaaaaattaaaaagatgatactccctccgccacaagccgtatgttgtctcgttacggtcaaaatttgactaacgattatcctattttgatatactttttatgacgtaaaattgatgttgttatattcatatttaaaagtaatttgtatcatattgatatattagtaaagtgattgttttaaccttgtcttagattggcatgttagaattgaggagatggctatgtttttaaataatttgtggcaaaagtacaattttacccctacacgtctatatttttatggataatcatacctcttcatatttctactattgttaaataaggttatagtataaaaagatctgaactctcaaataaaattagatttgtggttcagatcgattaacttctactactagtagggagtaccatggtaggactcaaataaaatacgttatatttatatgaagtagtgtaaatgagaaaaaacttgttctaacgagcttagctcaaccaaatccgtcttctatcagtcaatctagaaggcctgggtgccacccaagtgcaaattcttctcttggctagtcacgcaaaatagagtttggacggcagataggctggagaaaagaggatggtaaaaccaaaatatttgcccactttgctgcactgttgacgaatcgtccttacacctcctggccaaatgcagactcacaaagaggatatgagcagaaatccagagatggactgggacttacctccaaatggacgattgggaaaactgccactcagtcgatcagtggtggaccctcgtaacggaatccccaaacaccccgcacaaacccctaaggaccctggtgattttaatctcgtgggaaatctggtgcgaacgaaacacaagaatatttcgcagcaatgcatctgcgccgtcctcaattttagcaaagatcaaggagaaaggaagagcatggatcaaagcaggggctgtaaccctgcaggagtttggaactttgggagatatcacttaatatccgccttttgtcttccttttgcgggttattgcttttttctggctaaccctgtatatatcttgttataatttttttctactctattaatatatacaagacaaagctttttccttctttaaaaaaaaacgagcttagctcagctcacgaactgagcaaagttaactagccttaatcaatcgagctgtagcctcgttatccacctcaggtgtggctgctggcttggcttgtgggcttgtggcagcgtcggtgtgggggcgatgattttgcactcgatgctgtgaccttacttggaagatgctatgctgctattcactggcccgttcgtttttgacagccttttgtggcgtcaaggcttgatttgatacacgatgttcacgatgatgtctccagccatcgtgccttggcgccttgcttctgtcgctagcagcggtcagggtcttggcgtcgaacatgccatcatggctcgccccgacaaaattgacggactcacgtcgcatgatgcttactattaaccattcaatggaagattggaagaactagtgtactattatggtctgtgaatttccaactaaattaaaaataactaaacaaactcctcgcctgtttggtttctatttgaagagaaaggtaaaccagagtggttagcgtctttctttaatcccactggccttttgtttctcttcaagcaccgctagatttattctactacatcatgggagtgatacatgtagcttttggcaaaagcgaccttaggagaaaatttggattggaagctaacagcagcattaacaatgccacgaaattgttgtccaaacattactacggctcctaaacaataattggaattgactatcatggatggtgctcctaaacagtatctatctttctcattgctttcgtgggacacaaatcaagaaaagctaaaaaaacaggatagcgacttgggcaagcaattagtgagaaccttgattgttccttcttcaggagaggaatacacgttacacagtcctcccagtggcagcaacttacagagtacaagtgtaagaaacttaattattcttacaaaatctcatagtagtaattaactacacagtgttcacatttctataccctttatttatatttttacccatgcagaaatcataaaaaggtgttaattaaggagtatggactagtgaaaattaacagagtacagtctctactctcccggttggtcatgccctctgtgtaaaatgccttggaagaatattgtatatacgataatggcttaattcacaagaacctcatcggaagtactcgaagttgaagtcgccgaccaccatgctccggctgacgtcgaagtcgaaatgtgtcatgccctgctcttgctgcccatggcagggcagcccgaacttgtgctccatggcgtccccctcgccgtagcccacgaaaggctcgaccttgctctcggtggcccaatgcagcggctcgctctcgagcgcattgttcacctccggcgcgcccacgccgcagttccagttgctgctgttgctggagctctcgccgtagcccaggttctccgacacgtcaagcacgctgctgtagtccacgaacccggccgcgtccttgccgccgaggtggccgtacaatggcatgcccgtggcgtcgaacccgctgccgaagctgtcgatcaccgggaacgggtcgaacacctgctgctgctgcttcagggcgaagccgtcggcggtggccggcggcttctggtcctgcgtcgacgtgtccaatgccgccgccgcagcagcagcagccgtggagatgggctggtgggtgctggggtcgatgccgcgctgcctcagcttcttcttgaggcagctgttccagaagttcttgatctcgttgtccgtcctccccggcaagtgcgacgcgatttgcgaccacctgcatcggattcgcctcgctgatcaggccacttatcgctaacaaatcacctccacacaaccacattgcgacgaaaatagtactggtacgcattattgccggagcggcagtacgtacgaacctgttgcctaggatctcatgcaggccgacgatggcgtcctcctcctgctgcgagaagctgccccgcttcaggtcggggcgcaggtagttgatccaccgcagcctgcagctcttgccgcacctctggagccctggagcacagaagaagatcgttgcacggcacgggtcagcgatgagacactgagacacatgcatgcaaagagcggatcgagcagagcaggagcagcttacgacctgcgagcttgggaacggagctccagcaaccgacgccgtagcggtagatgtgattgtagagcttctcgtcttcctcgggagaccagagccccttgcgcagcttctgctggacaccggcggcagagcacgcgtgccgtcccattcccgcccgacacgcgagcagctacctgccgctgggttcgttgcccttgccggcgtgtatctgtctatcgatctctctgtcgatcgaggcggccggctgggcgcccgatccagggggtatatatggggaagcgtgccgagaactactgcacacacacacgtacggtgcgcgcgcgcgagggaggcagcagatcgagcagcgatcaagtggcctttaagcaatcaaccaacgagccacggagccaagcgtctctctacctagtactcctcttctctgtgtgtactacctggtgcgtgcggcttgatatcgtgcttccgctacaatggattggagcttaagatatctccggttcgtgagagaaattaggagaggagaggagcgcagacactgggccagcgagcgaaagcgagcggcaagctagggccccgcgggaacaggacggaaaggacggaggaaaaaaaaagcagggttagttggagattatgactaagatttttccatcaacacttggttagggaagaacacggtacagccatatcactattaatctcactattaatccctccaggaaacttgcaagttgcagctacacgaccgaagctataagcgaggcagcgaaaaaacacacgcctcgtgcagcgctcgtacactgggagggactaatgggcgggcgatcgccgctcccctatactctatacactcctccctcccttcccctctccctcctctctttcttctcttcctactatagtacaccacacaaatttttttaaaaaaacaaaaagttagaaaaatttatgtataaaaatactatatataaaaaatttgaattcaaattcaaatttgaatcgggtatgtaaactttagacttataaattttaggtgtatagaaatactatatatagaaaatatttgaattcaaattcaaatttgaattcaaatttaaaattgaatcggctatgtaaacttttgacttataaactttaggtctataaactttaggtgtataaactttagatgcataaaaatactatatatagaaaatatttgaattcaaattcaaatttgaatcgggtatgtaaacttttgacttataaactttgggtttataaactttaggtgtataaactttaaatgtatagaaatactatatataaaaaaattgaattcaaattcaaatttgaattagatataaaaacttttgacttataaacttttggtctttagatgtataaacttaaggtgtataaactttaaatgtgtaacttaaggtgtataaattttatgtgtataaatttactaaagtagaaaagtaatacggtgccaaaaaaggaaacaggtggagaga

SEQ ID NO: 65712 - DNA, 4709 bp, Oryza sativa
ccccccccccccgcgtcccaggtgatcaatcgccgtttaggatttccgtactcggttgcatacctatatagcccgtggggccaaatcaacagggtaagatcgtacggcggccatagctctgccgctaattaaacacggcttaattagtctgctgtgctacgcaatgcagatggcggtctttggccacgtcttcaattgattgtgcccggctcggtcgacactggccgtaccgaccgcgtgtgtgcctgtgtccacgcatggcaataggcgaactactaccgctgctgccgactgtcgcgttccatctatccgtgttgatttgcaggtgccagccccgtgcgccggtgcgcgggtggcgcggtggccaactgtgcgcggcgagacagccgaaggtaaagctgccatccaagttgcggccggtcgggggacgtcacattcgtgcgtgtaaatacggcattgtttttcatagatcgggttaaactgatcactgtccacgagatcctgaagaggatagcagccgacagttggaattgcagcgttggccccacgtctttccacgtaagagtccttttgtggggtactggtactactacttgtagtaggaaattttttacacggccgaatcgatacagtacctagaacattctttcagaatttctactttgttatgttctaaagaaggcataaacacttaaccaggttgcttatcgcacagtgtcagtttcatgcatgagaacatgtacaggatacctgtcgtaggatctactgacatgtgggtccgatatgcgtccgtagacggaagaagaagttgatgattttttttttcttccaagtagagagtggatattctgtaacagttaaaatgtcgaagcataaaactatctttaatttaggtgcgggggtaaaaaccttgctcgttctagaaagacatgcaaaggtgaaagttacacgctgaaaggtgaaaataacgcacacgctttggtctcatcagctgcaagaaagcagaaatgagagagcaaaatgaccacagggagaggggtacctgattaaccgccgagcctagccaaagttactgcagaacaaaacgggaacaaacaaaccaagcaaagcagcacagcagtaggccctggccatcgtaccactaggaaggaaaaggtgagatgcagatgttcagttcaacgtaccagacggctcgatcgatcagtcgactccatcctaaattcgagtactacgtacttgcagtgcgtggctcgatcaaccgtgcaatcattcagctttcagtacactaaaagcgagggtccctaaagcctcgggccatagcaattgcatgcaggacagggcagcccccgcttaacccccagcacttagcctcccacgcttgtgcgctaaagcatacgcatgatcgagttgtacacgtcaacctttttattttcttttccatctatctggaggccctaggcactaattaagagcacgatactaaaacgatcaaacttgccataatgccatgcacgcgttgcaacgaatttctcaataacggcacacatcatccgtggtgttcatgctgttcttgcatgccaacgcagcttgtagcgcgaaaacgatctgaaaaccacttaatttaagtgctctggcctgtaccgattaattagctagtgccgtgaccctcgttagagtggcttgaaggctcgtgccaaatgatggcagctagttctcagcagtatgactgtgcagggagatagagataagaggccaagagcagtgctcgatcgaggctggctacaaccgcaaggataatgatgtagcgaggggtgtgtccgttccgtccaggaggggagggggggcaaagctagcgtgctccggagaaagcatgcagggttagcgtagcgcggagaccaccagcaccacccgtccaccgcgcgcgcacggcctcggcaacaagtttggtggccaatcagggtcaggcttagcttccagcctgctccatgtacatgtcgagttcggtttagttgggaaccctagtatccctaacggccgcgcacttaattttttttaacttgctcttggcgttgttttgtgcgcgctgcaactgcaaatgcatgcagacacaccaagttgcaccaatgtgctcatgaattgtaatgcattgatcttgtgccttcacagatcgattggaataacgggaaaattgtgtttgcagtgaatgatcagatctgtgaatgctactgagcatttgtctgattctcccctcttttgacttgagagactgctactctgctaggcaatatcagtgatcaatcacttgcctaacggtgtctacaaaagctaattgcttggaaataacaacacatgtgtgagtggctaagtggtgatagcagtgcggagtcactataatgctggaggcacaattttgcatgtcaccggtaaaaaaaggcatatttttcgccagataaacctgcatgagtgaaactcaagaaatgtgcgtcaacgtagtagtgttaaccttctgataaaatgggatgatctacatgttccataggcgacaatgcttcttctccaattcttctgacgaagttacccgcgtaccaggaccagggtaggcagcttttccctttcgaccgagcttgcagcagttgctaaaagacaagctggcctctttttcacccacaagaaaaaagaggctcacttgaagaaagttggacaataacacaaaaaatatatttgttgacaacttggtactgttatcatcctctccttcctttttgtactctgttttttttctttcttcaagggaactccaattgtagtaccaagggggccgggggcaactgcagtgtattcttgcagttgacgttgattatttcagagttcagacaagtggacggctaaaagaaggaagaattaggactaccgactaccgagctacgtagccactataaggcaagttgttaccgctgcaacttccgcagcactaactaagacgacgactacgtggtagtatgcgggatgcatgggcgacatgtaaaagaatcgcccggcaaagtagtcactaatcgatcaattgggaattacctcaagtgcatgtctctattgtggccaaaaggatcctccaggattctcctacctgaggcttgatcttgacatgcctcctctataaaggaaagtactactagtaagtaaaaccccaaaggtgagagagcgagagaagaaagaaaaaaaaaacaaactaaagaggtggtgcatcatggtagctcctctttgaagttatgcaagcccaaagctagcagctaagtggctgcattacacatcacatacacatgttactactagtttactcatcgccgagcgacgacgtcaccggccgatatctctgggctcccgaggttggtgcgcccggccggcgctgccgctacgtagtagtagtaatactagtagtacgagttagaggccgttgctgtcacaaaaagatggcgtgatgtgcacttgccttgcatgactaacctgcatgattgaacttgctgctggctagctgcaatggaaagcgcctgctcaagccatgcagaactgaactgtgcactaattaattctcccctcacctaattcagctcgcctctctctgttttttttttcattaggaggccggacttgctgcatgcatgcctggctgtctggatagtgcgtactgttcctttcctacccctctttctcgctctcacggcacactgacaagatatgggctaaggtacgtagctaatagcctaatatctagtagtagtagcaactaagctagagccatggaggttacgcaacggaagccaagcaacataactaatcagtggtactctccagtactgtccaactgtcctgatgcttggagcttggaaagtttggatgctagctgcatttcagagtaaggagcgtccgtacacgcagtttactgaattttccgttcttcagttcagaggattgtttcttcccgtcgtcctctgcttcgtttcaatattggtgccgtccgatctaggagtagaaatggaatccgtttctagtgcattccgagctacctgactaatcattccagcgtgattgctttcaaacggaatcctaccgggcttgaaatcgcgggcgcaatgcagttatcttcgtagtgcgtaccaagctagacaatagtattgcgcgtacgtcatttctacgtatcagcctaatagcctattagtgatcaatgcatgcatcagatgcatcttagaaaaaacttacgggcaaagcaagaattaatcatctggccgtgcgggtgtaatccgtatctagccacgaggaaggccgtacacatgtttcattgcttaatataacaaacttgcagtactgcacccacggcgaacgttgaaatgcaacgtgaatcgttctgccattatttgatcatccgtagctcgagtttctgaatattattgggtactccagtctccaaatgaagtttttgcaaaacaataaagtgtagcttcaggggcagaaaacaacgaacttccagtcgttaagtggaggtggccttcagctccacaaagctgcacattttctgtgtctgccctccgggctgcggcttcagaatgttctgccggccgacatgcacgtcagaaccagcatggactagtcgtgtgtgtgttttagagaagggtattttttacccggcctgtacatccaaccggatatataccgcc

SEQ ID NO: 65713 - DNA, 20769 bp, Oryza sativa
  unsure (1)..(20769): unsure at all n locations
agtggttacagtgacctgagtagtgcaccaaggtcctgagttcaaatcttctatgtagcgaatttcagattagattgtttcagtggctaagttccctagttcaaatcttctatgtagcgaatttcagattagattgtttcagtggttaagttccctatttcaatggctgtatatatccggttggatgtaagaggccgggtaaaaaaaatacccttatctaaaaaaaataaaaaaaaaactagtcgtgtgttaggtcacgctaaaattgaaagtttggttgaaattgaaacgatgtgacggaaaagttggaagtttgtgtgtagaaaaattttgatgtgatgaaaaaattaaaagtttggaaaaaaaaagtttagaactaaacaaaggtgcagttttgctccgttgtcatgtttagctggagatgtgtcccgttctcttacattttgattttgcagcccagatatcatcggtgtctggccatcccttttgatatccctcgtttttcaaacgatatgacattttctttttgtgtgtgtgagatcatctcaactgtagtaggcattattacctcagtgaaaatgatacggctgcactgcacctttaataatcctatgacaactttccaatatacgtagcacaccggagattgcacaatattgtaaggacccctttgaatcgtaggaatgtaaaagcataggaatagaaaaaacgcaggattctgacaggaatgtaggtgtaaaacagatgattgaaaaatacaggaaaaacacaggaatgatcgtttgattggaccacagaaaaaacacaagaatcggatgagagaaatagactcaaaggaatttttccaagaggttggacctcttgctaactttcctccaaaatttctatagaattacctattccataggaattttaaaggatagtataggattcaatcctttgtttcaaagggtttcataggaaatttttctataaaattaaaatcctttaaattttctacattttttctacaaattgaagggacctaaaggtggacgtaaaatcttgcatgccacctgcttcccagggaagatttgttcatgaccctcttctgatgttaacttctctgccaggaaccttcctgacatgtccacaaaagcatattctgcctttttctttttctttttgtgtgtgtgtgagcgtgttttttgccacactgtagtacccttctgtatcaatagaaaacaaatcgtagaactgtggccaaaataggggtcaaaatgtttggaaattgctcaaaccatttctcgactatggccttgtttagattctaacttttttctttaaactttcaattttaccgtcacagcaaatttttctacacacaaacttccaacttttttgtcacatcgttccaaattcttcaaacttctaattttgacggggaactaaacacaacctatacttttttcttgaaaaaacggataaaatggtatagtaagaaaacgatatagaatatatcgaaaacatggcaccatagtgtcaactgtcaagcaaatgaagccataaatactttacaaattacttggtgaagtcgtgaagattcaaagcacaactaataaatactactgaggatgccatagcattcaacacactagtaacacataagggtcaggggttgattagggtttgatttaataaaggattgtttgtgctgggttgccagtacaatatagtagtttttgccaaaaaaaacttatgaaaacggtacaccggcgaaactattacggcttgtttggcaacttgaagcaggggattgagagtttacatgaggaaattgatgtgagattgattaagatgagaatttaatttttaatcctaatagtttgtttggtagagctgatggaaattgataaggagtttagttggagattaggttattaatgaaaacggataattgagatttgtttaagaaaagtaaaggaggaatttcctcccgattaccactccctacctagatattgaaaatgagggagtttcttaattctccgtctccatcccaccaaaattcttatgtctcccaaccaaaataaaacagttaatattcccatccctctaaactctcaatccttcgtaaaaactcctcctaaccaaacggccgttaaaaaagcctcaccagatcacatttatgcttccgtcaattccaattccaagtaaatggtcagtacaaaagggggaaaatgttcaggatagccgggggaattccatactattttcaccttttagaccaaaatatatctgatctcaagtgaagcaggacttgcccaagcactggtgcgttacatctgaaacaaacaaaggaactgtgtaccaaaatcttgacaaccaaacatctaactttgtcaatattttgtcttggcttaccttttcttttagtataaggtttaggctaccttttcttttggtataaggtttagggactatctatacatttgtcaataaattttttcttaaaaaattaccaaatatagatatagtatgatcgtagtataactacattataacttactcctacatatgttatacaacgtaatttgtcgacaaatgtgtagtaaaatcatttaagttttagacttgacacgagtgcacacattcacgagtaatagtttttttagtgatattagatatatccatcggcaatcagatacctgtgataactttgttaatcgtaagatatattggcccagtttttaaagtggctcatagtggtagggtgtacatacatgtatatgagcatctaaattcgtgtgtactgtgtattagaaaaaagcgcgaaaaatctgtcacaagtgaaattgcaatttgcaaatccgaaaagaaatcgtaaacaaaacctgtgaggctgctatactgagttactgaccaatccactggatggacatacgcggcccggcccagcggccggtacgtggtctctccgcatcagggtttcaggattcaggtcttcaggggagctgcttgcttttgatcgtgtgccacaatcctgccgtcatcacactagcactactgccgcagtgccgctactatacgtacgtaccgaactacggatcgatccatggcgcggttgctttcgcacgctgctgtgcgatattccacacctaggaaacaaagatagctataggggcgggggagagcgtggaacgccaatcggccaatgcccaatatgtcgacggtggtgcaggccccgcatggcgcactcacaaggatcggcggcgttcgccgcccggccgcgggagtgtcggcacgatcgaggtcgcggaaggccgtaagctagatagcgagccgccctatcactcgagccatacattcgtgtcgcctgcagtgcggtgcatgcacagctcacccgcacgtacaccaggcgaaatcaacggtgttggcgtttgccgcgcgcacgaacgtcgatcgggtcggactgatcagccgagacgtcgagcgagcgagccgagatgcgctagcaggagatcgtgtgacaaaggctcaccttaacgacgacgtgtcacgtgcatgcctcgttccatccatcgatcgtcgcatccgtccaactccatatctccattcaccgactgaaaataccgtcaggtcacacagcaagtcggcaactaattaagcaagcaagcgagaagagttttagcacgatccaacgtaccactaaacctacgtgacgttgaacaaccacgcacatctagtcatcaacaatgcacacaagcgatgccatgcaccatctgtaagaaattaatttgctgtgtgtatagcgacagccatgtagtactacgatcgactcggatagacggatggacggcaggacgggatatctgaatcgaaaaaaagtgactaatatatgtatcaggacctaattaatcgctcggtaatcgcattggtttagcgatcgtaatcgatcgccgtggggatcattgacttcaatgtcacgttaagtgcgattgggaaataacccgtcgatcgattggtgatgggggctgggtgacaccactgtgcccaaacatggagttaactatatgtacacaaggtggattaagattttggacccctcttatgttagtgtcgaattgtcgatccgtctcgtcgtggtctccatcagccaatcagcgaggaaagccgagggtgtgtgtggtgcttctagaattccttctcttgcggcacagcttgattacagcggggattaaaacttgatagctgaccttttcttatcatgcctctttttcgtttgtagtagtagtagtagtaatacgcatggtactgcaacggtatatgtccaaatctacctattgtacagtgactggacgtgtacagaccaacctgccaataggccattattgatcctcattccagatgtccaatcttcgtatcgtttttgttttttatttggatattttaacttaacatattttggggggggggggaggggggtgtttgagagagattgttgcggatgcacggtcacaacaaacgaaaaaaaataattgctcgtcctatagctatctatccgagtttatatatagaatcgtgcggttatcgtgtttatcatgtgcgataaccttaccagattctgaaattacgatataccttgcggtaaccaccaaaccatggggtggcaataatcccaccttaaacggtttggtaaaccctaatagttatcgcccaaccacaattgcaactagctgtaaagtaacacggtcaaacaagttcaaaggttgttataaagtactcctagtagtacaccacggtgagattttcttttcgatactttagttgttttattttcatttttctatgtgggtatctacactccatggatgggtttctttacagggctgccatctaatgtgggtgacttacatgtgggcacgattttgtaagtaggttggacagatcgtggctggcttgcttgagtcgactcgtttcatttttgtgaagagctgagctcatgttttaattagttcgttagagataacaaaccagctcaagctagctcgcgagctactcatgagccaaacaaggtgaaggtctagagcacttgccgcagccgctggtggtttggaggctcgtgcttgttgccccgcccctcactgtactctattggccttgacctggttgtactacatgcgcatgctgccgcgtgcgctctcgccgccacttggatttggcagctctctgctctacttcccatcacgttgtggcgcctgcgctgcatgtatcgtcatccgttgactgttgtccttcttcttcccgtccaagacgacgagatgcggaggatgacgagtccctgtttcgacagaagactggtgagcttttgcgcgtcgtggagcctgttgcttcggtgaggtcggctggtgctgccaaccatgacgttctccttcttgtttcgctcgccatccatttgcgctgcccactagcccctcctactcgtgcgcgctcgtggagaagatagggcatggtgctctgcctagtagagctcgcgagctagcttgagccgagtcgagctaactcattatcctaacgagccgagtccaagcccgagccagcttgatatccaccctttgatgtgtaaggctcaaatatcaatcacttaaaattaaaggataatattacagaggattggtttccatactccatatgaatagctttcgacgagaaaaaataaaatgaagcatggatgcacgctccttgtctaaaactgtgtacaaatgaagaggagcctatctgtgcatatgcatctaggatcataaaatactttccactagccgagaaccccttttatttgcgactaaaaaagatgacaatctttcttcttttctgcaaaaaggtatgctaatatatctggcggtcgttttcctgggcttagagtatgttccctgtcaagcagtgatcgaatccataaagttttgggtaattagttttcagttctgcctttacacttattgttcccatctcctttacgtacttttctcgcctccttaattttccttgcctccttgagcgatcaacatcgatgagatcatctttagcttgccatttcaaggagaagagatttgcggctcggccataccatctctctttcagggctagcttccctggctgcacagtttttctgacgagacagaaacgttgcacaagataaattagttacttccaggtaaagtaattattaccaggccgacaactgaaccggtaaaaaccaaaacgagggaaaactccaaaaccagcgcctctatcgatcagtttggtgatgatttttttttcctttttgaaaaaaaaatcattcacaggtctagctttagaggcaaagtaagtgtactcaagtaaactaaaatatataaaatgcatcagatcagatgcatcgatgaaccagtgtcggcgactcggcctgcaatcgtacatcgacgaacgacgtataattccgtttgcggtaattggagggtgcgggatttttgggccctggctcacatgttttgggagaactggacttccacgcagcctgcagctagcaggccatcatccatcgcgcccgcaccaaacggtgtccacctctgttccggccgcacacacgggccacacactgaaagcccccaaagtcccaccgcgcgccgaggtgttagcgcgggcctttcgctgattgattcgctttcgaagaaaggaataagttcacttttggttcctctatttgtcgtccagtctgattttcatccctgaaccgcaaaaccgggtacaacccgtccctcagcttacgaaaaccgggcaaacgaggtccctcggcggttttgatagcggttttggttgacgtggcgcctacgttgctcatttaactcggtctttatctgacatggcactgatgtggtacttacgtggcaatttgatccggaaaaataacaaacccgtgggacccacatgtcagttgcacatacaaaataataaaaataatggtgggacccacgtggaccccacctgtcaccctatttctcccctcttatcagttatctatatcctctctctcagtccccggtgggagaggaccacgtgaggtccgccgtgccaaggctcgggaaggctgaaggctgacggcgctcaggaggcggacctcgccgtcgacgctgccgcatgctccgtgcactgccacgcctacgccggggatggtcgccgccggcagcaaggagctcctccgcaacgaggatgggttcaccacggaggacgtcgtggccatggactcccccaacatcgtcgccctcgctgagacgccgacggcaaggacatcgccgccgccgccgctgccgaccacctcaaggccatctgagcgagctagctgctctcctcaaggccatccgtgcagcgccggcgagccgcccggagatccttggcgtcgaggcggccgcggcggagacagcttcccgctccccctgccgccgcggctccttgtggtgctcggtggcgtacgcttgcgggtgaaggtggcagagcagcatcccggacgtgtccgcctccaccctggccgacagctgcctcaaccgcgactccacccagccctgtgagctttggcccagagaaacaacaaaacacacgcgaggtcacacacgcacgaaggaatacacaagtgatgcaaatacttcagtggacaaacacgagcttgcggcgaactagctacacttccactcttatttctcagactcagtgatttgttagtcaagctgcaacacatacagttaccgatcattaagaccaagcagtacttaactaatcaccacccacatggcgtcggccttgacgatctcctggcagacgtcgtcgccgacggcgagctgctcggtgatgacgcgcagggtggcgtctgaggccgagctcgccgtcgtcgtgctcgatggcgcgcagcatcaccgggctgggccacttccaccgcgcaaagccgcggaagaagcgcgggagcagcatgctggggatgtgttggggtagagctggcacatgcgcgccacgaggatagcccagccgatgccgccgaggaagcccgcgacgttggagtagacgccccgcgccttagcccagtgcttcacgcaccgcagcatggtgcggaacacggcggtctccgggacaagccgcaggatctcgtcggccacgcggatgccgttgaggctgcgcgccgtggcaaggtcgtcaaggccgcggagcaccgaccggtcgcactgaggtccactccaggttgtcgggcaccacgggaggcacacgccggcgtacacgagatccacctgcacgccgcggaacctcatctggatcaccggcaagggatgtggcggtggcgggagcggcggcggagtccgtggtggtggcgctgctgtagagagaagagatagaggaaaggggatagagatgaagatgccgagagaagaggaggaaatgaggagtgacgatgacaggtgggacccacgtgggtcccaccatttttatattattttatgtgtgcaacttacatgtgggtcccacgggttttattatttttccggatcgaattgccacgtcagtgccacgtcatatgaagacaagtcaaattagccacgtatgcgccacgtcagccaaaaccactgtcaaaaccgccaagggatctcgtttgcctggtttcgtaagttgggggacgggtcgtgcccggttttgcggttcagggacgaaaatcagactggacgacaaatagagggacctaaagtgaacttattcctcgaagaaacggggacgctccggcctcgtggcctcctcgtcgcaacgccccggaaatgtcaatgtggaccagaaattttcgcaaccaggatcctgctggaatttaaaatttggaacaagttcactcttgctccctcatcttgacgttgagtttgagtttgaattacatcaccgaactgtaatgtcagaatgttgaacccctgtctttcaaaaccaggttaaataaaatcataagacagtatgaatggctgttttgattggcgtggcatcctaatcagaaagaaaaaccatgtgtggctcacatgtaagtggactaaagaaacaagctctcgcgtcgtcttcccctgggggcggcacgggaggcggcaacccggccgcccctcaccctcccctcttccccctccgcctcgccaccgcccgagcggccgccggcaaagccggccggccgcaagggcggcggcggggcctctcacgtcctctctttcgggcgggcagggggctgtcctaggcgaagcagcggtgaccgccagatccggcccgctccggccggatttggcggggcggcaactggcggcggcgagggtggcggcaacgacggcggggatggagttggccgagggcgcggaggcggcggcggtgcctcccagatccgcgcctctcggccggatctggagggtggaggcagttggccgacggcagttggcgacgacgacgacgacggccggcggcagtaggcgatggtctcggccggatctggatgccggcggcagtgggcgacgacggcggcagtgtggtgacggcagcggcggcggccgtgggccggcggcaacgtggtggctgccgtgtcatctggcgacggcggtggaagcaatggcgtcgggctgctacctactcggtggtggagggcgatggcgcaacggcggttttgcggaggcggtggttggtgtcggtggcagcggcgacggtggctgtgactctagaggcggtgatgacgttggtggcggggaaggagtcgggtgcgaggtggggatgatgacggcgaggtggttaggtgttcggcagtagcggctgtggtggtggtgaccgtgttcacggtcaccggaggcatggcagcctcggttgactagccgaaggcgtgggagacgtccgcatctggccggcgtggcaccgttcgatggaggggtcggagaccggcttggtgcagagaaacgcaaccgatggcagcggaggtcggctcggcgcgagaggcgtgggcggcggagatggaggccggcttggcgcgagaggtgcgacggttagagggaggccagattggcgcgagaggcgcgtccggtagaggaggccggtttggcgtagtgaggcactgccggcggtggaggaggcgacctaggtgtgaggaggagctgccggtgggtgtggcgcggtcttcggcgcacgaaggctagctggcgggggatgccggtgagggggtcccacatgtcggcaaagcttgtgtggtggtggagcatcggtgcgtcagccgtggtttcgcaggggcgatctcgtctgtgccctttgttggtctagtggcagtcggtcacgcttagcggcggccgatccggtggtagccttctcctgggcgtgtgtgttggcgatgtcggcgtgtgggtggtggtatttttttccttttcctagttatgactctctagggttataatcttgtaattttttactactctatcaatagaacctcgcaccgtctcgtgtgagtcgttccaaaaaaaatgtaagtggacttctacctatcgactctttcctattttcaactctcccgtctcttctctaggagctcgccgatgaggagagggacaacgaccgatgagtctgtcatgggagacggaagcggtagttggaggtcaacggcgaaggggtgtcggtggtccacagcggaggaggaaaaggagctgatgagctcgagcttggcagccgtttccttgaaagcgacggtagcggtgagcaactagagaggatgcgtttgtggctgtgtgaggcgacttccaccaccacgaccgcctcccaccggttggccatcgctagcacgaggccagctcctgcgtggagagcacctcaccgcgcctgcaggcgaggaagccaacgccaccatcatcaagctccatgcgcatcccatgctagcctgcctcgacagccacaacagatgcaaacgagcgtctccatggtgcctggagccctccacagggtgttgtggaggccacaacgccgaaagacttggaggtgacgctcgtcctccaccggagccgtcgcatcatgtggtgtggccacgatgactcccattgcgccctgcaccacacgtgtttggcctctaccttcgcctgatctccaacgctggacacccgggggcggggggcggggggtgtatggctcgtgcttgtgcagctattgccgctggtaggggagagggaagggcaagggaggaggaggatatggtcgtcgttgttgtgactgccgaggcgtcgaggccgacaatgtcaccaaggcccgagccatccgtttctgtcctacacgcagccaatgttgtgcttgggagacaggagccgtcgcatcgtgttttgcccaagcaccgccctcgatgctgcactccggtcgtgaggtgagaggagtgaggcgagtaggcgactgcttgagctctatgactccgttgccgctgccgccttgctccgttctcactagtagctgaccgtctccccccagcaagctcctatggaggagtggggagagccggagaggtggagatggggaagaaagaagagagcctctagaagcccacttacatgtagccccacattttttttttgactaggatttcacgtcaaccaaaataatcatctttattgctttaggatcttatttaatttggctttaaaatttgggggttcgatatttatgatattctggtttaagaatataattcaaacttaatatcaacatgagggacataaagtgaacttgatccggttttatctcaccctttgcgggtgttaccaaactggcaggcacggcctcttttttaacgagggaagtgtagcaggaacggtctttgccttcgcgtaaagagagaagagacaactagacaagagagagagaggcatatgtcaccttcccacgaagacttcagatttaacttgcagatcacccattcacccgttctgcacaaggtaaagagcgtaaacgcacgtatgcaacgagagcgataacctcaggctcaatggatccccggaccccgcctgtttacctgctagtgcacacgacaatattgataccaaattgagcgtctcggtaattcaccgatggtggatctgcgatcgggaagtgaccagaaaggtttgaagtaccgtgtcagaaacgggatttctcaaccaaaatgaggaagcggactgctggtagttgcctaccacatctacagagacgttcaacctatacagaggagctccgggtcctctgcggcagcttcatgaatcaatttcctccccccaaaaaaaaagagaaaacaatcaatttcctgtgatgtttgctatataagcttcattgtcagtagcttcgattcaacacaatggatgaggcagcgacatctgatgagtgatgatccctctcgtcgtccttgactgaaaggcactgtatgattcaagatatatagtttcagacaagtaatgctgttttaaactgttgcacttcacctaccattacaatagagatacacacaagctagtaccttttttttttaccgaaaccaaatcaaactcgacattcaaatatataaaatcgtgacctaaatgcaatgtttaaggaaacaatgtgtcaatgtattagtactacaggatgaaatcaacaagggatctttgttgagtcatgccgtctgcccaccataaaccgaacctctgtggctctctctccttgcgtcccacctaaacaaaaccaaacacaagctagagcctaagagccatgagaagcattggcgggaaggggacggttaggccaaccgtttttatcttcaccacaccacgacctccactcttggcgccaaagcaaagccgttagattgttggtcaccatctcaaacccaactcgatcgcctcctcccctcccacccattttatcccttgacgctcaaatcagccgcgcccccaatgcccctcccccttgaccggccaccacaatgcggccgccctcgtcgtcggcgacgcccgggacgggccgggtgtcggcgttcacgatgcgcgcggtggcgcgcatgtcgagggcgcggtggttcatcttcctgaggcgggtgtaccagtaccagaacggcccgaggtccgacctgggctccaaccccttcaactcgcccggctggctcgccctcgagctcggcgtgatcatggcgcagatggtcgtcaccaccgccgtcgtcgccacctcccccaaggagcgccccgcgtggccgctccgggtttgggtcgccgcctacaacgtgggcaacgtgctcagcctccccctcctctactggcgccaccggcattcctcctccggcgcccgcggcggcacgctctccgacgatcccgagatgcacggcgccaacgaccctctaaggttcataaaacggcattagctgattagctttcttaatttcttgatggaaattgaaattgtgtgtgtgggatgcaggaacaggtcgtatctgatgaacaaggcacgggcgttcctggagctgttcttcgcgatgtggttcgtgatgggcaacgtgtgggtgttcgacgcgcggctcgggtcgttccaccgcgcgccgaggctgtacgcgctctgcatcggcctcctcgcatggaacgccgtcgtctactcgctcccattcctcctcttcctcctgctctgctgcttcgtcccggccgtcggctacgcgctcgggtacaacatgaactccgcgtccgtcggccggggcgcctccgacgagcagctcgccgcgctgccgcagtggcggttcaaggagccggccgacgcgccgagagaccgcgaccacgacgatcaggtgagcgcacgttccgttgccgcgtacgttaatatcgtgggatatgttagttttgcatgcacagagatgattaggcagtagcaaagcagcgtgcatgtctctgcggggaggtaggaaagtttagcgatgcagagaggggaattaaggagaaactcgccaaacaaatgattggtgaactcggctattggccagaataggatatccaaaaagtgatgaaacgtgcgcaccaaactagaacaatcttcctttttgggcggatatactaagataagaactgctaaaaccttacttttccccatggttcggtgcttaggaacaactcagccaacatgagctagtgctaactagctaacataagaactgctaaaacctttacctttcccattggttcggtgcttgcttaggaacaacttaggcacttagccaacataaactagtgctaactagctatgatgtgttgatgttgtccagttttatacatctaagccaattagtttgctctctagctagcttattattgtttagagctcacaacttataggaaactaggaattgtccttgcttttacatacttactggaattaaatggcaggagtgctgcatatgcctggctcagtacaaggagaaggaggaggtgaggcagctgccgtgcacgcacatgttccacctgaaatgcgtggacaggtggctcaggatcatctcctcttgccctctctgcaagcaagagctcagctagaaaaacaagctgacatgaatacggagctactgataccgcgccttccgacgcatgcgtcgcacctcacggaagaagaaaaagaaaagaaaaaaaaaccctggcacgccaaccatgcgtgcactgacctagttcgatattgctgatgacggcacgatgaatatttatgcatacacttgcatgtgaaaaagatatgcttggattaattaggctaggtagacaagcgggaaatgtgtaaaagagtttttttgtgtgtgtgtgtgtgtgtgtgttgtttgcggtgttgttgcatctctcgaatgtggtcgatcgagatgcgcgtgtacgtagtttttttcagcagaaaccaaacgagaacatataccagggtttgcgctcgtgctccagcgaatgccaacccaaaggtattcggcccggtcgaaactactacagtactgtattctaggcctggctcagagtgggccaacattttcggcccagtttattgacctactgcccagcctataattatcaatcagcccacctcgtcgctgcgccctgcgggagacggcggctacgagcctagagaccgttgtacgaccggccggtgaaagcgagaccgtcgtgccgtttcttccacagacgcgatcacgagagggagaagccccaagacaaaacacacaagtgacacaactctatatacaaccaaaacacacacatgcgtctcgtgcgactcgctcgtgaaattaacgggcgtactacgtgctagcgtagggcctgcgccgtgcgccactcgatccgttggtcaagtacgtccctggtctggtcaagccacctagccacgtgatagttgagcacctgggcacaagccgccggccttcgcggacgacgatcggtgcctacctgcgtacgggcagccactttggtcactggtgacggcatacggtggtggggggattgggggaaaatcggtggaagagttctccggcccggagccccggaccccggagagcgacggagacgcaccgcgcggagatggcaccgtgcctcgagaccaagtagagccgcagccgtgcaactcgatcctatcgcctatcggtgtcacggtgtgggccgcggccacgtgtggatctactgtgctggcatgattgggaggatacacacgtggccggaggttacggcgccggtgcttgctcctcgttgacaggtgacaatccagtagtaagcccataagcccattggaattagcgagcagttcactggcactagtgcactacacactgtccaactactctactcctaaactccctgagggctttcttttggcatagcccggtgcttcctttctttcgtcacatgactcgcgtactcctagctcactgctcacgtgtttgcacagtcgcactcaacgtgttcggacggccgaatcagaaaatatataatgcatacgtgtagcatcatcatcttgattagtcccatataatcttaacaaagtggattgatcttacagaaaactaatgcaaatgctgacaggataatccattaagaatgacatataggctgagttccttcccctattttccaaactaatatctctctctctctcttttgacttagcatgtttttaaaaccactaaatggttctatacgaaagagtataaccgatcgtcgactattatttctttgactactggtttcttaccctatggagcaattcgtgtggtctcgttcgactttattcttttctgtttttatcttttgattttctttgaaaaaatagtacaaatgcaaaccctcgtaacatacgtacacacatattctatcgctatgagcacctctaaaaaaattagacgagtatatgcacactcatccctataaacacgaagacacacatcctatttctataaggacatccgaaatatttcccatgaacgtgtacacacacatcctatctctgagcacattcagaagactggaacatcatgtattgttattgacaggtacgttgcctgtcattaaaataataattagctataattgcgagtacctgtgtcaaatctaagacttgaatcaagtgggccggttccatcatatggaatctaactaattgagctacacttatttcgtgattttggatttttatttgcctgttttccaaacttataaacgttgtttttgtaaatttatttttgttgtaatatttttcgaaagcaaattttcaactctgtaatggttcatttatccgtatgtactttctaatagctataaaaaaatcagattatacattatcaatttcagttatccaaaatacagcctaaaagtactcatggcctccaataatcctctcattgcagttgattatattcatgttcttcgcttgctcggcctattactatcttccaagggagttgtaccaggagcttttttttcggttgcccacgacaacaaaaaaatccttacctcgtgcatatcgcgaatcaatcaatgttactttgtcgttcttacctgccaactactccgctaactgatatgcgagattctccatcgctaccatcgacccatcgtgccagtggagtgtggagtgctgacgttggcatggggagctaagtaataatggtattctataagcgtatataaaggagagagagaaaaaaatcaggtcctatgacttagttcttcacatacttaaatgtagatgcaccaaatataatagaggagaggaagcgagatgagaaaaaagagatacaccattgtagctcatctattatgtaccctctctgtcccaataaaaaaaccaatccttccaggctcgtagctagaaattctttttttttacgtagtagtatatattagttgtaaaatgcgcttataccggctcctgagctgccaccgacctcgttaagcttgcgagttgcaactcggcctcgtcgagcttcgacctgccacttcgagagtaccaccggcctcgtagagctccctcgctacaccccgatcacatcaaagctcctaacctgccacccaaagccatcaccggtctcatagagctagaggaagttgacgagggataggaaataagaagatactccctccgtctcatagtataagaagttttagagttggacacggttattaagaaatgtaggtagaagtgaatgatgaagcattgtgattggatgaatagtggaggtaggtgggaaaagtgaatgttggaggtttgtgattggttgggaggagaatgttggtagagaagttgttatattttgggacaaatcctaagagctaaaaattattatattttgggacaaatgaagtaataactagtatgagcatttttggtccatatagaaatacggtatgaaaaaaactggtttaacaacacctcaaacacatataatggcataattcaaatttttaaaaataccattgacacggagccggtacaataaataataatgtttttttttcattacggtaaatttgtataccatgaatccgatcaacccaaatatattttgttttctggattattacatgacatgaacatgcatcggtagattttactaatgaatactttaattgtagtggaaattctattgagttaccatgcatttgcagctaaaacaataacaataaatgtttgtatctaaacaaccaaattgcaaattaaacaaaatagtatgattttgcggagtactacccaaatcagtagccaagaccgcactgtcagtctgtcgccctccaatccgttactcgtttattcgtatctcctcccaattattctacacgtttctttcaaattaaaatctccctaaactctgtcaaattcacggtgttttctggaaagggtggaacgctagttccgcaaaccagccaagcaagcaaacgtgtgcctctcacggcgcccatctcccgtccttaaataaacgcgtgcgccgaagctgcttctccccacaaaattttgtgtgtcctcatcccccatctcctctccaatactcgccactaatttcttctctctttctctctctctccgcgccctcgcatcgcacgtgaggcagtcgagggatagcggcgcaatggcggcggcggtggtggcgaacggcgcgagcggcgactcctccaaggccgcgttcgcggagatatacagcaggctcaaggaggagatgctcgaggacccggccttcgagttcaccgacgagtcgctccagtggatcgaccgcgtaatgctctcttccccgtctcgatcctttatgctgggagggatacggatgttggtttttgatctggtttagcgagaggggagggagggggtggcgttgatgcctacgtgctcgcgtgacgcgtcaaaggcttttggaatttcgccgggttttctgggcttacgagtggcgcttggctggtggattcgctctgttattggtatatgtgtttcctgatggtagaatgttaggagtatggagtatgcgagcaatgactagggggtaacgaagtaagtttacgtctcacatacagatcgatatggtgtgttgaattgcatagtgggtctgaactctgagcaacagagcgagtaatctctctctcttatctgttaacaagagtaggtgaacaaggaaggcagggcttttctaggctacagtgattgatcgatcaacttgttaggaaaagccggacaggagtgtctttttttacctacagtcgctggtgaagtagatcatataaagtcaccttatgaactttaagcatacggatttcatttctgttgtacaacagatcctttaaaaaattagtaaagctagccttttggacaccatgttctcttttatttgtgtgtgtgttggaggaaggggggcacaaaattcttgttgagtattttgatctttgcctaagtacatcttttggaatatttagatcgataaggtgaaaatgctgtgggtttccttgacataaaagatgaactcaccgtatgttgagttgttctatattgcagcaaaaacgatctatcaaagctgcatctccttaaccgtggaaagttaaaaagagctagttgtttttactactttgcatgtcaatatttcagatccaagctgcatctccttaaccgtggaaagataaaaagagctagttgtttttactactttgcatgttaatatttcagatcccgttggttagacagtataaatattacagatgttccttcaaaaataaagagtaaatttcactttgggccaccttttattactgatgtttcgctttggacgatcctttgaccaatgttttcactttaaaccaggtaaatcttgcctttgtttcactttgggacaccccaactctcttctcaagcatatgaatgacctcgagtatgccggctcatactcgtcaataaactccctcggctatatgtagatcatttctttgacatatgaatgcagatggataaaggagttgagggtggcccaaagtgccacaaaggtaaattatccggtccaaagtgaaagcattggttaaagagttgtccaaagcgaaacaccggtaataaaatatatataggtgaaaagctggggagcacaatacattgttcaggtgtattctaaaagttttactactttttactgttaatgacacaacagtagtagctaagtgtaaatgattggttgctgatggtttgtttctgttgtttgatttttatcctctacctattaccatttccatttccatttaccattgttatttattgtgtattgatatcagaatcatacccacagaaattggacatacagtatatttgagtatgttaaagtagttgacattttttttttatccggagcagatgctggattacaatgtgctcggaggaaagtgcaaccgcgggatctctgtcattgatagtttcaagatgttgaagggcactgatgttctgaataaggaggagacatttcttgcctgcacccttggttggtgcattgaatgggtaatgttttctccaaatgctatcttgtaggatgtttgttagccaagtgaagttatatgctaagtgtggcaccactgatggttctgcataattttgcagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 65714 - DNA, 743 bp, Oryza sativa
cgacaacaaaaaaatccttacctcgtgcatatcgcgaatcaatcaatgttactttgtcgttcttacctgccaactactccgctaactgatatgcgagattctccatcgctaccatcgacccatcgtgccagtggagtgtggagtgctgacgttggcatggggagctaagtaataatggtattctataagcgtatataaaggagagagagaaaaaaatcaggtcctatgacttagttcttcacatacttaaatgtagatgcaccaaatataatagaggagaggaagcgagatgagaaaaaagagatacaccattgtagctcatctattatgtaccctctctgtcccaataaaaaaaccaatccttccaggctcgtagctagaaattctttttttttacgtagtagtatatattagttgtaaaatgcgcttataccggctcctgagctgccaccgacctcgttaagcttgcgagttgcaactcggcctcgtcgagcttcgacctgccacttcgagagtaccaccggcctcgtagagctccctcgctacaccccgatcacatcaaagctcctaacctgccacccaaagccatcaccggtctcatagagctagaggaagttgacgagggataggaaataagaagatactccctccgtctcatagtataagaagttttagagttggacacggttattaagaaatgtaggtagaagtgaatgatgaagcattgtgattgggatgaatag

SEQ ID NO: 65715 - DNA, 717 bp, Oryza sativa
ttatgatactcattccaatatattctaactttacataggttcctatacaagtgaataggcgtatagcgtataacaatggattgaaagttgtacaaccaactccatctgagagctatgtaagctcagaccaattccaatacacaagacttgacaggtttgtaacaaaagtagcttcataggtttcagtaaagaaaggtttattttaaagcactgctaatgcatcccgtaccatttgaaggcctgacgatcaaccttgctttgaggcccaagagtttgatttggtccgcaatatgctggtcgctgctgttgaggaacgctacaaagatgctggtaagctcttgttggcttaaaatgcatatagtaaaatagtcatacattgtgacagtgttgcattgcattattttgcctcctctggaacagataaattttatagtttttcttttgtggaaattgcaactaattcgtacaaaattcctgcgttcaaaatgggccctaaatgggaagtctttgtttttttttatccgcctcccgactcacaaatatatgctgcataatgtccatggcggctaatatctggtatcatctgtttcagctcaatacagagatcagcttttcatgttccgggcaaagaaaaagaacatgatttaacaggtaacagtcgcccatgccattcttgaaatcttcatatagtcaatttctttgtcaactttcacgtac

SEQ ID NO: 65716 - DNA, 748 bp, Oryza sativa
aaaacaaatatgcaagtacaaaacaattgtacattagaaatgcggatattttgggaaggagggaccgagggagtagtactggtaattaaatcttcgggttgcttgggctgtcatcgttgcgacccagctgctagttgtcatctgaagcaacccttttttcccagcattccgtgcctgtccagcttcagctttccaaccgccatgggcctcacgctgttcgatcgacaaacataatgtagatggagacgtacatatatctgtttgacgaagactaattaacactagttgacccaggcttaagctaatcaaccacccaatcagttcaaaacacgcaagccacatacgtgtggtgtctgatccgagcacgtagtagctgctgctgctgctgctgctgcaactttagacatattaatgctgacaatgctgggtaactgaagcttttgttcgatgtttttggtttgtccaacgctattagcatgtgcttaattaatcgtgtagtcagccagtaggctacgtgtccatgtcgttggctcgatctgcctgcgtgtgtgtaccaacactaggacaaaccaacactaggacgattaattctaaggtgtgttttggtcctttttgagacagcttcctttatgaggtccatctgaaggctgccaactgtagtcagccattgtttttttttctttttttttttaaaaaaacttgtagtcagtcgtgattcgaatttaagacctctaggcttgatatgcat

SEQ ID NO: 65717 - DNA, 1444 bp, Oryza sativa
aacaaaagtttcagtttttcagtcacgcatgcatgctgaaaaacaaaactgcatgcatgcagtgtacaaacactgatcagagatattcagaaagcaggcagtacatatttgaatggagcagagagaaatctatatatatatatatatatatatatatatatatatatatatatatatatatatatatatatatatagagagagagagagagagagagagagatctagagagagaatgcaatgcatggtgcaatatatgcaatatggacccatctggtcgtaatgttaggagatatgttgattcccctgttggtacgtagtacatgaaacctcctgcatgcagaggaggagcagaattaacctttttctttttgtttttgtttgcctttgatctttgcaagaagttaccatgcctttgctttatccccctatctctctctctctctctctctgatctctcactactgttgctagctagctatagctgtttagctaagtgtatatgtgcaagatcatacaaagctagcttttccttttcctctaaatccaactttattctcctcttccttctcccaaaactctcccttaaaaagaagctgattccccatctgatccctcatcaaaacccttctcacattcgatctcgatcactcacacttacactcgcagtttgcacagctacttcatctcaagtagtagtagtaatatactagctagatcggtcggctatttgctgtagctagctagcgtgagctagcttggtttgtagagcttgtatacttggagggaggagatcgatagccatggcttcttcgtcttctgacctaaccctagacgaccaccaccatctgacggcggtggctgcggcgtcggggcaggcgacgcagaagcttcaggagttcttgtcacgtctcgaggaagagaggctcaagatcgacgccttcaagcgtgagctccctctctgcatgcagcttctcaatcatggtgagtaattgtatgtaacctaagctaaatcgatcgccatggctaaccctagcgaggattggtgtgtgtttgcagctatggaggcgtacaggcagcagctggaggcgtaccagatggggagccagcatagcgccgcggcggcggcggcggcgagggcgccgctggtgctcgaggagttcataccggtgaagaacatcgggatcgacgtcgtggcggcggacaaggcggcggcggcggggggcaacagcgtgtcgtcggagaaggcgagctggatggtgtcggcgcagctgtggaacgcgccggcgtcggcgtcgcggcggacacggcggcgaaggggccccagacgcccaaggagcactcggagcaccacccgctcgacacgagccccaagctgatcaccgcgctcgacggcggcggcggcggcggcggcgcgttcctgcccttctccaaggacaacgcca

SEQ ID NO: 65718 - DNA, 8113 bp, Oryza sativa
  unsure (1)..(8113): unsure at all n locations
ttttgttttgttctttgcaaattaaagtggcgaccccgaagcagattcgcgagctgatgaaggttgatggattgaccaatgatgaggtgaaaagccatctccaggtagggtaattatcatctcatcatgcaattcatccatctcacgtacgttcttaattaaatactgtttaaattgatcattgactacaagacagtatgattaactgattgctagacatgaatgccataatgagcattttgatctgaatttttttttgtttgggcagaagtacaggttgcacacaagacggccgatgccgtcgccggcgccgccgacggcagcgacgccgcagctggtggtgctgggaggcatctgggtgccgccggagtacgcgacgcaggcggcggggccggccatctacggcgcgcacccggcgacgcagccgcactacacggcggcggtggcggcgcaggagtactaccaccaccaccaccaccacctgcagcaccaccccgccgccgccgccctggtgcaccaccgcgccgtagccccgcccccgccgctgccgcctcagcagcagctggcccctccctacagcgccaagtcgtcggcgtcggcgaggctcgggtccccggactccgacggccgtggcagcggcggcggcggcggcgccgccgcctccggagccggaagggacatgtccgagagcatcgaggaggaaggcgagggcgaggagcgggaggacgacgacgacgacgacgagatggcggcgaccaacaacgcccacgccgtcgacggcgacgacgacaacgacgagatcaacaccaccaccaccacgagcgcgggagcgataactactaattaatcaaccaaaccaaccaatcaaatcaccacgcgtcgtaattaattactcattagtaataatactagctagtagcttaattaatcgcgctaatccgggagattaattagcgtcacctggaaaaagggaaaagtgattttttgttggcgcgcgcgcgcggagaacgggagccgagccgagccgagccgaccagagaaggagcaggagcttgagcttgtctcactcgttgatgtgatgcatatgtatggaactatggatcgatggataatgtgagggctttactttgcttttgcttttgctggtttttttttctccctcttgtttttcttccttttttgggactctcagctgttcctgatttaataatccggtagtactagtagtaaatatcaaaattatgtgatggtggagagattaaatatgagctagatgtaattgtttgggagattatgtttgttgttgttgttaagttgagaattgtgaagagccaccaataatgcataatgcagggtttgcttctgcaattaatgtgattatatgtgaatggttctaattaatagtagttgttatgttttggtatgcacaaatatagcatatgacattaaattttccaatgggataatgatatgcttggtggtaccaaggctgtgttcagaacctttgttccaacttctcttctcgtttttcgcgcccacgtttttctaaactgttaataggtgtattttttcaaaaaatttctatacgaaattgcttaaaaaatcatattaatcatttttttaaaaaaaatagtaaatacttaattaatcatgcgctaatggaccgttccgtttttcgtgtgcacagcttgtgctgggaacatagggttctgaacgcagcctaagtactccatccggcaaagattacttgatatttccgacagctaaaatccattaagcgcaagttattttgtttgtccgaaacgtcatatagtattatcgtccagggaatatattgcagctttaccgctgtagaagcaatcctgacactttgaaaagcaacagccgcatcgattttcaggaatttttgcgatggctattcagattcttgatgttttataaaagtctactggtcaaagttaatttagttctttattaattcttcgcataaataacacccttttcaccatattttgactataggagaatatttttggagacaaacatatcaactcggttgactcttttatttgcaagaactttgattattacacttttaaaaatgaactttgatgattacgcagtattacagcggttttagcctgcaatcaactgcaggcccatgaatacagttttagctatactagtgatggaccattatgggccaggccgtatttaacagccgtctcagaaaaggaataagtttatcatgacttcctcactctcgctcctgattgaattgcttccctcaaccgtaaaaccaggtataatacatctaccatcttcgaaaaccggttcaaattgacttctttgttggttttagaaacggtttctactgacgtggtatgttggcagcatcaacaggtagagcccacgtgtcagggctctcctttattcccctccttctctccctacagtgggagactgctttgtccccaccctcttctcttcctgcattgggagactactttgtcgccatggcccaggtcaacgaggcactcgaggaccaggcgcaggtggtggccttgtcggcgtgtacgacggccataatagccccaaggcggtgtagttgatcaacaagaggctctcctcccacatcgaaggaatcatccaagcgactatggtggcgagccaaacctagaaaggtgcagtgatggtgacgaggtaggagatgagaagagggtggcgacgcaagggttccaattgcatcctccaacatgtctcgtctctgctaccgtctatgacgagagagggtaccaccttcctcggctcgtcagtccgacttgccaccaccaaagccctctccggagtccagttcgccaccaccaccgtcctcttgctgttgaaaggtcggagaggaagaaaaggggagaaaggtgggttagcaaatgaggtaagttattgacatgtgggtcccaagcgctcaatcaacgagtcatccgtggtcaacctaccgtgctaggtgaaattgcttcccaaactattaaatgagtcgatttgcactaattttttttaagtcggagaagacattatacccgttgttacaattgagggagacgattcaataagaatcaagaaatgagagagagaatataatttatttcccaagaaaaacacatgcatatactactatttctgggccgaaacgagttgagcatgatgccctcatcccacctgtccgatcaaataacaacgctttatattcggcaccgaaagattgagaggaaaactaacatttttcgcgggtacgtttttcaaatgatttaacagtacgtttttattaaaaaattaaaaaactatattaatatatcttttaaaatttgaatacgctaactactcatcatttacgatcttctcacatcctctcctctcaaacaaactagattcgtcgctgcaacccaacggtctccgtactccggcgagccgccgtcccgctccagacgcggcgcggccgtctcctccggcgccggccaagatcgaggtggatagcaacactgcaacacacataactctagaagtaattaaatatctctctccacggccacgtgcggccatgtgacggcgcgacgtccctctcgtggcctcagccgccctgacatggcacgggcttccccgtgcggcgagcggccggccggccgcgatgcccgccgcggcggccgcgcgcgccacctgcgtcgcttcgtcaactcccccatcctcacctcgctgtaaccctcacagttgcgagataatctccgaaatgccactgctcgtttgtaccgagacgatcctctcacagtggcaatcctgtgataagtcactctgatcaggggcattctcggtgatcaagggtgtaaccctctgtttctgggtcacttcgtcgcaaagtcaacccccaatactatactagaacccttgattgattcgatgatgcagaaggggaattaaggtgtggaaaaagataatgcgggggaagcatccatccatcagtgttgttcagtggtggtagattagattccagctgatccaatctggtccgggaattttttctagatctgacaccacattctggtcaaattcagagatccatgctgctctagtctgtactagagccgtccttggtgaacagttcttcgacactcacctcactctcatcgaggtctcccagcttgaggagcactgaagaaatttctatgttgaggtcagtgatctgatcatctgatcatgcaagctgaacaggattagttagatatgctgcagaaattttattagattttttgcattcttctgcaagtgttactgcatagttgtgttcatccaagttgatactgatctgatcatgcaagctgaaaaggattagttttactgcattgttgtgttcatccaagttgccaagaagtgtgaagattttgatgtcaatcactcacttggtcaaatttgatccaaagcagcgttgctaaattcatctgagttcagattgcgagtttgtgacattgggtttggttttgcgcagcaatggtgtcaagaagtctgcagcttgtcggcgcgttgctgctgccgctgctcgccgtcgtgtcgtcgtttgatccgttccaccgtgatgcgaaccccatgggcggcggcgccgggcagggccccttcatcccccacgagtacgtccgcttcgccgacgtgaagcggcagtgcaagtccgtgctctcctccgcggcggagctcacgttngacgccaaccgcgccaacggcttcatgccggagctgtccttcgtcaagggtgactggaagcacgacggcgacggcgacggtggcggcggcgcgccgctgctgccattcgacggcaccgacgtggcggaggacgccgccgccggggcggcgcgcgacccgctgccgctcgcgtcgttctcgctcacgcacgtcgacgcggcgcggcgcgggaggacggcgctgaacgtgagcggcgtgctcggcgtcgccatctcccgcaacggcaccgggccggagatggggccgtacgtgtcgccggagttcaaggtgtggcccgggaacaccgagctgaaggtgctgctcgagggggtgtacaccgagaacgacgacggcgagagcgtgctgtgcatggtcggcgacgccgtcctgccggcgcgcggcggcgacgccgccaacccgtggggctgggccaagcactccgaccgcgacaggttccagccgccgatcaccaaggacggcaacatcctcctcgtgctccgctaccccaagacgctgacgctgacgacgcgcgccgtccacggcgagctcacgagcaccaatggcaagacccacgccgcctacttcgacgccgtgcacctgctgtcgcagctcggcgcttactccaactaccagttcggctccgaggagctcgtcggcacggcgtgcaagccccacccgtaccgcgacgacgtcctcgccggcggcggcggggacagggggctgtacaagggcacctccttctgcggcatcctcgacaggttcacgtcggaggacgtgctcgccgtcgtgccgaactggaggtgcaacacgacggacgacgcgctctgccggcggctggggccgttcgagacggacaaggcggtggacgccaccgacggcgggttcgccggcgtcaggatcgtgatgcaggaggtccggtgcgagccgaggaccgacggcggcgagatctcggcgagggtgtcggcggtgttccgcgccgtcccgccgtgggagcacgcgtacacggcggcgaagcgcagcgggctcggcggcgcgacgatgtccgccgagggcgtgtggcgcgcgtcctccggccagctctgcatggtggcgtgcctcggcgtcggcgccaaggcgtgccactcccgcgtgtgcctctacctgcagaccaccttctccgccactcgccgcagcatcacggtgggccagatcaccagcatcggcggcggtgccgcccacttcccgccgctgacgttccagcggacggtgcacccgatggagctgtggagccggttcggcgtcaccggcggcgagccgctgagcttggcgtacagctacaccaagaccaagcaggccggcgagttcctccggcgaagcgagccgttcgacttcggcaccgtcatcgccaagtcgctgctgagctacccgaggaaatccggcgacgccgccgacgagacgacgagcctctccaacctcgccgaggagctcacgctccacgtcgccgccgtgccggatccgttcccacgcggacgattcgagcggccattccttcagcttgaggtgctctcgctcggatcgctcgtcggccgggcctcgccggcgacgtttccggggacgccagctgcggtagggcaaagcatggcatcatcatcgtcgtcgacgacgacgaagctggatgcgacggctatcctcaacgtgtcggcggagctgacgatctccggcgacgcgtacgtgaacgtgtcgacgctgtccttggaaggcgtgtacaacccggtggatggccggatgtacctcatcggctgccggagaatccaggcgccgtggcgagccttctcggcgatgggcggcgtcgaggaaggcatggactgctcgatcgaggtgagggtggagtacccgccgacgacggcgcggtggctgatcaacccgacggcgaaggtgcacatcgcgagcacgcgcggcggcggcgacgacccgctgcggttcaacgcgacggcgctccagacgctgccgatcctgtaccgggaacagcggcaggacatcctgtcgcggcggagcgtggaggggatcctccgcgtcgtgacgctggcggcggcgatcgccgccgagttcagccagctcatgtacatcaagtcccacaccgacgtgatgccgtacgtgtcggtggtgatgctgggcgtccaggcagtcggctacagcgtgccgctcatcaccggcgcggaggcgctgttcgcgcgcatcgccgcgtcgagcggcgacggcggcgcgacgccgccgccgtcgtacgaggtggacaagagccagctctactggaccatcgactgcgtcgtcaagatcctcatcctcgccgcgttcctcctcacgctccggctggtgcagaaggtgtggcgctcccgcatccgcctcctcacccgctcgccgctggagccagggcgcgtgcccagcgacaagaaggtcctcgtctacacctccggcgcgcacctcgtcggcttcgcggtggtcctcgcggcgcactacgtgagcgtgctggcgcggccggtgaggtcggaggcgtcgtacatggacgcgcgcggcgaggcgcacgcgctccgggagtgggcggtgacgctggaggagtacatcgggctcgcccaggacatgttcctgctgccgcaggtgatcgggaacgtggtgtggcggatcaactgccggccgctgaagacggggtactacgccggcttgacggcggtgaggctgctgccgcacgtgtacgactacgtgagggcgccggcgatcaacccctacttcgcggaggagtacgagttcgtgaacaccagcctcgacttctactccaggtccggcgacgtcgccatcccgctcgccgccgtcgcgctcgccgcggcggtgtacgtgcagcagcggtggaactacaagatcatcagcaagacggtgaagacgcagcagaagaagctgcagcacctcgggtcgcgggtgtacgagcgactgccgtccatgtcgtcggccaacttcgaggccgagctcgtcgccggcgtcaacgagggcgtcggccatggcctccgccgcgacgccagcttgagctagctagctacactgctacacctcatcgatcaatcgcctctcttaattactcagtagtcttctcttgttgctttcttaggtttttatgatgttcttcttcttcttcttcttcttcttcttcttcttcttcttcttctttatttcttcttaattagatcttcagattcttcttatgatatccaaatgtactctactacaagttcaataaagttttagtttcttatagctctttgttcacatttctgcacttcttgtgtgtgtgttcagcttatgtgacacaaagtgttcgtgctgacaaatt

SEQ ID NO: 65719 - DNA, 1210 bp, Oryza sativa
aaggtggttggaggcatgtaacatatgtgttgagtatagtacaaataagtggaggagagaagaagggcaacagagagaggggctatttttgccagaaaaggaggaatcgttttcatcccaagtacttccaatggtttcatgcccccatttggatctcctctctatatctacagcctttctggttaagctagccctcttgtctccatgcatccagatgctgcaggttcagtagtgacagagacacagagtgagtgagtgagtgagtggagcctagagaaaaccagcttacaattgcatgcatgcatgaagggaattgatgctgtgcatgcaacagtccaatgccagtatgccactgtgctagtgtgcatgcatatgtggctctcattgcatatgcatgcaaaaatcataaccaaatgtatctcaggtgttgatctttcagtttcctagtagcaaatgctgtgatatttgaagtattgttagtcttagaaatttcaggatggctagtgtcatgaggatggattctcatctctcgggtggacatccacccgagtgtttaaaacagtttcccctagtgtcattgattagttgggtggtcaaaaggggagcaagaaccaccagattttgattgctcatgagacatgtgcattagaatctataaaattctcacgcatgcttgcttacattttgggggtcacggttcaggtgtgccacactcacactggtttggttgaactatgatgtgcaattgtgcatgcatgcatgccaactgagagcaccagccaacaccaggtagatgaaaggatataaacacgggtaagcaaaattatcaaggaagcctatgactaggcagacaagtatttaatttgagcaaagttcagcatgatccctagctgtatttactgaattatttagcagtttttcaccccacgtatatgtgagaggcaaatggccatctctgaatttttagattgtttttttggtttgtgaataaggctatatagtacattgcacaatgtacttatgatctgctagtgtgtgttggtagatgagagggttcttcgatgggatttaaccacatatgctgctgtgaagaggtaaagacaaacatagcaggacaaggatataaagtaaaaaaggagattaccacaccatgctgcttcagaagttcagacacgctctggctgctgcatttttcctgggccaatccaaa

SEQ ID NO: 65720 - DNA, 708 bp, Oryza sativa
tatttagtagttcgaaaagcgagaaagttaaagtttggagatgagaaaaggtactaaggcctaggtactctataggcttaaatacgctaaataggcttaacatgttagcccagcccaagatgtttcctgcaagaaacggtgggcctgaacagagcggccatgttagtccgagaccatttgcgaattaatgggcttctctgaaactctgaactttttccttccttttttttttttttgcggggactgaaactctgagcttttgatgtgcttcttttcttctcgtatcctatcatcagttcagagaagttcaggtgcgtgtatcaaacgaagaagaacaggatcaccgtccttttctggtcgttccatcacacattcacattgccaagaagacattttcatcgcttgtgaactctgaagcctgaacatttactagtactacacgggcgaggcgatggttttggtttttgtattgttttctgcaggcagaaaacaggtctgaacttttcctgtcacgcactcacacgggaatactcctggatatatactttcagagtcaaagaaatacgagtatttgcaagtttgagccagtagtaaaatgatgaaaactgagacaagacccagcttcagccgataagcagtagaaaaagcaaattacaaacttggctctgattgtttgaaagctcgtgccggaaaacatgcctccgattg

SEQ ID NO: 65721 - DNA, 2966 bp, Oryza sativa
aaattgtattgatcgtagagatagattacatagaccccgggtgtacatatttatacccatgggttgatacaagtccttgtcggataagaaagaaactaacctaaagataaaaggaaaatataaagtccttatcggacactaaacacactttcctaaagataaaaggaaactaacaaactattcttaattaatagataaactgccatgccgcatcctttttaaactcgttcaattagggataagcttcctttagtagattgatttccttaaccgaatatagcaggaatccgactattggcgacttgataactcccatcggctgattccgagatgctgcagccgataatgattctaagccgatgacgtctttgccgattaccaaatttcactgttaacaccctttgaatcacagggtagaaaaaacagaggaataggaaaaacacaggattctgacaggaattaaaatgtaaaacaaaggattgcaaaacacataaaaaaacaggaatggtcgtttgattggagcgcagtaaaaacgcaggaatcggatgagagagatagactcaaaagaatttttccaagaggttggagctcttgctaaatttcctccaaaatccacatgcaatgtgccattccataggaatttcataggatttggaaagcttcaatcctttgaatcaaataaccaaataggaaaattttctatataatttaaatcctataaaattcctatataaattctttgatttaaagcggtcctaagtaagggtggggaggttgctagctccatgtcgaacagaaagaagcaagagtctcgagtctcccactaggcgagggaaggagacacaggtggcacccctggtggccgcggaatgacggttgtgcccctggtggcgaggggtggcgtggggggcaggacggtaaatctgcagtggagggggaggcgactgggcggtgagctgatgagggaggggggcagactggtcgctgacacgtcgtcggcgagcgcattgaccgttcctcccctgccacccgccacgtggcccgtcgcctgtcacgatgtcacatgccccgccctactgtcctctcctgccctgccctaccggtacgtgctccgtctgtcccttaaaaaaattccatgatattttgagacaaatgaatactccctccgtatcaaatgtttgacattgttgactttttagcacatgtttaaccgttcatcttattcaaaagaatctgtgaaatatgtaaaactatgtgtgtacatgaaaatatatttaataatgaatcaaacgatgtgaaaagaataaataattacttaaattttttaaataagacgaatggtcaaacacgtactaaaaagtcaacggtgtcaacattatgaaatggatggagtagtatttacgcttttaatcttaaaataaaccaagtcttgtatatgaaaataatactgatagatattatcttcgttccaaataggtactccctccgtactcatcaagatagtaacacagtctccaaaacacaactttgacttattgtttctataaaaatatttattgaaaaatgatatatgtatacttttatgaaagtatttttcaagacaaatctattcatatattttttacatttttaaactcaacaacttaagagttattcatgatttatatttctaaggtttgacttaaacattgtcctaaacgacttcctttgcgagtacggagggaatatccttttaggattcaatttttttccaaaatatttgtactctaaaatattacctctgtttcaggttataagaacggaggaactatttatcctatccatcttcttatattaaatttctccttgttataccctccaattgccactccgattctaaccatatcatttacagaaaagagaatattgagaagatacgcaaaacgatgtgagccattagtgcatgattagttgagtattaactattttaaacttcaaaaatggataaatatgactttttaaaacaactttcttatataaatttttttataaaaatacacgtcgtttaatagtttgggtagcgtgcgcgcgaaaaacaagttgttttctctctcgatctcccagcaaggaacgcaaccttagtgaagagtagtatagtattttaacttaaaccttaatttatgctaaactaacaaaaaaaaacaattattttgggatgaagggagtataacctaacggagatcctctgcagggtagtgctactcactgggcacaagggtttatgccttatagatccacgtgtcagtgaacagtactgcagagaatcctctttcaatataaccttattctactaagataagcatattatactgctgatgttggtcatcggagatgatcagcaaacatttactaaagtttcaaagaaggaaaagaataataaagctttaatactactactacacatttggtcctggatgaatggggaaattagggcttatttgaattaaaggatttttatgatgaggaaaaaaatggaggaatccaattcaaaagaaattctcctactatatgagcagtttagtttggatcatacgattgtttcaaagggatttcaagggataggaaaagtctctccacatcttcgaggaattctagcatggggtctaacctcgttgtttcgaattcttttgtgatttttaaggcatgttctctcctcctctctctagcaaattaaacatgtaatctcaattttctctcacccgttcgatatatccaaacacttgtgtttgaatgattcctgtagtttgattgcttggaggatttttcatgtgtgacatttcaatcctaagttttcctcttcctgtattttgagtcatgttccaaaggaacccttaaagtggacttataactttcatcaatacatatttggtaactcatggtaaggagattggaaatttagagtaataagctaatgagggctgcaggaa

SEQ ID NO: 65722 - DNA, 746 bp, Oryza sativa
tgtaatgaagaagttgtttgggggtggttaaactataaaagcgataaaattcaatggtccaaagtaaaaagattggtttactggtgattcaaagaaaaactataataataaaatatagcctaaatttcaataactatttttttatgaaggaagtagcagtatggtagcatggaaatgaaacgatggactaataaaccgagccatcatcatgtctagctactactggctactgatctcaaacggattcgtccacatcttgtctatgactttcaatgcaaatgatgctcagacagattatgatattatcctaacaacttttatccttcctaagcgatcgatcgacgattaatttcacatatcgtatttaggctaagatttgtcaattgaatcatgttccattttccggtgctttgtggtagcacaaaaggaaacaaaaggacattgctcatgggaccccatgctgaatgaaggagccacacaagggataagagtgatagatccagcttataccaacatgaaacactgtgtttggcttatgtggatgaatcagtggacactatctagtgtatggagaggatccacaaatggggtacttggcaattgagcatggtgtttgcccccctggttcaatggacttgattgcgattgatgatgattttaattaattgctaatatatactaattagacatgtttcttaatttccccttgaaaaagatgaacatgcatgacatctataatacaggtt

SEQ ID NO: 65723 - DNA, 1323 bp, Oryza sativa
cgctctctcaatctcacttctgtactccctccatctaaaaaaattaatctaaaaaatttaatccagtgtaaatctggacacatataactctattatagatgtgaatctggatacacacttagaattaggtgtttttttgaaacgaaaggagtacgcaagatatacgtatgtatatagagagaacaaaccaaatatatttgtatatacattagcagcagatcaagctgcctccaccactgtacgtatgtatatgtatacacactggtggagacagctcgaccattaccatttacgaactgccattaacatatgtaaaatttgatcgattcgttgcttctttctttattacaaactgtcatcaatatataaaaaaattgatcgatcatcgtgaaacgctattggtggtttgggcttaagaaaacagtatgctgcacacggcacggatgaatgatgctgggaataccttcctatacgtccggacacgaatgtctagctatagctagtagctgcatatatattcctctcgagaagtagaagatataaggatgtgtttggataatggaaaatagggggtgggattgggattggaaaatgaataaagggttaggattaaatggaagagggagaatgaatggttagtatttaaagatgggtgggaaatcatttccctttcccatttgccaaacactcactaagagcaagtataatagtgagctataagcctactataagcttagatggaggagagaggtagcgaaaaattaagaatgttggctctcatgcaagagctagcttatcactagctctaagacaaatgcattaaatatataagtgagagatagagagatgagaagaaaattatagtcaatcttatagctaatctattatatatgttggctttaagatgagctaataatagaaagtgtgctctattattatcttgctctaaagggaaaaaaaaaggaggaaagatggtagtaataaaaagctgggacgagtggatcgatccatgcatgtgttgttgcgtacctgcgatgcaggtagaagatgctcctactgccccccttttgaaggtgttagatcttcaatccatcaatcaatcccgtttcttctccatctctcatcgccacgcaccatcgatcgatcaccaaatggttagtactcagtacagtactcctcatacctttccttttccttttcttttttttttctttctttcttgttagtagtagttgctgctctagctaggttgttgttttgcagtcctcggaggcagcagcagcagaggccaggggacgcagaatctgctatagctagctgctg

SEQ ID NO: 65724 - DNA, 1332 bp, Oryza sativa
cgcagaagccggcgaccatgccggcgacgacgccgaggaagtcgtggcggaagccgaagtggtcccggaggaagtcgacggcggtggtggtggtgatgccgtcggcgagcagcagcggctgatccaggtcgccgaactgggaggttagcaggccgtacagggtccatgacaccgggttggcccagtaataccacctccaccacgcaggaatcctctgcattatgtttaagcccattaatcattagccactttaatcacgtcctaatttaaacaaaccattattgcttcccaattgctaaagtggttctagtacatgacaagtggtcactgtaggacaaaaaaagttactggtgggtttggtgaaattattaggggcactggtatatcagggcactcatgctccattatagtacaatgttaatagaaactaaaaactactatgcaacatagcagcattttagatgatgtgctaaggaattataaagaaaaaagagtgtctcggatgagacattgcatatatattcaaaccaggaaaatagatatctcctctaagaatttctgatgaaatttgcgaagggagataattcatttttggccccagtaataaataatatgcattggaaacactatttccatagctatatatgttaatgtgacaaaaaaaaataaagatatggataatgtgcactggaagtggccttatggattggaaacactatttccatagctatatatgctaatgtgacaaaaaaaataaagatatggataatgtgcactggaatatggattatggggaaaacagatcatgggtccagtacaattagaggacgttaggtgcaaattatgcatggggttcctgttccttccgtacctttcttgggatcatgaacccacagaagagattccacagcgtgtagaatggagcagcaataataggcgcaacagtgtggttgggagtgatcgccgttgtcatcatgccatagaaagtgaagtacagcaaggtgaagtacatgaagaacaggtaccacaagaacttcactgctgtccactcgaacgagcccaagctgtagaaaatcgtgccgtagataagtgactgcacaagaatgtaagggaactccactgtaacctgcatgccgaagaacagttcgattgttagccttattatggtactactacgagcatcaaaacatgatgagatgacaggagtttttgacagggaaaattaccagggagaatgcaaaaggcagtgccgagtacatcccagctgccctctctctgtacgagacaaatctttcgatggaaatcacaggttgaacagaggtggcgttagtg

SEQ ID NO: 65725 - DNA, 716 bp, Oryza sativa
attagtaaagatggtcaacgcattcatctatttgccatcatgggaatacagaacagagaaaatacaactatatagatctaaatccaggacataggcaactattctaattacaaataactagcatacagatatcacataacaaacaattcaccaacatggccaccatatgttggtctctgtttccagattagcaaacaaagcaatgcactaccatattttttctctacagcacagtagctcaacagatcaaacagaacacaagatatatgataactaccatagtttggtaagtctctaccacaaaggggaacagataatggggatacagattttcaacagtatgaaatacgatgttgatcatagggtaaaaacaagtcgcaataggaaaacgatcacatcatccaaacacaatcacataccctaacgcgattcatgcgttcacaattttaacagtatgaaatacacgatggtgatcagtgggaaagcgctgtcactcataccgatggcgagtagcgtgggcttcttcagcgggcgatccgcctcgtcgtcgggctccggcttccggcgctgcacgatgtggaggtacacggggttcccactcttctcgtagttccacgccacgtgctccctcccgaaccccaggaacgaggtcatgtcgacgtacagcccaccctccgacctctgcacggcgaaatcggcgtcaaaaccctaaccct

SEQ ID NO: 65726 - DNA, 3745 bp, Oryza sativa
tatttacataaatttttttaataaaacgagtggtcaaacactacgagcaaaaactcaaaattccttatattataggacggagggagtacttctttgtttgatattatatttggtttttttctaatcaagtttcattaagtttgattaatttataaagaaaaccaaattagtttcactaaaactaatatttaatatattatgataatatatttgttttgttttgaaaatgttgctatatttttttataaacttgatcaaactcaaaaaggattggctataaaatatcaacacggcttataatagtaaccagggataaatatgtgaaacaaaatgatacatccatctatccctaatgattttttttcccaattacaccggggacttttttttttgcaaagtctgtgttcttccccagtatacccaactcacctctcccgttctccacgcgcacgcttttcaaactgctaaacagtgtattttaaaaaaaattatataagaaagctgttttaaaaaatcatattaatcatttttaaaaaaaagttaatacttaattaatcatacaataatacgtatttttcgttttgcctgttgaggatgaagggttcacaacccctcctcccgaatgccgcctaagaacagtttggcactactactccaagattttattagctagagcgatgtaccaaacaccttcaagatcttaaataatgtagagtggaatttgccgctttcctcctgataattatacggataggcatttccgctactcaaaaccgataaaaagttcttgtaaagttggattagatgacattccacccagcctgttttagaaacggttagaacctctagattattttggattactaaaccagtattttccatctactcggacggcattttatcctcctcactttatgaacgagaaatacatttttctccaggttataaacctataaagtcaagtggtaaactaaacaaaacagaatctgagaacctgttaaacctgtgatgatggttgcaacaactaagcattgtatttacctctgatcattctgatgaagatgcatatgactcttctcaaaaattcccatgtaggtgtagctatcattgtgaaagccctacaggatgcagtgttcttccaaactgaagatcagagagaaagatgcacattccctatctgataagaagaaaaatcaatgttcagagaagtaactgaacatctctgatcaggaaccaatgatctgttcacagatttgtgttgcaatcgatcgatcaaaccgtgtcatgggtatttttggacaggctggggaatctaagagccgtgcaaagactgaacatgcaaacagggcaaatacattcgtttattgcaggccagagatgccgattcattgctttccccagacaccaagcatccgtgacgaaaccacgtttgtaaaattcagtaagaaaatttccaatttcttgctggaattgagcatacttcttacaaaaaaagtcccttgaaattcctacgagaatgccacattcatcacattcttcatattcatagcagagatgcagcagaataacttcttagaattcagaccataaacacttcagtagttcagatagactatgattaatactaaagcatagttcatgttctgtacaaaatgctactttcccagggtcagcaaaaggtatactaggatagcaatattttcatcagtcattcagtagccagctactttgtgggggatattataccatatagagtgtttataccatcatcacacaatagctcttcagagctgatggtgtgaccaaaaaatgaggaagaaaaaggcccatccttagaagagggttagagggcgcggctagcttgaaagcacatcatttccacagcttgacgaacttgtcgtggctcgtggaagcgaccaaccggagcttgacgacgccagggctgtgatgaggctgtcatgagctgcgagcgtcatcgttctgttctccgacatgtcccacagctcaagagactgcggcattcaaacacaaaaccagaggtaagcgtactacaggcattgtaaacatgaaccgcggtgaaaacataagtggtctctatggccgaatgcttgttcttaaataggaaaagtatttcattgcagtaaatcttcaaaataattgcatgtgtatcatgaaggaatatttgaggaacttgatatatgtgtaatgatgtactgaaacaagtgtggaatgatcctcagtgtgagtgagtagtcatgagttgatctagaaaaagtcatttttaaccagctacttaggaattaggatgatcagtgcagattagttttgaatgaatcgtgacgcatgagcataaaagagatccacgaatataaagtacttgcctggtaacaaccaatgataagcatagatgaatatgaagggtggaaagcacacgagtgaaacttgctcccggtacagctaagctcttgcacgcagcgatcatcgctcccagcattcacagaccacaccttcaccgtgtcttcactgacagatacaacatattcgccactgggatcccagcatactgaatcgacatgctttgtgtggccctgcagttcccaataaagaggacagattaaagtgattggttaccatcactcggaaactctaaagattaacatggaagtgaacactggctacagctagcacgatgcgactttgaaaatatgtaaacaaccaagcaaggacaactaaccatcaagggaaatgaacaccacaaagctaattacaaaataaatagatagatttgcagtatccaaaactcactctaaaaacgagatttgaaaagtaaatacatccttgcacatagatttgttggtcggtatatatgttactggaacctcagtgaatttagaagatcagaatgcacgtgccaactgcaaggtagaaagtctctacaaacctcaaatctcctaaggcaagcttgagtctccacatcaagtatagagacagcattctccgaagctactgcaagatatcccccatgacgtggttgaaatctcagctggcttgatcctccctacaaagggattggaaacaaataaatcaagaaacagtgtatcctacaaggcatctccttttgagaccagttgttgattatggatggagacacctaataacagcccattaactacaaaggggttatgacagtgattgaaaccaattaacaagtaggtatggaaaacatctaggatgttttcttttacgtaattttaggatgttttcaacagattgacattcatcatgcacattttctataaagagaaaagtctacaagtatacgttggagtgctttgtcaaggaaatgttaggattgttcacaataaagcagcacttccagattgacagaatgctgaataagaaaaactgagtaaccttaaatatccggacgatgtttccattgttgatactccagaatcgaatttcattatccccatcacaagaacaaatgaggtcatccttgtttgggtggaaatccagtgacataacagatgctgagtgcccagtgaacgttcgaattgaatagccttgctgcaaaagtacaatgacagcattagaatatgatgagcagtaaaacacaacagtactttgctgcccttgcagctttaacattacaagtactgacattacccaggaatctgaaagttcagaagtatcatgcttatatcccctagagaacaaacaagttccacttctacaaaatgaa

SEQ ID NO: 65727 - DNA, 716 bp, Oryza sativa
atatcctagccatagacaagagtaccgacccaaccccacctacggccggaacccctgggacaggtaggcaagactgagcccctagcagcaggacactggccctgtgccatgacatctcgactaccgggccacagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagacctgtccttatatggccgaggtgctactatcaaaaccatgcaccccgagcccagcctaaaaccattttgagggttttgaatagaggggaggtgtgaatccaattccacatgatccaacaattccatagtgtccaggtgatatgaatatcccaaagtctagagttgtaaaaccacctaatgttacctaattaagcggcgaagcatctacctaaaatcatactagtggtaccttgagtagagtgtccactagttggggttttgtttattctagggtaaacaaggaaataataacaataacaataataaggtcataacaaaggtaaataggcatggctagataaaacagtgataacgcgggaatttaaataaagcgataatgcaataatttaaatcaaaataattttataaactgggattcaatat

SEQ ID NO: 65728 - DNA, 830 bp, Oryza sativa
gacttttaactttgcacattttaattgttggaggctttcacacggattttaattattctaggcataatctagaggatgtattttagagtcattttgggacgtgacaattgatttcatatttctcttgtggagcctatcttcagctagccttgcaaagagaggggaacgatgaagaacattaatatcattgtgagatcatggcaaaccgaagaatgcatgcggaatccaaagatcttttgaagcaacaacttccaaaactatagttcgtttgcttaattttcctttatacatgcctttccatgctgaagggcaatttttccactcccaatgcatgcaatctatggatccaagcattccaggaaaacttctctgctctccaagtgcaagtaatctagaagtgtcagcactagttggataacgcaagtactcgtctccgaaaatctcaacaatagctctcacaaaccttttcagactctctatagtggtactatttgcaatttgcagatattcatcttgagtgtcggctacgactccattggttatcattctaagtgtagcggtaatcttttgcaatggtgatagacccaaagcactagcatcatttccttttttgggctaccacatcattaactatatgcgcaagaaaagaggacgactcattccaaacctacgcaacaaaatgtgaattaatataagtggagaacaaaacaatatcaaccaaaatatgtaaattaattgcaagccttctccagaataagactaggtcatatgtaggatgctccaataagtagttgtggtgcaacctatcatggccggctcgacgattacga

SEQ ID NO: 65729 - DNA, 4070 bp, Oryza sativa
ttgtacctccagctatgaagctacaacatgatattccaaatttactcaaaactcattttcaaagttatgtacaggccacattttcatgctcaaattagtcatattgtggtagaatgaaaaatggaggcaatgtggatgcacttgtgttccacaaataaaaggaaaaagtagtggtggggtttaaccatgaaaagaaggcatttttcagaatcgtttttaatacaatgtgttatgcattttgaaaaatagtgggcactaatcaatttgaaatctaaggatgcttacaatattacatattaactgggaacagcgtaacagtttaacttatttgaggtaacaaaccttcaattcaatatcgacataatttactcctagctccattgctaaacggagtgcttcaaatcttgtagcatcatcaccttcatattggcctccttcccaattgggtctgcaaaagaaatatgcacatacaaatgtcatttatgcaaagcataacggtgaatctaatatgcagtagttatataaatataaccaacaactacaaagtggggagcaacattgtgaagtaaaacaaatgtacctgcattgcatagtaaatcaattaaagcacagaaattgaaaagataaatataaagaagagagaatcaaataagtctggtcattctgtttacgtggaccttttttttttaaatcccagcataatatcaatttctagagtgtcaagggtaatgatgaacgatcttatgccacttgtcaagggtaatgatgaacgcaagtcctctcaactagtttagcaagcaccaaccttgtcaaaaacgacaaatgatttcaccttgtctcaatcggaaaaggacgaacaaataaattgggtttaggttcttagctgggcacttttcaaaatttgtggttctacttgaaatcttgaacaatttattcacatattaataaatattcaaacttagtcaaacaatatagattaagctatatattcaggaacaaatataagcttacaacttttgctagttttaatgtcccacaaaatttaagaatgtgttatcacaaattcacaacagctccataatcccccagaaaaacagagaactaaattttctccaagttgttctctatattttaatagagagaattatgtttttcttatctcctctctagtggatctcacatcaatttgctcgtttatttcagatcacaaagccatgtagcaggccaatgtggcaaaacttgtggaattagcaattgtaaaagatagctaggtatagattattgcctattctatcatgtcttaaagagcatgcatgctggatttctcaataacctcgtgcctactttcactgagtgcgtagagaatgtgcagtaatatggtcctatactattgtagtaactatgccatgctcatgcagtaacatagtgcttcctctttccaaaaatctgagacctatttcattctttagtttttctaaaaatctaagtcctatttatagttactatgtgctaaattaaattgttgatcaattgcatgtttatttgttttgccacatggtgagtgagttaattgcttattggtattgatgaaaaagaaatagatctcagatttttcgaaggagggattagcttgtatataggtagagtaacacgctctgggataagcaactggtgcaataacatgttgttaccaactattagccatgtcattgctacatttgccctatttatcctgatatgttgttatgacacaagtcttgacaaaaagaaatggtttcactgccattggtaatactgttactatgatcagcatctacaatatgaaatagggaattaagtaattgttaattgccaaaataattatagctgttaagggtagcagtgtgcgcttaggccatctccaatgctaggtgcttatatggagcttagaaaagaaaaaacaaaatccattttactacccaaactaatccaatagctagatcacttaatctctgaaatattttttatcctccaaactattgaaaatggcactttacttcttaataacatctcttttttttactctttatacaagactagaaaaaatgcccgtgtgttgcaacgggtgaagtttattttaatcttattattgctatattgtttagttgagatgaaattcactgtagtaattcgcttagatatatatatatatatatattttaaaaaaaatcatgagctgtatttaggagtccgattgtctcaagctagcatgcgagtgtttttaaagaggcttcttatatgactcctttattttcaaaagcgaacgaacttaaaaaccgactcatacacagaaaacgttccaaagtaccgataaaaacttcttcaatttttataagagtagaaatatattttaagataaaactttttataatcatagatggcgctatcattaaagttaaaactacacgaaaattactttgcaccggccaagtagagacgcctcgcgcagatgccatggattaggctgccgaagatgtcaaactgataagtttgcttcaacttcttacataatactttctcagaataagttcatttttcaccaatctcacacatatcaacataaaactgaaaagactagaatacatccactttatcaaattctaattcaattatttgcactttatctgctcccaatgcatttatctggcctctactttcacaaataccgatgtaatgtttatctaaaaaagaacttattttgagataaataggagcagccaaaaataaatggagggagtatatgtctgcttcctctcctctcattgattggtgccagttctttgccgcgtgagcatggtggcaaaacaggataagagaacctgagctgctttcttcgtctcaaaatacagcaatctaagattggatatcgacaggggtgaaaacgggcggatacggtcggattatggcattcccatatcctaacccatatttttctttaaactcggagtcgggtacggttagtgacggataatatatcactcatctcgtattctatcccatattattttcatcaaatcggattcggaaacggatatctatttgtatctctaattcatagatattaaacataataaggtaattaaagtattaaaagagatacatcaagagaaaaattatgcaatattacatgtgagctcataaaaaatagtgattaaccaatcttttatcatgtttgtaagtggatttataatagattttcatatatattttataatatggggtatgcgggcggatacatgttttcccgtatcctaacccatattttctaacgaattcggattcgaacttggatagtattgggtatcccattttttctcccatattcctcctgtgagcctcgggtagggcgggcggttggaatatacccgccccattttcatccctagatatcggtatgttacaaatccgaataagtgtactccttttttttattatttctttttaggaatgcctagaatcgggcgctcgacgtggggagtaaaatcgggcgccacacgtcatgccctcccgcgcgcgcgccctacccgccacatgtccccgcgctgctcccgccacgtgtccccaccatacacgccgttgcaacaaatcacccacatattatggaaaccctctataatgtactcataatgtttcactatgtatggatcaaatgttgcagtgaattgaaacaattcttttgtaacaaattacccacatattatagaaaccctctattaagggaatccatttcatttttttccacaaaaaagttcacgtaatttacttattgtttcactatgtatgaatcaaatgttgcagtgaattgaaacatcatttcgctattcgctgaaacattgttttcatataaggtgaaacagcgtccgatgaaacattttcgatctacttagtaaaacaattccatatacttagtgcaacagcgtgcaacatttattaaaaataattcaataataagcttaaaaaagttcatcggattatattcatgtgtggtcttgttttaaagatttaattgcaataaatttaatggtgcaatc

SEQ ID NO: 65730 - DNA, 5793 bp, Oryza sativa
tgcagtatttcttctctttgatcgcaacaaagcatgtgctcgttgttcttcgggaagcatatgcgacaggaatcggcagaattatctatctcacgattagttcgtcgccattcccgtagcttcagaacttcatgaccgccagactgaatgaatttgggcctgatatgggccttcctgcccccgcaatcaaaacacgccatgaaaaaactaaccgtgcaattaaaaagcaatggcagagcgattttgctatatctcactcgaaagattttttcttatctctcactcgattttctcactcaaatttacagtgcattttcttgtaagttatagtgtaatttatgaaacttacactgtaacttttgtaagttacactgtaatttttgaatcttcacatgtaaattttaaattttatatttgatttggtctttttcttgaggatatggtaatttaatgttcattatggtgtttcttaattgctttttgctttttattatatctatcagattttaatacaaagattaaaaatctgtgtgatacgattataaaaatctttcgaaagatgtataggtactcccatggcagagataacaacagcatgtccgtactattatagtatactaatttttggtagaatgatattgctaagattttgttttagattattacccctatcaaaatttagcaaagttaaaatgatgataaagtgaacaaccgaacatatacaagcttatagtatcgcagatcgcatagcctcacttgacactgcctccctcccagtacaactctcccaagtcccaacacactctgactgccacaactggctgtgcacatgtgaaacatgccatgcgaaaaaaaaaaagtagaaatagtactaataccagttctaaaaaaaaaagtactactaatagcggatagagcagaagtgtcacgtactgtaataaaatacatgctagttgttcgcttagattatttgtgcctactagtctgttctaaaagaagataaaaccctatatacaaacctgacacgcatatatctaggtttataattagaattgattttttaagaatgcaggggtacatacgactttgattgttcaaaaccacagctgacatgtacgtgaaaagaagcaaacaaaaatatggtttaatatttttattagcggtttgaaagcctatattaaaaaattgttttcataaaatgacttcaaaatcaaactcttctaaattcaacttctggatgtggtagaaaagcaggcgaaatctttatatgtatctagtacgcatcgacggcatcgtaccttggcgcaaactcatcttgttgaaacaaatcgcagtactaaaaactatatcaagtctcatgaagaattaacctatattgtattgacgagtgacggagtgagtataggaaatactagagtacaaactacaaagtgtttgattcctgagggagctcgtgactcttataatatgtatatggccagcattaaggaataaaattgttcactctttagtcaagttgccgttttatttttcttgtcgtatcctctctgcaccgcctaaagaaatagttagaaaaagcttggatcttcctcgggtactgatgtgaccatggctactacggatacaaccattgctcacataatgcgtgaacaagaagacatcaagatcaaggtctccaagtgctggaatccgattcggccacctgctgcactgttgatttcaaacggccgccgaatctgcatacgacctccgtttttggcccgtgagtacttgatggaaagcctacggagtcctctttccaatggatccagcctcatcgccaaattccatcctagtcatccgcggatgaacaaacaaggtgctgcgtcacctgtcatgggcctttgggcttgtaacttcgtttgggaccctggcccaagtggggcccaagtggggtgcgccccaaccaggtggagcacgaccctagagtgcccttggtcgtcctcctatctctttaaatagttaggtaccccttcagagtttcgcgggttttgattaattgtaagtttagccattgctacttcgcttgcagcgcgcgtgtcggctagaccgtccgtctgcttgttcggaaccccactttatcgtgtatcaatttatctttgtgcgtcttgtctatctagcaattcagttgctttatatcttgttcttgcttgttctcgatagcttgcaggaataaggttgatctgcaccggcaagatcaacaacccacggagaggtgtatcgatcgctaaggcgcaacgcaacggttttgtacagttgtagtcggatcgtcaacgtttctcccaaatcgtagttatcacaactcaccgaaagatcgggccaacaacagccttgagtgtcgagatgaactcagggttcatcaggtatgtttcgcttcactttttttaactactactttcttattttccacgcaaactttttacgaggtggtaaatgttattttcttaaaaaaattctacgtaaaagttgcttacaaaatcatattaatatattttaaaccaatacctaattaatcatacactgttccggtttatgtggtttacgtgggaaaggaaaaagatcccaatcgtttcaaacgaacgcagtctagccgcataagtactaattaaaagcattagagaaatcacacttttaaaagcattgagtaaataatctgtgctaaaaattcaaaagaaaagggaaaaaaacagggagcgcccaaaatccatcccgaaaaatgtatacaaccccaaaagcaaagcaaagcaggaataatcatgcatggtaagctgaaacactcgaaacgttgcaacttgcaagctgtgcatatgaacacgcgctaaatggacgcaaatcctgtatcaaaccagtccagcgcgcggtgcgcggtagctgcctgagagagcacgacgtacggtagggtagcaagagcgggagagggccggggttctgacctgtaggtgacgatggcggggagcgggcagccgcggagcaggcgcgggagatcctcccgcgggcggaacttgctgccgatgaagtcgagccggatctcgacgaggtcggcgccggcggcagcggccgcggccgcgtcggcccgcatcgcctccaccgtgcgggccaccagcggcacgcacaggagcgtcatctcctcctcctcctccttcggtagcgacgacgtgaatgctcgcgcgagcgagatcggcagtggcagagtgccagagtactgatggtgaagtgtgaggtggggggcggggcgggtcgggtcgggaggtgtgttgggtttgggtgtggcggctgtggcggtgggcgtagcagggtggcgtgggttggtaaggtgggagtgtgggagtgtgggagcagccggccgggcaagggaaattaagcaatttggcattgtgtcggagactcgggagttgccaaattggggttgccgccggaaaagtgataggactatatttttgccgttccggaagatgacgcggacaccgcgtgtcgtggggcattgttcgtcaaattttctaaaaatttgacaaatataattatagtataatcatgatctaattacaccgtatcttatatgtaacttgtatatcactttcaaaaatttcttcgtaacatgctatttcggtgaagaggtcgtgggaacgaatcctcttgcatatatgcgcgcaatgacatttttccttctttagttgcacaaatcttgaaacaaatctaacggttcaaaattatgtaaaagttacatacaagttgcattgtagttacatactagttacattacgattgtactgtaattacatccgtcaatttttaggagaaaatttgttgataaatatacagcaaaattgcatatacgtacatataatatttatatgtactagcataacgtttgtgtattgtaatagattctagataactttcattgacataaattaaaatcatatatcataattcggcataaatgatgaaagaaatataataaaaaaataacgacatgaaaccacaaataagtttggtcggaatgataatttaatattaaaacaattatataactaaatccccttttttcatttagctataaataattcaatacagagaaaaattataagttaaaaataatttttagtggatcaaatagtgctaaaactaaaattgtaaatgaaaaaacaaatgaaattagctagaaattgaaaaagcttactttaactcatagatgaaaatttgatccattaattccgaacgggtgcccgtttcattaacataaattagaattttcctattatattcatattactatggtttcaatattatgtgagtgattcaggagcatggttaggttggacaaagaagcaatagcacccaacaggcattgttcatcgtctttcctagccaaaagcgagaaacaaaaaggagggaagatggatgctggtgcttcggtgaaccaataatagtaagtaagatggtaggatgtgtcccacgatgtgactcgtccatagatgatggatattggcaacgaagaaaatcataacagcaagaacgtgaccgataatgacgtggtcccgatagagagagaaactacaacggcgagttctgacgatgaacacgacgtgaatacaaccggtacctcgacggttcatgtaaaatataaatgcatgtgattacgtcagtatgcaatactggtcatcattgatggtttcaattattttatctatatttaaacaatattcttttcttattaagattcggattttaccccaatttcaattagcacgtttttcaaactactaaatggtgttttccgtgcgaaaattttttatacagaagttgctttaaaatatcaaatatatccatttatcaaatttatgataatttaatttaattaatcatgtactaataactttcttattttatttgcatctacttaatcttcatctcaccagtttcgaacaccaccggttacttttagcatttaactacttttgtcagtttctgctgctagtccagcatataaaagctcaaataccacatgatttgttgcatcaactggtcattacagttttcatagaccgtccagagggttaatagaggcagtctaatcctttggaatcaactgatcgatacagttttcaaccagctagaaccaactccccccatctaataataaatttatttttgactcctcatttatcctaaaataaactcattttttaagtaaatgtatcagagtttgtgaaaataagaaataattatattaaaaataaataaagtgaagaatatctatattgagatttgataaagtaaaagtattcttatcttttaagttttgtgttgatgtgtgagataggtgaaaaaataatttattttggaatgaaggaagtattagagaagcttagtgatccgataacaaccgtagtcaataagaaatcttaggttacatccttgcccaacccaaaagagaaaaacatcgagtgattcaaactgccacgttatcaaaagatcatactcatagagtacagatcctgagacagagcatccttgcctgataaagttccattttaagctgcaaacttaggcataaaccagagctttatataataattctctgaatggacttgaacattcataggtcaaacgtccagcaatcacgtacacctttcttctccagactgacatgaagtacaatggaaaggagtagagcataagcagctgaatattacaatgatgtatcattgccaatcacagatattggttccattacgaatgatgaacatgaaa

SEQ ID NO: 65731 - DNA, 1389 bp, Oryza sativa
agatgaacataatttgttctagtgtacaaaccgttgaaaaagtggatcatccttacatataattcataatatttaattgttgattttttagaaaaagtatttaaatcatagaagcaatcataaaaaatcatataaataacaatgatgcacacatagttatatttagccattgtgttctcactggattgcgtggactctttactcacactctgctcgaaaagttatttgatgggttgtcttccacactgtgcaattgaattggactttacgagcctgtgcattaagcataggatcatgtccaacccaaatccacccattaataaacaacaagaatataataataataataataataataataataataataataataataataataataataaggaatagtactatacatgacatttaactatgtacaatctgttttaactcttgaattattttggagaggaagacagacaaatatatctgtgtattgatgaaatggataggatcaaccactcttgaggtgaggacgagagagggggaaacctatctacctatccagctcatcatgaatctgggacatatgttctcctttaggctgaaggaaactgccctatataaagcctatacttgaccctatactatacttacaccatcagtataactctttctactcttgctgtgacaaggggcatgggagatggagagcagtagagctagtagaagccttcggtgatgcatagaaccttgtcctttggttttttacgagcatatggctagttctatggatagtacgaacttctgatgtctagctacggagtagatggataagtgatttatgtttggggtaatgggttagtctttatgtaaatgaactgtgagatactttctcgatagaaatagggtacttttagatacttccgggcggccgccgctcctcccgctgcacgttgacgacgccgacgccgccgcacgcctttcctccctgcagctgctgacaatgccaataccgatgtcgccgctcctcctgccgctcttcctgccaccgggagaggagaaagagaggaggaagagaagagaagaggaggtatgtggtggagaagagaaaggaagagaagagaccgagagagagagagagagacgcgtgagaaaggcgcagtctcccttatctgctcgatgagaccgaggcgcttttccttatccgctcctcaggcggctcggctcatggctcgatcagaaaggggcagcttttttaaaaaaaccgacacctttaatttattataggtgtttttttcatagaaccaacacctataacatcttaaagatgccttttttatgttttcggaccacggaggtgggaaaaggcttataggtaccggttttagtaaaaccggc

SEQ ID NO: 65732 - DNA, 2706 bp, Oryza sativa
aataataatgtcataatcatagaacatgattgtgatacttagcctgagatggccgatatctgaaacaacaatatagggtcagccgatatctggaatacctcacacaagtagggaattcagtgacgtgattctcagttaaaggtatcactggttgggaaaatagactaaaggaataagattataacaattattttaatacctctgaagagtgtatttgaaccactatatttagtatcttttattaatggatggctattaatatctacagtaataatgtttcatctaagaaaaagagtaaatatactaatcttgcttagtatgtgtaacatactcatattatttcttgctatttgatgtgcatagaaactagtcatgatgacatgtcaaagggggatggcgacagacaggcctaatggggagtgttgtcttctttagtcttcagtttaaattaagaggatatatagctgcttgccaggtgtagggaatagacctgatgacaacatggtggtcagtggaccagtggatgtatttaagccatgtagctggtgcaaaataaatgaagccattgctctagttttgcaaactctagttgggatagttagacattacatcttacctttgtatccttatggaacatatgtatatatataatccctttgtattcttatggaacatatgtatatatataatcagtatatatgcttataaggatacgacagactccaaaaaaaaatgagaaattttgggtcatgacaagctgcttatacaaaaggtgattggtttttattaaaaattacaaatggtgcaactctatgtcactatttaccatctcacagaagttgaacatgaaacaataattttatgtaggaaatgccaataagaagtaaaatgatcaattcgagaaaatcttataaaaatctcagttccttttcaccaaatttggaacacccgttatcgtagcattacataatttttaattgcttagatcctaatagccttctcacagtcctatacggtgttattagttcctccatatcttacatatataagggcactaaggtagcaatacataattgactatgttttttttccttaagatatactccctccgtttcacaatgtaatcattttaatattttccatatttatattggtgctaattaatctagacatattcattcaatatgaacgtgagaaatactagaatgacttacattgtaaaacggaggaagtactatggatctcacacatccgaaggaagcatggtctagatatgtctcttctctatctttatttgtatgatccaattagagggatgtcacgccccgaactagtcccgagcggaactagcccgtgacgctccaaattaacctgttaaccgataccagtcccaggaaacagtgctggtatcacaggaagacggaatatcacagcaacagatgtctctttattatagagtaggagtacagtcatgttgggctgcggacagatcccgagctcacaactgcattacaaaagggaagtggaagccaagacttggaccaaacatcacaggcgcgacttgggaactaggccgaaaccctaaaactcatcgtagccggcttgctcctggaagaactcctcgtcagcgggatccgcttcatcttcttcagcaactgggggggaattatttatatagagcaagggtgagtacaggagtactcagcaagccatgggaaataagtgtttaatgtaggcttcaaagaaaggctgttgtttttgcgattgattttatttaaactcttttctgaaacaactaagggagtgcttctcaaatgacacggatgagacagtgcgtctcgtccggtcggagtatgtgcaatgattcagtcttttgaattgatcaagattggcacccggccaaaagctttcaaacggccacccgggcctggctgatcccatcagccgcagattttccaaacatcaaacccattccacaacagcaaatttcacaaggcagtagtcaaacaaaaactacgctaggaatcacctcacatccgcccatgaccgtgggcacggctattcgaacagttttaataacctctgcagagggggtacactttacccacacgacattactaacccggatcatccagcccatgcagaacggccacgactagagaccttaaggctttcataacaaggcatttcgaaagccgacacagtttcaccatatgccaacgagaggggtcccagaccaacaccagattaggtcccagaccatactatgccaggaagcccaggggtcctccccgacaccaccccggcgaattcacatgtctcttggcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttcctcggtccgcgattttggaaattcatttagttcgcaagcaccgacccagctgtcgggttttccaagtcttttgtaaaacccaagttttacccaagaagtttctcagattttaagtttgaaggcgaccgtcgatacctgtgcagagtgcacgattaccgaggcgcaactaggtgtatacaagggaacatggtataacaattacaatggaagggtcaaatgcaacaaattaggtaggt

SEQ ID NO: 65733 - DNA, 862 bp, Oryza sativa
aagaaaagaaggagggacggaaattagacttccctcgggcggctagggcgcgacccgagagaatggggcggctcggccgaccttaatgggccggctggcccaagaaggcggcccaaggcgcgcgcgcgggcgggaggggagagagagagccggtgggccgggtccatcccgcgtggtcccgggtgggacccgcttgtcggcgactcggctcaccgtgagcgaggtgcacgcggggcgtgctagggtttggggagggaggcgcggcgcatgcgcgcggttcgcggaggacgcggtgcggcgggcccacgcgcagcctcacggctcgcggtggaccgcacgcgcgagggggcggagggaagcggcggaccggggtctacttgacccggtcgcggccgaggtggcgccgaggtggcgcctacgtggctgccacgcgggccggtgggaggtagacgacgacgccggccagaacggacggcggtcgacagcggcgagcggcggagcaaaccatggcgatacaggcgaaggcgagcacaccgggatgttgcgcaggacgaggggagacgagccaatggctcggattcgccgggggatgctcgacggcggcggattgcggcggcggcaaccggcggagagaaaagggggaaacggcgacgaggtcacgaggggccgattcctggcagtgagagcatctacgcggctacgggaatccaccccttgcgccggattaggaggaatcgcatcgagggaggccggcgacgagaggcgcttccgagctcgggcggcgacggcggcgagcacacggcgagcgacggcagcagtcggggcggcgccggctagctagggggggctacacatgctacta

SEQ ID NO: 65734 - DNA, 923 bp, Oryza sativa
ctttttgctccatcaccacctaaatccctccacgtaggcataggcaataatttctcgacgacattgaatttttcacatacgtttggtcactcatcttatttaatttctttttgcaaaattatgaaaatgcaagtcatgcttaaatacctttaatgaccaagttacaacaaaatagataataattatgtaattttttaataagacaaattgttaaacaagcgtaaaaaaaatcaatgttgtcaactattagaaaccggaggcaatacaaattaagggacaggaccatcccgccaaagttcatggcgtgatccatgatagaccaaccaattaatcctacaaggaggttctcaaataaaaaaaccacactaagaatcaaatcctacaaccaatagttaaacattattggcattatatatagtttggcgtttaaactatattaattctatcggttggttagttggtttacaaaaacatcttgcccttgtggttttggcatggtgttagagaacgtcttcaatgcaaatgatacaacagaatctaataaatatactaaaccatcatcactacgactagaagaatagaaatgaaaaggcaaaagctgaagaacgaacctgttatgtgtgttttgctaatacctcacgcatcaggctttcaggagctgtagaaagtagattatcagaaagaggaatgggtgatagcatttggcataacaaagtgtatgatataagttagaaggacacaataccttcaataccatttgtgaaacgctcgaactgacccaaggcttgtctgagaaacatctccacaccgctgacactttaaccccacattcttctgcttctcgtagaagccgggtgactttcggagcatataccgcatcgaacacaacaatttagaagcttagtgcttgctgcacatacaaa

SEQ ID NO: 65735 - DNA, 738 bp, Oryza sativa
ttcccgacaaaaacatccatcttgatcccaagtcttcccatgtaaatccttgcccattcccctgtctccagagcacctagctgggcacaggcagtgaccacactgaccatggtgaactcatctgctctcaccttgcaaatctgcatgtaacggaatgtctccaatgcgtccctgaacctgccaacctgtacatagccatcgatcatcgcggtccatgcgatggtgtctctttcaggcatatgatcaaacaggtccctggcacgatcaacctggcctgacctcacaaggccagaaattaccgacgtccaggacgccatgctcctcatctgcatgccctcgaacaacacccaggccgcgtccatgtcgccgcactcggcgtacatatcaaccagagcgttctccaccctctgatcaggcaacaccccgctctcgaggacgcgcttgtgcacctgcatccccagcagcaggtccttccctttcccgcaagccgagagcaccgagacgtaggtgaccgcggtggccatggcgctggctctgaccatgtccacgaaggagcagcaggacagctcgaaccgcccgctcctgttatggccagagatgagcgcgttccacatgaccggcgctccccctcccgtggcgaggcacgccgcctccagcaccgcgcgcgccgcggcgccgtctcccctggccgcgtacatgacgatcagggagctcgccgcgtgagcggggctgcaggaa

SEQ ID NO: 65736 - DNA, 2345 bp, Oryza sativa
gaatcatgtcatcatcgtcacgttttccgtccttttttatacatataaatgaattaaatatactaataaaattgaaaatatatgcttctagaaaaagtatgtttaggagcttgaaaaacgtgcctattcattctattgatcgagatcgagtgcaaaggaagaggatatgatgttgtactcatatttatatccatgaaaaatggtaagagtctcgggcagtgtttagtttccttcaaactttcgaaaattccgtcacatcaaatatttagacacatatatggagcattaaatgtggataaaaagaaaaaccaattgcatagtttgcatgtaaattgtaagacgaatcttttgggtctaattacgctattatttaacaatgtagtgctacagtaaatatttgttaatgatagattaattaggcttaacaaatttgtctcgcggtttacaggcagtctttgtaatttgttttattattagtctacgtttaatactttaaatgtgtgtctgtatattttaaaaaaattggcacacgaactaaacctgggctcaatttaaggaaaaaatgtgcacttgaaataatgatgaggctaactttgggttcgttgaagacatgacatgacagcaatttttgtaacctcttcacgtgagctataaactgaattacaatgactaacctagatgctactactagtacatctcagcaaaaaggactaataataacctattgatggctagagaaacttttaacaacgttcgtgctacataggcaagcttacttgcgttgcacttgtacggatataatgcgcacacatgtatataggtatagttctaaaaagaaaaaagtaaagttggtatgcaatgcactgtatatggccaacgatgctcgtggtccattcgaccatatgggctttggtcccataaaaacgtagtactacattttattgaattcattatcaaatacattttgatagtatatttgtttagtgtcggaaataatgcttagattttttgtaaatttaatcatactttaaaaagctgacttaggaaaaacttatttaaaaaccttattatatgaaactgatgtagtaatggtcaaagtcacctattcttagtcgaaaggatatttccgctcacttggtttatcaattaagcttttgcaaagtcaaggtaaatacacatacaacatatatgcatgacaccatgtacaaccatatatagatgaacaggagtatacatacctacgttgcttaggtagcaccttgatttaatcaaatgctagctagttgatgccaggtggcacactgcggacggatttgtttgtcagtttccctgcattacacattgtacaggagtgtactacatccacatacaatgaacagtagtagtagcagcagctatatactccagttgcctagtcgtacacaaagtataattaatcacaaaattttcattttatcatggaaaataagtaggcattcataatgcacgtacactccgcacccatacaatgaacagtagtagtagctactagatagttgcctagttgtacacgcagcataattaatcacaagattttcatttttcctaaaaaaaaacaagcagacgtataatgcgcgcacactcatcctacctttaatgagtatcttcagaagattgagcctgttgtcgtcgagaggtacagggtatgtcatctatcactcaaagaataactagtcgtaaatacgagtaccgggttgctgtcaaggggtataggttacgttggctatctcttaaagaataattgccgtaaatgcgaataccatcaagcctaagacttgcatccatataggctagttacaccacaaaacctaacgtgttaagctacgctccctccacacaaaattttcatttttacccagcaaaaataaatgaatactgaagcatgcagcgctgtacacgagcttcttgtttatcattgcgtatttgtcatcatctaaaaaaaattgcgtatttgtacgcgtacatgcacgtttccatccacaatttcacatccatacgcgggtgacatatattatgcagctctcgtgggcatagctcgccagccaagaacgagctgaagctctcgtgcgcggcgcggccatgaaggcgtcgtcgtcgtcgcaggggcagagcccgaggaccgccgtcgcgcgcgccacctccgccaccgccgagcacacgcggtccttctcagagccgtggctcgtggcggcggcgggggcgagcacctgcgccgactcgtgcgtcaacgacgtcgagaacttcgcgcgcaccgtcgccgccgccaagtttaggcagctggtgggctcgtcggcggcgtcgcgccc

SEQ ID NO: 65737 - DNA, 1173 bp, Oryza sativa
tttagtaaaaagaaggttttgaatttttttactcgcaaaatagaatattttgatttgactgttatggtgaaattcttgtttttctttcacaagaaattaaattccagctgacatggtagctagtggtgtgttgggtttgcactagtagcagctagcatatgcaaagtatgcaaccatgcaaatgtgttggccgatgtgccaacgttggatgcatcatgcatgttcaatataaatgtactgaaccaaatggggagttttgttctttggtcaatcgccacgagacagcctgaaaatttgtgaggcgtctactgcatctgtttttgtgtttgaccactgaaattgcatcggacaatgcactaacagcatagcatattctacatactccgtttggtagtacgggtgctcacttttctctgtcgaagagaatcttgtgtgtcatctactcactaaacatccttttggttttttgcaagtataagtataaagtttagtgtagggtgcacaatcaaaataaaccaattagatataggcttggaactttggaagaaacaaaatttgtgtaatattgtatatcaacaggaggagaatcaggacaactgataagacctgttattttctcccttgggtttgttttgtcttgttagcttgtgaactgaatgattgatatcagtagttgcttctcccacttcactaatatataaaactaaaatagctcattaaggccattaagatccttctttgtgtttgttctgttggtgtttactgtagtgtccaaactataaagttactaatatctgaagattgttcagccaaatcacttgtagtttttttttctgaaaaaaaaataaatcgtaactcggagtacttctatgaagtagggtaagaacaaagcgtagggaagagatcacgtgagctccaaactgctaaagaacaaaggtttacctgtatttacacatgggaataggtgctttgtggatatcaaatccttcttgtcccttagcttgctgcctgctgttctcatcaacacttgtgctttgtcctggtgcgagtgactaacaagcagttttactgtagctgcgcgtttcaacaaacaaaaaaaaccacatttgtacttaattatttttagttgtttcattcaattttatcaaccgagcaaacgagtgtccaaagagt

SEQ ID NO: 65738 - DNA, 704 bp, Oryza sativa
ttgaaagattacagaccaataagcctttgtaatgtgatttacaaggtgattgctaagtgtttggtgaataggatgcggccgttacttcaggatgttatcgtgccagcgcaaagcgccttcattcccggccagatgttcactgacaatgctctcatagcttttgagtgcttccatgccatcaatcggtgtaaatcggttgagtctcaattctgtgcttacaagttggaccttacaaaggcgtatgatagggtggattggagatacctagagggagctcttcttaaggttggtttttgttctcaatgggttcagctattgatgacatgtgttacctctgttagctatgctgttcgcttcaacggatctatgcttgaatccttcaaaccgaccagaggcctccgacagggtgatcccctgtcgccctatttgttcctctttgtggcagacggtttatcaacggcgctgagtgaagctgaaagatcaggacggttacaacctctaaaagtctgcaggagagcccctggaatttcccatctcttgtttgcagatgatagcctgttgttctttaaatcaaatatggaacagactaatgtggttaagagtgctcttactttgtatgagcaaagcacaggccaactcctgagcccggccaaatgttctttgatgtttggaaagcattgtggggatgctctgcagtctgacat

SEQ ID NO: 65739 - DNA, 737 bp, Oryza sativa
accgcgctagccttgggagaggcatatccaacgacgggagtccagggatggcatcaacaaagtcggtggcggccattatggggatggttgcggcgatgatgacgaattgcaatggcggcgatttcgattggggattggggctatggtttctgtaactttttggattttttatatttttcgccaaaaaactttttgtagtcagggttgaaaatccgttccgtcatacggttatgatgcccgcaatagaaaatcttgacttttgcataaattgtcttaggtgggtgctccatctatctaggaaaggtggttttggtcggctgaaaaaggccggtctgtagtggggatttactgttagtttctatcagtatatttcagatacccctcaatattacaattaatactgggaaagcagaggcacttttcgcagcaaatatcaacatatacatgtgtcgacgtttgatgtcgcgattccggtatttgcatagtatgagaatcgttggtactagaatatatgcgagattgtaataaaagagatgtggacgaggatttttatacaggtttgggcccctgaattgtcaggtaataaccctactcctgttggccgaagccggtcgttactcttattcaccataatcacaccagcataatatttagggtaacctatctaactgttgtcgacttgacggtctgaagtgttgactcgtagtcgacaacagggtagccttcctcctcaaatc

SEQ ID NO: 65740 - DNA, 1418 bp, Oryza sativa
  unsure (1)..(1418): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatcaactcgagcaggcaagcagcacacgacttctcggttaatgcatacctccaaggctccaactgttcttgtcacactctcactgtccacgcttgtcttggccgcttgactagatacaaccacacagccatgtcttttgccagccacgccggcgccggcgccggcgaccagcagcacaggtgctgctccaggacggtgcacttcgtgctggtcccgatgatggcgcaggggcacaccatccccatgaccgacatggcccgcctgctggccgagcacggcgctcagatcagcctcgtcaccactccggtcaacgccggcaggatggcggggttcgtcgccgccgtggaggaggctggcctgccagtgcagctgctggagctccccttcccggctgctgatttcggcctgccagacgggtgcgagaacattgacatgctccagtgcaaagacgacatgaggaaattcctcgaggcctgtggcgcgctccgggagccactcatggcgaggctccggcagcacgacctgccgccgagctgcatcgtatccgacatgatgcactggtggaccagtgacatcgccagggagctcggtatcccctggcttacctttagtggcttctgtacctttgcctccctcgccaggtaaaaatcacaggccactggcatatttatctctacaagaacaacaaatagttagaattgatcaatagacgaggcaagacatgagaatgatattggttaaaggattttaatcaaaaccacacattaagccttttatctaaaaaatacttcaggtcaggttggcaattggttggcagcactactaactcatttcagaaaatagaaaaacttttcatggtatcttaagaactgccggttggatgtgttttaagagctaagactgctatcttgaagggacattgtttaccgtaacaatctattgcgggacctcactgatgaggaggaggtcgttaagctctcagggttccctacgccgctagagttgccaaaagctagattgcctggaagcttgtgcgttccaggtctggaggaaatccgtgagaagatctatgatgaggagatgcgaagcgacggcaaggtcatgaacagcttcgacgagctggagactttgtacatgg

SEQ ID NO: 65741 - DNA, 1676 bp, Oryza sativa
tgcacaggggatgagaatgagagcaaaagattttggcataaaggcaaggagggctttggaagagggaggttcttcatataacaacataaggttattgattcaagaaatgggaaacgagcaaaatgcatctggttgatacatatatatgggaataagctttttttattaaaattctagatctgaaagaatgaattggaggatactatcgtacctatatacttgtaaggatgggaggagtccatatttggccctttaactatggtcttgcccggattttcatccctaagaattgtgctcccttcaattccaaatacaagccgtgtaaagacttgtgcataaatatgatttatttattagaaggataacatttatttagtatggaaaatctggaagaatagtaaaaacttctgtattctaaaatgacttgatattgagaaagaatcgtgaagcataaaatggcttacatttgcagcctggcagtccaccagctcctgtagtggaggggatttccaggatccctgcagatgcaaagagggagtattttacaaatgatcagtattattgtatgaggctcgtttgtggcatgattgtttacagtctggattattaaattatatcactttctgtttctgacactcttgcccaagtttcctagttacttctgaatatatgaagataaaaattaggaatagtggtcaagttatgccgtagacttcgaaagaaaaaaaatactgaatagtgagatgcagaggacagggagtatgagtatgtatagcaaccgtggttaacctgaccaaccgcgttgtccggacggctcaaagaatggaataaactcgaggactttggctatgagtccataactataacatgcacaccaaagttgccaaagttcagcgatgctgttatccttttcagcatgagctcaaactggctgatttgataggaggacaagctgctctgcaattatttaattctttttttgaaagaagctgcaattatttgattaatcggcaacattccactttcctccgactccgagatccgaagcatcaggcactactccgtagcacctcaaagcaagtactatgagcatccaagcacaagccccaagatgtcacataggactaaattgtgaggtggaggagagaagaaggatgagagagaaatagtcacctctcatgcaaggggcagcccctacacaaactttaataaacatgtgagagtgttagaaatattagggattgtgtggtagagatgacctattatacatatcacctcttaatttaattatctatgttatgtataaaattagatgcgatagtcacctccaatataaaacttgccctcagactgcttgcagtcatcaactcaaacagcatacgacttctccagagttattgcatacctccgcttgactagatacaaccacagccatgtcctccgccggccacgccgtcgaccagcagcgcaaatccaccacgatgaaggcgcacttcgtgctggtcccgatgatggcgcagggacacatgatccccatgaccggcatggcccgcctgctggccgagcatggcgcgcaggtcagctttgtcaccactccggtgaacgccgccaggatggcaggattcgtcaccgctgtggaggcggctggcctggcagtgcagctggggctgcaggaa

SEQ ID NO: 65742 - DNA, 1816 bp, Oryza sativa
aaggaattggaatggtagtttaagatgttgcttttatatgaaaaatgaatcaatataccatctattctttgagtgccatgtttctaaatttctttggagagctatacaattattttttggactttatcctctacatagtacatctcatacgtttgggaattggcttttgggtgttagtaaaaaaataaaaaaaattattcttgttggagcttccgctgtatgttgggctcttaggcttagtagaaatgatatggtttttgataaaaacaccatcaaaatcttatttgcaggtgtttttcagggcaacatattagtttcgaggatgggttcaattacaaagacatgatgaagatatcaagctaataaatgatgaatgtcgtaaacttgacacgacaattatgcatctatttgccaacttcgggtcgaggttctctaatagaattaagtagttaggggatctttttcttcggttggtgtctatgtaacatcccaggtaaccacgtacctagagtgccataccaaaatacactcaaaaaccacttaactccgaaaattattagaaatttcggcagtctcctcctaaaattacggacatccacgacagtcagttataagataactcaataacgatataatccacacaatccaaaccatcctagctcctcaaattccacgtgaaaataaggaccggaactttaaatgaccgttacaagttctacgcaaaacttatgctaagcagaaacataatctaaaactaaattccaatagtgtgcaataataatgtgtagtccaagggtgctactcccgccccatgccgatcaatgtcattaggtacctaaaaaccaaattaaacacaagagtgagtaaagaatactcagtaagtacaatattgaactagtaaaacatacgcaggtttagtgcaataagaaaccaatatgaagcatttgctttccattaatttaaaacgaaggagacaaaaaatagtagttccctcccgagcaggtgtgaatatcctcttagcattaccggtaagccgagcaagcgtgatcagcgcttcttaaggatcatgaataaagatccaaattgcactcccataactacgcatggtacttgaataacgtaaacagaaacttccggaagaaagaaacatgaataacgtcgtgaacttgaacatgaagtgaaatatgaatatgtaacataataccaaaaccacacaattgataataggaagcttcgaataataattgggtaaataaaaccaacaaagcaacacagtttatccatcgcacaagtccgtcttgtacttgctttaactccttcgatactccgactcaactccttcaacgttggaacccttcatacctgtggagcaaaactacgcataaaccactatatcgaactaatgacagatataagggatatttactaaaatcgataacctgaacatataaaataacctatagcagttcccttactattttatacgtaactcacaaaccgtctaacggaatctagcaaataatataacttcggacatctagacaaaattgtctacaaccttcatgttgagtgaaaaatcagattatgcctctgaaaatcccagattaaggaaaacgaatttgctgtcctgatttcaggacccggtcagcagtactatttctgttgtttgtcctaaaccgtttatcggaatcgagcgaaaccagcggcgttagaaagatatcgtcgatgactacaaactttatttaggacaactaacctgaatcgtgaaggtttaatgtcagttttgaaaataccgtttccagcccataaccaataa

SEQ ID NO: 65743 - DNA, 1886 bp, Oryza sativa
ttgttactcctgttcaactgcttcctgtgctgtctggagccttctcgtctctgatcgatgcagcagcgtcaagcagcaagccacgctatagcatgagcagcagcaggaacgttagcatgcacaggcagcggcaccaacaccagaacagatccaattggcggcagcattagggaaaacaggaacagcagggaagaacacagcagcagctcaccaaggagacgagcggatggggtggcgaaggacgacgacggctgaaccggcggcggcggcggcgccggcggagacaggaacagcggcggcggtggtaggacgcaggagatgtggcggctagggcttgcaggagcgatccccctgtttttttttcttttttgtttttcgtttttcttttggttgggtatataaggagactgaaaagatctaacggcccacattgttttaacttatagtctatttgcactactcggcgaactctatgcatccacgattcctgatcgcttattcgaacaatggtttaaaaattaaacttttgcgcatttgttctaatattccccaaaatatactaattcgaaactcagggcattacattcttcccccatttaaatcgaaatcgccctcgaattcgcccaaccatgctcaagaacaccgggtattacagtctattagtttgtgtttgcttagctttgtttctgctatcgtgaactttctttgtgagttttcttctatgtgaattatgtaataattggctgtaactctttgagtaaagactaggatgtttcattccattatataaaaaatatgtgataacgacatgttttaacgtgtattttcaccatgttttataagatatttaaatgttttagttgctgattttttttgtttcaccatatataacttaatgtttcagttgttggtcaactgcaatatttgatcatcctcctattttttggaggcattgggcgtcccactcccatgggtagattcctcccgaaattgatggctactgactatctaagatgccattggcatcgggcgtccgcgatgccttcttcttcagttctccttttacttcttggttgcactgtagatgaaatgcacggtagctctaggatcatcggctagacaaactttgttggaggcatgccatgaagcccttcggccagatctaccgaaaccatagtaccagcaaggattcaagccaaagacatcaaaaccattcaggcgaagccctatggcgaaagccataagcgaagatggcgaaggctggaaagccgcatcggtactccgaaagtaaaggcatctcgagcgaactacaaagacttcgccatgacgagttcggcatcaaggaggaccaacaggctgcccccggccttttaggcccgttcgccatagaccaggcccagcctatcagcccattaacggcccatatgtacaaatgacactgcgtacccatgtaaatgtccctttcataagggcaaccatgtaaaatcccctataaccctaaaccctagaaggtgcaagcttgtgctaaggctataaatagacctctagggccatgtaatagggggatccctaaaaaattttacgaattaatacaattgcttttacattccaaatattgttgagagaaccacgcctttcaatgtgacatagttgtccattcgacaacagctggcgccgtccgtggggatacccagaccgaaagggcaaaatgggacccttctcgccacacgccacgcccttcgccatagtaccaataaggtacgtcgtcaagggctgcgggtgaataggtttcgccacacccacgcccttcgccatagtaccaataaggtacggcgtcaagggctgcgggcgaagagttttcgccacacgccgcgcccttcgccata

SEQ ID NO: 65744 - DNA, 1529 bp, Oryza sativa
atagtaccaataaggcacgacgtcaagggctgcgggcgaagaggtttcgccacacccacgccctttgccatagtgccaataaggcacggcgtcaaaggctgcgggcgaagaggtttggccacacccacgccccacgccacgccttcgccatagtaccaataaggtacgcgtcaatggctgcggggaaaaggtttcgtcacacgccacgccctttgccatagtaccaataaggtacggcgtcaagggctgcgggcgaagaggttttgccacacccacgcccttcgccacagtaccagcgaggtacggcgacaagggctgggggcgaaaatgggttaaggagttgctcccaagagcagccgaaagaaatttatcatttttcaagatgctccgaggggccggaaactcaattggacacctgagtgtcaagccgcattccatgggctaaggtaagtaccttcagcactagtgtaaaaatccatttggaaaaacattttctgttgattcggtgtgccgaaagagttcattaccggcaataacaagcggtttgactccgagaagtccaaggaaatatgtgaggggctaaaacttgaaatcaagttcgcatcggttgcacacccgcagacgaacggggcagccgaaagggacgaacggcaaaaccctagcagcactaaagaaaagaccgaaagccgataacagttaaaaaggtcgaagtactaaaaagaccaaaagccggcaatggtcaaaacgatcaaagtacctaaaaatacctttgccaaaggcaaaaaggggaaagtacaagccgaacagccgtaacacgcaccacaccccatttatttgccaaaaagcacaagttacagataaattccattgcccaccaaaaggcattcggactttacatccgattcatcagcaaaagcagtcctcaatggcgaaggactacccccttgagcatcttcttcatcgctagttgttagatcaacacaaaaaaaatttaaagcggcgaagaaggaaaaacggggattatgctgcgtcgacgctgggcaatggcaaactgacgctcagtcatataaaattcatgggtgtcttcgccttttttgtgtatgatatttcgtggaaaaaccccaaggcaaacgtttgatcaacgaaaacaccaggggggcgatacgaatcggtcgaagcatagctcgccgaacgttgaaaccgcgaaaccgcgacagctcgttttcagaaaacataccgatcgtcgctacactcgacttctgcaaatacttaagcatttctggatgcatatgccaaaagtcgagagcgaatgatgcgggctaaaagtcaatgtgaattccttttgctaacacacaaggggaccgacatgcttcacccttccgaacgtacaagttacaaaatgcaatgatagcgaaaagaaacttaaaaacacgcacaagctccatcgggcaaaagcacatacgtgttatacaaaggagcaaaaaattttataagtatattacatcatccgtttcaggacattttcgcct

SEQ ID NO: 65745 - DNA, 1739 bp, Oryza sativa
tcaatagtgtgtctacatgggtatctatagctctctaatatattgcctcgtttttctctatagactatctccaagttagtagatagctttgctctctctcttcatttagtctcttccatatagtaaaatatgctgacatgaatatcttgtagagagcatatagataaccattgtgggtgcccttatatatctgcagtttgtttaggttggccatgtggaaatgacttgagttgtaaataaattctgtggagaccatttccttttatttatttatttactaaggtagtaccttagcctattatattagcgctcattggaatcaacttgttttgatataagtgtttgtgtagggctgtaggcgaatggggaagcgggaacggttgtgagtaattatagcccaagtattcctctgggttaagttaacaaaagttttggatgccagttttgtcctcggttggagattctttgttgtaacgttaatttctccgacttgtcgcctgtcagagatgtaaacagaaaatgctaagtgttcaatctcatcgtacttgcaataaattaagaacttgcatccatgactatgcagtttgcatgatgatcatgatgggcttcaaagaaactaataaagcatcaagctatacgatcagatggttccatgttcatcacgtaagattacacctgtcgacttgcttgctactaaaatatataatactagcaaaagtgcccgtatgttgcaacgggaagaaaaaagagaaaattgaattcaaacatattaaattctaattaattgaaatataaattttttggaatatttgggtatttttaagtaggtaggtatataattaaattaatttataagtaaactaagtgtgagaaataaaatgatatggttgcatttattttttattaaattctccatattaattacactctttgaaattttcttgaaatttacagagcttaattgttaattttgataatacaaactaaacatcattttagcatttatttaaataaaaaacattctttctctatgggccatttttagcccattttcttcttcagcccgcaaccgagccgtcccacttttctcaggccgcaaggtattaaagtctaactaacatctccatactcctctcagttccacgtttgtgatggactgtcggcccgcatgcggctcaagtgtcaccgtgtggtgatggaggcctgcccaacactcgatcgatctgagccgttcgtttcgatggacaacaaccccagtgcaaccctaaccctagaatcattctccccccacccttccccaccacaccatcggccgcctcctcccgcccgacgccgccttcccccgcccgacgcagcctccccccaccggcgccgcatctccccctccttcacccctctggcggcgccacttactctccactctccctccggtggtgctgctccctctccccctttccctcctgtctcaccggcatggcgcggcgacggcggggtacggtggagatggcagcgacggccgtccctccccctctccttctccccatcggactcgatggccgtccctccctctcagccgcaagatccggcggcgttctcccaacggcggtggcttcccgcggccggatccgataccggcggctttctgcggtggatccagcgatgacgtagacatcaccgatccggcttcaccgatggcgccgacagcttcccgtggatggatttaccgcgtcacatgtaat

SEQ ID NO: 65746 - DNA, 5145 bp, Oryza sativa
gatcacggcattgtcgaggaaatcgttgtagccgagctcttgaacggtgattaagtcaaagttgcgcggggctagacgacgaagacggagcagaattaatgctgatgtcggggacacgaagagtcgacgacgcaaacccgttcattgaagggaaaaaaaaaacaaaaaggtacagcaagcgcagcacagtaaccagcccatagtgctccatggtctatagaccaagtccatgtcctgtcgaaacccagtcagccgaccccatatggccatatcagccttagggcatctccaatgtttatgatcatgagtagcattaaggtgtgtctcactatttttatggttattaccacaatgtttgaagcaagagtaaactttaagatgggtcccacaatgtactattctagtacttcttttatcagccatgcaaatttttcatcatcacattcattttaccctattattttattgcttgtggtcaagccataagcttaaagctttcttttgcatttaatgccttatggctttgtttcacaatgtatatggtcactataaaatcttatggcctcttcttatggccacattgtggctgcccttatcctcccacgacctactccatgtctccatccatgtgtgaacactgaacaccgtggctgctggcggcttggcgcagcacgtcagcaacggcgggaggcggtggaggccatgggcgctcgtcgtcgtggagccgttcttcagatccggacaggggcggctgaggcgtgtggagaggcagttgttccccagcggcgacgtgggagagacggccggcggggaggtcgtcgaggcgggatctggctggaggagggagccacggtggcggaggcggcgctccctcccctccctcccagatctggccggaggggggagggcggcggcagcggtggtcccagcgatggcggcgcgcgttgtctactgttgctcgggcgcacgcgctgcgtcaagctcgtgccgccaccacatcgcgtctgtcagtccaaggtgcatctcgcctcatgttcatgccggtaccggagttctcatgtttcatgttgcaatgcaattttattggggtggattggagttctctcatggatccctctgctgattttatttgggtggattagagtccaatttgacaattcaaagttctctttatcatattcgcgtacgaattggaaatttggaaacgggctagctgccgaacgacttggttttttttttttggaacagacggtatatgcgattttttttttaatttaggcctatgggcttaatctcaaactggagtaggaatcggtgtgggtttcttttttgcgtgacaattgggcgcgctttttttatgcgatctaaccaaatctgatccgaaacaaatttttttgctatatatttgttgacaaattttatcccaaaaaattgacagatgtaattacagtacaatcgtagtttaattacactgtaacttgcatgtaattacactgcagttatcgtagtgttattacactgtaacttgcatgtaattacgctgcagttatcgtagtgttattacactgtaacttgcatgtaattacactgtaactacagtgtaacttgtatgtaactttcaaaaatctttctgtaatattttatttcggtaaaatggaggctgtgggaacaaatccttacacatatgtgtgtgctgtgattttttatttaacgattcaaaattacgtgaaacttatatacaagttatacggtagttacatgcaagttacagcgtaattacatataagttacactgtaattacatataagttacagtataattacactacgattgtactataattacacctatcaaatttttagaagaaaatttgtcgacaaatgtataggtggtcccgatccgaaatcggatgcggtggaaaaaatagcgccagattagaaatcggaaaaacgcggtgatggacgaaaaaatgcggatcagaggatgagacgattggaaaaatagcaatatttatattagttaagatatgactagaaaatgggcgtgcttgtgatttttagcccgtaggtattgctaagtgctagtatttcaagatttatagtgtcatattattttaggaattagtttagttatatattgggttaaacctatccaagtgttgagcatggccaaaaacttctaaggtccttgatgtaaaatctatcattaaattgtagttctactattaggcgcgctcctaatattacaagcgccaaacatgcatcagctcaggcccaccccaccccatgtcccagcccaggcccaccccaccccatgtcccgttatcccactcccaccattgtcggagtaaacgattgtcggtgacatggggccgggggtatcgtgactagaggcttgggtagccgcgatcactcacgtggcccgaccccctcggggggggggggggggtcgggcccgacggtgacgtggccacctctccctctgtctccccgaggggtcgggccggtcccgtttcggccccgagggctggggcaccccgaccccctgtggtgattggcgccacgtgtgtgggttaggtgagcacagcggcgctcacctaaccgcatttatagcgggttagacgagcgcgtcacgccgcattcaatgcggcgcagcgcatgcttatccggtctgtgaccagtcgcggtatgtgaccggtcacagaccggtcagatcgcgggttaggtggcaacaggcggcctgtcgcacgcctcgccccgtcccgtcggaatgatgagagcttcctggttctcgtctctagccggagctggcgtgctgactcctggagttggtatgtcagtcccggtcagatccattccaggcttcagtgcaagcatggcaagaaaatcgctggccattgaatgaagtatgaaacgggcgtccaccgggagagctgacgagcggagcaggaggcgtgtgtactgcttgtcagaggtcatttccggctgtagattagccctcattgtaaaaaacatgtttcttttcttaggcagagagaggcccatgtggtgacccctaaccagataaaaaaaggaggcccaggcctaaggagagaaaaaagggggggggaggtgagaggctggccacttgattggagagcctgaactctctctcgctctagagctctctggctctggagctctctgttttccttcacacacagatccaccagaacacaggagtagggtattacgcttctcagcggcccgaacctgtctacgtggcccgtgtcttgtgcgcttcttctcgctgacattcctcagatcgagggcgaagaacctcacttagcgcccccggccgaaccggcaaaggggggcctgcgcgttctcccggtgaggagccccacgctccgtcatctggcgcgccaggtagggggcgcgcgtgtctttcgaagccctcgtcctctttcgtgtgcgccaagcttcgcccgctcagcccaatggccgaacgggcagtggcgcacagcctctctccgaacgctagcggtgtcgacggggagcagaacccgcgccgtcgggctcgcaccccaccgtccccctctcgccgaaatcttgggcgggggaggcgctcagggaggtcggaggacacgcgacttcgccactcgcggtcgacgggggaggacggcgagacggagcgcgtcgccgcctcgtctacggcgatggcggtacgccccagggcgcgctccaggctgcgggcgcgctcctgcgtcacccgcccgtcgtccccgatccagagactccagcccgacgttggctggatgacgtggccgacttggtcatgacggcgcagcagcgactaggcgccggcgggcggtcctccgccaccgaggcctctggcgcagccgccgccggctccaagtcgtcgaggcggagggcgcggcgagcggcggccgttacccgccattcgtccgccattccctcgtcaatgcctccaacccaagaagatgtgcgtggggggccggatgcccgcctcgatatcgagcgccagcgcgacgctcgtcacgccgcccgcgcaacggagggcgcttcctcgtccggagcgccgcttcggtctgggcactggtccggccccccgtgtccccggttggcggtgccggctgtcgagcctttgtggcgagccttcggaacgtccgttggcccccaaggttccggcccaccatcaccgaaaaatacgacggaagcgtcaaccccgccaagtttctccagatctacacgaccgggatcgaggccgccgggggtgacgacagggtcatggctaatttcttccccgcgtcggtccactcttgggagaatttgtgccaagcagttcaccacgaacttccagggcacatatccgcgcccaggcgaagaagcggacttgcacgcggtacagcgaagggacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagcttcggccgcccccgggtccgccgctcggtcagggcggcgggacaggaggaggaagaaggggtcggcccgtttcgacgacgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagcgccgtgagggcaagaccctggcggctcccgccggcaaccggcgaggtgaggccaagcagaaggccatcgccgaggacatcgacgatggcgacgatgacctggggttccaggagcctgaggccaccgtcgccaccgtcgatgggggagcgtgcgctcacgcttctcgccggagcctcaaggccatgaagtg

SEQ ID NO: 65747 - DNA, 5466 bp, Oryza sativa
atggtggtttcccccacagtttgcaatgtgcagttgcagcgtgtcctcataaacgggggtgcagccctcaacatcctttcccccgcggcctttgacgccatcaaggtcccggggatggtgctccggccgtcccagccgatcatcggtgtgacgccggggcacacctggccgctgggtcatattgacctcccggtcaccttcggtggttccgccaacttccgcacggagcgggtggacttcgatgtggcggacctcagtctgccctacaacgcggttctggggaggcccgcgttggtaaagttcatggcggcggtccactacgcctatctccagatgaagatgccgggccccagtggccccatcaccgtccatggcgacctcaaagtcgcgcttgcttgtatggagcaacgcgcggaccaccttgccgcggcgtccaagcccgcgggcggcgacgagaggctcagcacctccgtcccggccgccccaaggcggcggatggtcacgtgcgacgaggtcccggtcaaggaggttgtcctaggcgacggcccgtccaagaccacacgaatcggtggtcttctggacgataaataggaagacgcgctcgtctccttcctgcgggcaaacgccgacgtcttcgcctggagaccggcggacatgcccggggtccccagggaggtgattgagcaccgtcttgccgtgcagccgggcgcaaggccggtccggcagaaagtgcggcggcaggccccggaacgtcaagccttcatccgcgaggaggtggcgcgacttctggaggccggattcatccgtgaggtcatccatccggagtgactggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcaaaagtctcgctccgcccgcataaagctgaaccccgataagtgcctgttcggcgtgcctgcgagcaagcttctgggtcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcactacccctatttaagctcctcaaacgctccgggccgtttacctggacggaggaggctgagcggaccttcactcagttgaaagcgtacctcagttctcccccagtcctggtcgccccggagccagatgagccgttgctattctacctggcggcaaccccgcaggtggttagcgcggcgttggttgtggagcgcgacgaggacaaccctcaccccgtgcatccccaccctgtgtcgactcgacccgggagagagcagggaggagaggcccccgagccgaacggcggcccgaggcccccgacggccggagctggccctccgcctgcttgtccgacggtgccaggcgcccccgacccccaggatggccccggggccactgcgggaaggccgcgcctatcgccctctgaccccgaggtcgtcagcacagaagccgagtgcggggccgcgaggcctctcggacgaagagcgccctggagatgcggcccctggcgaagaggatcggccccgccgaaaggtgcagcggcccatctacttcgttagcgaggccctccgggacgccaagacccgataccctcaggcccagaagatgctttacgctattctgatggcttcgaggaagctgcgccattacttccaggcgcatcgggtcacggtggttacgtcttaccccctcggccaaatcttgcataaccgagagggtactggacgggtggtgagatgggcaatcgaactctctgaattcgatttgcgctttgaaccacgccacacgatcaagagccaggccctcgccgactttgtggcggagtggaccccagctcccgagcccgtctccgcccccgaggccagctcgggccccccgcagctgcctcacaccgcctactgggtgatgcagttcgacggctccttgtctctttagggcgccggtgcgggggtcacgttgacctcgccgagcggagatgtcctcagatatctggtccgcctcgactttcgggcgaccaacaatatggtggagtacgagggactccttgcgggacttagagtggcagctggactggggatccaccgcctcctggtgttaggcgactcccagttagtcgttaaccaggtctgtaaggagtaccggtgctttgacccgtagatggacgcttacgtgtgccaggtgcggtgtatggagcgccatttcgacgggatagagcttcggcatgtgcccagacgggataacgcggtcccgacgaactctcaaggctcgcttcctcgcgagcccagaccccactgggcgcctttgaagaaaggcttgcccagccgtcggcgcgacccgaccccctaggggagacggacgcgcctgaacggcctgaggcccgtcggagtccaggcctcgggacccgagggaagcgctcccagctcccctagattgattgcttggatcactgagatccaggcatacctcgtagataagactctacccgaggaccgcgaagggagtgaacgcgtccggtgcatctccaagcgctacgtgctggtggaagggaccctctaccggcgcgcggctaacggagtcctctgagtgcattcctcgggaacaaggcgtcgagcttctcgccgatatccatgaaggcgagtgcggagcccactccgcctcacgcaccttggttggcaaggcctttcgtcagggtttctattggccgacggctctcaacgatgcggtcgacctggtccggcggtgcagggcgtgccagttccacgccaggcaaacccatcagccggcccaggccctgcagaccatacctctttcgtggccatttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcgatttggggtgctaacggtatcattacggataatggcacccaattcactagtgagctcttcggtgactactgcgaagacatgggcatcaagctctgcttcgcctcccccgcccaccctagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctgaggtccccttgggtcaccatgtattgcgaggctgatcaagatcagcttcgccgagacgacctcgactacttggaagaacgaaggcggcgcgcggccctacgagccgcgcgataccagcagtgcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctccgttcggctggccacgggcgacggcgcagagctgcctaacccgtggaacatcgaacaccttcgtcgcttctacccctagtgggggtcgggcgtcatgtctcgggctcgggccaaccccgcaccccccgggcgtgcagggttggccgggggctaccacatgcatatccttatcttttttctcttccgtatttcaataaaagcattttcgatttcctgaggactgtgcctgtgccatcgtttcctttgaagaatcttggcttgagttagcacgctcgtgctcgaccctgccctcggtggcccgggccggctaaaatcgccaaacgaggcccagaaccgagccgtgccccggggcgtggtgaactccggggggggaatcggcaaaggcccacaatcgggtcatccataaccctcggtcaccacgctcccggcctggccagtctcgacatgcggatctccccaggcactagcccccacccgcgccgcttgaggttgggacctgggcacgagccctcgttcaagccaagacacagaaggaccgcggcacagaccatcctcgtctcatacacacaacaaacataactgacgcagaaatttcctctttacttgattacagattaaatcagtctatacaagaagggggcccgaaggcctcggaagaagaaggaaaagctattaagattggcgggggcctgggggctcactccggcgcccccgggccgtcggcctcgtcgccactgtcgtccgcaccgtcgtcaccgccctcctcgtcggagtcgagcgcgaacgcgagccgaggggccgtaccctcgaagctgtggacgatgtagtcggcggcgtcccggacccgcgcgcgcgcgccatactctgttccgggagggaactcttccagcgctgcccacggggagaagtcagggtccctggcctggtagcttgccagtacgagctccaccgcccccgggcgaggtccctcgaggatgacttgatcgtctcctcgagctcctcggggagccgctggagggccccagccatctctgagaggcgctgggcgaggcccccctggttggcggcgtacttcgcgtgccgcccgccccagagacccgcctgccgcccggcgcggtctagacgggagacggcgtcccgaagcatgccgggccctacctcgctcgccaagcggagggcctcgacctccccagcggacgagtccagcgcgccctgcagctcggcgatggtgtgttcggcggctgcgaggcgggcggctaggtcgctgtggcccgcggccgccccgccgctgtgcgccctcgtgtccagctccttcgcctgcgcctcgagctcagcggcccgctgatccagtgcggccctctcggcgcgggcgccttccagattgcggcgcgcctgctcctcccgcgctgcctcgcggaggaacag

SEQ ID NO: 65748 - DNA, 1561 bp, Oryza sativa
gccccgacctactgcatgatggtcaggatgttggcgcgctctggatcgcagcagagggggaggaccccttgggggatgagggatgcctccacggagctgagattaagcacccgttggaccaccatcctgaagtcctcagggtcccagtcccatttgcgcccctggtgggtcctcatgacgtcctcgggcccggtgtactcccaggcgccccgggcgcgccgctggagcggcgtgatccggcgacgaaggtagtcgccgaacaccatggcccccgtgagcccctgggatcgcagacccgccaggcggtcaagaacggcgtcgtagccgtctcccagatctaccgccgcccgccagctggaggcttgcgccggaggctggttcggaagtcggaggcgcgcttcgtcggcgaggggggtgtagaaccaatcgctcttccagtcgtcccactttttgcgaacgacgcagggaatgtagcggttcagcacctgcccccacggctggaagtagcagccaccgactaccgtcggcggcgacaccggctgtgcggtgaagaaccaccggaacagccggagagacgggtgtaccccgataaacatctcgcacaagtgcgcaaagatggccaatgtcattatcgcgttgggggtgaggtgtgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctcccggccggtggcagattccggcttgaatcggcgcggcagcccggcctgcctctcgctcacgatgcgggaaagcggcagcacgctaccctcgagcggtgcggagccccgtgccatgacgccggcggaggaggagcttgagagcgagcgagtatggcaaggttagggcgcaggaaacggagagtcagagcacaagtggcgaaggcaagggggagagtggcgagaggaaggaaacaaatcccttccttggcgtctttgtacccttgccaacgctatgcccggctcctcgcttcccgcacccactacctcgccccctcgtttctcgcgcccgcgcctccactaaccccactcgcccgtttgcggcgcacgcgatagatgtgcggccgtggcgtttgagatggggcagatcgtgcgcgcattaaccgcgctcgccaaccgcgaaaaacgccatcatcatgtccccaggcgaaacaaaccggctcgtcccgattcgcgcgctgctcgagtaatgtagcggtcttgaagaggccgctcattattgtcgatcggtttctcccttgccgatgcgcgcgatttgcgaccgttgggtttctgcctgcctgtggggaccggccccacctgtcaccgggcctaaggagtggcatcatgcccgatcgcctccctcgaggggggcggtcgccctggcgtgacgccgggggctactgtcggtgacatggggccgggggtatcgtgactagaggcttgggtagccgcgatcactcacgtgg

SEQ ID NO: 65749 - DNA, 2435 bp, Oryza sativa
gatttaaatcgatccaccatcccaccccacagatctgggactcaccattgtggaagacgatgacaccgtggcggtagatggcggtggccggtgagcgatggccgtcggcggttgatccgaaggcactgcttcgggcctcgttgccggacgttgggcagcaccttaaccagaataaggtattcacctgggccaatagcaacaaccagcggctactccaccacgtcggcggcattgatagaataagcaagtaaggaaatgacactttgatttgcatctgcatactctccttcaacttcatgcatgaagccccaatatttttttcaaatcaaattaacgtgcaatctccaatattacctgatctcaattgatgggctgcacaggtcctacatttgcacatcgtgctccatgtggctggccgtagaggatagggtggagtccgtcggtgatgtaggttgtttgatatttttcttttgctcgtcatctctattgacatgaacgagaatgtttttacattttttcgtgcttgctagatgatggatggctgcgcaacgtcgggctcatctctataccataccgctacatccttctattattccatcgtcgactactactcgctccctggttgcctctccactaccagtctgtgttaccagtcagaagacacagactgttctcttcatccttatagcaagatccagcaaagccaccagatggatttttagctgaatcattttttttcatttctagtttgattcacctgtgagtaattttatcgcttgtgtgtgattgagcctgtaattttttcacttgtatgactattttatgatacagatcaacaatactcttagtatcaattttttactcttatactgtacattgaacatatcagtaaacatattactatatggtggctacgagatcatggctatatcgagaggaaggtggtaattgttttactcgcagaccaaggaatctcagtttttactcttatactatgtattgaacacatcagtaaacatattactacatggtggttacgagatcatgggctatatcgagaggaaggtagtaattgttttactaacataccacaaaatctaaacaatatttataatattggtaaaagaactactagcattgtaagctggtagtaattcttttacgaccatctaggtatggcgtcatacgatgtggagacattcatgtgagtaaatttgttacttttaaatgagcagatgtgggaggctgggagtaaatgaaaaactccacggagtaaattcgttacttttgaaacgtgcggagatactagaaaaatggaaaactcggaaagaaaaactagacggtaaatattttactaaaacgcgaaaacagaaaaactacagagaaggaaccaaaaacagaaaaatctggatggttaatattttagtgggcccattgatgaagcacggatgagatggaaaagagaaaaagaaacacggaaggtggagtggtaaaaaacgaaaaaaacgaaccgagaaaaggtgggatgcggaggaaaggtggggtggtaaaaaagggaaaaccggaaggagagagcgttgtgcggcactcgaactaatattccgcgctgtagagcgcggaatagtgctaatggaatttttatcaaatcgaattggcgagaagatgaacaagagagaggatggaggaggaagaaatgctaagttagtccaaaatttcattgtaagggcagtgagaggcatatatccaatatctacaagtttataatggtatatatgttcaaatatataaatggtagtgttatatttcaaaactacaaaagttacgatgacaagcctaccagaggaggtgaatggtagattatgtcagcggaaaacaaataatcgaatcttaatagattaaaagtacaccccaacctcaaaaaccaatggaatacacgtccggcggtctatccgacctactagagtcggtctgaccaaaacctagccggtctaaccgcaggtcactcggcggtctaaccgtcagccctaaaaccagcacgacaacgcttctgtgaaaacttgatctctcttaaaccaaccattagatcgagttgcagactcgatagaataaactaaataaactaaggaacaactccacctgagagatttgcaaactataaacggtttaagagaaaacaccctcgaaagtcagctgtctcagaattttagcaaatctgaactaaacctaaaacttaagcaaattcgaatctagtaagaaccaatcaacgaaactttccagatctgatctatgaagtattagaaaggttttggatggattaacttgaacaaaatcgcagcaaaacaagcaatcacaagttaatgccaaaaccaaatataaacgtaaaacttacgaaaccagaatagatcatcgatgccttgatgattgaatatgatctt

SEQ ID NO: 65750 - DNA, 1719 bp, Oryza sativa
  unsure (1)..(1719): unsure at all n locations
ttttttaaaactttcaactcaaatttgaaaagtttcaacttgagatttgaaaactttcaactcggatttgaaaactttcaactcgagatttgaaaatttttaaattaagatttaaaaattttcaagtcaagatttaaaaacttttttaaaaaatgaaaacacttgctactggaagattaaaaagtaatcaggaaaaaaagcaaaagaaagcggaaaaaaaagaaaacagcggtggttagatttcgtgtgcgcgccgcgtgggccgtatgggccgggagtgcgcgctgccggcgcgcgcgtgcgaattaggattatcactctaatctctcaaacttggcttaccttaaggcataacctccatctctatttataccaagaaccttcaacttcaacttaaaggacgtgtaaaactccatttcacgatattactcaatccatcatatttctttttctccaaaaccgcagccggacttccattcggactcctgcgagtcctcgcgtgggccggctcggaccaggccgaccgctgctgctccctagccgactcggtttactaaccaaccgagccaaccgaaacccgtgcatgcaagctgacgtcaacacacacctacatgcatcaacatatgcatactgctcgccaccagcccggacacagtgcacacacatatgcatgccatgctacagtaccgcgagaactgtagcaatcactcaatttttcttccagttttccttcgcgaacgccgacgcttgcacgcacatctcgtgaaacccgttgcgaagatctctctcacacgatatccatccatcgtgtgccatctcgcattagtaccgaaaccatcataggtgccggttgggaacgggctataggtgccggnnnnnnnntnngnnctnntncnngannccggnncctntgnggnnnnntngnnccggcncttttngctttgctcgagcnnnntnnngtnggagagacggctcgattcgagctaaactcaccaaccacacaccaccattgttgtcatcctccctcgagcccagcactactccccttcatcaccgtctctcggatccgagatcaaaatcaacaacaaactagtatatgcatggtacaaagcattaagaactcaacaagtttgggactagaactcaacaagaactcaagaacacaagaactcaaaaagaaaaaaaatcaagaactcatgccggggccgccacctcgcccgcaccatcggcgtccttctccacccctgtcgccgtcgccgcatggggatggcatggccaccaccgttgctgaggtgcgccgcagatgcctccgccaggcagccgtcggtgcgggagcccgccgcatccccacttcctgccccacaggctcccctctcgccggatctagcggaggggagcccgccgccattgctcgtggggtgcccgccgccgaccacggaacccgccgcgaggggagggcgctgccgcatccgctaggccagctaccagccgcagggcccgccgccttcgccgggcaaccaccgtgagagagagagagaaagggaggagggaggaagagagacgcgagagcagagaaacgagagaaagaaggtggatggataagggttgacggagaaacgagtagataataatgatgcgcggtgggtgcggcgctgatgggcttggctcaaagctataggtgccgtttttttaaaaaaaacaccggtacctataatatat

SEQ ID NO: 65751 - DNA, 1250 bp, Oryza sativa
tgttgcaaataaaaaaagagtttaacaatcataacaaacaccccggagcccagttgcaatggcaattttaccacgatagtgcaacgtgtacttcatcagtttacatgttttcgagctctgctagattactgccgcctgtgccgatctttgtcacgagatgagtgcgaactgtagtgatcaccacgatctgaaaaggtagccaaaatgaagcagataagaaaactatatatggtccactggagggccgctaatgtgctagcatacctcttgatgagcggggccttgacttctctttgtcagagtatcctgcattggaggggcatcatgcaacatcaggaaaacgtaacatcgttattaaaagagcccaagcagaaaaatcaatggcaatacctgaacttctgtccttagaatggtgtctccgctgcctatccctgtctgcttctctatcacgctccctctcccgatcggagtccctgcccttgctatcacgatcagagtccggcccctgctatcacggtcccgccctcttgatctatctctttctctttcccgagagcgatcaacattggattctgacttctcactcttcaaattcactgcagggccttctttaccattgggttcagaaggtaacgtcttcccatcatcgtcacctttttctttcaccttatctgaccctgccttaatcagtgcatccttttcctggctagaacttgacggtacaggggtacccttatcgcttgcaacagtcgttgcaggactttcctgcacgtgagtacaaaaaaatgacatcggtaacaattttttaaattaaacttagcgagtccaatcattctttttaacctttgaagcatttgtatcagaagtcctcctatgcgtgaaggaatcattgtccttatacacttgtatatattgtgacttggggaggctgtagagatgagcaagaactctgcaaacttcctgaattcctgcctcatcagcatcaaacacattccaccagggaggatcttcagggaggggcacgccatgcctccttgctgcagcatacacaactccacatgctacaacttcactcttgaatcttacacatagagttgtccgcaagctgttatgcaaaatacgcattgaattagaagtgcaaattgaactcaactctcagtatgattgaaaaagctcaaggcaaaagcagtaagccttgataataaatctattttatggtacactacatcctgactgatcagacttgaagt

SEQ ID NO: 65752 - DNA, 1308 bp, Oryza sativa
agctgataatgccttgtcgaatcctttagagacgaaagaccatgtaagatctggtcatgtaagagttctcgccgtgcgtattaaccaagccgtgtaattggaaatggattttccaactttacggctgggggctaggattagtgcttatgcaactaaggcaagtcggtccaagagccttatcttccgagaaaaattctccgacgataaggctgggggctagggagagtgtatgactcaagtgactgatcgaagtcacgaagtgagaagacactcgtacacaccgcatccagagtaagaaaagcttagttagatagatttcctttctacttcacaagtatttcttacagtctgcaaaaaattccgaaatatattacacttttcctaagatgcttgtcacagatataaaaagagtaccaggaaggccaacgccaatccattgactggaagactttctccgccagcggcgccatcaacttcgctaggttgtctatctccgcgggagtcctccgagaatgagaaaacccttcgtggaggaactcgaggtacaactgcggacgatgatctcgtatacacaccagcacgtgccctccggcataccggctcgatcgacggcactcctgcttcaggcctcgtcgatacgcttgccgatgccttcgagctgagcacaggctccgtttagccacgagatatatccggccgctgactcctcgggatccccgcgaggtactcggagttccctgcagacgacggccatgactgtgcaacaactcctgaggtacgagttgaaccacaccttgcgacctctgagtgcctccacagcccggtcctttttcacttccaacatagtcctctcaagttcggcgacctcgaacttcgtcctccagtattggatgtgacggtcgcgatcagcaagcgcactctcgaggtctgctcgacaagcaaacaactaagttaagctgttctcctcttttgagagcacggcaagttaagctaatccagatagaagagcaaaggagatggaaacaaaaagaaccaacctaaaggagtcgtcgtcatgcatgtctccacgggcagattctggtctatgtcgtcttgcggcacatacggctcaagcgcaagtgccggaatgattacaggcaactcaggctgcccgcgttgctggacatcctcgacatcgacatctctacaaacaacaacaaagtactcggaatcaaaatgccaaagaaaactaaggtgataactgcacacaccaaggcagttggaaccaacaaattgttttacaatgcatgattgattaaggagtacagg

SEQ ID NO: 65753 - DNA, 1785 bp, Oryza sativa
  unsure (1)..(1785): unsure at all n locations
ttagtagcttagcgccaatgcggttggtgttgagcccttgccatgtagacgaggggattggctcggctgccacattggcaagggagtcggcgctgatcagtgtaacctcagcgcaaaggcggttggcgttgagccgacggtctatttttggtaagtttttttgcacggtctagctttgaaataagtttttgaaaggacctatttataaaaaaaatagggttagattggtgtagttctcatgtagcttagctgaagtacaatttgtgaaatacaattttctgaaagccaacatgctaaaattaaattacaaatcctaatgtttttcacttaaaaaatacttccaaaccatagaaaatcccccatgccgagtgatgtttacaggccttagggaccattacacaaagttttgacatgtgcaataattcaaaaacatcatggatctgaatagcttcctttatttttttaaaaaaaaaagaatctaaagggggcatgcagtagtagtgggctagaggcaagatgtactgggacattatacaagataggtgacatgcaagtttccatgtagaaaaagtgaaagccattttcttggattttaataaaantgacacttacttggcnagtgcaccatcacttggaacatctgtgacacatcaacaatgtcattagctgttgttgcgattttcactatgtcagatccaactgcttgtattctagccacaagatctgcaagctcttcgcaggacggagtactttcataattgtgtgatgagacaataagtttacacttctctggcttactgccagaaataaagctgataaatttgtcagcaacctacaaaaaaaaggaaagttggttacaattgtgtgcatgtattccaaatcgtgaactcaaataaatgaggcatatgggtgtacatggcttgataattgaggaagagtaaattattttagagtgttttgctaaatgtttgtcttaatccagttataaacaggccttgtattgtgttccagaacatatgacataagacgtgatagaataacaactgaaaaaaaaatctgcctgcaagattattagttagagctaccttgtattattttcattttctgggctagtcttactgtctcagacagttaggcgttccttttttctgttgtgagacgttttatttgttagtttgctcctttgttaatacaaagatgcacaaatctttcgtgatttacctaaaacaactggaaaacatgaactgtgcaactttaactctatttaataaataccaaaaaaattacaatttcattccagagaagcttagaggaaatcacaggacactaaccacaaattgagcataagaaggatgtattgagcattcattatcaattataggacatttttcaattaaatttcctcatctggagttatcttttagtgtgatagccaaatggcagctaaacactgaagtatataaaagaatgattggcaaatggattccatctgaagttaatggtatgattaatctactggtgagcaataaaattgaatattaaaagcaatagagatactaacatagtatcatttagaatgaatgaacaagtgcccatataggcacctccacctgtgaagctataatgtgcttttccaaatttaccgagaactcattttcaaagttatgtgcagtacatacacaccacattttcatgctcaaatcatttgtattgtggagaacagaaaaatgggggaaatgattatgtatattgcacaatgtccagtgcatgcatttacaaaaacac

SEQ ID NO: 65754 - DNA, 2093 bp, Oryza sativa
atattgccaaaatatagaactagtaatgcttgcaacgcatatatctgttagaataataatattccactagtattaggtatactaaccttttgcagacaatggcaataaagtggaggagaatcgacatcaactcagacgataaatcaatcagacgttgtcgataaccagacttatgtatgaatgggccacaaactcagaattgacacgatgaattgggccaaaatttacaagtctacatagtgaagcaatagaggaggccgccagccgaagatgggccgggaagacccagcccatggttcggccgaacccatcctagcaccgttggatgcaaggtttggcgtggacgtccaggattgcatcccaatgacggttggagggcacttcggacaattccccttccacaaccgtcataactacctctatataaggacttcaccttctcacttcactcacacacttcaagtaatagctctctcattcccctcaagtttagtttagtagctctctcattctcatcaagtttagtttagtagtatctagctggtggaataggaatagagtagaaatcaggagtccggagccttcggaagagttcaggtatggctctagtagcttttctcttctcttttgtaagctttgtaattttattagaatactcttttatataaatttatggtattgaaatactttccgagtatatgagtacctactttacattatgttcatgttatactgaatatacggttagcttatctgggagatgctttggtgcgggtataatgtttgcttatgcaattactctatgtcatgacgatgatattagagtagtatctggtagtttaggcgtggtgtctaaattacgggatatcattatttggggttatatattgcggatgagaggtgggccgctgatggtgacagctcagtacgggtattcctccgcgccggtatataatcttaagttaattccctagggagggtattccttcgtatttagccccagttgtatggtcatgacgagctgtcgtaaggaactcggtagtcaggggtggttctcaagtacaaagagggcatcggatagatggtattagctagtatatcggttaactagaatgtatgtatactatgtatattagaagtataaaaatagattttcttcctcttttctttccacttagcttagatgatatattatgagaatgagtagtgaatgcttgtgtatcactctacccttggattatcttaacccctgcttagaatatgatcatcacaagtaatatataaattattagtaatgttctctctacatgatcttcccacgggataaaataaatacgataccattagaatactctcgggtgaaatgtgtttctgcggatgaactctgtaaccataatatatcagaagtatttctgcgccattgctgggaattatatttctagtaatgtcgttaagaaataccaacaacaaacacaaagaagagtacaatgaacacaccaacaacctttacataataggtagaccataacctcaaatgcccatcaaacaatcaactaggctaacagctaaccaatcagtagcaaagatacctttgtggccactcaaaacaaacattatacaaaacaaaacattaaagcatgtcaaccaccataaaaactttaagcaaacataataacatgataatgcaatcattagacttgtacactcgttctcaaagcatcaagcaaacattccatcgaaatatggtttcatctatccctcacagccttcttggaacactcaagtccaaccccctattatgatattgtgattggctgaaaatatcatcactaaaaagagcactcaaacaaatatccagcctagcaagtagttaagatgcatggcatggtggctagtccatctatcactcaaatatttttctcaaaatggatagttgtgaccctaacaattgagacagaacaatagaaggcactagcactcaacacacatacattgttttattacacttactatgtaggaaaagaaaacaggcccaacagacaagagcaacaacaaaaacctcttagcatcgtcatcacatatgaatacaaaat

SEQ ID NO: 65755 - DNA, 11594 bp, Oryza sativa
ccccagaaattcccaaaagcctgggatgccactaaagaaccatacgaccatgtgaaaatgatgaaatttttacattagattctttttgttataaaaaaattattgtggaagcttcgacatatagatacaaggatctaagatggcaacaatctgacacatatgaacaaactaagaatggtagataaaccatggtgaatatctatagtatttaataaatccactataacaacaaactctaattttaccccctaatcacaacatttataaactatgtgatatcataatgtgcagcggtgtagctactcccatccattcgtgcaaacatatccgaccgagtacctgaaaaggctataaggtggtgagaataaatctcggcaagcaaacggctttgacaagctatttaaaccatagattcattgtatagttaattaaatatcgagttatgattcacatgaaaacaatttgaacatccaagcactaaaacatcataaccttatcaataaaatccacatcctcacaaatcctagagaagaaaacacttctcaaagatgtcttcgactgtatgatttccatagcatcctgcaatatgtgtgtatgcaatgcaatgatatgaactactgccttcacacccaacaaggtgtgaagctgcatcatattacaacaatatacgatgatgtaccggtacggtcgcaacaataggttcgtagcataaatccaaatccaatgcaaatgtgacgcgaatgtaggttgaattctagagtaataatacgacaactgcattcctacataggagaccaatatacataattatctccaatagcataaagcataaccataagaatgtaaatcaataagtatgactcggataggtaaatcctttgtataacatataaaagtatcttggttgatgatatataatttcaaagtagaggtagaataaaataacaagtcaaagcggtagcaaaccaccgctacgtttacttgcctctaacaacgaagagacaataccaagcatcaccacctattcacaagtcaacctcagcgtattcactaaaacacgcatataaagtaacgacaaaagttgcacctactgcctcatcccaccaaaacacaataacaaggaatgccacttgaactataaacaatattactacttcaaacctttatatctcaaaatataaaaaggctatgactgcaaaaaaaatacattttagaaatctacaaaacaagacctagttcttttatgtagaaagcacttttttgttctgccatttaaatggtctaattcacacttgaatgcaggcttcagaatctgtacagaatttcagaggatacatagaaaacaactatatccggagttctacccatccgatcaaagtgtactttaccaacatggaaagctcacagaaaactctaaggggcctgattgattccactgtttaacctctccaaaaacagttcaatctacaactatctagattttgacaaaaaaaagcaatagtcatactcaaaaattcatatcgcttattccacttgagataaaatcattccctttggtcagaagatagatcacgatgttatctacaacgtttctgtggacactttgttcagaatatatcattttgaccatgtaattgatggaaaacagaggcactataaatctgcccagcctagctagaactaccaattcgattcacaatgtccaaactcttctctaaccgtctttaaccacgaattaaaccactaaattcaccccagaactgatgcacaaggggataaacctcacctagggttttccttttatatcccacgggaaacagcggggaaactccgatctaacccctccttctactcttctcctcctccacgttccatttttccactttgcttcttgatccaagctatgaaggtggagatctagggagagcaaggtctgctagagaggagaggaagcaaaactaagtataggaggtggaggagtcacaaccggcgtcatgggggaagggagggggggatggttcggttcctctcccctagggttttaggtgggggtaagggatttggctaggctcttgggccttgacccaagctaacttgcccacttacaaaggaactttattcaactaattgtggctatcttaataaaccaaaaacattatcttttatttttttaggggtattagaactatagagcgagactgcagatatatactttttatgttaaaccatagtcctcttaaatggtttaattttgatgaatatgattatttgaaatgatcataaatcgattggtaaaatctatccagtgcgtgtgcactgcatgttcttatctagtgacccttttgtgagccgtctgaatcagttgatgatggttgagatatatattcatgggtgttgtactaaccaagagacaaaaaggggaccacttgctagaatatgaggaccatatgctatctaccagttgtcatagcaattcacttgtattttttagatctgtttgaaccaccctactctacttaaagagaaaattccctgtgtacccctgaaagttcacctaatcccttctataccccctgagatttgctcattctctcccatgcccctaaatttcagtttggatcacttctataccccttccgtcaattgaccgttagttgaccgttaaattcacatcataaagtctattttaccctctagtatcaagaaaatataaatttataaagtatattgatggagtgtataaatttattgtatgcgactattatatttatgagtttatttcgtgaggtattatttgcgacggagcggcggcggcaggcgtcagaggggcggcggagcggcacggcggtgtggtcgtggcggcggtgcagggcgtttttagctggtgcgggagcgggcatgagaaggggaggcgcgagtgcggtcgtgagagggggaggcgcgggtgtggtgtctatacgtatgtttacgttggcttcaccatcaccactacgaattttttaagtagtaaagagtaaagatagtgaggaaaaaaataatctatactatatagtatgcatgttagcttagtcaatactcaatagttagcgatgctattaaacttgctctaacccgatgagtgttaatgagtaatgaccggcacaacacgctagcacgtgcggacgaattgcgacgggaaatcaccatggccgagcttcctctctatctacttctccttgctctgctggtcgccgtccccttcctctgcctgacccgttggtcgctccggcatggcggcggcggcggcggccggctgcctccgtcgccgtgggcgctccctgtcatcggccacctccaccacgtcgcgggcgcgctcccgcaccgcgcgatgcgcgacctcgcccgccgccacggcccgctcatgctgctccgcctctgcgagctccgcgtcgtcgtcgcctgcaccgcggaggccgcgcgcgaggtgaccaagacccacgacctcgccttcgcgacgcggcccatcaccccgacggggaaggtcctcatggcggacagcgtcggcgtcgtgttcgcgccctacggcgacgggtggaggacgctccgcaggatctgcaccctcgagctcctaagcgcgcgacgcgtccggtccttccgcgccgtgcgcgaggaggaggtcggccggctgctccgcgccgtggcggcggcggcggcggtggcggcgttgacgaccccggggcgacggcagcggtgaacctgagcgagcggatttcggcgtacgtggcggactccgcggtgcgcgccgtcatcgggagcaggttcaagaaccgcgccgcgttcctgcggatgctggagcggaggatgaagctcctgccggcgcagtgcttgccggacctcttcccgtcgtcgcgcgcggcgatgctcgtcagccggatgccccgccggatgaagcgggagcgacaggagatgatggatttcatcgacgacatcttccaggagcatcacgagagcagagccgccgccggcgccgaggaggacctgctcgatgtcctctgcggatccagagccaagacaagacgaatcccgccctcaccaacgacaacatcaagaccgtgatcatcgtaagccgagctcagctcgatcagctacctccccacttaaaaagttcaatttcctcttctttttgtgcaggacatgttcgtggcgagcagcgagacggcggcgacgtcgctgcagtggaccatgtcggagctgatgaggaaccctagggtgatgcgcaaggcgcaggacgaggtccgacgagccctcgccattgccgggcaggacggcgtcaccgaggagagcctgcgcgatctcccctacctgcacctcgtcatcaaggagtcgctccggctgcacccgccggtgacgatgctgctgccgagggagtgccgggagacgtgccgggtgatgggcttcgacgtgccggagggtgtgatggtgctcgtcaacgcgtgggcgatcggcagggacccggcgcactgggactcgccggaggagttcgcgccggagaggttcgagggcgtcggcgccgccgacttcaaggggacggacttcgagtacataccgttcggcgccgggcggcgtatgtgccccgggatggcgttcgggctggccaacatggagctcgcgctcgccgccctcctgtaccacttcgactgggagctgcccggcgggatgcttcccggcgagctggacatgacggaggcgttggggctcaccacgcggcggtgctccgacctcctgcttgtccctgccttgcgtgtgccgctccgagaccatgagcgatagattgctacagtatcatttggaaatggataagacatacagaaaaaaaaagaaggatcaactggatgtcatcatgtcatcagtatatatacagactcatactctcatttggtgatgtttcaagtgttatctgtaacttttaaattactgggttttgtcatcatgtaacatatttaacctagcattgaatttgtggaggggaatgagtaactcaccagcggtgggacacgactttcagattgtagcacagcgtgttaaaactccgacagagaacttggaattccactacaagaaacttgttaatccatgacgaattcttggtgacggattcataaaccgtcactgacagaggcaatccgtgacgataatttgttttccgtcgtggacgtgcactagtggatattcttggcccgttaactcgtgacggttttatccagatcgtcacagtgtgtgattttaaaatcgtcacagtgtgacgataatcaaaaggcatttcaaaacttgttttgcttgaaaaggatttgaatttgaggttcaaatgaatttaaaaaaatgaaaagctacactctctcttggaccatttctggctcactctctcctcttgggctcgggccagcctccctctcgcgctctgccccttcagctgggccagcggcccattttccacatgggcagccaagacaggctagccgcaggccaccctgcgccttgtaaaaaaacaagaaacaaaaaaatgtagccctctaggggactcgaacctacgacaacacgcacagtattcatgaggaaaccccactgagccactgaagcgttttgccaaacgacgtgcactgtattatatatattaaactgtagcaggtaatggacctgccacctactcgtggtgttcatcataaaattcacgagaatagctgcagatttttacttttaatgcgtgtataaaaatttaaattagtttatctccctcatactaacttcaactttaattattcttttttataaaattttctaaactcatgatctatccatttattgtgctattacaactattatttttgtcatactttcatgtgactttgttttatcaattgaagatttaaatttcaaaaagtggcaacttcaaacaacattttgaagcagtaaatgattgcaaaacaaatcaaacccaaaagacaaattttttttgaactaaattattttgttactaatttgttacttgtatatgttgcatatggtaaaactgaaaatatttgcatatatatagtgtgcgaacaaaaaatatttggagcttgtaggaatttaacctaacacctatagttatccagcaacattcatagctacttcttttagttgattatgtatgcactcacttatacttttcactacaagaaatatattaaaagttaaagcaatttaatcaagtgaattaatcaggaaactaaatttttcctttaaaaatcatggccggaaatatttttgtaaaattctaagcggtctaaattattctctaaaattttccgtgaattttcggagctcaataactagttttaataccacaaaattcatttaacctattaaaataaatggaaaataaattaaaatatctctctgtccttgggccttttttggcccaagtgttactctctccctccctcagcccgcagcctttctctccctcctgggccggcttcccattcccctccttcttcttcgggctgccagcctagcccatttgctcccccctcgccgagaagtccattttagctccctcttctcaattaatttcaaaatataaaaaatccgagtcaaattttatcatactaaataaacttatgtgaaaaagttatcaaaaacaaagttgtataacttaattagatctatcaattttattttggttatttctccatctgactttgattgacctatataaaatttgaattttaaatataagaaaaatcaaataatttttctggtagtaaataatttgaaatgaaaaaaaaatgtcaacaacaaagttgtatgacttatcaagatctacaacttttgttttggtcattttgctatatgacttcatttcaataatttgaatttgaatttcaaattatgacaacttcaaacagcagtttcaaatactaaatgatttcaactgaaaaagtcatcaataacaaagttatataaatcatcaatatctataacttttattttggtcatttcttcatccgacaaagtaatagtaacattatttataaaatttacatatctctctcatagtttataaactgtataagagatatgtacattttgtgaataatgttacaattcgctttaacggatgaagaaatgacccaaataaaagttatagatcttgatgagttataccactttgttattgatgacttttttagttgaaatcatttagtatttgaaaatgttgtttgaaattgtcataatttgaaattcaaattcatattgttcaaaccaagtcatatagaaaaatgaccaaaacaaaagttgtaaatattgatgagttgtacaactttattgttgatgactttttcagttgaaatcatttattatttgaaaatattgtttgaagttgtcataatttgaaattcaaattcaaatttttgatacaaagtcatatagcaaaatgaccaaaacaaaagttgtagatctcattaagttatataactttgtttttgacatctttttcacataaatttatttagtatgataaaattcgatttgaagttttaatattttgaaattaattgagaggagggaggaaaaacagacgctgggccggcggcccgaaggagcagcgggcgccaaactttcagtgtggcgggatgttgatcaaaatttcaacgtgaaatgaccattttgtccagatattttagtggtaacttcggatgcaccatgggtattttagtaaaatcgcattggttcctcaaccctagccgatccaaatcagataagccgccaccacacgcgaggcgctactgcagatgagaccgccggcctctgtctccgccgctgctgggcgccggcctccgtcttcgccgccgccgggcgccgctcaccgcgccggcttcctcccccttcgccgcttgccatgccggcatccgtctccaccgctgccaggcgcgggagcggtggatccgctgccgccggcgcctctcgggcccagagggggcgtgcagcgcagcatccggggcagccaccggtgacgtgaatcgaggtggaagaagcaccggcgagggagagctccgacgagtcctcctcctcctccttctccggcagcaggtcagggcgcagatcccctcccagcagcgcgcctgcttcctacatctcgcgagctccgtccatcgagaggctgctcgaggaggacgccgcactgctgcacgcgtgagcatagggagcacggtaggcgatcatggtgggcgaggacggtttgacacggatgaaaaagaagaggagaggcgccagtctttctttctttgtttcttgcattagtttcttggcgagttttgacgcatgtgcctcacccatgtgcaggagggcggaggcgggatctgctactgtgagagggactggtgattggtgaagcgccccaacttcgactgcgagcgaccgcatcccaactgtaaccaatctctctctatccgctgatgctagttgcttatcaaagttcctgaatctgatgaatgcagaaacctctaatttagttaagcaagtcaattcatgctgtaacaatatgatctctgacaaaaaactgaattccttgtttctgcaaatgcaagtgcagtcataaataagaaagaatattcgtgaaagtttcatagaaactagataaaaaaaagaaagtgttttagataaaaaaaaagaatgtgtttattttcagaaatccacagttgctatatttcagatatcttcaaaactgaataatgttttaatccatttgccaacaaaaagaaaaagaggtgcagaaaacagcttacttgggggataccatggatcatgcttgatttgatcagctcaacggtgatttgatgctatctagattcatccttttttttttaagttcaacactgtacacatttgctggacataatgcatatatgttgttttcagcgtgacaaatacaatgaagaagaacctaatgcatttgatttgttcaaggagttccactacagcaagaaaaaaaatgctacaccactgctgtatagtaggctattgtaagataagtttcaaactttgctctttgtaatgcttatttttaattctctcatcaacaacaatgtttgctccttgcttgctagactcaaatggaaaacaagctgtctacaagttcgatgaagaggactcaatctgagatggaagcggaaacttaatcttttgatcagtcaagttcgatcaagttaattcatgcatgatgctatatcttttgctactacatgcattttgctgctattgctaacttgtgtcaagtcaatttttgactaagctaagctatacatgcttgcattttgctgccgcagcattcattaagctcctagacttgtatgcattgcttggaatctctatttgttgttggcttgagccatggtaaactgcaaggttgtatgcactttgaatgttgtaatctgatgttggatgaaaaatcatgtgatatgatattgaatggaaaaatgatatttctatttgatttgctgctgcaactattagttgcatgggctgtgtatatgggctttagttgtgaaattaagctgtatatatgggctgtaagcgatgtagtagtgggctgaaaagggcaccaaaaaatggtgacaaaattgggctgcaaagctgctgaaatgggttgtaaagctattgaaaatgggctgccaaaatggctgaaaaggagctgcgaaaatggatggaattgggctaaaaattggcccatctttgattttggcctgttaataaataggttgaggtagtgtctacgtcatcatccacgtaagcaaccatgtaagcatccatgatgatgtggcattcaatccgtgacggttatttttcgtcataggaaatgaacttgggctgggctaactaggcctcgggctctatcgtgatggtttaaaaccgtcaccgattccattaatccgtgatggtttttggtaaaccgtcacagaggttaatccatgacgctcaatccgtgaccatctctgaaaccatcacaggtgctacatagtgacggttttttgatgatccgtgacggaaatttttcatcatgcattaacagattccttgtagtgttcaatgttccagggtgagctaggacaggagggttaggggagagagggaggggaagtttcctagactttgaagcataggcgtgtagagacggcggtggcactgccgaagccatggttttggaggagtatggtgggcaggcttcgacatctagggagttagacccgaagtggttaggaggcgtgagcgatggtgacgtctttgatgacagagagatacatgagacaaggaagacattggtgcagaatgccttggagagatatatgagacaaggaagttgtcggtgcaggatgccttgctactgtgcggcttgtggaggaggagagattgggggggggggaaggtgaagaaggtaagtccggctagccttgctagcaccgaaattggcaggcgtcagcacttggttaggaggtgcttttaatgggtggaggtgggacagaggaggtggtatagaagataggagaatgttactatggtgcacatatctgaccatccaaaataactgaaattttatatgtattttcaggtgtttcctgttttcaaatattacaaaattgttagtaaaatatgattggtaactatagattttgaaaaatccgtagtataaacatccaataatcacatcatatttcaataagggagtatatgtatggctgtcgacatatttttcacatagtcatggtaagaagagaactctgtgttcggctgctagggttggcaactaatcactgttgcacggaaaacagagtggtccattagcgcgtgattagttaagtattagttattttttttgaaaaatggatcaatgtgattttttaagcaacttttgtttagaatttttttgcaaaaaacacactatttagccgtttgaaaagcgtgcgcacggaaaaagaggagagtgagttgggaactctggctaccgaactcagcataggaagtacttagatattgtagtttcattccatatatagagtattacaccatacttatattaatatattccatagcacaatacgaatagattcacaatagaaccatcaacacaatccataattttaatatatgacaaaaacattgaaattataaaataagcatagttgcaaacattgcttgctgctcatttattcctcaacaagttctctagctaattggtccaacacatcttcatgtctcttcagttttgcttcattgaaggttgatgtatccttctccatcaatttttaaatacatttggtatttttctacccttgcctcctctcttttagcacttgcgttctcttttatttttgcttctgctccaatcagtgttgcttctgcggcctttagcaatgttgctgctttagttgtaatagcttcatgaaagagaaccatattttgacttggcttgtcccccaaagttgatggagcaccttttccttttttcctctgttttgctgccttttgcctctcaaggcacttctctttgcgctctggtttctcctctatttcttggt

SEQ ID NO: 65756 - DNA, 1951 bp, Oryza sativa
ggaactgaatggatcaatatgttgttcatctcacttgtgcctcctttcgtaggtagcacaagaatgttgtagaagccaatggctaggaaagcaaatgagcaactcaaatgaaagagcaccaacggctagtagaagtagttactatctgtagtaactgacatgtatattttattggtgtgaacagaaaaacattacaagtattatattttgtagctttgtggccacaccttaagcttaaagtctagttttattgcatgacttgtggtctgactccacaatgttaaatgtgttgtactatagcagcatttattgcttatggttactttttagtgtacattgtgctattgtggatgtcctaagacagtatgtaattcaaaggcaataaaattattaaacgagataaaaaaaatgatgtagcttgatttataaaaaatacagatttaaatttcattcataataaataaagataaaaagttatatacatatttaacaaaatttacctgtatagctagagaaattatattgcaactatgtaatacaatgtaattagtctaattcagtaacatattttaagagcacacgttacgcttacaaaaaatcctcgaaaatagtaaaagtgaagtgatttcttgcatacactgtttaatgcaatttcaaatttaaatttaagtttagattgtttgtgtgtttttttttaaaaaaatcgaactgtttggatcagtaaaaaaaaacaaattgttcggttaagtgccaaaattatggaatcgtttgaggtactgaaccgaacaagcacctccgccgaatcattcgcggcatatcgcatcggcatcggattgcaattcgcaccaaaccgaccgccaccgccgcaccaccaccgaaattctcaattttctctcgcgacgaaaagggaataaaagcgcttcgcctcgcccactgccacgccccccatctcttctcccgactcctgagagaagaagaaccgctgcttctccacccgtcgcggagccccgtgtccatcctccggcgcggcggccgccccccagcgatccgcctcaggtgagagcaccgcccgcaccccctactgctctcccctcccctggagatcggcgtcccactcactcccatcccccacctcatcggtggattggattggataccagtaggggggcgatcgctcatcgctgcttgtgtgcatttcttctggtaggattgggggatttactgcgtgaccgtggtgtgatattatgttcgtgttcagtgcattgcttcttcttccaggaagagatatcaactctcttttattaatcgacacgcgtcctgtgtgttcttctttttatcgcatcgtaacatcgttaatgatgcagggtggttatccgcgttgttagaagatactatatggattgtaaaatctatagaggattgtttcattttcttcttattgttgctaacattaagaagatgctaggataggatcataggatggtgtaggtcgacactgaccactgcattgctattcgcgcaacgccaatcttttagtacttcacttcctgcttcactcctctgtcaaaagtcgatgcttggaattaaattcttctggaaattgggagcttcttcaaagaatcgtgttgtcctgaatttctttgtcccgtttggcattttcctttttttttatattgaatgactcaagcccatctagtgtaagtgtgtaactgcgtgctctaacattttcaactgaaccaggggatagttttcaagtttatcaccttgcctttgctggtttagctgtaccaaaagataaaaggaacaatttccaatgaattacatatacattttgtttaacaccaagtgagctttatataatatttatcaatagacttgaagacttatatatatatttggtataccctatgccttattcgaaacgaatccaatatgcttttttgagtaatgg

SEQ ID NO: 65757 - DNA, 3105 bp, Oryza sativa
tgagctgaagcttcaggcacgttcaatatttcacatctgattctgttaatctacaattatttcgaaaatctgatggctaaaataactagtaacattgtctattgccgtacatttgcatggatacagccagagacagaacagcgtccacataaggtcagctttttgttgataaaaagagtgctcaggaagtgataaagtctctctccggtaatatggagaaatgcggggtgaggcaacattcgacttgatgttagcttgtttcaattttggataacttaagaactatttatggtttcttttcgtattatgttaactgctatatttcttgtaaacagcttgatgttaaaataatctacagtggtggccaagaccttgacatattacctcagggcgctgggaagggtcaagcacttgcatatttgcttaagaagttaagctcctgtggaaaaccaccaaacaatactcttgtttgtggggactctggtaatgatgcagaattatttagcatccctggtgtacatggtgtcatggtcagtatacaataaatttcatgaagtgtctaacaaagttcatgccagattgaatataagtttactgtaactgcaatctttttttaaatttttcaggttagcaatgcccaagaggaattgcttcagtggtatgcagaaaatgcgaagggtaaccctaaaattattcatgcaactgagaggtgcgccgctggtattatcgaaggtattggacacttcaaactaggacctagtgtttctccaagagatgtggggtttccttatgttaaggaggaccatatcaaacctacagatgctgttgtaaagttttacgttctctatgagaagtggcgcagggctgaggttccaaaatcagattcagttgtacagtacttcaaaaatatcactgtaagtacatcactgcccagtgtgatgtttcttcaaaataatttgtaacctttgtcaaaatcagttttatcttttacctcaaaagaaattatcagaaccttctaattttggaaaagaagttatatttccaattaataaagtgaactgggtctgacgtattatattgttgagttaactgattttttatttgtttttggtttgtcttagcatgcaaatggtgttatcattcaaccttctgggcttgaatgttctctccatgcctctgttgatgcattgagttcatgttatggtgagaaacaagggaaaaaataccgaacatgggtggacagactatttgtctcacagtctggttcagacagttggctggtcagatttgacttgtgggaggcagaaggttagtccttagaattgtgtagaatgagtgaattagctcttatatgatattttttacacttcattcaaatttctttaatgttttacttacacaatttagcttgttcaatcatattttttcacttgtaggtttctctagacatgtcacttcaatctattaattttgttgtgtgttgtagtatatcctcgtacacaccagaaattatatgaaggttttaggcaatagtttatgaaaagattgacaacatattcaactctgcatctgtacgtacaaatgtcataatacattacacatatgcaggctagggcaattcattttgtaaataaaagtaagaaaacatactcctcaataaaaaataatttattttatatacgatttaaattggaccaaagccaagaagagaaccagctgtctcggctagggacaaagaagaccctgcaagtacacccaatgaatataatgattaaaatatgtccaaagttgtagaagaccggcatcaatgataatacattctttggagtctacatttttcaaagtacgaaactttggagtggcaaacacacatgaaactctaatatttgattgaaattgaatatgattctctgtactaaaaaacactaaaaattttcagtatggtatttatggatttccatgtttacctggatgcatgattgaacatctactctcttttgatgcttgtggttcagatgtctatgctgcaaactgatatatgatttatattagcttgtattgttctctgtactgtctagacaacagagcacaactactgtctaacagagagcagagcacaacacataaccttgatgacaggctataatttttgttattttattctttttgtacaaatgattctcacctgaaagttttaacacattcctactttaggtgatgcgcggttgtgctgtttgacaagtcttgcgctgaatgtaaaggtacatcatctctactcagtcttgcactgaatcccgttgcaattttgcatcgttagcatgtctgcatgatctaaaaacgcaggtttaacttcactttttttttttcaataatatcagcctgaaacccctgctggcttcctgataacacatgtacacaaaacatggctcaaaggatactcttcagcggatgagcagtcctccaagctttaaaccctttttcacccctgtgcacacggaatgaatttacttgatgataaatgaaggacctgctcgtctgagaatctcattttcttatttaatgtaatataaatgatctgtctcgtgactcgtgcgatgataaagtgaacgatctcagaaggcaacttcaacaaatgttggatatgattttacagagagttcagaattagatttcatgacacaagtaccgctaagctggcattatttgtgggcacttgccaacaagttttgcatcactatgtgcctagcggtcaaataccttgcaaaaattatgacattatgcatgtttttctttatttctgaatgatattaggtaacatcattggttcgccacggataaaaaacatttggttctttcttttcccctaccaaaataagcctcttgccatttaaaaaatatatggcttattctgagttggcacaagtattaaggcaattaaaatcaagaaaaatatgagttaaagtatttatgctactgatgcttaaatacatcgaagtagggacatcagctagtgataagttttagtagagagggagactggtgataagtttaaattcaagctaattatatattttaaaattcacattgtcggtgatatgtgtctgg

SEQ ID NO: 65758 - DNA, 7880 bp, Oryza sativa
  unsure (1)..(7880): unsure at all n locations
ttgggcgaactcacactcgagtctgagcgacttaagtgatttgtaacttcactcaatcagccagacacataagtagggtattacgcttgcagcggcccgaacttgtataaaccacttttgtctcatcgttcctgaggggcccaaccccctctatgtcacaccttccatcgagtctttgattttcacccactgcccccggccgaactaacaagggggggcctcactgtccctcgcttgaggagtgcaccctccgacacacatgcaccttgtagattatatttgaaatatgagtataaatctataggagtatttatatgcttgtgtgtttgttgatgtaaaaacacgaggcctgggagatctgcttaactccagtgcaggtccaaaacttgcctttgggtgtgtgagcgtgccagttgatttgatcctgcaatcaacaagaaataaagacaaagaaaccacggttaaatccataaaagatagccgatcggctggatgctgatgacaaatcatttatctttgagccgatgtcatatatgcatcgatcggcagtcatgaataaataagaaagaactaaatctactcaatcggctgtagatattaacaatatataatccttatgtcgatatatacttaaatcaagtgattgggacatatcggtcaccatgccgagacagtataaatcacttagatcgaaatatataccaacaacaagactatctatgttcatagcatagccagtcagatagatctagcatgtatcggctaatactccgataccactctatattaagatattaatgcaagtagaatatatcaaacagaaagcctaatatacttttagcgcaacaggatcttaacataaagggcagatttaacatgtcaataaagcatataagataaatatagttaaataagataagatcggctgaaaccccaatacaaccctaattggcaaccaaagacaggctagagattgaaattctaatcacgacttataagatcaaactcaactgatgcagctataagtatgaaaagaaaggcagtatctagacaatcaaatcgttggatgttttatagagtggtagatatcctatataatctagatcaacatcagtatttaacctaatcggctgccttctattagcagatgttggccgattgtaggttatatgacgatattgctagagattacgtaagatatatgataactcgacgaattacataaacaagattagagtgtcataaagatagaagcactaatcccgagaacgcaagccgccataacaagttttacctcttgttgaagatcaaaactgatgcagctcaacccaaaagtaagaactcgtcgaaacaaaacgaaagtaaaatgggtggcgatgcgccgagattgtattgaacgtgtgttcgtttgattacatggggctcgggtctatttatacccgagaattacaaaatacgtccatatcggacacgactcttatctctaacaaactctaagataccataagtctttgcggtagacttttgcccaaacatatctctaaggaaattatataaaatatcctaattaatagatacaattgacttctcaggactctatccatgcgtggcaatcatcatgaagcacgtcaacctaaaccgacaacatatgctgtgtcatattgtcggattcggcttaatcggctaaccccgtccaactcgaactctgtcgatcctagtcgtagccgatttggactttagccgatcttcactctgtttccgggacaatctctatctcgatttccatctcgattcctccttcacatccgatatttggactaccaaatttggtcgttaacagtgttgcaacggtgtattcataataaactaaactttttatgggttcatgtgaccgagaaaagtaggcctcagcctcaaatgagggaaatatccaagtatggtcatcaaccctcatactcaactaaaacattcgtgcatagttttttatgtattgttttgatcatttgtttctatagatttattacaataagattttttcgagaaaatattacagtaagacatagtgctaaatttataatattatgcatataatttttcatgcacaantttttatttcatattataagtcactttgaattttttatgcacaatttttttaaaaatctataagttgctaaatcattctttaatcttaaaaaagtttgactacgaaaagctcaaagcaacttataatatgcacttttttgatgaacgtagtagagtactatgtatttactgtatacgtaagaaattaagatatatagacattgttatagatatgatgcattggagtgctctttttttcgagggaacgggtgggagtttatgcgattccactgtagaagaagagagttgatctaatttataaaaaaaatcggacccaaaagccttacaatggctcagttaatttgtgaaaaatcagcaaaaaccctggtattaacaaactgaacctaaacaaagcataaccatccaacaagggaaaagctcctaaaatgaagccttcaaggacacgccgacagaacggcaacatcgcccgaccctaacgaatttatggttttcatccggagaaatctcttgatgtggagttgaacaagggctccaataataacgccttcaagaaagtgaacggcgcccgagagcgtcgccgttgctagcatcggcaaacctgagtaaggctttcacctcgaagtcccatccaaacatagcgtccccaacggaagccaccaaataccaccaacacactggaggtgcctctcctatgcacacaaccacctgcacaccgttgacgacctactctacaaccggcctcgctagtacgtgcggaagccaccagagaggtgccggatctagacctacgtggtcagatcaggccgtccctcgcacagccttcgccgccggtctgggacgagaggccgccagcaccgggtagggaggagggctaggccgccggtcaccttagatctggagaaagggaggaagggaaaaaatagagagaaggaagaaggggaaaggaagaagcagggaggaaagggagggagcgtcgctgctaccggccatcgccgcaggtggcagcgttgccggtggcgtgaggccggcgaccgtgcgctggggaggttggggaggcgggctttgcctcccggatcactgagagaggtgacacaggagtccggcgtgacgcataggcattggagtgcttttaatgggcaacttttgttctttagtaaagcggctcgttgtataatgtttatctagatcatgatcatatttcattatctgcaaggcctacttgcgttggaaagttgcatgggaaaaaaaaaaaggcagaaatcgtgatcaatggaacttttgttgatgatggtccttcagtccttgcatgtggattttgtggtaccaatctgccagcagcacaacttttccttaggtttataaacggcttatatatagtaatatcgtcgattttaacttaggatcataagaatgtcgtgaaatgtacaggtgacgatcgaccatcctttaaagtgtggtggcatatatattaacaaatccaagtaaggtccattaaacaacacaacaattctcagtgattttgcaaaatatatacaataacctaccaattttataaaaagaaaggaaaaaaaagtgcaatgcgaacatagctttaattgtagatttgtaataatctggatgaaaagttaaaaattatacatctgaaaatgttgttttaaaagtataaacatatttaggattcacaaatagatgtcactaggtaattccccgcgctttactgcaggaattagcaattctcaatatattttttctcgacaaccagagtaaaaaagggaacacaaataatgaaatataagagtttattagtacttatcatgaaacaatcaaatgatacccgtgcttttatatgaaacatattgataattatatgttaaaaattataaaaataatagatagatttgttaaaatgttatgcaaatatttacaacatcatatataatttatttaattgtgggctataactttatagaaagtatagatttcagatgtataaacttaaaccttgaaatcttaaagcactttgattagtaaagatgataattgtagattggtcctgaaaaatacttctatataattatatttttaatgatctctatgaccatgcatgtgaataaaaatgtaatgataagacatcatacacattggagacaatgtcaatggaaacggcaaacaaaaaaaaagatctggtatatatgtgattagggggatcatcaatatcaatcaattttttaaactgcacgattgcatccaaaggtcacaggtaatttttttacgatcatcaaaagtaaagaatccccaccagtataaaaaaatattatcttcaaagcattaaaataaatctaaaagagatcgtgaaaagaatatgaaacactgatgctatactagagttggaattaacttcacaacatatatatgaactcttttggatcctttcttttgtgaaagcaaaccctcatcggtacaactgagaaataattaagtgtgtagtaaaaaaagatgaaatgaagaacagaagagcaattaaatggagccttccattccttcgatcgatcaatcgatcgatgaggcatgttagctttgctagaagccgtgagcaatgcacgcctcccagaagagcctgtcactctcggcgtcgctgccgccggcggcggcgacatcatcctccgtcgccggcgcggcgcacttgccgtcgtccgcagccaccaccagctggtagcccgcgcagtactcccgcatccagcgctcccacgacaaagcctccacggagccagccgccgccgccccgccgcctccatcctgatcacccccgcagcacgactcggcgtcgccatcgtccgcagggcagctgccgcggtccaccgccgccgcgtccgactccgagtcgcccgtcgcctccatcaacgacgacgccatgctcggcggctgctcggagttcataccgacggggcgacacaggaggccgagagggagatcgttgtgtcgtggcgtggcgtggtgaggagaggcgttttgtagcgggcggggaggtaaaaacgtgaagaatgtgggcaaaggtcgcaaggaaatgagcgagcgacgggtcaaagattactgatgcgaagccgaagcagcagcggcagcaagaaaaaaatgggttttaaccgtgcggtggcgtggtaggctgctatctagttcatacttcatacacgtcgcgacttggttgcgcttgcgcgccctcctctctactttatgatatactccctctattttgtaatggatgaagccattgatttttgaacagatgtttatcatacaattcaaaaattttatgtaaatgtataagatataaatcattcttaaattactttaagttataaaacaattcacaacaaaataaattataattacataaatctttttactaagacgaatggttaaacctgtgaaaaaaaattaacggtattatctattaaaaacggagatagtaagattgctaaggctaggtcggctaataaaaggtcaagcagttaatttgttactaaagcctgtagccatggcagtgcatccattggccaaaaatgcgtggtagtattaattaatggatctgtgtcaaaagtctcatgccatatgcatttgaccaaagatagctctatcgatcgcttatacggtgtgtcgttgatgaagtcggattattctacatggtaccatttgttctagttcttccgtatatgtttgtcatccttgttagtcaacagttagttatgcacctagggtgagattgtgagtttgtttgtttcgttctccgcgtgacgtttcccgaactattaaatggtgtgttttttgcaaaactttttttataggaaagttactttaaaaaatcatattaatctatttttgaaatttaaaatagttaatactaaaaaaaagtctctttctttccccccacaaaagagtacttctatatttttttaccagcaatggcgctatattttcccaataaaaaacaatcaaatcgtttttatactgtgaattttaaatgttacaccgccgtaaatcactttacaaatttcaataattacaatctaaattttataatacaaattttataatgaaattaagactaaaagtaattgatcagaagaggagatagatgagatagaaacatgcttaattagatataacatacagagatactaatcactactacctccgtcccaaaataagtgcagccatgagttttcacgcctatctttgatcatctatcttatttgaaattttttcataattagcatttttgttgttatgaaatgataaaatatgaatagtactttactcatgacttatgttttaaaattttttcaaattttttttaaataagatgaacggttaaagttgggcgcgaaaaactatggctgcacttattttggaacggaggtagtaaaaaaaattgactgaatcaagtaaaatgtggcccgtgtttttgaaaacagaacatattgtcttaattaatgcctaaaataccgttatctgctttgtacaaccaaaattgtattccattttcctttttagttttgaaaaacaaacgagaatccatatatcacgatcagagaacactacaagaagacataattcatactatatattcatcttaccgatgtgcaggaaaaaaaaacaaatgagtaaatttccaaaactattgatgttttgaccaaactattacaacactaaagatttagggtgttgtactacaaaattatagaattagctcaaaatttatcaccaaactagaagtacagatctatagatttgggagtttaagtccagtgatagtttcattattattgaatatgttgttttgctatatatgcactctgcgttaaatatgtagttagtaataaattatcgctaaattcatagttatgatacaacatcttaattaagtatgcagttttgtagaattcagtctaaataaatctaaatttaaggatccaactatagggactaaattagcaaatagccaccgctagctacagcacaagttactatatatatatatatatatatatgctcttattaatctattatagttttattcaactacacaaaagttttcaaatctagaaatatattccacggttctagatgtcaagcacatggtactacacgactatagccaaagtcaataatgactactctaacaaacctgtatactaacataagtagtgtaggaacatatcacgtgcgtactctcactaattgcaagtataaggctgtgtttttctgaaattaggaagaagtttggggaaagttggtagatcccttatattatgggacggagggagtatagaatttggttctttgatacggtttttgatttgagaaccacctccttgtaggattggttagtctatcatgggatgatctcatgaactttggtgggatggccccatcctataatttgtattgcctatgcatacgtgcttatgaggggtggatggattttaggtggtgatggaccaacaagatcccatttcacaaaccaaacaatcttgtttggttccaacatgcattcatttagtgtggtttgataggctttcccaccttgttgagctgtggacactataaatcagcggttttgtttatgttagccacgtggaaatgacttgagttgtaatcaatgccatggaaaccattcgttttcatttactaagatatactgatcattaccatcgcttattaatgctcattggatgcaactttttttttgatataaccatgtttctgtaggcgaatgg

SEQ ID NO: 65759 - DNA, 5339 bp, Oryza sativa
ggaaagttggtagtttaaaaaaaaaagttagaagtttatatgtgttggaaagttttgatgtgatgtgatgtgatggaaagttgggagttggagtgaagtttggtgtgaactaaacacaccctaagtcatcttatatttatgcatgataattgaggaaacaacacaactttgtaaccctttattcattctactgatttacttgtgagaacaagaacacattaacttattgaagttaatgtttttgaagaagagttgatgatcttaaagaaagacttacatttagaaaagagttagtgcaactaaaacaacttacactgggaaaaaaaaagatgaattgagctcatttcattactttgaaaagtggaatttcaaattaatttcagagaaattttgctacatgtcatccaaaatttgtgtaatatgctgatagatattaaaaaacatgctaaggctaaaaaacacctaaaaattggtaattacgagaggacatttcaagctcaattagagagaaaaattatttaaaaagataagaatgcttctgaaaccacaaatttctaacctgatcatgcagtgaaaattttgaaattatgcaactctcaatctaccatcacccaaagtacactagtagcgcacatcatacttcatctttactcttgcatcaagttagaatttctaaccccaagacattcttatctttctttttaaagaattcctctctctaattaggtcagaaatatcacaagttaccactttttggttgtcatatagccatgatacatttttttgatacccactagcatattacacatactttgaatgccctatatcataatttgtcttagtataatggtcacctaagaaactgccccgtttttttctattcttaattcattttttgctccttttctaggggtatacttctgctgatcgttttggagaaaaagggaatattaaataagattttctagtcaaacttttttcaaataaaattttctagtccaacttgctttgcgttgagatgcagactgactggacgtattgtccacatctagaacgtacaggacaatctagcacggattgtacatttctagaagctctaggacgtatgaactggtcttcctttgtctgcaaatataaaagacatatactccctccatccccataatacaggagattttgagtttttgtttatattatttgaccactcatcttattcaaaattttttaaattattatttattttttttggcttactttattatccaaagtactttaagcacaacttttcgttttttatatttgcacaaattttttgaataagacgtgtggtcaaacagtacaagcaaaaactcaaaactccttatattatgggacagagggagtagtatactgacgaacttaattatgcagggtctattctgcagattactgctaaaataaaccgttttaaattttgacaataccaaaattttagaaagttaacattattattaaggaaaaagtacgaattaccccccccgaactatcgtggtaggccgaattacccccctgaaccacaaaaccggacattttacaccttcaagtattcataccggataaattacccccttagcactattttgagtggttttgacttaagcttgcacacgtggcgccaacgtggcagtgcagtcagcaaataaaaaaaaatgttcgggcccacctgtcatcccttagactcaacaaattcctatcattcccctgggctctctctctctggcgaccggtggcggaggtgtacctcgttccggtggccgacggcggaggtggacctcgctcccggccgggacgggcggcggatggcggcgcgcgggaggctgtagcggggcgcgcgaggacgggcggtggacggcggcatgtggaggtgggtgcggcgaggatggccgacttgggcacgcgcttggacggccggctgtggcggtggaggtggaggcgcccgggcggctggtgtcagcggaccgggcggcgggtgacggcagcgcgcgggagcgggcggcgggcggcggacggcaacgcactggggcggtgtaacgccccgatttttgttcgggaattaaaaatcattaaataatgcattttctagaaactaaataaaagttaaagcaatttaatcaagtgaaatactgggagaaataaaatttactttaaaaatcattggccggaaatattttgtaatattctctgtgccctaaaatactctgtgaaattttccattaattttcggagctcgagtaataatttgaatagcacaaagtttatttaaccaatttaataaaaagaaaaacaattaaatctaccctccttcactttggccacttccggcccaaagccctccttccctccccgcggcccgtcccctcccttcttccttccttcctccttgggccgtcgacccatcttccttcccctcgcgcaaaatctaaataacccccctgggttctcctccctctctccctccccgacaggtaggctcggcgaccccacctgtcaggccctcctcctaccttcggcttccaatgccgaagccgccatggccggcggttgctgcccacgtcccgccaaatccagcgccctcccgctcgcaccctcacacccaaaccgagtgaaaccagttcccctccaactcctccacattttcccccacttttccccaatttttggcgccaaatcgagtccccactccgcccacgttgagtcccacgtcaccggccggttgccgcccgatcccgcccctcttggccacgatttcaccctcccgagcctatataaaccctccccgtgctctcctcttccgtttccccctgtttcccgagcccatcgcgccttctcccgctctctctgcacgagcccgagctctgccgctcaccgccgtgcttccagctgcatgccatcgcccctccagacgccgccgcgctgcgccgccaccaccgctagcctcgccgtcccgagctccaccccggcatccactttatttccctgaaccaccgccgtgatgccgtgtccacgcacagcccgagccgccggtgcttttgccgcctccggccgcctcttgctgccgctcccatcgccgctgcgccgcgcaaacaccgccgtcggcatcgccatgccttgccgcacactggcctttgcttggttttcccaaatcgccaccgcatctaccaccccaccgtgaacccgaggtcgccgccgtgactgtcgcctccggccacctcttgccgtcgtttccgacctcctcacggtgtgctgtcgcctacgtcggcttctccgtctggtgccgcacctcggccgccccatcgccctcgccttccaccgacggagtcctctccttcccgtcgaggtgagctactccccatgtcgccggctttcggccgagttttcccgccgcctcgcgcctcctcccttttccctaacccttccatcgtgctccccatgtcgtcccggtcgccgtccgcagcctcgtcgcccgttggccgccgttggagtgccgccgctatctcgcctccgtccggtgtcgtgccgcttggtgagcatccccttcctcctctcctttccgccacccttcgcgcgccctctcgcgccaccgctcgccgtcggtggccgttaccgccgcgcatcgtgtctcggttgggccggctctaagccatgcccgtgctctgggccctcccctagtcccgctgacgtatggggcccgcctgtcggcgcgcccttcctctttgatgacgtcagccgtgccttttcccttgagaaaacaattaataattgtgcaataaatcgatattaattctagaaattcatttaaatggctcaaaacttctaaaattcatatctaattcattcgaactccgaattgagccattcaacttgcaaaattcatctaaaattaagctctacatgtttgtttacttttcatgtactgttttcttggtgtttattagagtttttcctcgttttgcgtgctagcatgtaggatccgtcgtttcggaagttcgcggtcgcgaggaaaagagttcggaagatcaaagtaaagaagcaaggcaagtcacacattccccttgagcatgttgatcccaatttacaaatgttttaccatttgcaaataaatatgcatgttttgctaattacatgggatcagagttttacctatctgctcgcttgtgccatgtttacttgatatccgtcctttgtcaacattgggtaataaattggctagctcatgttacttatgtgacctagctagaactatatgcttagccatgcttaattaccactagctcagttgatgggataattacaatattagacctttttagtatcagaatgagctgcgtgctcgagacatctggccatgcttcattgtcgtaattatccaactagaatgcgactgaatggtgggctgtgggtgcatggttatgctagtcgcacccatggcaattaaagaccggttcgtgggatgccctagaagaacttatcgtacttaccacaagccagcgtggtaacggctgggcttgtagtgtagctttcctctagccgacgtacccaggcgagggtgggcatgatggagttgggtcggccggggtgtccggttgatcggcttctggattcatcgcggcacgagaggagggctgcccattgtctgctgggggcgggggcgaaccctaaggtgtggtgcgatcggttagagggggttatgcgaagggtcctgtcacggcctctttccagtatgtcgtggtggcatgtcggcgcacggaaacgtgtcgtggggctgagtcttgtgggtacagttgtacacctctggccagagtaaaactattcgaatagccgtgcccgcagttacgggcggtcgaccagattcaccgtgattagtcccaccttaataaatcgactcaatgcactgtagttcaggtgggttggttgggcctgttcaacgtggtgtagcgttgatgagtggagatttaatgttactttaattactcaacagttttactgttttgctcaataaaatgttttacaaccgcctttatgcaaatagccacaaaccgtccttgtgttccccttgcacgtctgcatcattgatgtggcttgctgagtacggtggttgtactcagccttgctattattccccattttcagaagtattgtgcttctgagctgaagacgaagttagaagaccaaggctcagaccccagttgagttttgcctgtggagtggagctgaagccccgctaggatcgcctttttccgctgctgctgcttttgtttcggtgtgaggactaagtgcctcttctgtaagtattttacgct

SEQ ID NO: 65760 - DNA, 11353 bp, Oryza sativa
  unsure (1)..(11353): unsure at all n locations
caaacatggcatacttgcattcgcctttattactaaataaaaacttagactaaagcaaatgactaaacatactcaagatcaagatcatgcaatatgtgtgtgtggtatatgatggaaatggtatataaaggaaaataaagaaaaagcttctcctttgtgcttactttcttctcccaaaaaatcattcttttattgattaggagagggcatggctacatttttttttcagtgtcatgctcatgcttaatggagcataactttatttttattatttatttttttcataaccatgcctttccctctctcttttttttttctttttcaaaaggatttttttaggagaagaaaacatatgaaagtatggagaatttattttggtggtaatatggaaatggaatggaatattgcttagctcccagtgtaggagtttagcatgtgcatatatgtgggtgtatgatcttgatcatagagcatgagaattatctacacaactcacaagagtttgacaaagttcaatggaatgacaagcaaccaaaatgtatatggtttaatcatgatagcacatttttggctctggtaggaatttatatcaaatgaggaactctcaatttatcattttgaaaaacaaaacatcctgaatgaaagtcaaactagtatcaggatcatagcaactcatatttactatctcatatctcgcaacaacttagacttagatcagcaactgcagctcatttacctcaggttcccggataattgttggctactaatatttaacctttgagagagcatttaccaagaacccatatatcagagatatagaacagagcaactattcatcatttcaacgaagagaactagcttgtcttacctagcatgacttaaacctatcctatctttttggtattttctattttgcaaatttttatattgttttcaagttttataagatgcaagtggaaagcaaatatgcaattggaaagggaaatatacaatgtgatacaagttaccttagtggagggagaggtatatccccccaagcttggctttcgctcagggtccttgataaggattgaacccctgaaagcgaaagtacgcttgtaggtcatcgtgctgttgctgcatcatgttgatgtggtgaactgagcatcagcagattgttgccattcttacgtttgagctatgtgttccgtgaggttgtactggatctcccctgtctgcacatcaagggtgtccattctcctagtgatttcacccaagtcccaacgagaggaacttgagcaccattcacttagagatggaggcacaccacatgatctgggaggttgattgtccccccattggatgtcatgaggcgcatgccaccggtcctcactggcacttgcccaagttgagactccgatgctatggcgtggagcttaggtccatccgggtgcatcctcggttggtgcccaacctgcctcatacatctatacggttggcaacgggatttcatttgtacaactgggtaaaaagtaaatcaaagatccatctactccatgtttcagaatattgccttgcgctagataagcctcatcaatacacggacgagcggctgagataaaagcaatttggttgctaacgacccctagcccttttgctatccaagtaatcaaagaagtgcactcaacaggagcagagaactttatactttctaaccattgccttatcatacatttcacaggagtaattttaatttttctaaccgtggcaaacatgattgacggagcgtggggctcctcaccgggagaccgcgcaggcccccctttgccggttcggccgggggcgctaagtgaggttcttcgccctcgatatgaggaatgtcagcgagaaaaagcgcacaagacacgggccacgtagacaggttcgggccgctgagaagcgtaataccctactcctgtgttctggtggatctgtgtgtgaaggaaaaccgagagctccagagccagagagctcgagagcgagagagagttcaggctctccgatcaagtcgccagcctctcacctcccccccttttttctctccttaggcctgagcctcctttttttatctggttagggatcaccacatgggcctctctctgcctaagaaaagaaacatgctttttacaatgagggctaatctacagccggaaatgacctctgacaagcagtacacacgcctcctgctccggtcgtcagctctcccggtggacgcccgtttcatccttcattcaatggccagcgattttcttgccatgcttgcactgaagcctggaatggatctgaccgggactgacataccaactccaggagtcagcatgccagctccggctagagacgagaaccaggaagctctcatcattccgacgggacggggtgaggcgtgcgacaggccgcctgttgccacataacccgcgatctgaccggtctgtgaccggtcacataccgcgactggtcacagaccggataagcatgcgctgcgccgcattgaatgcggcgtgatgcgctcgtctaacccgctataaatgcggttaggtgagtgccgctgtgctcacctaacccacacacgtggcgccaatcaccacagggggtcggggtgccccagccctgggcgcgaaatgggagcggcccgacccctcggggagacagagggagaggtggccacgtcaccgtcgggcccgacccccccgagggggtcgggccacgtgagtgatcgcggctacccaagcctctagtcacgatacccccggccccatgtcaccgacaatgataatcaattcatctcccctaatgggtctaagatcacctcaaggaaacaaagtcatagcaatccatttgtgcatgagcctaagtgtaggattatggatatcattcgtcctaggtttcttgcaaattggaccaccagaaatatcttcctaaaacctatttttctcgaacccagaaattcctttctggatatcgattttacaggaatcgtgaaaaccaagaagtgtacttaagcctttccatgtaagtgtgaactcctcacggaaaaagcgagaggaaataccatcttctatttctttcaaagtgtacagaaattgcaaagtaagcagacgagaaccaggctcatctaccacagcaaatctctaccaatcaacagctttccaaatagagtgaaactcaacatccatacctatcttttttagcagctccggtgagtactctcgcgtgtgagcatactcctggtcgctcagcatgtagtaggtttgtctctcccgatcactgacaagttcgaggtcggtgtcgtttaggagtcgcctcagagcttcggcatcttccatcgagacatctgctgatgaacgagtactagactcgtcatgatgacttgatgaagagccggaccccttgaacagacgagacagtcgcctcctcattctgcacaatggaacaagaacggactaactcggcgggggttaattaggaatgacaagaatttcacccgccggttagtttcacccaagcaacttgtatatatgcaactaagtatttgaatttgagggaaaccatcaaagcttgattgaacttgagagcaaactttggagagggaatgaaaatgtgtttaaacagggtggagttccctctcccggccggttggcttaagaagtgcacccacaacgatcaaaactgacctgtggggcccactaaccattgcctcaaaaagagaggcagccgaccgttggcctggccagtcactggttcggccgaacccctggtgggcccaaccggccccacttttggccgttggattccaacggtcagtgtggtcgtggcacagcaaatttacattgaaaattttattttggtttgctttgaaagattcatttgaagaatttcctcaaaattcataaatgcaattttgaagttcaaacatatgttgatgcaaaaattcaaattgttgaaagaaaatttgcggatacataccaatttacctgttggcgaagctcgcgtcatttaaagtccgacgtgcaagaccatacctccttctgatttagttccacccatcttcgggggtgatggagcgggcgtctttggcttttccttccacaccttcttcggctttggtgcggaagacggcttcttctgagccggctgctctaacttcttggccggtatgggtggttttaccggcgtcttccaataacggtgcttgggcatcgttatttccttctctaggaaattctgcatgaatttcaccaggctgtccattttgggtggctccacttcgaccacttgaatattctacgggtttggcccgtacttgattctgaccacggagcattgttctgtcctcggttgaaactcaaacttttcctccttcccgttaatatgaaaacggatactccctgttcccacgtcaatgttggctactgcggtactaaggaacggacgccccaggatgaccggcgtttcttttcccgtgtccatgtccagtaccacgaagtcaaccgtgatgaagaaatcccgtatcttgactggcacatcctccgctatccctactgggtaacggactgacgagtcagccagttgaaggcgcatcggtgttggtgccaacaccgtgaagttgagcttgtcgaagacgtctttcggcatgacgctgacactagctccaaggtcgcacaaggcctggtcgaattgttgtgccccgatcgagcatatgatcgtaggacaccccggatctttcttcttttctaggagcttgtggagtatcaagttgctgcattgttctatcagcttgaccacctccgttgttaggagcggtctcttgttgttgagtatatccttgagataacgggcgtatgttggcacttgcatagcgtccaacaacggcacgttgatgtggatcttctagattactttaacaaaacgagcgaattgctcgtccaccgacggtttcctactccgttgagggaacggcagcaaccgtgtgtcacaatactcctgcggcactgacttttctggttgaacttccttgtcagccgagtcattagatggcgcttcttttgatatcccactagttcctgcagggttaggatacggcggatcacgagtagacttacctcccctcatcgtgatcgccttgacattttcaatggaggagtcgggttgccccggaatcctcccagtttcatttgcagggactaaggatgccaactgagctagctaggtttctatcattttgttaaagctcagctgattttaaaaagcagaagcaaagccatctaatttgacattaatgttatctaggatcttatcattggccgcaagctttttgcttaacgcatcagtggttttagattgcgcaaaaacgagatccttcaaggaggcctggctagaaaaattactgttgttgttacctccttgataatatgggcgtggttggttccacccctgacctccttgtggacggtacccgttgttgttgcccatctacatcgcctcctcacgggtttctaggcaatcattcccagaatgacccgtgccgccgcagacctcacacataacgtgtgagtccaacgccttgacggtgccttgtggccgtttctcgtggtcgtccaaacgtttcatgaggaggtccagcttggcagcaagtaactccgtctccttgacggcgtgcatgcctcgctgatgggtctggagtcgttcctcgctccaacccatattggagaccatcttctctattaaatcaatggttccttgaactgttttagagaagaaagctcctccagctgccgcgtcaaggtgatcgcgggacatcggggtgagtccattgtaaaagttctgcaggatcagccagtcgtccatcccatgatgaggacatgcggccatgtactcctgcagtcgttcccatacttcaggaatagactcatctcttgtctgctggaaacttaaaatccttctacgaagggcattggttttgcccatcgggaagaatttcgagaggaatgccgtagagtatttgtcccaggtgttgacagcagcacggttggcataaaaccactgcttcgctctcccgagaagggagaacggaaacagccttagcctaacggcgtctggactgacgcccttgatggtgtacgtgctacagatctccaggaactattgcagatgagcattggcatcctcattaggcttgccacagaatgggctagcctgcgccatcatgatgaggctggacttcaagtcgaaatccacgtctcccatgttgatctgcggcccaatggccacattgtcagcagagggagcagcgaattcgcggagagtcttgtttgctacagatctccaggaactattgcagatgagcattggcatcctcattaggcttgccacagaacgggctagcctgcgccatcatgatgaggctggacttcaagtcgaaatccacgtctcccatgttgatctgcggcccaatggccacattgtcagcagagggagcagtgaattcgcggagagtcttgtttgccatagtcttgaaggtcggtggcgctggtacggctgatttctctgtcggtagagttttctgcggagcagcgactcgtggcctgacactccggaagaaagcttctggattttctttgaagttttccggcaagttgaaaccagtcatgcactaccctgtttgcacaacaaaaagtgaaaacaaccaaggttagcctgcaaaggaaaatgattatacagaggtaaatataaagtataagttcaagtaatctctattatgaatcttccccggcaacggcgccagaaatgcttgttgatatttcttaacgacattactagaaatataatccccggcaatggcgccagaaatgcttattggtatttcttaataacattactagaaatataatacccagcaatggcgcagaaatacttctgatatattatggttacagagttcatccgcaagcgcatagatataccattgtagcatttcacccgagagtattccaagggtatcgtatttattttatctcgtgagaagatcatgtagagggaacattgactaataatttatacattacttgtgatgatcatattctaagcaggggttaagataatccaagggtagagtgacacacaatcattcactactcattctcataatatatcatctaagctaagtagatagaaaagaggaagaaaatctattcctatacttctaatatacatagtatacatacattctagttaaccgatatactagctaataccctctatccgatgtcctcctggtacttcgagaagccacccctgactgccgagttccttacgacagcccgtcatgaccatacaaccggggctaaatatggaggaataccctccctaggaaattaacttaggattatataccggcgtggaggaatacccgtactgagctgtcaccatcagcggcccacctctcatccgcaatatataactccaaataatgatatcccgtaatctagacaccacgcctaaactaccagatactactctaatatcatcgtcatgacatagtgtcgaaacatgaattcggcaataataaaacggnggtagcgcacgagaacctaaaagtggatggatgtggagacaaaggatttagacaggtcaggccctctcaatgagaggtaataccctactcctgtttggggatttgaatccgccgagtatgtattgatctgacgatcaggttgtctcatcatgcccctagaggggctccctgccctccttatataggttggggggcagggttacaagatagaaaccttaaccaatacggggtatcggtttcctaaatctactttacaatcttatcaaaccaggactttaggccgtttcataatatacagggaaacgtaatacccaagtcatgatctgttacatattccatagatataagttatcccctatagccagtcggataactatgccatgtaggtatggggtacccataatctccacagtagcccctgagaccttcacagtcgaaaagataatcttctctcgaactagattactccaaagctgagtgcttcaatcatcttcgccatggtctccgaagtacttttaccaaatacgaagactgtggagggctgaaaaataaagtcaggtgcatcgactagatgcacctaataggtgtagcccccgactatgtggttaattgaacaaaccaagcatatagtcaaggaataaataatccaaccaaccgagtggttttaataattatagtcaaccaagcgacctgatattaatatgtagcatatgcggtgtgaatccctgaataacatgatccgagtgatataccgactgctttgtaaaatatgatgagtgtaacctaaagttggttacatcattgaaaattcacatagcaaaacagctataaagaagcttatatattgtgaataaagaaatttccaaagtattgggcatacgccatgcgcacactgctttaacagatgtgcttaagtccctaaaagacacatggtttcaccacacccggaaatatatggcatatgtggtataaaatccaagtaaataaactcataaaggatttaccaaccgcctgaaaaatgaccacaatatataatcagcctaagccataatattggtcaataaaaatgcacacttacgtggcgaaaagcaatgatattgtatctaatcaattgcttaaaaacccaaacagcaccttgacttatatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctagaccaaaaaatatgccttcgacaccctttaaaggatgacgcatgtaacatgctctcgagtaataaatcttccgggtgatatagaccaggtgtagctcatatgaatagcttctgatctgagtgattatcccttatgagatactccaaaatatatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgacccacatgaagacgaaattgctcatcagaagtaacggaagatgtcagtggtagtaaaaacagtgacaccaatcaaaggtaatgaagttgcataaccatggaggcggagaaaccagtcggcaacagtcaggtcagctagcagtgaagatgtaggcgcccaacaacaacaacaaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgaagaggcttaacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcttgaatattggagagtcacttgttgtagtaaaatatcatggcattgcatgccgagatgtcgaggttcacaaagacgtcgtggttggtgaagtagtaaaacttgcgaagtagcagcaatagagtttgccggtgccgaagataataaagatgaagtcgctccaccatgatgacaaagttgtattgccgtaatgaagtgaacacaagtcggcggcaacagaagcaaaccggtagtgaagacgcgtagttgtgaagataaaagcaccaatcggcggcagcataatcagtcggcgacggaagatgatgatgtccatcagtagtggtagctgtataaaccagacgtagaggtaagggcactagtcagcagcagacgagacgaccggcgatgaagatgtagatgcccaacaacagctgcataataggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcagcggcggtcgaggcggccggtcggtgaagacgtagacgcccaacaacggcggcataaaggccagccatgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcagaataataggccagccgtgcaggcggaaacaccagtcggcggcggtcgaggtggccggtcggtgacgacgtagacgcccaacaacggcggcataataggccagacgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcagcggcgaaggcaagccggtcggtgaagacg

SEQ ID NO: 65761 - DNA, 872 bp, Oryza sativa
ggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaacaaagtttcacggatcagaatttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggccagccgtgtaagcggaaacaccagtcgacggcaacgaaggtgagccaacggtgaggacgtagacatccaacaacggcggcat

SEQ ID NO: 65762 - DNA, 706 bp, Oryza sativa
atgaacttatgaggatgctctacatggcaaataaaccccatctctttcagcagatggcgttctgtccttaccagatcatgcttcaagtctgagtatttctgcaacaaatagttacagctttcaattagcataattctttataaaagttacatattttctaaaaaaaagcataggtattacagctctagcagcaagagagcaagaactagagacatcaagatttgaagtgcacaaaggttcaaaaaatatttaaaataaacagagagtaaagaaacagataaacctttgaaaacacatctaagtgttctattggtacgttctctctcctacattccattctatggaagacaatgattatatgctttgatctccttggactctcctccaacttccctgccagccaaacacagcttgcagcaactctctgcaagcataaacagagatattcattggttcaactcataaaatcaaagactggtttgatcagagtaactgagacaaaagatttgcttaccttaacgctaaaccgaacaaatgatttcttgcagtaaaaacgatgaaacaatacttgtgctgtggccatcactgcttgtggtctttggtgcgtcaaggaatccaccacatgcaaatattatacttttaaaaaagaaaagaaaataaaagttgcaagaatggggcctagctaaattcaagctacatagaaaat

SEQ ID NO: 65763 - DNA, 1623 bp, Oryza sativa
attttgtatatccctcgtagatatagaggccggactaatgaaaatcaattatctaaaaaaaatatggttgtaatcatttcttaatatttagcataataatcaacattattttgcaaagaaaaggtaaaacctagaccattgcattattattgttactaaaataaaagaaatatagtgcagaaaaaatcatgatgaggattagacatatattcaggaactagagtggactcgaatccttatatacaaatttttatatactaccgcattattatttgtttatatttaaataagaaataagaatggttccagggcggcgccgtacgtagcctaaagagagaaaagggagaaattggtggagagcgcgtgggaagcggcgggcggcggcggggctgcacggatcccacccaatggcgacgcgccctctgctccatcgatcccgacaacgcatccagaaggcgccggcgacacctcgccgccgatcgtccgccgcccctagtcgccgccatctctcgatcatccccctgtcccttcccttccacgcacggccggccattccatcgccgcctacctccagacccaatgcatcctctctctctctctctctctctctctctctctctgtctctgtgttaattttgtaatgtattagcaaccattcatggatggatggatgatgatgatcatggcctctgtcctctgtttttactcgtggctgcagactagtgctgtcttttctcttgtttgctgttctagaatctgtgtgctgttttctaaacaatttactgtttatatttgttttgttttgtttatttttgtagttgtaatataaggttagtcttcttagtaaatatattgaaaaaagaagaagtagataacacggtttgaatcttggtaattgtactgtgctcgacaaattaggacgtaatcctatcgtttcagattataaaatgatttgactttagtcaaagtcatgttgtttcaagtttgactaattttatagacaaatataataatatttataatactaaattagttaattaaatatattttcataataaatttgtcttgagttaaaaatattactactttttctataaaattagtcaaacttaaagcagtttgattttgactaaagtcaagacgtcttataacctgaaacggatgtagtactgtatatgggaactagcatgaagatcttgctactgaaagtaaaatatcgaatgaaattcgacgtgtatgagaattatacggtaatcataattaattagaagtggctgcatgtgagaatgtttggttctaaagcagacagacgaattaaaaaaaaacaccacggcaacggaggacgctactgttcctgtgaaattcctatgtttaattacctaatctgttttatgtaatgtgataattaaaaattactctggtgcttatttcacattgtgattttactttactataacataacttaatttgtatgaatatgtgtgttattaattgggtggcagtgccactagccagccagggggtggtgatgagcatactagctagatttgtgttgtgtagctaagctggtggccttgtgtgctccacatcactccaaaccctctgtcccaatcaccacatttt

SEQ ID NO: 65764 - DNA, 1404 bp, Oryza sativa
atagctagacatgtatttgtatagatgtgtgtgtgtatgtatatttatattcctacagtggaataggccatggatgtgtaagctagtgcagctacaagtctgcaactttgtaggacacatctggctttgtactgttgtgcaagcaagcatgctctcaacaagttaacaaaccagatgggccagacaatgcatgcatgatccacacggatacaatgcaagatgtagaagaagagaagaacaagcaagaaatagtacatggttatatgttcagggaagctcgaaattctgagaagcagctaagatgagtagctagctggattttgtatgaatgaatgaatctgaaaaagtaaaactaaactggattttgtatttcctgatttctagtttatttttttagattttacaactataaattcttggaattttgttaaagaattaattaggattctgtttgagggagtcgaagatttcgagagaagccatggctccgagaagctcctcgaaacagggctacactatgtgctagcttctttttttttctttttttctttttttttcttttttttatgccgggaacactatgtgctagctgtgtgtttacgaatcatgtacataatacatgtggggcaagagcctgaaagatgcagggtttgggcttttcctgcaagcacaaggccacaagggagccccttttgttctgaaagagtgaaagaaattggagatctctgcagggatccctttttactttttgcatttcagcctggacacatctatgatctactgactactaccccctcatttgcatgcatgcatgcatgaatgaatgatgcaaaaccagagaagatgccatgcatatgtgcattaggagttaggacacagggccaggcctcctcaactaacattcagattttcagaggctgcaacttgcaagcaaatctagtacaaagtactactagtgccaatgccaaatcagatgccatctctatctccatcacacacacaaaagctgagtagttagagaggcagtcagtacagacatggaggcagaggaaatttatgtgatggttgcagaggaagccaatccaggggactggaaatctgaagtttggtgaaggaagcaaagagaatgatgagtgagctagtagtagcaaagctaggtcactgagcccagtgagtgagtgagcgactgactggatgagtgaatgagcatgtgcagaagcaaattgaatgcatgaacacaagagagattttaatttctcggcatcattctcttcctcccattgagatcatttcatttcatctctctccctccatagctggcatgcagcacggcagccaagtcactgaacacagggcaatattaagccattgcaggggatgatcagttgttgcatgcaatattca

SEQ ID NO: 65765 - DNA, 1500 bp, Oryza sativa
tttttcatctcctcatctccattttttttatcatcttttttcagacaacgatttgttgttatcttcttgcagagtaggcatgccaactaggctcgccagcgagtcgcgccactgtgatatatggcctgtatttttccgggcttcattatctaacactatccgtaaaccggaatccgcgtgtagtatttgtctaggctctagaaaattcctggatccgccacgcggagagtcgcgtggctggatttatatgcatgtagttgtagttcaggtgccatggtgaaagctagaggtatggaagggagctaggttggaacacttgtaaggaggaggtgcaaccatgtgtaaggcaagatggatatgggtgaaaaaccggatatatgatgatttctttgcaggttaatcttcgctttctgatctttactgaacctcatctggaaccaaccaatccgggcctgaatatatatataaaccttttaaaaaaatccacaatatggcactcgtacaaacgtgcaattaattactccctggaaaagatcatagtctcctaccattagtagcaagtagtagtagctatcccgtttttcgcatgaaggtgtttgtgccggattgggaatttggattgctgcttggtttcatggtgtgacaccacatggaggataacgatggccggccggccgcctcgagcacacgcaactcaaccctgcctcaaagctcaaaaccagtagaagggtaggataggatgctggagatggagtgagctctactccgccaacgacagccaggcgcgacgacatggcactggctgtcgtggcggaacctagaaagattttagagcccggacaaatctaactacaagatgatataacgttagttatggtggcaaaaccgagtaaacttttagagtccggacaaatctaactacaaacgacataacgctagttgttgtggcaaaaccgagtgaacttttagagcccggataaatctaactacaaacgatcgaaacgatatgacgctggttgtcgtgacagaaccgagtaaacttttagagcccagataaatctaactgcattaagtatttgatatctattggttggctttagtataacggagccaaaaataacttttagagcccgaacgaatctaactactggctggttatgtgcatctcgcgatgcagaggctgggatttgacctctcccaagcatcgtccagcggtatttgacatctcactaaaaaccacgatgcaaatacaacggcagacagactgctagctggaatgaaacagggagagatggtttcacgttgaattattctccttttcaagctgtaaaaggatggtggttcagaaacagtaaaagaagttgctgccactttgatgccatcgtcgttgtctactgttctttgtgtgtgtgtgtgtgtgactgaccatgacagtcagcaatacatacacattgccggtgtgtaaatacggccgtaaatttcacaattaagacgggagga

SEQ ID NO: 65766 - DNA, 1373 bp, Oryza sativa
ggggggcaccggcagctgcagctagctaggctaagcaacagtgctactgcagggggacagtggtgttgatgtgtaatgctacagctactgtatgttggttttggctccagatcaatctatcagattcagatatacaaactgtacattccaaacaagatggggatcggatatgatcatccatagatgaacagtcaggtggttagcgatggaaggaacagtgccggatgctgctagctgcagctgctgctgatagctggctggtcgagaggcatcatcaactccattgcactggggaaagctgcatcatgcatgtaatgcagatgcagatgccgttctgaacatctgaatgttgcagggctggggctgggcttgctatgctagctagtagcaaagcaatgcaatccaatgacaatgcccgatacagtattgggttatctaccctccttggaatggatgcagagacatgcagtgaatcattattgtgttcgcctctcatgcaggagtactccctgcatactcataagggtacccacaatggttatctataggctctatataagagatccatgtcagcatattttcctacttggaagagattaaatgaagagagagagcaaagctatctactaacctggagatagtctatagagaaaaacgaggcaatgtattagagagctatagatacccatgtagacatactattgagatgatttactattaatctagtctattgctgagatgtacatgttttatagataacaccttactttaccattgcgggtgctctaaagcatactcataaataaagccgtttaggacaatgtttaagtcaaaccttggaatataaatcatgaataaagttgttgagtttgaaaatataaaaattatatgaatagatttgtcttgaaaaatactttcataaaagtatacatatatcacttttcaataaatatttttatagaaaaaagaagtcaaagttatgttttggagactcgtgtcgctgtcctaaacgacttcttttacgagtatgtagggagtactgcacaatactactactccatccatcccaaattataagacactctttttaaggaaaatcaaacttgataatttttgacaacttttaactagtaagcatactaatcatatataggctaagtattatgaatgttatatcactatattcatattttaaaatattttcatgtgatactaatttcatattcgtggagagcataaaataaaataaattaataatcaaaatatataattgaagacgtataaaaaagattcttataatttgggatgtacttttcaacgagcagtgcttatcagtggcagaaagaaaacagtgtatgcatacaaatggaact

SEQ ID NO: 65767 - DNA, 1134 bp, Oryza sativa
aaatacaggtatcccatatccttgggcaagtcgacagaggcagcaaccttactatcattgaatattacccacctcccgtctttgaggacatgggcaacgtagtgcccacaatgggtagaggtgcccatatggctcacaaacgccatcaatttgtatcctgcagagcatagagcaatgttaataaaccaagaactgcaaaacacacacacatactgaagatagataatcaaccatctagaagtattgaacccaatggtttggaaacacctacagtctgagacaagtttggagcttacttttatatggtttggctaatcattcactaccatggatttctttacatatatcttaaaagaaaaaaaaattaaaaaagtaagttttcttggaaacttagatgggacatgggtcatataattgtaaatccacatccatttcttgacgataatgtgccatcgttattcagaaatgctcagggcatgtacaaagtcatctttcaaatgttgcaaactacaaattcaacattaacagttcagaatgttaatgaaattagctcatgagattggaagcttggcactagaaacagtaaaacagaaggggtagaaaaacttactgccacttccatctggtatgtgtgcatcatcatcttccatattgcttgttgaagaatcagtaggtactgagctaaaagcctcagggtggctaaaaatccagtctgttgctctctcgatatttccaccctatcacattagaagtacaaaacataagcctccgatcaaaaaggttggttgcagacaacgggaaaggaacaccctaagacagttttgaaaggtcattatatgaaaataagcaaatatcaactttctgagaggtattcaacattgcgaactgtacaagaaaatgtaaaagatcaactatcatggatgaaattaaaaacagaagattattacagaagctgccaaggcctttcgagcaacatcttcttgaaatccgaaggaaacaagagtttgaacgctagtttcatcaacagtttgttcagcagcctgtgaatctttagatattggatcgttgatatctgtatagcagaaaggtgattaaagtttgtagcggtcaagttacaaattagggctgcaggaa

SEQ ID NO: 65768 - DNA, 2618 bp, Oryza sativa
tcctgcaccccacggcagcgcggcagaaggagagaaaggaccatgtcatcaaggggatcaagggcaactagcactcctgtgaggtcaagagatggcaatggcaagggcaaagcagccatggtgcaatgtgagtctgagactgaaagatctcagacagttcagtgccaaggacatcctcattcctccaagtcctccttacagagtaactggcatgtatggaacacctagatatcctgcagagaaatcggtgctattgaaaaagaataatgtgattcatcggcaaggcgtcggtcgatccgaaggcgacgcaaacatgaaccacaccggcaaaggaactgtggataagtggcttcaaatgctcatggaggatcagcagcagcaagaagatcctgcagcagcatatcattcttctgaagatcacaacactgctgatgaaatcgcttcagacgagcaccaaatgcaaagcagaattgatgatgagagctgcaggaatgagatcaccgaatgctccgatgagatcgtcgaggtcggtggcgatggtgctactgagcagcaggacaggtgcaggaacagctttgagatcaaggagaggggagaggagaagaagatctggttcccaaggtctgacagctccaggggtttcaggtctctgccttcctcaccttccaagatccttggaatgagaaggggtgtggagtgcatgagcaggaagcccaaggtggtcggcgacgacaatggcagatacggctatgaagattcagtgtccacaagcagcagcaagttcctcaccaggtgcaagcaagccatcaagaaagcagtgaacaaataaacaattctttgcaccatgatgcagcacatttcaacctgtttattcttcaaatctgtgtgtttaaattcgtgtcaaattgctagttttgttttctgtagctgaataagttagtactcaagtgaggcatacatagctttgcagagttccttctgcaactagtgagacagacatttactgttcatggtcactattatgtgatcatactggcgttgtacaactatttgttgatttatttatgaagagaaactaaattcttaagtccatttcgtcctcgaccaaaccagaaatcttatatgcttccctctctttttagaacatcacagatttatttatgcactcaagtgagcagatttatctgaatggtttcaccacaaacaatagttcagacagaaaggtaactgactgtaattaaaggtagtaaaacagattaacgacccacttagccatcagctttggcttcagaatttcagatcctctcatgacatcgacttgcgccatttcggcgtcggcgtcgcggcggcggcgccggcggcgccgcccctgcccttcttcccgctcgccggcgtccgccgctcgatgccgctctcggagtcctccacccgcgcgacgtcggcgctcatgccgccgaaccagaacgtgttccacttgaagaacccgccgccgccaccgctgccgcatccgccgcaccgcctcctctccgtgctcagcctgtccacatgagcttgcagcgcgctgcactggacctgcacgtcggcgacgaagacgaggacgaacacctcaaaaagctttgaatcgaatcgatgaacggcgtcgagcggcggcgtagatggccgtatctggaggcgggcgaagtcctcgcggaggcggcggagctcgtggtgctgggcgagcacctcgcgcttggaggggcagcgggcgccggggaggtcaaacgccgggctgggcgcgccgaaggaggaggcaccgccgctgagctcggcgaggcggttgagcttggtgtcggagaagagcacctgcagcacggaggcgcacggggaggcggtcgttctggacggcgtgcgccgccgcctccgccgtcagcttccgcgcgtcgatcagccggcacagcgacttcctctcctccttgctcgtgctcgcgtgtgcctgctcaccatgaaacagccaaaaaaaattagctctttcttaaaactagttgggtggcccgcataattgcgcggctagcacccaaacaaaatcatatatttttcagtatgatttcacttaaaatttattaaatagctatccacgtatcatccccatatttctaattacgtagcttttaaaagttataccagctgctacccgttacttctgtcatatccttttttatttgcttgctcggtctaccactatttctatttattcttcttgaaacctttaaaaattagatcttatagttttttgagtttattatctcgttgggtttcgtttttataatttctggaagtcccatcaaacgctgccattatactcctttacggcccatccactgtcttttctctttattgtcattagaattttacaaatcgaacataattatcgttcaagtttatttttttactttctataagtcccgccaaaccgtcagtggctttgccattgtactcctttatggctcacccggtgtctcccttctttattctcattgagattttaaaattatacatgattatcattgggtttttttttttactttttagaagttccgaacctttaaaaattggaccttgtagtttttacaatttattgt

SEQ ID NO: 65769 - DNA, 1128 bp, Oryza sativa
taactatcgtttcaattcattttttattttctagaagtcccgccaaccatcggtggctctggaactataatcctatacatcatgcccgctgcttctcttttttattgtcattgagattttgaaaatcgaatatgattatcaatggggtttttttttcactttctagaagtccggcaaccatcttacacgtttgcttcatggcctgcctatcatccctccttttaatcattattaagattctatttggtgttttactaatagtttttatatgtcgtatcaaccgccaccactctactcttttataggcttgttacttaatttatctcatcgtatgttttatatggtcttttttttcaatagtctttatttttatcaccaattttagttatttataaattgtattcctaattgaaatattttttatttttcttattttagaatttattttttaaaaaaattatttaataccatatagcattcttttaatatttttattttttatttttgaattttagttgtttcaaaattgtattcttacttgaactctcttttagtttttctaattttggatattattttatttctttattctgaattttaattaatctcgtattgggttattatatggatccttcttttaatattgcttatttttaattccgaatttcagttaattttaaattgtattcctacttgaactcttattttctttttgctaatttcggattttatttttatttttattccgaatattaactaatctcgtattgggttcttatatgtactcttctctcaatgttccttatttttaattccgaatttcagttaattttaaattgtattcctacttgaacttttattttattttctaatttcggattttattttatttttatttcgaattttgattaattttgtattgggttcttatatggacacatctttcaatatcgctatttttaattccgaatttcagctatttttgaattgtatttctacttggactctccttttctttttctccgattaatgtgagaatttctagcttccacagcgaacgtggtgcctcctttcaagactgttttaataatataatagatagattatttttcttttttcactaatgcg

SEQ ID NO: 65770 - DNA, 709 bp, Oryza sativa
tgtcttctcttttgcattcattttggacacaagaacatatattttgtgtttagttcttgaatttggcacaccaatttggtttatttcctcatcattttcttttatctcttgacctaaggcccccatcgtttgacgttatatttgcaaaaaaaaataatttgtgaataaaacttttatatacgtgttcttagtgaaaagtaaataataaaaaataaatttcgatgaaaaaaaaactccaaaatcataaagttgaaaatttaaattttggttgataagtgtaagtataagcaaaaagatgggcttttagtaactctgttgttaattgccaagaaaagaaaaactctgttttctgctatggtccttttcagtgctatgcatgacagtgtgctggtctgtactgcatgctatctgtatcgaactgaacaacagcaacagcaaaaggaataataataaaatgtcaagatcacattgttctagtactagttatgatagtaaaaagtgtttttgtcttttaaaaaagcaacataactggtcactgtaattttcttcatttgtttctcttcttgaaattgttttcagcgtttagccggcgccggcgccggcggaggcggcagctccgatcagctgcaggtgtcctcctacagtggagcaacagaggcagcagtggctatccagcatcaggagcaggagcaagagatatcactcgagc

SEQ ID NO: 65771 - DNA, 701 bp, Oryza sativa
agcagtgtcattctgcagcaagaaccaagtgtcaaattttacaaggtcgtacaatttgatccagcaggaaacaaaaaatgttctgcacgtggtgtaccttgatggacgaatgatcccactaacattatccaatatcggcaacttcactcttccccctcgatagatcctcaaatgcctcagaaatgcctttcagaaaaataaaaacagcaaataagcacatctagagctcatttgtgaacccactatttacagctttttacacagcaattttacccagagtaaaaaaaaaaactaatgtggttaaaaatcatgctactgttcaaaacagctagtagatcattgctgcagagctgagacaaaggaggggaaattccagtggtggattggtccaacctctgtcatgttgcaaatgaagtttgggatggttggcagcgccctgctcccgacatgcacgtatgcgtccactgtcagatcctcgtacctcacttcgatcttggggaactctatctgcactctgcaaccaacaaaaataaaaaaaaatggagagcagcacagatgcttcagatcagcccatgacaagtttaccaacactacaagcatacaaacaaaattctacaccaaaatccaaaccaaccagaggagacgagcgatttacagatcctacaagccgtagctgaaattgtttcgtaaaattacagcaa

SEQ ID NO: 65772 - DNA, 1679 bp, Oryza sativa
ctttgaacagaattcttcaccctctcctcgtacatctttgcagacaaagaacttgcagctgaagtgctttgtcgtgttggaggatcagcagaaaccaaaccattatgtgcacttgtcggcaaatgactgctttcactacgctgttgttgcttctgctggcggcgttgttgctgtgttgttgctgactctgctgctgctgctgctgctgtgcatgcctctgtagtaggagttgttgcatttggatctgctgtgatgactgctgggaatgagcctcttgctgctgcagctgtgatggctgctgctctcgagctttaattgactgtgtctgggttacaaaatttatgtgtaacaacatcaggaacatgaaaatagcattttgcaataagattgacgcatcatataccaagaaatggctagtttcaaatgagtaatcaccagaaaatgaacaggtattagctacggcctactacaaagggaagggaccattgccttcaaagtaattaatcatattgataataaaatgttgactttgaaattttacttgaattttaaagatgataatagctggagacaacatagtatgtattctacgagaaagtgttttgcattctgtaccttctaaaatgattaagacacatgttcttctataattgtgtgatatgatgcagcatgttttgtttggaaatatggggaaacatttgattttttttttaaaaaaaaatatccaccataacaagtttttcctacatagatgaattaggcattttcttcttttttttcaagagtgacatggaaagttcttgaatttggttttcaatgtttgtgtggaatttaaatccatttgctttaggcaaaaaactaaatccttttacagtgaacatgatctctatgactgacacaattcaagcatttacacatgtttattgtaagataagcagtaaaccactgtaccaagtgagtgcaagcaaacaacaaggacaagtaataaccaagatgcatgtgctacaagaacctcaatgtacgaagcagcaacatcagagtgcttctcgttcgtccttgcaatgaagatgtcccagaagacagaccaccactccaagaggaaaccccctggggcatcaattgctttttttgcaaaacaaaagctgacatctttcagtacaagaagattaaaatcgcattcattacaatgcagaaacatcagagactggcatgcataaatcagacaaaacaatgtggctgtagtattgttcctttgtatctgcccggtacgagtagctaataatactcgtgtctcgcacatgcacaaatgtaagtgtagtactaatcaagctaatcaaatgatcaatttgtaaccatcctattggcccaagaacaatggcagtctgaggaacaaactatctggtcctaatgcagaaagagcaaagattgcaaactacagtagtatgacaaaattcagaaattgatgcactgaccaacaggatcggaagacacgctgccttctgcttggaatgccttggcagtgctctgcaggttcctcttcaaaagataatcatggatgtacacgtccaacctgcttccaagaacagacatggataagttcagtgcggggatatataataagtaaaaaaggaaacatgggggtttgcatgcaagcacagcagcaacaggaaggaggggat

SEQ ID NO: 65773 - DNA, 1140 bp, Oryza sativa
agaaaaaaagacgatctaacccgccaagaaacgaatccgaaacccctcccagaggaaaacaagaaactaatcttggggaaagataaccatgcggacaccaagagaaccaaatggaatgacaaaaaaatctcaagacaaaacggagaacatttcaccaacataaaaaaaagggaaaaaagaatgtgcgaagaacatcaaaccaatctgatcgcaataacaaactaaggaatgatgaagcaacgaagaacagaagagagataggagaaagctcacatcttctccgcttcccacgcactctgctgctgctgctgctgcgccatggccgccgccgccgccgcctcactccctctcactcctcgacctcgctcgcggtcacgcacgctaaacacaaaggcacaggagagagcgcctcaggaactgacaaaaggagagcacaaaacacaacgcgcacaagctaaaaaagaaggatttgaccgctcacattcgcctctaaaatctactactaatcgaggtgcgccaaaaaaaaaaaagaggcaaattgcttcctttttaaaatcttcggtcgcggagagatactatacttctactaccagcggcaatgcgtgtggaatggaatagaggaatcgaataaaaaagaaagagatgaacagggcagtgtgagtgaggagaggaagggcttaaacaaaaaaaaaaaactgaagatgactgtcaaaaaaggtcagtttaacaatattttctttcttgaaaacgccaaacagctgcccatttcacactgttttagtggttcaccgagtaaaaaagaaaatgagattgtgggattgtgaatttgtgatacagctgcatataatccaatccaattatccatatcaattatcgttatatgcgattaaggccgagagagagagaaagaaaataaatgtgaaatgatgctacagttctagggctaataatgagtggcatggattgatgagcctgcagaaaaagcgtacttgcggctcactgtagctcctcggtcgaaactgcccctccttttgcacgatatttcgctactgccatcgtggctatattttttttctcgaggcatttgtcatgcaggtaagataagggaggtgattctgtagcacagtaggggtgcaggaa

SEQ ID NO: 65774 - DNA, 9753 bp, Oryza sativa
gtagatggtagaacatcaactagtaggccaactaaaaatatcgttattaaacaacgaacatcaataaacgctatcaaaaggctccacaaaccttgaaaattttgactacagtatcccctcttatcgcaacattacaatgatagacttttgtcatgcctggatctgaatcaaggttctgcaacaattaaaatggaggaatggagaatgatttcatcaggctcatgttataatatactatcagaggaaaagaaacagatagcagaaattagaaaaatgaaatgtcagtataatattctcatgatgttattgatagatcttgatgctcaagaatgttccaagttctagggaactgatgaacttacaagaactaggtatcattagcagacagtgtttctaataaggaacttttgaacaagaaaatatgcataagtgcatccctagaagattgtaaaagcatgatgcgttgcagaaaacttattacaggaaatggtttgtgatgttccagcttgctgatgaaccggccacagaaaatcacggtccaaaaggtggttttgctgcatttatcatggaatgccttgctagatgattggtaccgtttctatttgtttttgtagttctgaagtaaattaactcgaaatggaagtcaggaactacaagtcagtagtaccacctgtatggttctgctttcaacagaagcaggcttcttttcagcctttagtcttaaaaaaaagtcaaaagtgcatgtaacatacctagacactaacatcaaaatgaagaaaacatgatacttttaagatattagaagctcagatcagaatgtacaacagagtaagcatgcattatgtcctcgatgcacaagtaaattcaaggagaatgaacatgcataggtgcaaattatatatatttacttatggctccgtttagaattatccaagttctactatgaaatgggatcatcatctttgatcatttttagagatcgtcaatgaaatacaggaaatagaagtactgccattgaaataacctttgctctatccgaagctgcaatatacttgtggccaaatgttctccagatttgtgactcaaattgcgccatggacagaaacttcaaggatctaatatagtccacagacagaacattctctatcttttcactgaaacataaaagagaaaggtgtattagcaacagcaaaacacagacaaaagtcatctgacttaggaaataatgaatgttcaggtacaaaagcagtttttttttgttctccgttctatagaaaagcacaaaaatgaagagaaactaacctggcaaggtaagcaaaaaccataaatatttttctgaaccctaactcttccagcgctagcatctgaggactcgctgcctccctcaatgcattgtctgttgtatggcaagtcgttgtagggttttgcggcatcgccgtaatggggctcggcggacttactgaggggccagccatattctcaatgagtcttgaaatatcctgaacagagctcggggtggaaactcttcttggagtagaaatcatcggctggatggggctgtcaatctctatatagttctgcaggccagatggcatgcaacggcatggactaccaacttgcatcataacatcattaggcaccgcaggagccattgctcgggcaggactgtcaatctacagagccatttggttcaacccaggagaaaccattgcctgggtaggagtcccaacttcaatgcagccttgattctgcgacacagaagatgtatggccacatggactctcaactgtcagctgagcaagctgtggaaccaaacgagcaatttgtctgacagaaccaccattgccatgtaaatggaacggcatctgttggttgggactcccaacctctaccatcccatggtttgagagactagtagccatttcattgctggggctttgatcgtacatctgaacctcgttgtcgaacagttgcgtgtatactgattcctctgtataacagaagcctcgttagtctaacaagcattacagataaatcagatgattaaataactactcctctgtttcatattataagtagttacgatttttttcagtcaaactacttaagtttgacgaaatttatagatggcaacatctacaacatcaaattagtttcattgaacatattttaataatacgtttgttttgtattgaaaatattacttatttttttaataaacttggtcagaagtttgaaaaaagtcacaacttataatatgaaacgaaacggagtgaatactacacttcacaatttggaaaaaaaatgtaacagctacagatctacaacaatctgagcaaagacattagaaagaaacaacatccaagcgaaatgcatatgtaactgcaaaactaaaggggaaacaccatcataataacctgaaccaacgaaggcaaaaccagcaaaatcccaaaaccacgacctcaaccttaaggatggtaaatcaagaacgtgaacgactcatcgacaagcatgaaaaccgaaaaactcggaaggattctcctccaaaatgagaccagaaactgaaagcgcaaacagaaaaatggactgaaaatacaaaagcaaaagagaaatccccttacatagtgtatgaccttgtgattacgagcaagcgcgtgactaccagacgaaacattccccaaatattgtgttactgtatgcgctttgcaatgaaaaaaaaaagaaagaacaagaaaaaaaaacacacacacacacaaccagaggaagcagaacgaagagctatccttccactgcatccagtgccactaaacagcaaaaaaaaaaaacgtgtttttccctcacaaattggtgcaagcaaccctagttaacgagaatggcatcgcaacccaactccagaaaagaaagaaagaaagaaaccgaaaatgtcacgcggcgaactaaaagaaagccctgaccttcccgggaagggccggagatgaacgcgggggcgctgagggcggtggggacgccccgcgcgtcgcgcctcgtgatcgcggcctcccgcttcgccaggtacttgatgaagccggggagcgtccgcacccgccgcgactccgcgaccgcgcgcagcacccgcgccgccccggcctcgccgagcaccgcgaggtggcgccgcgcctccgcgccggcgagctgccgcagcctcccctccagccgctccagctccgcggccaccgccgccgggagctcggccggctcccgcgcctccgcggagccgatggggttgtacatgacgagggttcgggggcttctagcccggcccccccgcgcctctcggcggcggcggcgaggagagccgaggaggaggaggaggcgatcacgttggcgttcgcgttggggcgcgcgatggagggaggaggttgggaaatttgggaggaagacgcgcggaggtgttgaaatggcggtgggtgttccacatggcagtgggaggtggattgtcgattgtgggccatgccgggtgtggggcggggcccaatgaggagtaattcgggtagcttgctcggcaccctacccttcctctgtgcttgactgcggctgtggttgacacggtgcttgtgtgttgtgctgcggtagaatcggtacggggggattgaggattcggattccatttccactgtgtcatacatcgactcatcgaatttaatgttgtgtttagttccgtgtaaagtttggattttggttataattcgagttaatgtagctgaaaagttgtgtgtatgatatgttgatgtgatgaaaaatgcctgaagtttggatctaaactttggatctaaacatagcctaaggtggtgtttggatccgaactttggatctaaacaaagcctaaggtggggtttggatccaggaacttaactttagtctctatatttagacactaatttagaatattaaatatagactacttataaaactaattatataaatgaaagctaatttgtgagataaattttttaagcctaattaatccataattagagaatgtttactatagcatcacataggctaatgctcaatagattggtctcgtaaattagtccaagattatggataggttttattaatagtctacgtttaatatttataattagtgtccaaacatccgatgtgatagggacttaaaagttttagtcccatctagacagggtctaaggctatgtttagatccaacctttggattcaaacttccaactttttccatcacatcaacctatcatacacatacaacttttcagtcacatcgtaccaatttcaatccaaacttctaactttgaaaggaactaaacacagcctaaagataaagaaggcatagcatgactggggctgtgttagttccctttaaacttgcaattttttcctcatttggagatatatataatagagtattaaatatgtaaaaaaaccaattatacagtttgcatgtaaattgcgagataaattttttagtctaattacgacatgattttacaacgtggtgctgcagtaaagattaaccaaggaggagtagcttgctcggcaccctatccttcctctgtgctcgtgtgttgtgctgccgtagaatcggtacgggggattcggattccatttccactgtgtcatgcatcgactcatcgatggcataggattaagtagctcccaccgtcccaaaatactctatctatcccactctaaatgcaaaatactctatctatcctactctaaatgcaactatgagttttttatccgattttgatcatttgtattattttaaaaaatttataatcagaccctgtttatgatcggtttagatgggctaaaactttttaatccctgtcacatcggatgtttagacgttaatttggagtattaaacatagactaataaaaaactaatttcataaatgatagctaatttgcgagacgaattttttaaacctaattaatccataattatcaaaagtttattgtagcatcacattgtcaaatcatggcgtaattaggctcaaaagattcgtctcgcgaattagtccaaggttatggaatgggttttgtaattagtctatgttttatactctaaattagtatccaaacatccgatgtaaataagtccctgtttcacaatcccccttagattctaatttttttttgaaacttctaacttttccgtcacgtcgaactttcctacaggttagttcccaactttttcttcaaacttccaacttttccatcacatcaattagtacacacaaacttccaacgtttccgtcagatcgttccaatttcaatcaaacttctaattttagcgtgaactaaacacacaaacttttaacttttccatcacatcgttccaatttcttcaaacttccaatttcggcttgaaactaaacacaacctcggttcggtattttttgctgttatgagatgataaaatatgaacggtactttactcgtgaaaaaacgaatctacgactggacgcgatatattctagtataatgaatctagacagagatatgtccagattcgtagtgctataatatgttatatccaatactaggttgagtttttatgggacggatggagtatgtttttaaattttttttcaattttttttaaacaagacagatatccgtgttcaacatttaaccgtatgtcttatttaaaaatttattaaaaataaaaaaaatagtcacgtatataatattattcatgctttatcatctaacaataataaaaatactaaccgtagaaaaaatttcaaataagacgaacggtcaaacgttgaatatggacagtataaaactgcattttgttgaccgagtaaaaaggagtacgcaaggattctttaaaaataaagcagcatatccccgagtatagtttcaaaatatactacccatcctaaaatactactaatatctttaggattcaaattttgttttgaaatcttttcaaaaagaaattgtttcagtatattatcactttgaagtgctagttgccccatcatgcatttcgtttcaaaagttttctcattttaccctcaataaccatttaacttccggtcatgtattattcaataaaaggtattataatatttttttattaaaatcaaatcctgatgtctaaatttatttttagaattcaaatttttatagaacggaggaaatatatattcctgtgagatggcggatagtagcggaaaagggttaaggcatcagaatgtagtctaaaactagttcataagtaataaaatattccattcagccacctaaccacattatggaactagtccatagcaagaaaatagcaaaagccacacataagtatatgggctgcccatatagaataaaatatgttattttctctctctactcctaatactagttgctatctatatacattgtgaagataacaataattatagtccatatatgtgggtcctatctacatggactacttttgctatggcaaaagtagtccatagagatgggacccacgtatatgaactttaattattataacctacacaagtatatggatagcaaatagtattggtaggagaaaagagatagagacaaatgatatattttattctctatggacagcccatatacttatgagtagtttttgttatttctttcctatagttccacaatgttgctaggtggctgaattaaatattatattgcttatggaccacttttggagtacattgtggatacctcttagggcaagtactatgatagatgtggttgctacctccaaatttatttatggcattcaccaataaattaagatgcaagatatacaataagtcacctataatacacaaatatcaatgcctttagtactctcacattcttcttagagtttgtgtggaggctacctcttgatttaggggtggttcatcatctctcctcacttctctccttcatcttatcacctaatcctatgtgttatttttagagacagcacatgaagcactatagcacttgcccttagggcctagtactagcagagaggagggcgggggcatgccatgtcatgtcatcctggcgtggcgtggcgtggcgtggtgtggtgaacttgccagaaagcagaaagcagagagtgcactgattccttcacaaatctggcgactccaccagtctagagaggagtagactagtagtaggagtagtaggcatgctgctgccctgccatggaacagacatgagcagcgccgcgccgcgccacaccaccccacacccactgataccgaaagatatcgtgatcagatccagtgcagttgattcagggctgtttggataaattttagtccaatagaatgtttagcactaattaaaaatattaaatataaactaatgataaaacctagtactccataatcctgggctacatgtgctaattatatattatttaggattaaaaaatttatctcgtgaattagctctcatttatataattagttttattattagtctacatttaataattcgaattaatgttcaaaaatttcagtacctagatccaaacaccacctcagcaccacatgatgagaaatcaatgactcatatcaatgcatatcactgtagtaaaaatattacttttatacatcatatagtaacgaatgtgaatcgttagatcaaaatatggatggctcagattgcttgcagtttttattgtgcagttatactcatcaatccataaggaagtgtttggcaaatgtcaaagggaaatgatttccacccatttttaaatcctaaccattcattcacccttttccatttaatcctaaacttttattcatttctcaatctcaatcccaatgccatcctccattttccattatccaaacgcaccctaaaagtatgatagtagggcagaattaacagtcatacgaaaccgtatatttgggtgccgtaatctgtaatcagctcacatcctcaagcgacaagcttatacccaataaagtccctctcttctttttccaaaaagggaaaaaaaagaaatcagttaatctaaactctcacggtatacatgcattttttttcttttatcttctacaaattaaaagttgtctatacatgagtttttcccttttatctttaacaaattgaataagacttggccaacgggcaaagtgtcccaactgggacgaattcattcgggagaacggcagaagaagtgtgcaatctgctgaacaagtggatcgtggacaacggcacggtagaagccaagccgctacagtgagcgaaattggaacatccattccctccgctgtagcaaagattgaagatacagcacgaatcagcatgcatctacacactacggtatcagctttgatatgctgcagttcatcagatgattcggtgttagaacatgtgccatcacatataaaacacaaccaccaatattaaagtcgtttcactctgaatatgcaagctcttgatatttcatttagacttcacatgtcagtcatgcaagctctgaatgtgcatttgttcagtgatacatgatgcatgcatgcatgctgaaatgattccagagctaacgtagcaatctttagcttgactgcttgtgttcacttcaagcagccatgttaataggcccatcagcttagttataaagtctgtcctgacattttcctactaaaccatcagcttaagaagtccttattagtccgctcctgctcctatattgctgttacaatactacatacgccaaacttcatacaaattaactatccctaaatgcgatgctacttcacttgcggtacttcttggtaaatctgaagttgcggagaagttggagcgagcaaaccacagcgttaccctcattcttgaccgtgtagaaatggcacaatgcacggccggcaactttccaagcgaagccacatctggcgacgttgttggcagaccgtgctttctcatacgcgatctggtagattgcacaggcctcggagaacacgtcgtcgaggtccctcggtgtctcttcaaattcagatgcaccgtagagcaactgaatgttggcaagagcgattgggtcagaactctgaagctgttttccaaccattaggaaaaaaaaagctggtattcaaaagaatacaggacactcacatgcttgtacttttcatagagttcctgaaactttatcttcttttcttcttcatccgcctcttcggcatagagaagtgaactatcagccaagtactcgttatagcggtgttgccagagttgcttgattgctggaggcacgtctctctccgcgaaacatgggagcgatgatataccttattatcaaaaacaaaagagaaaaggaatgtcatgttacagagaacattcataaagtacttgtctcatcaaatatatgaaacctgcttgtgacaccacatcacaattcacatcaaccgtgttctgtgccaaaatcatgagttgttctaaatgttgcgaagcacaccacatcggatggcatggccaaaattttttgcagcgtttgtttttgaaagttaaatagaaaaaaaaagtgatgacatacagcataccatgggttatacacagacaacttattagaatagatgtaattgttctccattaattttacatataaattatacgaatatgatcctatagtctcacaaaactgacctagagtcctaaactctttccatgataacacatactccctccgtttcacaatgtaaaactttctagcattaccaatatactccctctgtcccataat

SEQ ID NO: 65775 - DNA, 2258 bp, Oryza sativa
atcccttatattatgggacggagggagtacatatagatgctaatgaatctaaacacatacacatgtctagattcattagcatctaaatgaatgtggacaatgctagaaagtcttacattgtgaaatggaggaaatatatatttattaatatcaacatcctcattgccaccttaactgctgcaagctcaagctaagttgtagcctactatgtgctacaggtagaatagagagaatgtgtggagtatccctactacagataaacaaattgaaaaaagaagggagctaaataaagacaacttactggttggttgaacattatcagatcgcagcggttttggatcacctgctttatcatagatttttccaagtatggacgacgaatggtacgaaggactgcggtccatgaagtgggggtattgttttaccattagatcacgtggaatattgacctgtcgggattggtgggcaaagcttaaattgttaaagcacaatatgcattcaataccctcacattacaaagcttcaaataactaaagatgcaattgcacatttcattttgtatcttgtaattttacttaatctgactgcttcatatgtcaaatgcattcatgtggccatgcatctgtacatataaaaagtaatatataagaaccaaatatgaaataccaacgagttattcccataactaagcatggtacatccattcttaaatcacgctaatataccgagagttaacacatatggttaaaagttcacacaaccacaatcaagacgcaactaatggaacaaagaatcatcatgttatggtatattaatttaataaaagagtgacttcataactatgtacatcaagaccagtgtagtgtatccacagcagatagcaacattcaggtgcatatgactgattttgctataattttgtagtacttactaccagaatagaatataatagcaactaataaccttcacacgcactacccaatagcatatatggattgaattggataggctgacttgtcagcacattcctcagtatgatttcataagtagttcagttcatatgttgacatgtatataagaatagtccaattgatttcactccaaacttaatcaaggtgttattaactaattattactacaaggtcttggttcaatttgtttccttctttccggtgtttatcaaaataccagatgaaagcataagttaataaggatttcagttccatgtaaaagcatttgcaacaaacattgtgtaagcccaagattgaagttaaccttgttccccatctttggagcatccaaagccaaataataaaggtcaactaacttgagcatctttttctcaattagtttcttttcactttcgtcaagtgaaacagttaatagccgatccatatatactaaccagttagtagctgccgtagcacgcgcataactgaaaggagaaaaaagaaatccaaactcatgttagatcgtacaaaacttataaggttgtatatattaaaaagctacagaaaattgtcaccaacattagatatttaaaaatgtactaatcggattcatacaaaaagatacccaagcacttgtagttataaaaatattgaattcggtcaagggatcatcattggcgcatgggaggacatccattgaagtattgaacacctcaataagttgtatatactagaagttaaatgaggtaaatttctttacagtagagaaatggtttcctaatgaaaaatatacattagaaaaactgagcttggtattaatacctaggtgcaaatcttgttttcaagaactcatgaaatagcactctttcaagctcggattcattaaaatcctcgggtcccttttgcttggtcccatttggtgtaatagctggaacccatggtttcgaaggtttaaaatgttctaacagctgaaaagaccatttttattatcagagcagcaataatctttgaaaagctcaaaagagagaatgtgctgttatatatcaaaaccatatacatgcaagaataataagcaaacatatagtgaaacaatgcaaagacacaatgaaacagcgatgcacaattttgcaacaaaaagcaaacatggcataactaaaaaaacagctaccctaggaccctatctaccttaagatggctatggatccacccaaatgggcgttcaaagctattataagaaaagcagaggatttctttggaaaggacaggataaagcaactgtcttttgtcttgggaacatgtttgccggcc

SEQ ID NO: 65776 - DNA, 3694 bp, Oryza sativa
tcttgtctcatgtgtcttccccaggaaaagtatggaccttgatcttaaattgggattggtggatgcggcccctcagcctttcagtatcccatttttcaggatggtggtggaaggttgtcaaggagattcctaaggagcagcgtaaggggttgaactcgttgattatcgtagtagattgggagatttggaaagaccagaatgattacatgttcaatggatcaagtcctctgtaggttgtgagtccaccaccacaaccgaggctagtttgtggtgtctagctggagagcatgcgctccaagagttcctctgtaggttgcttgcctcgggcagctaggttgtccttgaaggtgtggtcgtgcgtcaccttccgtggtgtgttttttgtgggagggttttcgtaaaccctcgtttgtaacttgtaagtgtgttatacttcttcttaatgaaatggattttttttctctcctgcgtttacgagaaaatattttcccaagtggactttactggtcttaaacaccaccctgaacttcaaaaccaatcacctttcaagttcaccccaaatgcagacctgttttggcaacatgacgatgtcacccaaggccgaaccaattttaaactgacttagtaaactatttcaaaacgttctggaaacctctaaccagtacagtggacctagataaagtatactggcccttcaaaaataatgttaaaaaataaatacctacaaatttatataaatgttcgactaatttatccaagttttcaatactcccaacaaccaatcaaaaagaaaatttaagtcatttagttatcataaaaaattcaaaaaccatttatacctggtgtatattttttaacattcagaatcagaaaacacctgaatcagttctggaaaattctcaataatattatggtgtatatatagcctagaaaatttagtacgagaaaaataaagtataagcatctggaaaaaggtgtgttcaaaactaaataagccaattttcatttcactgactaaaatatactctgtttcacttgagactaactatactccaaggtgcgactaaagaatttgtccatattttttatgtcaactcactaattccaaaaattcaaaaataatttcaaccttggcccttactgccaccttaatgaatgtcatgtaaaaacaatccgattcaggctaaggtataaagtgaatgattttgatcgtccagattttgaatagtgtctacttttgaggtttgaggttaatgttgtaaaacaagccttttcctcattaaaacctaagcatactaataactgaattcttctaaaagcaaaggagctatgacatttaatatcatttggtttgggtgcagtgaccaaattagctcctcaggtttggcgaaagagccatttttcctggagttataacatcggacacttctcttataaagaacagatcatttccaagagcattactggataaatacaatcgacatagaccatgggtaaagtagcataactgctgtatgaatggaacaactacgctgtggactaggggcaactgagcaaaactctgtagggattttgctgaccataaaagataatcaagcacaaaaacaatattaggtgcatctcccaagacgatgatttccaataaacttcacggtaaaatgtcaatcaggaattaacatacctttgggtttaatgagacccagtagatgtcaccatcaaaatcactattggccatctcatcagccaaagaccgttgtccagtagtagggaagagtatcgcatgtttagaatttcccacaaccttctctatgtcgctactatatgttgccttcaagacatgtatatcaccaggatgtaagccaggatatttatacacaagaacatctccagaaacttggccataatcactgtttaaccacatataaagcaaataagtaaagaaagacccaaaacataacaggcacgctacaaattaatacttgtatattgatgcacatttatgcaaggaatatatatagcaaagaacaaagttattatctttggcaaattcaaaccccttttcgtaatccaatatactctccccattttttaatagctgacatcattgacttttggcatgacatttgaccattcttctttttcaaaaaaattatacaagtgtcatttattttgttgcaagttgttttatcattaaaaaaactttaagcatgaattatattttcgttatttacactaaattttttaataagatgaatggtcaaacgttctatcaataatcaatgtcgtcatctattgaaaaacagtagtatctgttggtagaattttttttcctaactattaaaaacaattaaacagatcaaattactgagctaaaaaaggccatatacagatatactcaagaaattcaaaattaggttgaatgaactaaagaatggcattaaagtctcgagggtccaaatacatgacatgtatttatgatcttatgttgtcagttcaatactttctttagactccatttgctgacaaaattcacaattgcaaccaatattgttgccactattttcggatagtttgaataaaaaatacagtccggttgcgaaaagagaatacatgccaaccaatctaacctttgagttgtgattcaaaattgaggattgtaaatagtaagaaaaatggtaatgttggtgcgttacaactaaagaagactgtaagacattaaagtagttccaatgatgcccatggtggataatgatactcctatcttatgtggtaacaaaggatcactgaagcataacaaaaaaacacacactcaaacaccaagaagaagcaaaagagtatttccattactaacagtatcacgcagacttcattaggtccaagttttcctgtagggtctgcagtacccatcaaataatagcagtcatcaattggtatctttccattcttgattccttttctttccagtagagacaagaaatccagcctagattgcaagtacgactcttctagtgggattccggaaagaatcatccgtgctggcattgaatcttccatgtcagcatagttgaatgcaactgcaagaacatgagaatattagtccggatcaaacacggacaggtgactgaaaaatataaagaaaatagtaactctattacaactagtaagatgagtacaggttctacagaatgaagaagcacatatatacaaattgtacagaacacagtgcaatgcaatgagggtagttcgaactaactgttcagtgcgccagcataatcaaaacgagcattgtcagcctcttcaatcgcagtctgcagaagctccataaagaattcttctggaactcctccatagtgaagtaatgcaattaaattatttgatgtgaatgtccttcctgatcgattgctgagaaaaagaaatgatattacttactgtgaacaaaaaatagaactgactgcctgttgccaatcaaaaagctttactaccccttacacacctacctaatgagctcagctttactctccctcctgcctctacctaaccggccccaaccatgaggattagacatgtgacagcacttaaaccacagtaaggaacctccaagtctggccaccagcccacccaaaatcccaaataccacaatgatttaaatgcagagttcgttcctttggacatctgagtttcatgtaccaacaac

SEQ ID NO: 65777 - DNA, 5521 bp, Oryza sativa
aaagaggaaaaagggaggaaaaagaaaaagaaaaaggaaaaaggattttccctggaattaaaatattgcttgctcaattttaattggttaaaattatttctagagctctgaaaatttcactaaaaatcctgttaatgaatttcgacatgtagaactcaagaaaaattccacatgtcaaatccgattattatttgcattactttcttagggttttttcttgatttgcacctgtattttcttgggggtcgtttataaattaaatttttggcttgggaggagaacttcggggtgtgacagtcagacacgaagtctgttgcagtccccatcaagtaccgatcctcactgatccatgcatgccaacacatgatctcagaggatcttgagaatgtagattggggtgttgatatcatgtgatatatttcacacacaatgccaacgacagtatagctggcgagtcatgtggaagtcgtctctgaacctgatccgaaacatggtacagattctgctgtagatgatcgttcaaaggaaggtgatccatatgtatcagtcatcgtgaccccatcgcatctccccaaagatacgatcgattcggagctttgtaagatggagaagccaccgtatacctatccatgtaactaacgtgagacttcattttcgtagacaaattcatgctacctccgttttttcatatatgatattgttgattttctaacaaccgttagaccatttgttttattcaaagtttttgtgcaaatataaaaaatttcaagttatgcttaaagaacatttaacgataaatcaagtcacaataaaacaaataataattacataaaatttttgaataagataaatgatcaaattaaaaaaatcaacgacgccatatattaaaaaacagaggaagtacgcactatcatgccaatagatatcttttatggatgagcttttatgtagcaggttaaggatctaggctcagttaggctctattcgggagcgagggttgggaaccctgtaaccctaactccccggcacacaaaacgaagcagtgttttagtgcgtgattaattaagttttagctatttttttaaaaaatggattaatatgatttttttaagcaactttcgtatagaaactttttgcaaaaaacgcaccgtttagcagtttaaaaagcgtgcgcgcggaaaacgaagatgaggagttgagaacttgtactaacaaacggagccttagtcgagggatgcataaatctagaccacccaagttttaagttctaattgagataaatttgggtgcatgccctttaattttagggtaagtcgagacatgtgatcgaagcaacaaaaaataatttgagtttttttagtcatgcccaatactccctcaattctaaatcaactttctaacgaatttagaaatatgttatatgcaaattcctatatgaaagttaatttattataggacggatggagtaacttataaccgagatatgagatcgaggcaacggaaaatagttttagaagtcaaatatgacaaagaaaaacttaaaatttaagcttgaggaaaatttgggtactgcatatagatcatatggctgcacatgtctttcccagctctccttgattcgttgttgtccaaacactgtactggtcgcgggcgtatctccatgtgaatctcgcgaggcagatgcatgtcgagcagtcgaggtaaaatagctagctaggtgacgtccctgtccatcaggagcacgtcacggctgtcgttagctaaatctagctggattgtattgctagctcactctttgtcactcagcttgcccgtctttgtctaacctggctaaggccctgtctagattccaacttttttcctcaaacttctaacattttcgtcacatcgaacttttctgcacatacaaacttttaacttttccgtcacatcgtttcaaattctttagacttttaattttggtgtggaactaaacgcagcctaaagttgactcgctagtacttgtaccacatgtgtcgcgcgcgtgcaaactcatcagtgcaattgcaagtgcaaatggcatgtgatttcgtcgtcgtctcgcaccggattggagagggaaagatcttgccaagatcgctgggagatctgtagggcgctctctctctctctctctctgtgtcagggagatcagagatcttgtgacggctcagggtgtcgttaattatatgctataggccacggcgacttgaccgcggccaaggctgactaattagcatgctgtaaatcgtcttgaaaacgaaaggtagttaattagcacgttaatcgtcttgagaagggaagatcgagtcgggcctgcgtgtgctcgtgtgattctttgacggtgttggccggaagaaatcgtcttcacaacgaggatttttttttactttgtagtccttttttgaaaacttaatttataaatatatacctaaaaaaaacttaatcttgaaatggaccttttttttatgacgctaatatcattggcgccgtggttcaacatgacattgcgccgtccctctttaccccttcttagaagctaagacaccgatacaaaggggtggatcagcaccaatgtcattgacaccaaagatttatttgtaataaaattattataaatagatcttggtacaagtgaaaaatcctggcttcatctacctactgattctgaaagagaaaaaaactctttaaatctatacgtccagtcaggattttaacaactctatttcccacagagatacctcgtccatacagattcatgctgtcattttgcacaccaacagtgatgcatacttgtgcccattgtcacactggacactgcgcttacagataatcactagttcactacagcaggttcacttgaagcagccatgccggtataaacatggcccataataatttttctagtagtactttgtcccacatgttcatgagaagtgctaaatcaccagcttaaaaagtctgctcctaacattactgctacagtacacacatacttgatacaatagatagttaatttggtggtagtagtccataaacacgacactctacctgcgatgatccttcttgatgatcttgcgaagaagtggaagcgagcagagcgcggtgtcaccctcgttcttgagcgcgtagaagtggcacagcgcgcggccggcgaccttccaggcgaagccacacctgctggcgtcgttgctccaccgtgctttctcatacacaatctggtagatcacgcaggcttccgagaacacgtcgtcggggtccctctgtgtctgctcgaattcagatgcatcgtagagcatctgcagcaggttcaagggttcgttaggttaaaacgaaaacggcgagccgccaatttcattgaatagagaagaataaaaccgtacagaaaacaaacatgtacaaacatagggccacagcccgactaagggctaattaccgcgccacccaggcggcgagatagggttcgttaggttaaaaagctagctgtaattaattcgaccattgaaaacgctgttactcaggaaatttggatggatactcacatgcttgtacttctcgtagagttcttggaacttcatgttcctttcttctttatctaccattgcgcgatagagcattgtactgtcagtcaagtactcctcgtagcggtgttgccagaggtgcctggctgctggaggtgcttctctttccatgaaacatgggagcaatgataccccttattattgtaaaaaggaaaagagggaaaaaagtaaggcatactgttagagagaacattcatattatagtactattctcatcaaacatatgaaaccaatttaattgaaaccgtgttctatgccaaaatcatgtctagtgcttctgcagaatggtaactaacctctgcttctctcattgaacaattttgacatctctccctcccattcattttgttttgaaactaggtggaccatatgagtaaaaaattaacggttgagtgcataagtagatagtcttctccataattaaaaacagcagatgattttttttgtaactttttaatacaattttagaaataaatctttccacaacttatttctaggtctgaataagtgtaaactattataatttaagattatccttatgtgcgtaggtaactaattagaatagatgtaattgttcatcatcacttctataaataaattaatatatataaacatgaaactataatggtttattaattactatttccaattaattgactgccttacaattaatcattttttcatgcaatgaatgcaaaccgtttttttttaaaaaatggcatagaccctttccatgataccacatatgtatatactgagaacaacatcacattttctcaatatgcttgccatttggcaataccttaactactgcaagctcagctcataagttatagcctatgtgctacaagcagaacaaataatgtatgtcatctccctactgcagataaaactataaaagaactgaaaaaaggaacctaaataaaacagacaacataccgattggttgaacattacaagatcgcagagattctacatcttctgctttatcatagatttgtccaagtatggatgatgaatggtacgaaaaactgcggcccatgaagtgggggtattgttttaccatcagatcacttggaatattgacctgttgggacagcacataaactgttgaagtgcaatatgcattcccatgtaatgaactttggtcttacaaagcatcaaatataaaataataaagatacacctgcacatttcatctattatctttatcttgtagccctacttgatctcactgcttcatacgttaaacgtattcctgtcaccatgcaactattccaaccaccatggtgccctggacaccgggtagctggtccatttctaacttatattgaactatgttaattacaacattatccaataatcagcttattactatgtactggacacccactgcagctatccgtataaaatattggcagtttatgaatcattgtaatgaatcacgagttgttcagataactacacttggttcatccgttcatgaatcattgtaataaggattcagtactgtgtaaaagcatttgaaactgaagaatgtgtaagcccaagattggaactaaccttgttcccagtcttcggagcatccaaagccaaataatacaggtcaactaactttagcatcttttcctctattagtttcttttcaatttcgtcaagtgaatctgtcaatagtcggtccatatatgctaaccagctatcagctgccgtaccaagtgcaaaactgaaaggagaaaagaactccaaatcatgttagattgtataaaaccaataaaggttgcatatattgaaatactacaggaggtcaccaaaactagatttttaaaaatgtactgatcaggttcatataaaaagaaattcaagcacttctagaatattgaattcaatcaagtgctgaactcctcaataaattgcctactaaa

SEQ ID NO: 65778 - DNA, 2827 bp, Oryza sativa
  unsure (1)..(2827): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcatggccatctcggttgctaagacaaaaccttgtgcaaggaatcaaataagagagaaacacccaatagtcatcagattcaaaatcgaggccaggagatgctgggtggaggtggatgggttggatttccttaagacagtagggtctggatttcctagagaatgctattggctctggtgctggcagcatggacgtacgtcgggtgatggcgacggtggcagggcgacggtagggcgatggcggtgcgcaatcttgaactcggcgcgaaggacaaggtgtacaatgggacgagattaaaggtgcaatcagacaggcccctgaactcacttataatacaaataagcgggtaaaccggctgggtccgcaggtctgcccgcttacacccttagatacacttgtccttaccccctactagatctagttaccaacacaaatatccggtactaccatcatactcttttcaaattagtggtgggatatgtcactggtacctcctgtagtcctgttacctggtagtaatagcagttggtggtcctaaataaaatccctgttagaaaatagtataagatcctctaatatcccttcgtttagtcatacgtggttacattttataggatctcgaagtgatgagtgttgatgaaaaacacgaggcctgggaaatctgcttaactccagtgcatgtcaaagctcgccttcgggtatgctagcgtgccagtggatttgatcctgcaatcaacaagaaataaaggcaaagaaaccgcggttaaatctataaatgatagccgattggctaggtgccgatgacatatcatttatctttgagccggtgtcatatatgtatcgatcggcagccatgagtaaataagaaggaactaaatctatttgatcggctgtagatattaacaatatatactccttatatcgatatatacttaaatcaagtgattgggatagatcagtcgccatgccgagacaatataaatcacttagatcgaaatatatattaataatgggactatatatgttcatagcatagtcgatcagatagatctagcatgtatgggctaatactccgatactactctatattaagatattaaagcaagcagaatatatcaaacaaaagcttaatacacttaaatgccacaaaatcttaatataaagggcagatttaacatgtcagtaaagcatatataacaagtatagttaaatcagctaagatcggctaaaaccccgatactaccctaatcggcaaccaagaagcaagctagaggttgagattctaatcacgactcataagatcaaacaactgatgcagctataagtatgaaaagaaggacaatatctagacaatcaagccattggaattttcatagagtggtagatatcatgtacaatctaaaccaacatcgatatttaacctaatcggctgacctctactagtagatgttagctgattgtaggttagatgatgatattgctatatattatataagatatatgataactcgacggattacataaacaagattagagtatcatagagatggaagcactaatcccgagaacgcaagccgccataacaagttttacctcttgttgaagatcgaaaccgatgcagctcaacccgaaagcaataacttgtcgaaataaaacgaaagcaaaaaagggtggcgatgcaccaagattgtattaaacgtgtgtgttaattgattacatagggttcggggtctatttatacccgagaattacaaactatgtccatatcggacatgactcttatctctaacaaactctaagataccataagtctttgcggcagacttttgcccaaacatatctctaaggaaattacataaaatatactaattaatagatacagttgccttctcaggactctatccacgcgtggcaatcatcttgaagcatatcgacccaacccaatatcgtacaccaagtcgtattgtcggaatcggctgcatcaccaaaccaagtctgactcgaacttagccgatccaatcgtagctgatccggactccagccgatttttactctgtttccgcgataatccttatctctgattccgcttcgatctaatcttcctttccgatgccgatattaccaaatttggtcgttaacaatgagatatattaatagtcttcatttatttgaacgtgtatttaaagagacacattcacaattatgtgtatacctcttattatctctgtaactgaaaaagaaagacattgttttgtacattgggtttgaagtttgtatattaaattatactaacggattaaaattttatattttatattaaattgcttgattatattaataattacaatttcatatcaattattacaatgctttagatagatatcacaagtgacatgatttaccaattttcttccataagttctttctcgagtacatctaaattattaattccctgcaacacgcgggtatatatatatatatatatatatatatatatatatatatatatatatatagacacacacacacacacacacacacacacacatatatatatacatacatacatacatatacatataca

SEQ ID NO: 65779 - DNA, 4258 bp, Oryza sativa
tgagccactctctaagctttagtggtagaaatctgttaagagttcacattgatagtatattgaagcaaggagtgtaatataaattgtgtaaggtaagcaacccttgtgtgtacaatccctcggggttccctaaagggaaaaccatatgtattctattttgtggtaatgtagtagttttattaagctttccttgctcgaccttgttatgtttatgttagtttaaattctacgctaatgaccctataggagagatgcccttcagtaagttctcatagttcaccttgcatgcagcaggtaaagagaaccttttatctgttgaagaagtgttcccttcgggtggaactgcctggggagacggtagaatttttatctcacatgaatagacccaaggacgggattagggtaaaagcttaagctactccttcagcaaaatagttagacatatggtgagtaccgagtaggattacacatctatcgttgcacgctcggctgtcccagtggtttcgccaacccattaagatcttgaaaatttaaaaaatatatacataaatatccatggagaaatatacattaaggtaaatgcagtccactatatggattcttctgccatctttacttgccaaaatcctacttttaagtcagatttcgagaaatatcccttggatattcaactgtaagtaccgagtggactgcatagatgcaggataatactagtatgatcatccaaactagcatgaatgcagaagacaacaagtcacaatatgctgaaggtaaaaatccaacttctcgggaataaacagagcgcccgtgatcagaagaagacatttaactctctgaagaacccgtgatgccacaatataaatgtaattattttcactaagctataccgaagatcatagttggcactctaataatagtcaattaaatttaattgttgatttgatatataacttctatataaattggggaaaaagaaaagacgatttggagcaaaaggttgaagagttatataaagaacgaaaacaaatagtagagcaatattctgtttttagtactaagctaaatactgctttaaaattactacaagaatataaggcaaagcaaaataaaatttcacaaaacagtgattacatcaaggaaccaaaccatggctctgataccagcttatttctccacggataattttgctgccatgttcaaagaaaaatgcaaaatatatttaatggaacaaaatgggttaatgcataacgtataaaaaattcaattatatgtaaaatcaacataataaatcctaaccacatcattaaaacacgtccaatagaggcgaccccaaaggatatagaagaattattaaaggtagaggcaataagagaaagcaggagccctcatagatcagctgcatttatagtaagaaatcatgacgaagaagtgagaggtaaatataggatggtcatcaattacaagaggttaagtgataatacatttgaagatgcttataacattcctaataagcaagaatggatcaatagaatagtagacatttctcgaaatttgacttaaaagcatgattttggcaagtaaagatggcagaagaatccatagagtgaactgcatttacctgtcctcagggacattatgaatggcttgtgaagccactaggcctaaaaaatgcacctgccatattccaaagaaaaatgcaaaatatatttaatgacaaccaagaatttatattagtctacatagatgacttattagtcttttcaaaaacttacaaatagcatattgctcatctagaaatatttttttagaaaggtggaacaaaatgggttaatcttatccaaaaagaaaatggaaatatgccaggagaaaatcagtttccttggtcatgaaataggagaaggcaaaatacacctacaagaacatattgctaagaaatttttacaatttcctgatgctatgaatgataaaaaggaattacaacaattcttaggaattgtaaattatgctagaaaccacattcaaaatttagcaaagttagcaggaccattatatgctatattaagaaaaaatggtcagagatattttaattctaaagacattaaattagtaaggttaataaaagaaaaggtgaaagaactaaaacctctagaattacctttagaagaaaactattttattattgaaacagatgcatcgcagcagggttggttcctgtattaaaacaaagacctgctaaatactcatctaaatcagaggaaaagatatataggtatgcctctggaagacaatacagatcgagaaatcctagaaataatcaacgcgataaatgcttttaggttatatctagggtttaaagagtttacggttagaacggactgtgaggtgatacgtagatattataatcagcttaatagcaagaagaattctactaggaggtggatcttatttgaacaaatcattactggaaatgactataaagttgtatttgagcatattaaggggaaagataacaatttgcctgatctactttctcgtttacctattttgcaggtatgaagaaatctatgaattataatggagttgaattcttcacttttggggaagataataaactcagaatattcccaccaaactcttataaatttaaaccaaaggaccatataatcatatatgaagtgcaagaatgtattctggacaatttttggtatcaatataataatatgaagggctatatcctatcaatattaaatagtcttgctgaatattttcatttgataaatgaattaatgccagttgcaaaaaatattgaagccatacagcaaaagcccatttatgtggtttttgaaggaagagtaccaggcgtctatatatcctttgaagagataatatctcaaaaaatagacgcaaagctaacagtaggaatatcatggaagaaatataaagacattgaaaaccattaggacaagctaggaaaatattgggaataaattattatctagagccagcggcaaaggaatatattcaaaagtgcaagaggctagaaacaagaaaaatccagagcccccacattatacaaatataaaggaagaagggtcatccagaaaattgacatataaagaatgcttaacaaagggattagaccccttagatagtgaatatattgatttaaagataaatgaaaaaattgcagaagtctcgactcagtgaaagaaagatttaaaggaagaaattttcaaagaattaaagcaagaattaaatgaaaattttgaagctctgaagaaagcatatgatgagaaatttgaaatagccttttctgatgatgacactatggatatcggtggtcatgggcaaccagacgaatagttattatatataaagacctcattgataaggtattatcaattatacgggcatggtagaccatatatctatatctgttgaaaataaaaataagattacaaaggtctgtcgttatatcattttcttcaagagaagacgttcaaaattttgtggagaatattccaaagttcaataattaccaaagagcatcaaatatggtaaatattctctcatataatctaaactagcatgaatgcagaagacaacaagtcacaatatgctaaaggtaaaaatccaacttctcgggaataaacagagcactcgtgatcagaagaagacatataactctctgaagaacccatgatgccacagtatgataaaaaaatatatgagtgaagattgagctccctctccggcttctataaaaggggaagttggtgaaacagaaggataccaagaggcagcaaccctcagccagagtctcagaagccactctctaagctttagtagtagaaatttattaagagttcgccttgctagtatattgaagcaaggagtgcaatataaattgtgtaaggtaagcaaaccttgtttgtatcatcatccctcggggttcccgaaaaggaaaaccatatgtattctattttgtggtaatatagtagttttattaagctttccttgctcgacctgttctgcttatgtgagtttaaattctacgctaaggaccctataggagagatgctcttcagtaagttctcgtagtccaccttgcatgcagcaggtaaagagaacctttatctgttgaagaagtgttcccttcgggtgaaactgccttgggagacggtagaatttttatctcatatgaatagacccaagaacgggattagggtaaaagcttaagctactccttcaaccaaat

SEQ ID NO: 65780 - DNA, 6927 bp, Oryza sativa
gtagtctaataacaaaaaaaatttacagaatccgcctgtaaactacaagacgaatttattaagcctaattaatccataattagcaaatgtttactgtagcaccacattatcaaatcatggagcaattaggcttaaaagattcatctcacaaattagtcgtaatctgtgcaattaattattttttagcttatatataatacttcatgcaggtgttaaacgttcgatgtgacagtgtgaaaaatttttaggtgagatttaagcagggccttacataaatttttaaataagataaacggtcatacgttacaagcaaaattaaggtcaaaacgatatctattttgaggcggaaggaatagataggagcacaccatgcgtgtacgcacactgtgtaggagatgagtatcataccttagctactacggagtactactcaacatatcgtacggcaccggtaggaaattatggccggcgcagtgtctagctggctacataatttactacagaattggctatttttctaaatttatagtattagaatatctcgttatatccacataacgtatggggtatatacggaacattgggagtactagtagctaggtaggtcggtaggtgactgatctgatcctgaccgttgaatgtgatcaagtgatctgttgaaccctctctccaatgatcacattgctgcactactattagtcacgtgtttcacatgcatttctttgaaagaaaacagtgcctcatgttttttgttagaaaatctttcatacagttgattagttagttcgctaatttgttgggattagtcatcgtcatgtaacgacttgcacaacaaactcatttctaatttgctctctctttgttttgccgccgcccacgcaatgtatatatctactgcagattccttccatgcatgcatcttaattaacttctccgaattcatggattccaaatgaataatgaataagatgctaagctaggtttaccaattaattggctaattggcaaccaaatggctaatcatcatcaccatcatggcatcatcatcaaattttctaaacgttgcaccggaaaatcaacctagactggaattccttccaatccttcgctatagctagctagctaccacaacgatccaaaagttttgtcaaatatttagaacggggatagctaggcagtgtcgacgaagatgtgatgtgatctctgaatatctgaaccgtcgtctgatccacaaaaagcttcccggctccggacgctagctgctccatcccatcaattctctccattctcgcttgcatccagccaaaccaaattgaccgtggactgatcacatttatactgctacatcatccgccgttaatatatattttgagagaccatatcattgatagatacatgcatgcatcctactaattcgcccagatcaacggccggtctcgagacgtactcgccggtaatttgccggaaattgttatacgttttccaagggaagatgtctttttttatgccatctaaatagttatgaaacattttgattaattttcttttcacgggatagattaatatacgatatgtatcactctgtaaatatgcatgttcagaatttcaacccctacatgttattgtaaaatgataaatatgactgtgaaaatgcgtagactagtagagttttttttttcattttgttacaatgcaacttggtattcatgtttgtaaagtaatatatctcatattaatatatcttataaaaaattatatttttaagttattttggtggcttacaagaaacgatgggatcgatatattccttcgaggggaaaacaaggaacatttcccaatttgccattaatctactctcactcatcacagtcatcatgctagttgatctgcacgctgatccgatccggccggaaatttcgaacttaattagcacgtggattaattagttggcaaaagctaagtacaagtcattgtgtggtcaattgatcgactgatctgttgctccccgcttctgcggctttcattggctataaatacgcagatatgtgctcactgcctagctaccagtcttgcatctctaactatatatacacatacatgtagcatcctgctccatcttaactagctactactagtgatgagcagaatcaacctcatgcagtaatatgctgtgctgatcgaattaatttacacatatatagatagatagatagatagatcgttcgaccaatcgagctagcttgagcaaactgattgacctggtgaagtggtataattaacgagcagatcatggaggattgcagcagctggatccatggctacgccaacgctaacgccaccgccggcaacaacggcttcatgtgcggctacgctgccaggtaggtgttcaaacatcttgatgatcaccgtgacacgatcgatcgattgatcgcgacgacgacgataataccatctgtaaattagtcgtctctgttcttgagtggtttggctgatcagttagttaattagctacttcgtgtttgcagctgcagcccagtagagtttcagcagcagcaacagctggtcggctcgcagattgagcaccacctcaaccaggcaagcttgatttgcaatttattcgatcaagaaacaatgcataaaatcaaagaaattttaggatttaatttggtaggtgtcgcgttttattacggcatgcagatcagcatgcagatggggatggatgacgagtcggcggtgtacgacggcgcctccatggtggacgtcctcctcatggcttcctcgtcgccgcaccaccacgccggcgccggcagcttccagtactcctcgccgacgtcctcctccgcctccttccgctccgcctccgtctcgtgcagccctgagagctcggcggcggcgacgacgcacttcctcggaccgccggcgccgtccgcggcggcggcggggttccattacccggaggtctcctcgcaggcgccgttgccactacccttgccgccctacgagccgcagcacggccaatacaccaccgtcctctcgccgccgccgccggcgccagagttgccggcgactactacgccggcgaccggcggcgcgttcaggcggtacgcgcggcacctccgcccgaggaggctgcccaagccgggagggtgcgggcagaggatgttcaagacggccatgtcggtgctcaccaagatgcacgtggcggcgacgtacaaccgccagtactactaccagcaggcggcagccgccgccgcgtcggcgtcggcggccgaggcgccgccgtccggcaaccagctgcagcacatgatctcggagcggaagcggcgggagaagctcaacgacagcttcctcgccctcaaggccgtcctccctcccggctctaaggtatacatacatacacgtatcaatacgtacatttgtacgtatacacatgcatgatcattcatcaacattttgttcttttgattagtgatcttgactagtaatatttgcttcaatcatttcttcctttttaatggtagaaagacaagacatcgatactgatcagagcaagagagtacgtaaaatctctcgagtcaaagctgtcagagctggaggagaagaaccgggagctagaggcgaggctagccagccgccccgccgccgccgccaagaacgacaaaggcgagacggcggcggcgccagcgccggaagccggcgatgagacgaagcgaaaggacctagtagagatcgaggtgacgacgagcggcggcggcgccggagcggcggatgcggcggcggcggcgggaggagatcaagagacctgcacgctcaacgtagacttgcgcggcggcggaggcggcggaggcatgagcacgacggacgttgtgctccggacgctgcagtgcctgagagagcagatcggcgacggcgccagcctcgtggcgatgagcaccagcgccggctccggcggccgcccgcctcgtgcaaacctaacattacagctcaaggtgtaattaattaataaaaaagcattctactaaagaagttaaaggaaaaatctgtctcacatctcagtgatcagaaaaaaaaaagaagaaaaagggaggtgccatcagtgcaaaatagcatgcatgcatgcaagcacattgttgacagcatgattgtacatttttctctcttaagataatggaaaaccttacacatatttcatactagtagcaattgattcagctggcatatgtggacatgcactgttcttgacagcttgattaattagtcttgacacttcagttaattaattcactctgctctgctgactatcctgcgagccgcggaaaagtctgcatgatgaccgataatgatggagggctaataaacatggcacttctgaagttagtgatttcaggtcaacattaagaatcaagcgtgcaagctgactattataattagttgtcgtacgatgacgtgcatcgtcagccataattagcagacacaaatattatactctgaaaagtaaaggaccgtgatgtcagactggtaaaggaattctacaccactgtaaaaatcctcagcaacgttcgtacgtatacacgatcgcatccatgaatcttcaggagttgaaatttgagaaatacgtaacggcgacagttcctttactcccttgttctatattacgagtccttcggaccttttttcgttattcaaattcgttattttaggttatgtatttaattttaaaacagagaagacatatcattatagtttgggcccatgtgtcagacatgtacttactagattatctaatcctacttgcctccttgtgcccgcaacgcaagcccccacccaagaaaatcagaaaaaagaaattcacaaaatgacctcgtgctttgtttttcagaaaagtcctactaccaacccatttccagtcataggggcaaagagaaaaatttaatcttcatatgatcaaatcaacatgcaacgcacggttatgctacaacagggagttaaaaattgtagtttttgttagtaaaaaatatatagctttctaataaatttgcttgttctggttgcatcctttaaaatgtatagctaaaattacagaaaatgacgattttaacttaaataaccgcatacttttaaaatatactcttaatggtctattcaacttacagattatggactctcacagatagtggtgaaaatgctacagaatattctgatcatacctgctttcttttccctttttccgaccatgttagcattatcttgttttcatccagaatttcgaagaggcaagatgtaacttttgaaaaacaaatcaccaacattttctttagaaatctattaaaattaactttactgctttctaatattaattttattcatttatgtcctcaaatgtttttgtcattaggtcagtttcatccctataaaggaattgggcccaacttatttaagtcatgacattgttcgtgttatgctaggtgatgcagtgttagcgagagaaaattgagattatggcattatcaaaggtgggttttgccacaatgccattcggcagattggtttcgttgaattgccactctcaaaccgtgtgccattgctggaatgcattctctcatgaaaatacccttggacttcttacacaacttgttttcttaccatgttagtttgctcatctgcagaatggtattttaacgaaacccacttttgacaatagcgtagtctcaatttgcccgtagtccgtctaggctcatgtgaattattcatcgaaattatatataattaaaaaataaaaaaaattataaatattgtttatacgtcatgtttgatacaactccacatcttaaatttgcgctggatttaatgtttgtatgttaaagtatagccgtttaaaatttttatcttatttaaaatggaaacaaactgattgatctaaatgttatcaacataataacgaatttagatctatggatttgtggagctacgaatatatatatacagcttaaaaaaaactttgaatctgaagccgtgttaaaaagggccatttagttatgattgtttggtctctcaatttttttctaggtccgccattaacgatgacgggatcaaggtaagaggccgggacagccaaggacggcaccgtggcatgcaatgaaaggtcgtcgccggcgacaccttttgtcagcgccgctgcgcaaccgccgagcgctatatatagcaagctagctagcgagctagtagctccggcgacaccgagctaattaataaccgacacataccgctgctgcaagtttcgacgaggcttcatgcatgcgtgttgtctcactcaccgacgacctacgtacatgccgttcgtgcagttggccgggtgcagtcaaaacgaagtagtaattggtagtatggtagctgcggtcgtaacatgggagcagtatttacttgaattatatgtacacttattggggtacgttgaaatttcagcacgaatggtacgtataaatgatgatgatagggcgcgctgacagatgttttgaaaaccaccgtggtatgtacgttaggccttgtttagtgccaaaaattttttttcccaaaaacatcacatcgaattttggacacatgcattgagcattaaatatagataaaatgaaaaactaattgcaagggggggaaatttagagacgaatcttttgaacctaattagtccatgattagccataagtgctacagtaacccacatatactaatgacagattaattaggctcaaaagattcgtctcgccgtttctaggcgagttatgaaattagttttttcattcgtgcccgaaaaccttttccgacatccggtcaaacgtatgatgtaacacaaaaaaaattttatttcgtgaactaaacaaggccttagtagttagggcctagctaggttcgtacacgactgggctgcaggaa

SEQ ID NO: 65781 - DNA, 3861 bp, Oryza sativa
tgggtcatatctctatctaaattaagtttttttttaatggagtactcagcaatgatagctgagtagttgagtagatgaatcagcaattgatatgaaataattcatgttaatacaaggaattatagctgtcatgcccgtgagcaatcaagaaggatttgctgctctagctagtggccagaatgcgtgtcgtgtttgatttacctacaatactcttgtatacatgtatgatagaatctctctccaaccatatctttttaaaaggacagatgcgttagagacttgtattccacgatttttatattttcagcagacgccttgcctaccatgttaatatttttaatggtgcagtaacagacccgtcttccaattaataatttatcttctttgctatagcaacgtaacgaccgtcaaatgttcactgcagagagggatgacctcatccttcgtgccgtctgtatcaggtgatcaattttattaggaaatcagctaagctgcccccaaaagtaaataagattagcttaaggtgataaattagtatatagtaatcccaaagtagcaagtcagcaagtggttttattattttaaagaaggacggaatctttccgcttcccttactagttaagatttgcaaccaaccggcaatgcgatgcgattagaccagaccactattttaacgtttcatacacatcatccctacaaagatacccgaccatagtgttttgacgacttgaccttgtttacatttgcaatatcttaatcccctcgaactcccaacggtgcaacattagaaaaaaaggtgcgcagaaaggaacttaccaggaactgtctcgatgcatgaattttggcggggaagcagaagctgaactgacgactgttcaaaggtccaaggaaaatgaaggcctaatcctgatccatgtcccccctgcactgcgagtgtcctgccaccataaaccggagcctgcaacagctgaccagaagcaaggacaagaatgcagagcagaacgatcaaactctacatacctggacgttggattcttagctctcgagctatgtgaaatacccttctcatctgtggaaaatacacaactaaaggggtggacaagattgaccagagactcttcttcatcatgcactgccgtcatatgcaatacaatgttgatatcatcatatacggcgtaagacgaacatcttccattgaaagttacagcacattagtagtctcctttcaatcagtaaactgttgtgaaaactggaaagtatgcagttaaaatgaagttatggcccttacctgggatagcaactccattggctcctgatatttccacgaaacgggaattccaccaaacaagtaaatttcataatactgcttacttgagaatagtaagcaagtcataatcctaaagcattggtattctctccttgacctacatgtattatactggtttaacgagacatagagaagtcatattgtgtcagtccaccatatatagatgcaatttcacatagactagtcgatagtattacattgaatagaccatggggaaaaacaatattccaaccagatggcaaaactcttgccctgcctccaatccgtctaaaaggaaaggaagaaatgtgcgcacgttttggaagtcagttgctaaaaaataaggagtctactactctattctgtactggtcaattatgatgcatgagaggaaattagttaaccaatcaggcagtgcggtaacaaaatcccaagtcatcctaattcctaagggaagaactgaaaattcattaaccaatcagcgagtgaggtaagccggtaacagatttcagggcacggtaggtccacgtcaacactctgtaattcactaatttatgcctcaatcttccataggtaaaaagtggtaggctaaccccataagcccctccaggcctccactaccaaaaaaaataaacacacacacacacacactgacacaccaacccccgggagagagagagataggtcgttctcaaaagaactccagacttcatgagcattcttactatcaaagctttgaagattagggagttttgtcgttgctcgatcgacacctattagacatcgtcactttgcttcattttctactcgcagattatacatcatggaaggatctcattacacgaaaaaaaaaagatactttccccttgtcgcttgaatggtaaactatatgaaaatgacagtcagagaggaacaattggttcatctgttaccaagataatcgtatagaaggaagaaagttgcttgcttagagtggtggtgaccttgagcaactgccaccttttggtcaataggagtggctctaaattaacaggaatttgcgtacagtactacagtggtgtattaaaaaagaacccgcttacatgcctacttagacaagccagcttctagaagtttattgctttaactacatatgctttggtcccaacaatagtattacagtgtacgtttattatgaaaagttgctcctttgcatcccttgtccattcatttgtgagcatgtgatgcggtaagcatttcatctatatacattagcttgggaggatctctgcacgatccaggcacattgccaccttatccaactccaactcgggaacacattactttggtttgaaccgatgaacccaataaatctcagttttggttttctgtttactgctcaaaggcaaagaccaaaattagtgttggccatgagagctatacgactatccatcgtagctcattataatgcggatggcaaatgtcatgtaactggtagtagtaggactactaatttgccatatgtggatggcaaatctgtactgattttgcatgatatagagcaaaatacctccataatgtattgttagtgggacaaagtaagcagcagcagatgctctgcagaacaagaagatgggggccacaattgtttcgaacgctatgtgaaccagtatagaaagcacatggagaaattttcattggcataatggcgtttctcaatgcaatgcagtctgtatcccaaaaaaagcccatggtgaggaattaattccgcagttcagtatagagtagcacatttccaaatgcaacgtgtgtgccgggtcagagcagcacatttcctaaagcataagcttaaacgagtggatgcaaaatgtgtgtagcaccagaagaactcctgcaacgtagattgtccagtctccactctaaacatctccaatccaacacccaaacaccctagggaaagtctctaattactttggtccgatagcatcctgtgaaggttacagcgtaacctactaatcaggtccccaaatttcagagaacctactaatcacatccccaaattttagagaagtacagaaacgaattaatgcatcaatctactgtctagaactcaaatcacgcgacaggcatcacatcacattgatccgatcaacgatcgatcggaacgcgaagcgcgcgcgcgcgcgcacacccatcggaatctccgagcacccaaacgcgcggtagatcccgcaaccgagccaccagaaaaaaccctagggtgttcgcggcggattgtaccttgagcggagccagcccgagagcccgccatcgcggcggcctcggggaagacgaagcgcgggtggaggaggccgttcatccatcggcagaatgccactcccctcgggccagaactccggcgtgctctgctcgccacccccaaccgccgcggccgccatcgccgccgggaccgggagcgcgagcgcccgagaagaagtgtgggttgggcgcgggttgccgaggcggcggcgcggcgtgagttgggccgagatgtgccctcttgggcccagcatatatatgggcctcgagtcaggacc

SEQ ID NO: 65782 - DNA, 5005 bp, Oryza sativa
cacgtaacatgtgattctaaagtttcacaaaatcctacgactatatatttggtaaacatttacttaaaatttcaaaacatagaatgcatataaaactttgagtggtcgatttcttgattaagattatcagtttaactcttcactactttgaaaaatattgttttagatatgttgaaatcaattgcattttttttaaaaaagtaaggttttattaaacatttagacataaaacatgtagttatgtaccccaagtcataatacatgacttccacgtagaagttaactgcgagacaagatcgttgttattatggagcacaaagaaatcacacacaggtaacagggcattgattctcaactcctgaatcaagtctagtttttactttctctctaccaatttggtacatgaaaacaaggggaaaaggctgcataacgttgacaaaagttggataaacaagagggattcgctgcaattcacagccctggatcatcgctggatcggatccaagacttcctgtggagccagcagcgcgtgaaacacgcccagtcgccatctgaaatgaaaaagctcttccggccccagaccgaacttaacaatgctcacttgacacggctcgaataaacaatgcagtgtgacagcacagttctgcgtgaatcacacactcagatcctgcaaaaacgaatgggaagtatctcagttttcatacaagagctgcataaaaaaatgaactggaaaaaatggaaatagcagataaaagcaaaattgcagggcatgaggtacttcaggattcctgattgtttctgtttcagtgacctttcaagttaacttattaggtggatcgtgcgcaactaaacaagacatgttgttgctgtcttgctgagtatatcatctggtacagtggtgaactcaaattcccaattttctacacatttacgaatggttaattttctacaaagaagatttgcaattgtcgatgtaaaaatttcaagactaaacatcatgaagtttccaggtaaaagattgacctaacactcaaatacaagggaaacatacaagaaatacatgcacacgtaaagcatcgtatgaagaaacaactgacactgaaaagggaagctgtaaattgccattatgatactgtacgaaatgagatggtagtggttagacaaacaaccaaatagatgacaaagtaaggagtacaaaataatttgcatttgcagtcaacagttttagaaataatttaagaagctccctctaagaaagaaaaaaaatatagagaagcggttgataagtccaggtccaggaatagtgtatctgccgggaacaaagaaaatggaaccagaacaaattgcatcaaatcttctgaaaactacatttgaattcagctcgttatatgtatctgtgttttcattatctagttcacatttgacgcacaaattcaatgcctcgattgactgcgtcagcaaactaataagtgagttcgattaaattgttggttagctggacctaattccaagagaagtggtgaatgggtggcctcccacaacttcccaaactacatatctcataaaaactacaaggacctgttgatccatagatttccatcaaacatatcagtattttgctccttcatgatatccatgtcttttggttgccattaataatttggcatcaatgacaaccagacaaacaccaaaacaatcgacaaccagcagtgcagtgttatatcaggcagtaatgagatggcatgactactacgattctaaaaatccctccgtttaacctgactggctgactataatgaatgcttgatatcacaactcacttgtacagttgtacttggattactatttcacccagatcttattgaaattttctgcattcctaaaagtttttcagatgacaaattcagatgtttctttcctttgttgctacaagccattgataaatcaggtaagtagcatgacaaatcatgtaaatcaggtaatgtgtgatttttttttagataatgtatgaatacaagagtaagttcccagtatccatggagcaagcacaagttaaacatgtactagcaattattatgatcaaattgagatccaaaaacagcgccttagctgctctatctactactacacaattaaagtcttgcaaatcattttagcaaagaagcgtaaaactgattgtgtccacattaaactgtaatgatcacaatacaaaagaagagattaacaaattgtacacaattcagcggtaaaaacagaaattcatacacaatactgacatttgtaggaatggaccaagaatgaagaatcggaaggcaacctcgaactagtgagccggctgcgggggcaccggcgtgtaccagcggccgacctcatcatcgacgttctcctccgccttgtgcagcgcggcgtgcagcacaacgagcaggaccccgatgagcagcgaggagacgatgttggcggtggcgccggtgagcaggaggaggacgagcgtgacggcggcgagggcggcgagcacggcgccgtccccgacgacgcggccgaagagcacgatcggctcgtcgcgtaggaagtagaggacgagccatgcgaccatgcagacgaggaacacgatgagggaggccgggtgccacaggagggagaggaagacgacggcgaggaccacgatggcgtagttcatggcgtagtgggcgaggttggcgcgcacccggaggtaggcgtcggcgaggctcggcggcaggcccagggcgtgcgggtccgcgagctcccgccacggccgccgcgtggccagcgccgtcgcgccccgggccttggcgcgggagaagaagtcgagcggggaggccccgccgccgccaccgagtgggagcggcggcggcgcggcccccgaggaggaggaggaggaggaggtggggattgtgccgtacttcgacatgggagatggtcggcggcggcggcggggggtcggatccgggaggggaaggggaagggggggatcgggaggaagaagatgaatgggggaaggaggagggggatcgtggggagatgagccgtactaactggagggcgtccagtggcacgacaagggaacgtgactctcgagggggttccggatggcaaccgtcacccgttcttttttcaactttgtgtccgccaaaaaaatactaatttgtatacttcaattttatttttttttctcattacatgacggacacatacgcatacgcatcactatacacgcacactcacaaatgtgtcgaataacccatgatctaagaaacatatctctaatcttaatatacacctattgaaaactcacctacatgtatataatatttagggaaaattataaccataccattataattttgcaaaatttgagatatgccatcctgacccacatgtcattgaatcatgtgggtcctacatatcattgagataccgatagcatatctcaaactttaaaaaattataatggcaaattataatatttatggtactgagatttgaaccttggtgcgtttcagcaaaacatctccaattatttgaatataatgtagaaacttgtcataattttgacaaacatattttgatgtcctgcgaatatgtgatattttgcactttatttattaggtgtgatctaatgtatactgacattcacaatattacaccaaattatgggaatccaatacacaaaatgctatattggtctaaattttgttttcccttggcttttaactttatctgtctttgtactctatttcgttcctataaaatcggttactatcccatctctcggatatgcagatagttcactccatttgtcgcgagattgtccatgtaaccactatactcacattacgccaaagttgtatgtgcatgcacgtagagctagtaactagaatgttaataaagaataaagttgaaagaggagaaagctacaacagagatagatatgaccgtccgaacaagatggcgccatccttaccgttgctaggtaccataaagttgctgcagcaaacgccgccacctacgtcgtgtccccagtttgcgcttctagctccaatatctcggtcttcttgtcctcccttcgcagcttctttgtcaacttactctcgtccatgccaccgcttatcactagctagctagcagcagacaattcacggcattgattctatgtcgtcttatgcgtaatgcactcaacaacgtcgcaagatccagaagtactcacggtgggaggacgagggaagccacaaccattgcgctaagggaggacgaaggaacgccaataccgacattgctcaagctcattatcatcatctccgggtgggagaatcagcgcatataaccatccccatctcttcttcctcctcttttcagcttcgacctgataccctaggtatcaactaatattatttaggtatggtattgataaggaaatagctatgcgtccgacggatttgtacgacatgcatccgattgcggcttgcattggttcgctggagagaagccaaagatggtgattgatgcacatggtatggtcggacgcgggtcgtacgaatccgtcgtacgcatatcagtgctgtattgataataagatattatatagttgatatatgtgacgagtatctacgagtatcaccaatttctgaactatatttgacgtgttcctccaatttccaaccaaaaaaaccaacctttatgtcggcatgtcgctatcctatgggctttgagcccacaagaaaatagatgcgactgatcttgggccaacacatagcccatactccaagcccacgctactggtggtaggtacacgagtaaaacaaaacgtgttcttgcctgcgtatatacggtgtacgtacacacgtctagtacacgatcacacagtcacacgcacagatccacacgattccaaactcccaactctcgactagaaccgactccaatggcggcggcggcggctgctgctccgcccttcgccgccggcgactcgccgtccccgaccgccttg

SEQ ID NO: 65783 - DNA, 7173 bp, Oryza sativa
ggcaatggcacctccgccgccacgggcctcgtccccatcttccccacgctcacgttccccaatcactactccatcgccaccggcctctacccttcctcccacggcatcatcaacaactacttccccgacccaatctccggcgactacttcaccatgtcctcgcatgaacccaagtggtggctcggggagcccctgtgggtcaccgccgccgaccagggtatccaggccgccacctacttctggcccggctcggaggtgaagaaaggcagctgggattgtcccgacaagtattgccgccactacaatggctcggtaccattcgaggagagggtcgatgcgatccttggttactttgatctcccatctgatgaaatgccgcagttcctgacgctttattttgaagatccagatcaccaggggcatcaggtgggtcctgatgacccggccatcacggaggcggtggtgcggatcgatgagatgattgggaggctcattgctggtctggaagaaagaggagtgtttgaggatgtcaatgttatattggttggtgaccatgggatggttgggacttgcgacaagaagctggtgtttctcgacgaattggctccatggattaagttggaggaagattgggttttatcaatgaccccgttgctggccatcaggccgccagatgacatgtcgctgccagatgttgtggccaagatgaatgaagggcttgggtctgggaaggtggagaatggtgaatatctaagaatgtacttaaaggaggatttgccttctcgacttcactacgcagatagttatagaatcccaccgataattgggttgccagaggaagggtataaagtggagatgaagcgatcggacaaaaatgaatgtggaggagcacatggttatgacaatgccttcttctcaatgagaaccatatttatcgcgcatggtcctcgttttgaaggtggtagagtcgtgccatcctttgagaacgtggagatatacaacgttattgcttccattctcaatttggagccagctccaaacaatggttcatcttcttttcctgacacaattcttttgccgagtgaatgatcacatatacatgtgactgctgtggttttggatgagaaaggtcttgctgttggtatcctcctttagtcgtaattgcacttgtacacttatcatattagattcgtgtcactagtggctattcactgcctgaatgcaaatgctgctagtagagagtatctttgtccttatggacaacatttgctgttgttatcatgtcttatccttagcggttttcttatgcttaaattttcatgcaagttcaattaagctcgcattctctgcttaaaatgatgtccatcctgttgataagagattaaccagtcctagttctatatttaatttcagccaaccttttacccactgataataatttgatttatgtatctcctgttaccctgaattattcatagtcactgttagtttcttctgatcttctggtgatctaggtgtactcattccaacatatggaactgttgggaatcataatagacgaagtggtgtttttactttcctggaggatcttttcatggctttatcaataaattgtgtagcaacgtaacaatatgcacatgagcattaacaggcctttatttctctggtattagtattacatctgttatcagttctttgttgctttgttcttccttgttattcacttctgtcaccactttgctccttgccagtaaatcaaagcagttgctatattatgtttgagtattttggaaaaggccaacaattaaacatagatttcactcttccttttttttttggtatgagcaaataggatatctgattgggaagactatttcgttggcccctttttaactcttgaatcagaaaaaaaaaatcaggtctatgaatattccgttccattcccagaagaaaaatatgatgataccaacttcttaaaagcatagtttagagtttggagggctgcaaattgcatagtgtaaatatgtcgtgtccataaatagtttccttgaacacatcaataacatcattgttacttacttacttttgcatgcctctctgtgtatggttaaaataaccaactaaacataaaacattgttggccattttcctatctgaaaagagccatcgttttgtttgtttgccaacttttttgtgcattcatacatgtgtctctataagcttccttttcttttgtctcatacctatttcattatattatttgttctatctgttgaatccaggctgatatgttctaccttattttcacctgttggtggtcttaggttctttattttattgatacagaggttcaacctcttgaaaggtgaaacttgctaactgctcccatgccgttctgagaatgcttgttagctttcatcgaatactattatgttacattctaaagcctttttttttgtttaaattgcaaccatggtcctttgttgaatttccatagatttgtaatgtttttttctcctctaaaactatagttgatgcttggtactataactttgaattggttgctttgccgtctgtttgggcacatggtctgcacagtactttcttctacttcattttatggttcttgggaagtaccaagagatattggtacatctgactgtaatttttatgtgatatcacacagcgcctcctagtgttgaggaaccacagatgaactctatgaggtatggcaagttagctcctactgttgttgtattgagatgtactacaaattaacactacaagctatagtaggtatcttctcaaggaccacaaaaaaaaacttcacttcttcagttcttaaaatgtcatggatgtgcttaggatttcattctttttatttagatcaaagattggcaactcctggattttctcctccctgaacaataaaatgaaactgcaaagtctgctgggcaatctgtaattttttttgcaatatgggatcaggcaatgccccgtcgtgttatttcctgagggatgttgaaaacttagtacatttgagctactaaaagagttgcaaattataacttggttcatttgaattaactcatcttttagtgggtgcaagttgggtttgtgggtgtatctaccttgtcattgcaagaaatcgtccaagcatgtagcacagcaaccctttgaaacacttgacttacctattataatggcaaggatctgcacatttactattcatgaatacagtttcttgtctctccatatcttattgagttggttgtcttatgtgcaattgctacattagctgggttgtatatgcaattttgtcaagaaagatgatctaagcatttggttgtatttagtgtacagatagcgcatattgaaaaacacaaccaaacctcagtacctccgtcatgaaaactctgacaaccttgatagtttctttttgctattagttctgctagagctcatttttatgtgatttttggaactaaatacacaatatattgttgtttgttgatttgagtttttcaaaagttaattgtcatggtagattctgcagaggttggtgcaatcataaatcttgttctggctcttctgattatcctgggttaggttctgtattcaagaacactgccagttagagcttagagggcaaaattacttcattgcaggtaggtaaatgccttcatattctgcactgcacatgtttgtttgatactgtagacatttcatgaattagtacttcataattattatccaaaaatctttaagtttcaagcaatagaatgtcctgaatggtgaggctgtttctaattcttttcattattgaaattttcttgatgtacttctgatattttccatccttttaggtttaaaggaaagtagaaaagacagaaaaatgtgccaggcctgactgaatagattcctgatttcctgtaaactaaatcacatggttagccgaagtgatcttgatgaggtaatctgtatagtattttctttagtattcagtcagcaagatcagtttatggggatggaacagtaacactagttcttgccccatttgatataaagattgtattagttcataactttgcatgttaaatagttactgtctttctaaaagcagcataactttgagaaatcagaaatggtatagataaatagccttggagagaacatgtttatcttgttttttactgtacctcattattactgtacgtagtagctgctgataatcacccagcctcactgataaatgcaacccgacaggagcacaatggtcatacaatctagtgggcctttcagcgtagttgggtgatgtcctgcaagcaggggggccataagttggtctctgaaactatgccatgaacagatggagataaatgtggcaatgaacactagcaaacgtggccttattctaagaatcggcttgcagggaccggtaacacacggtaacagtgcaactgtaggggctataaagagtgagggtccagttgccacccaatttcttagtttaataggttcttttattggttcggtgatgcaggcagtcgatatatttgttgaccactaacttgcaagctttaattgctttggttcatattagttgtttgttcatgattatggtgtgtgaccttaaagatgctgctgtatgaactagatctgtcaaacagaagtgtagggactttctatactgttgtcacagctccgttgtttggaaaaatctatgttgagtagtgctcttcctgttttatcttttgctattcgatcatatggctctattcatgattgacctgcatgatttgccaggataaacaagtggtacactggtgcatgcatcgtattttctcttacgtatttgtattttatgttaattgagaatatctagctagttcctatgctatgcacttctgcatatcacttggctcattggctgtgcagagcaattgttcatcttttgtcttttaccattgctcactgttgaagtgttccctccatcatttgcagagttctgtgataatgtggcggtctgccaggaggaacaggtgtactgcaatcagctgcaggaactaccagccgattattctgtaggcaataattcccagaactgaagcctgagcatgccgaacctactgtttctctatagatcccttggtaagtactattgtctgttgattcactcgaacaataaatttacctcagccatcccacactttttccccaccatttctgttccgcatagatttcacatccattattcagagttgcacaaaccactatcacatatcttcacctttaccgttcgggagcactcccatggtaacaagagaatactcaagcttggcagtgcacaatggtgcaagactgcaggataatctgtatacactcattccaaggaccaaaagtgagcctgtacttttcttctgttacccccatacagggatcctttgctcctggctttgttcaatcaacttcctagcccattctcctcctgttcatgtgtcttgcgcccacactcgtaaagccctaaactgcacttcgccagtgtcctcgtcagtcgtcagctgcatgcaataggagcacgggccctgggcaaggtcactattgagatcccttttggcttgctgatgggtactgctaccaagaaatattgttctaacctttgtccttgttgcactcttgcctcattgattccttttgttccttcctttatgatcccaatgtgatgcttctctgtgcgtacgctagggcctgctttgtttttgcatgtgactttccttctttcttccactaacactgcccaggattgagcactcggtcatcatctaatcggtatttcaagcttcaaagtgttttgatgcctagctagcttcttttgtttgttagggttagggtgagaagaatgttcgaatgattgtggggatataatcaagctgcttttcctgtcaccttaatcatgcaatttctggtaaatcctaatgattggtgtccatctatccatgagtgggcagtctgagccacatccaccctaccaccccatataagtgctaatatgtgcaggaaacaaaatttcctgaattattttcgtgcaatgagtgatgcatatgttgaatttaaatgcctaaactataatcaattgtgatatatttttctaaagagttgttcttatgcagaactatggctcttcatatctgtactctcagcagcctgcttcatattcaggtcaggagtcttactctcttttttctcagttacaggtctttgtagtaaaagttgcaggctccaataaaaatgaatttgtaggtaaaacttttttatatgtgttcttggtgacttaaaagccaatgctaaaaaagaaactacattgaaaatatctcaaaattaaatttgaaaatttaaattttggcttattctttggctgtttaggccatccgatgggagcctgcatcttacttttttccatagataaatcagctagaaagaatattgctttgaagagtttttttaccttaccgaccggtctaattatcacatcatattaatacccaaagatgcaaccaacaactcacggcatttctttcaaagggattttaataaaaccatggcaattccagctaatacacgaaatgctttcccttttgctgcctttgctctttcaccgttgttgttaagtgtaaggctctttcacttaggagtcctagttcaagctaaaggcttttgaaaaggaaagggggagctctagtatgccactaaggccatccttgcacttggctcatcacttggtgccttacaacataatcaaaagctccgatccttgcgacctcctattggacctaaaaggctaaaaccatgaatgttctcccgtgtttgttaatcaaatcactggtccaaagctagagtagaaaattcccgcgcatgaggggcacataagcataggggaaaaagcacccttgatcatgactaaacaagtgatcagagtgtgatgctaatcattttagtaccgtgcggtttgggtccggccacatcattgccttataccagagtctgttcaagaactgatgcagagctgtcacttgcatgaatattattccctagctgatcaatggttttgctcttcatatctgtgggctgtggaactatggttgatatcataggtggccctccaaaattgcactg

SEQ ID NO: 65784 - DNA, 1887 bp, Oryza sativa
ttcctgcagccctgcagccctggaggagggagtgcgtgtgcgccgcggattgggccggagccattgcgtggtttcgtaccagcggcaaaggaaacgtacctgacctgcagcgacgtaccacgtacctatcgcttgccgttgctgcgtgtcgctgctgatctctctctgatgttgatgatgatggtgatgataatgtttgtgttgttgctttgttttttaattaattacttctacctgcgtttattcttttggggttcgtttccgttcgtgattgatgtgatgtttgtttgttcgtttgtttttggagcagggtgtcgggcgaggagcgatttgtttttgatactgacttgcaccaatctatttggaaacagtaggtaagttactgcatctgcgtactttgatttactagtttggaaaacactggagttgcaagaaaatacttctacgtctcctgtgtcatcctctattctttgtgaaatgggttgaggttagccatatgtccaaagattaccaatttatgataaacaggaaacgcatactacgtagctatacgtgtgtcaggttcgtagttacgatcgtgtttcttatagacggaggggtacatgatatggtaacattgatttcgtaaggtttgtaaacgattcaaatacttaggattttattcctataatgccctttggatttaagtgcattataatgtccttttgattttcataagaatgagcttttaaaattatatggatatggtttcctatagcccattctgaaggaaaaataagtatgagttccttggccccagttgatttaaattaatgagctagcagattatggatttgattatagggataaattacatattttaagaaaggttaagttgcattcatggtacattaatttggcatgcgagtgtaatttagtacatgaacgtgagaagtgagagttgtagtgtgataagggtgtgatttagttgaagaactaataagtgagcatatgggtacaacaacttacaagataggttcgattatggtacaataacttaaaaaatgatataacaattaattttttcgagcattttgtcatacatattcagtttttaagtactaattttgtcaatataatcgtgaatatttgcatactttaatttgtttattctagtaattaatatataaacttatgatggtggtgcaaattggatgagcaacgtaattccttattcttatagattaaatttaagattttaaggtaatatatgtagaattactatgtgatggcatattgatatcacgaaaaaactcacctagcattcggtaaccaaaatatttcatatttaaacaagttgatctaccaaaatagtaaattccgaagttcttgtaatagtaaattacactcacttactactgttgtactcggacattcaatttaaggtcttgtactggattacatccacttattaattgttatgttgtgagtgtaatttactcttaaaataaacttaacaactggagtagattgagataagtggtctatcaatgcactagaagatttttttttttttgagaaaacgtactttttgaagcgtgaatatgacctagttattgttttattttcccttgagaagagttattgtttctctccaaacaaaattccttcaaatttcctatgatatatttctcttgaaccatccaaatgcattaatattactagtgcattccagaggagcttttagacctgcattccaaactcatgtgctcgatgttcgatttctaatttttttttccttcctatgttttgagaatttttcttccaaaagagcttttattttggacctactatgagggtcattgcttgcttcaattaaatgactattttctctgttccaaaataaat

SEQ ID NO: 65785 - DNA, 3544 bp, Oryza sativa
cgtggagctcaatttctcttgccctcgccagcgacacctagtttcgtcaaacgtggaaaaaagaggccacagaggagcaaggggcattatcgtatttagatgcggttaatactccctccgttcaaaaaaaaaaaaaaaaaccaacccaagaggagatgtgagacaatgaacttggacaaagggctgtccaggttagcttttttgggacggtggaagtatgtgtcaagaagacaaacccgagggtggcaaatcatcggtgtagtagtaatgaagtgagtagcgttttatccattgcaacgtataaactaacattttatcaaaacccaacatagagagtagcatattcgtcttttttcttattattgataacggatttagggtattctttagttctactatttgtgttcctggtcgacagcgatgtgactggcttcatctccaagccctttcaaaccagtcgtgtgcgcaaattaagatagcgatcgcactcaaccccgtgcacaaatttgtcgttagacgccctactactgctgctactactaactactcccggcccctgcctagcactaggaatcttttgctagcctagtggtgaatgctctcactctattctagaaattggtctcagctcccgtctcccggtgccaaagaaatcttttctaaagtttgttggtgtgatgtgaacggtgtgtccgataaatcaatgtgctgctgcccccgggttgaccacgatgtaaaatctttccgtgcgcacgtttttaaaattgctaaacgtttattttctacaaaaattttctatagaaaaattgatttaaaatatcatattaatctatttttttaaaaaaatagctaacacttagttaatcatgctctaataagtcattctgttttacatgtaatgtgtatgggatgagtttccaactcaatattggaaatgaacctttttcaaaatagtcaattggagcactctcggcaaaagtgacaccaggcaaaagtcaaattcgtcctactcatgcattgaaccgttgcctacacccgaattacccttctcaatcatattagagctctaacttctaaatttagcttcagaagttaagtttggagtatagttgtggagcagcataaacccaacttcacatctctagtacatttttgtgtaaatgttttactcaattccgctcctattttaggtggagctgaaactatttggctgggctctagctccacgagaggtggagctggagttgtgctaaacaagcctaaatcaaacatagtgtggagcttaaacattaatttgtaaggccaatgtgaaagtatgtgttgaggtattacagtataaaactcaggaactacaatgcaaatttcctaaagctggtgggctggtgaccaatgttagcctctactccatgagggcatgttcaatgcgtgcccctggagattatccttagcacactccatcgatggccgtttgcttttttgtccatgccgtcctcttgcgatggaacgtgtgcctctgctggggacgtggccctcgctcgcttttggcaggggatgcgcgttgggcgcgagcatggcttgtggacaccgttcccaccgaaaaatttcaccttccaccccttgcccctctcactcatcgccctcacggacgccggtgacgggagagagagggagagagagaggccagcagcggtagcggcgagggagagggagagaggtgagagtctgcggtgagagggagaggacaatgacctggagacgatgccgacgacgacctgcgtgacctcctccgccggtgccgcgacctcctcctcgatgcggcgtggccggcgtcgctccattcgatctagccgcgagggggccagatccgcacacgacggcgccaaatatgctgcctccgaccgccggcggtgacggaaccgaggtcggcaacggcggcggggcgaggctagcgcgaggcggggaggacaatgacggccaccgcaacccgcgcgccactcttcgtcggcggcggcgacgggcggcggcgagagagaggtggcgaaagggagagagaggatgagggagagagccgcgacgcgtgagagagggagagagaagggagcagcggcggcggatgggcgggaggcggcggtgacgggagagtgcgggaggaggcgatgagcgatggtgagagagagggagggagaaagcgtcggaggaggtgccgaggaggggtagttgaggaaatttaataccgtgactttcgtagggatacccactgtgagctagagtatcttcatccagttttttcggattttgaggaacccatctagttgtggcctttattgagagacgagtgtccatatgagtgtcttcagtcagagaggacaccctgtgtcttccattgtacatgccctgaaggaactacaatgcaaattttctaaagttggcggggcggtgaccaatgttagcctctactccatgaaggagggcagggtagggtgggtttcgtgtcccttgtctttcatcgctgcacaaagaggagggcaaagttgtttgtcaaacttgatggccttcttcatccaactcttgttggagaaaagaacgggaactatatttcaactattgcataaaaaaaatctagtacggaatgtgatacagtctagacatggttctttttatgtgacgaagaaagtacattgaccaggttgccaccgttgcagatagagtaaagcatcgtgctagtgcatacacgcgcaagattataactattcacttcggtggttcatcatcgcgtgcatcgtgatgtcttaaaaaaaggggtaaggctagtgcaaacataagggttatcatacttttaacttgttatcacatagatgaaccatcctcacacacacaagattataactatggcaaaattggttatatagcatcgaacttcggtgagaggatttttcccctccatttttaaaaatttgtcgctgagagtttatatctcaagtttggccaatactattttaattgtgagtttgcatatacttagtagttatgcattacatcctaaataaaaccatatagtttttatttggaaaaaagtacgaattacccccctagctatcgcggtcgtctgaattacccccctgaaccacaaaaccggacattcttcacctcgaactacacaacccggacgaattactcccctcgacccaatctgcggtggttttggtctacgtggcatacgcgtggtagtccagtcagcgttctattcattaaaaaaaaatgtgggacccactctcttctctctctcactctcactctcactctctgtcatctttctctctctctcactctctctctctctctctctcacgcgcacagcggcgaggacggggggccggaggcggcgtcgaggatagcggcacgcacgcacgtgaccggggaccggaggcggcagcgaggacggcagcacgccccgcgtgctccgtcgacctccgggccaccctttccttccttcccctgcaccttcccctccatcagatcggtaccgccgccacaggagcttcat

SEQ ID NO: 65786 - DNA, 3010 bp, Oryza sativa
gtctcattgaggtggcctgactgcttgcatgatcgtttttgcatgttgttgggcagcgcgatgcatattgggaggccgtgatgcccaacctgaagccatcggtgaccacgacggcacgagctttggagtacagggaggagatcctcagagcgctgcgccgctgcctccggggcctgtccgcgtgcgtgcgcgccgccgcgccatgcgtgcgcgccgccgcgccatgcgtgccgccgtgcacgtctcggccatgccgccgtcctcgccgccacctccggcccccgtccgcgtgcgtgcgcgccgccgcgttgtgtgtgccgccgtcctcgccgccgtgcgcgtctcggccctgccgccgtcctcgccaccgcctccggcccccggccgcgtgcgtgcacgccgctgtcctcgatgccgcctccgaccccccatcctcgccgctgtgtgcgtgagggagagagtgagagcgagagagagagagacgacagagtgagtgagagtgagagtgagagtgagagtgagagagtgggtcccacatttttttaatgaatagaatgttgactggactgccacgcgtacgccacgtagaccaaaaccaccgtggattgggtcgaggggggtaattcgtctggtttgcattgttgagggtgaggaatgtccggttttgtggttcaggggggtaattcggccgaccgcgatagttcgagggggtaattcgtactttttcctttttatttattaaagggtggatagtctatgtctcacttaaggctcagcttggttcttatgtttcaatctgctcttcttagtcctttaagtttttgttttaattcaaactcatccttagacctacttaggaagccagataactaaatattatcaacatgtctcgattaaatgatccttttacccctcgttcatatatatagaaaataaaaaggcttactatcaatacggtgtaactgtatgatgaaaactcctatagatctgactatcataaatacatctaataattatatgatgctattttttttaaagagtaaagtgcacggacggtccataaacttatattggtgtgtcacctaggttcttgaactctcaaaatgcatttttgggtctctcaacttgtctcgggtgtcatataagtccaaacgggctctaaaccgctccgtgtgctgatgtggcatgccatggtggtgcctacgtgtcagtagaacccaacccatatgtcagtcacatatagaaaaaaaattaataacatatttttctcctctctttttcatttatttttcaaaattaaaaacttccttttctcctcaatctcccctcttttaaaattttattttttatatgtgagtgacatgtggatcccacagacacataagcgttagcgtggcatgccacgtcatctcacgaagtgggttagaactcgtttggagctatatgatacccgagacaaactgagggacctaaaaatgcaatttgaaagttcagggacttaagtgacacacctgcataagtttagggaccgctggtgcacttcactcaatttgcacacaatgatttttttttctataagtaatgcaaagtaatttatattctacgaaagtaattatgtatatgatactatagttgttaaagctcaaccctttgtatgagcaggttaaggttgaaataacgggaagcgttttattcatttttattctcttttgtagagtatgtaataatgtaaattaagggtaaaaggatatttttctaatacaaccaatgactaggatcagccatttggcacaccaagtggtccaaatgatgatttagggcctgttttaaactacattttggattggttaaatcctcgattttcgttagtcacttaatatgaaaactttttatatagaaattattttttaaaaatcaagtaaatctagtttttaagtttataataattaatactcctgtacgcctgatcatccaaattatgttacttgttttcttttctgtacgcctgatcatccaaaacacaaaccaccttgaaacgtacgcagccctaagctaaaaacaaatatttaaaggatatgtgtggatacaataaaaagataaaaccgatcaaattaagtttactagattagttattcacccttcattcttcattaaactttgataatgtaagagctattggtagtcaaatcaacatcattacgaagtaaggatagctcaattagttaggttttttttaaaaaaaatcaacctatcctgatttaaatcgtagatttgatatgagtgctcgtatttatggttaatttttttagtggtacctgttgataaataggatgtgtgtatttatagggacgagtatgcgaacgtgtgtttagaaaaattaaaacatcatcgaccaatagtgttgggcaaactctaggccagcagtatggtggtggtgaccggtgcgcggcaatgcacccgtctctactcccccacttggccccttttatgggcgtgggccctacgcgtgtgcgcacgaggaggtgaggtgagacttagagagagagagatagaagggactcctctgctctgctctcctctcctatatccatccataatccattcctccccgccgtggccgtcaccgtcgcccctcgccggaggacgacgacgagacgaacaccaagagactgttccaccatacgcaatcattacacagacgtggggactatactatactatactcctatttaggtgcggatcaacactataatcatcggtgtttaactttcggtaaaacctatagcaaaattgtttatctatatactataacatcatgttctaagcataattagcatattatgacacctataaacacgttatgacaccaacaaaccaattttctgatccaccactgctcctatactcctatactatactggagtattactaccccttcctcctcgtgtactttgcacttgccaattccattccattattatataatcctcccctccaaacccatgcccct

SEQ ID NO: 65787 - DNA, 2610 bp, Oryza sativa
gccgccgtcccgaggcgttcggctctgactgacgggcatgggtgtgcatgcatggtgcaggcacgggagcgcggtgttcaggtcgcacctgttcgggtcggcgacggtggtgacggcggacgcggaggtgagccggttcgtgctgcagagcgacgcgcgggcgttcgtgccgtggtacccgcggtcgctgacggagctgatgggcaagtcctccatcctcctcatcaacggcgcgctccagcgacgcgtccacggcctcgtcggcgccttcttcaagtcctcccacctcaagtcccagctcaccgccgacatgcgccgccgcctctcccccgccctctcctccttccccgactcctccctcctccacgtccagcacctcgccaagtcggtacgtcctccttcttctccctctccggcgagctcctcgacgagatagagtgggtggatgaattggaggaggagcagagtgggtgggcgtgggcgagcgccggcgtgcgtgcacacgtgcgcgcccgtgtcaccacatggaagtaacttacacaaggccgggaaagggaaggcccaaaaggagtgggcccaatcacacacactctctctctctctctctctctctctctctcatctcatattctgactctagagagagagagagtggctcacctccatgtgggccccaccccatcggagtagagttaccactaccagcagccgaaaatccacgttcctgttcgccaccagagcgtgtgtttgtgcactcgtaaatgtttattttttctctgcgtattcctctggaagagatgcaaatacagtcttgaacatttgtaatttttagagatgaggatggaacgaaatgtaattgcaagaaatggtgatgaaatgcaaatgcaggtggtgttcgaaatcctggtgaggggcctgatcgggctggaggcaggggaggagatgcagcagctgaagcagcaattccaggaatttattgtcggcctcatgtccctccccattaagctgcctggcactaggctctacagatcactccaggtactctctctctctctctctccctctcatctaagttctctttctctctctacctgtagtactccatgtaaacctgcactgcaccacacattgatctctactactctcttctgtcagccactctgtctctcctttatgtctgatgttgctcagccctactccatgcagcatcagcagcagcatgatcagtgtctcagctgccatcaccattaacctctcttaatatgttctctctgtttcacaatcttggattaaatgtatacaattgcactcgatccattgcacatttttgacacattattgtgtgtgtggtcatcaggccaagaagaagatggcgaggctgatacagaggatcatccgggagaagagggcaaggagggccgccgcctcgccgccgcgggacgccatcgacgtgctcatcggagacggcagcgatgagctcaccgacgagctcatctccgacaacatgatcgacctcatgatccccgccgaggactccgtcccggtgctcatcacgctcgccgtcaagttcctcagcgagtgccctctcgccctgcaccaactggaagtaagcctgtatacctgaaacctctcttacaacacagtaagctcttaattggatcaatacctgcatataattagatgctagagatgaatcctgaacagaaaagaaaaataaaaccataccctaggaagtaattaaggatcctctgttgctgggcatgggcagtcagcaaaaagggtccagaactgaaaagagttggattttctttcttttttgtctgaaaggaacatgatcaactattcattttgtcagagccatgtgttgtgcatgatatactactatcactattgtctactacacacaatggcagaggatctgtgtccccaaacaaaaactagatcataaaaagcctacgaataagggagagatacgtaggtgggcagaagggatcagcagcatataaagggttgtgccaaccttggtccatccctttcttgttggcatcttagagctatcattattatttgttatctaatgtgccatctgaaaagaaatactactactacttgtgtttggaccaatctttgcaagatgacgtgcgttgcatcattgtcaatgtcaggtcgggtacatacatatcattagaacagagtcgccttctcacaaaagaaaaggcttactatcatgatgtatcatctacttacatatcattagtttgtgctattatgcgttttttttttctaaccggctataaacgcatgtgcaaggaatagtttttttggttgaagtatggagggttttttatcaactggggaaaaaagaaggttacataatttggctatttattctatggagattagaaggcagcagtaatatttcctagctagcatgtcctattacaccagtagcattgtgtcatatgctagattccatttacatcactacagtgctaagaaattactcgcgtgtcgactgtgtttctgttttgatgccatgtgagcaataaactcattgaaacctctgcatgtctaccactgttagagaacatgcatatcgcggctgaagat

SEQ ID NO: 65788 - DNA, 1227 bp, Oryza sativa
cctgcagccccagaagtcaattgaatctcccaaaataactggatttggtagttctttgaactggtaaattcagacaacataagcttaagctgtccaggaaaggaatacacaccctttttttccctctattgtgtactttgtgtaagctctgaaaatgatatgcaaataattaatctaggcaaatgatggtgctgtactactgttgaggcatcctatcattatgatttgatttgggaagtctaataatgtgctaattggtcaagaaatcaatcaatctcaacaggagaaggacatgagcaatggcagcttcactccttttggtggtgggcagaggctgtgcccaggcctggatctggccaggctggaagcttccatcttccttcaccacttggtcaccagcttcaggtatggatcaccacatctcaatcttggccattcttagtgcagccattgattccaactccttagctttgtttcatgatcacttggcaacaatagcttttttttctttctagataatggaatacaaactacaacttttgcataattttccatgatcgctcggcaccgatagcatttttttctagataaaagaataaaaatcacgacctctacatcatataatgaatggaataaaaatcacggcctttgcatcatataatgcacgcaaccgggcaccaatggcatgcatctcatgtagtcatgtccctatcatttggccatgccctcttcgcatgcacattcatgttcctagtaataactaatctctgtagaacaatagaagagcggaacagtagatgaattatgcgttgattgacagaataattgtgggggggtatatagatcgggtacgtacatgaggatttgaagatcaagccgaatctttccagagataaaaaaaaaagaaaaaaattatgtcagataataactggtcctaatacgtcactagggatagcatcacgaggctttctcccatgcttatacctcctctgttatcatcttccttgagggagtgatcttactgtgcttaaggaggtatctaaagcggtggtgaagccagcgacatgtcgagcccggatactatagtgttttgtagtgatcaatccatttttacacgcgtcaacggtgattggtagtggagacgccgacagcgaagcctagacggtcgttcgacctggagccgtctccacctctgatcgaaagatatagtatggtattttcgcctct

SEQ ID NO: 65789 - DNA, 3403 bp, Oryza sativa
cccacatgtgtgcatgcatgcggactacgccgctgtacgcgtgcgtggcttacggcgcccgctgctacagctacagcgcccgcacgtgtcagctaccacgccacgccctgcatgcccaccgccgctgcacctccccttgagacgtggtcgctgggcggtggtgggtctcacatgtcagtacgtctttcgtcaaaaaaaaaattcaactttaatttgtttttttcatggtctcacaaccatgtagcttaccaatgcaaacagactaatctaaaaaaaaaaaaataagcttagctataatgcacgcttcgattaagcaatgttacgatgcgtgtgcttagctcaggatagtgcctatattgacacgaaaatatactacatccatataaaaaaatataagcattttttactataaatttatatatttattcatatttatagctaaaaatacttatattttgggtcggagcgagtatcatattttgattaccagtcgtccatcagctatggagtctgtatagggctacgtcctacgttcgggaggtagaaaatatggtgatttattttatttttttgcggggaaatatggtgatttattaatatatgattaattaagtattagttaaaaacttaaagaataggttaatataaatttaaaaataatttttatataaaaaatcgtattgtttagtagtttagaaaatgtgccggatcgggttgagttgggaaaggaggcgggaagaagcgtggtgtattaattggcgaagggggtaagaagggggagaccggagacatgggtgtgatggttaggcagccggaatgggctctctatcgactcgaacagttggatgagatgagacgagatgggtgacatgcgtgcgtgcatgcatactttgtgccttgtacggtccgtgactgaactgaatcccaggaacgcgaatataatactgtagcacgcacgcacgcacgcacgcatccagctgatctagccggccgagatgtgccactttgaccggtcgtcagacacgctgcatcaatgtaggagcacgtgccagggtatggtcgctgcatgcctgcctgcaaacaatactatactcctcccataaacaaatcaaactccaacaagagaatccgacttgctagaaaaacatcatatcactttaaacaatggagattggagagtccatcagtccaatgtgtttttctgtcttctttgaccatcttccaattccccattatgcttgtgctgacctctatctaattgatcctaagagaagcgttttgcaacatcttgtaaaaaagcaaatcacataatattactcgtgctttatgtagctaagctacattggatcaggatcctctgcagtcaaagtcacgtgactttgtcactgacattgtgggtccgataatcattgggtccacatgtcttacaaagacaatccggctacatcatcatgccagtttccgtaataaattgaccagtaatttagtactatggactttagaacctggcacatgcatagcacagattcatgcatgcgtgcactgcatctgcacgcatttgcattggttgcacaagcagctagctggcctacatataacatattactgtgttatgcgagcaactggccactgtccacatgaagccagtaaatcaactatcaacattgatagtagtaaagctcttgttcagagttgcaggcatataggtgctccctgcatggtttgctcaaacttaagatagatgatactacattctaaaaatgcaagtatttctggtatgtatctggacaagatggttaggactctagctataacatagaaaatgcttatattagaatacacttcattcgtctcaaaatataaggtattttgatcggatatcgatcccatccggttaaataccttaagtagggagtggcagtggcatcaccatcgatcatgtgttattgataaatgattatgattatgagatctcttatctacaatctctttctgaataatcgacctgctgatccatccattgcatgcatggttgttgcctgacaaggacattgaaatggactgctaattgctgccatggatgcaggtgggtggcggaggaggaccacatcgtcaacttccccaccgtgcggctcaagcggggcatgcccatcagggtcaccgccaaggaggacgacgactagccactagccaccactactactataccgatcaccatactcaactagtagaggagatccatcagatgcatgcatggatcgatgcagatcggtcggtcgagtacgagtagcccacacgagtcgacacatgcatgcaacaagccaagttgcacacaccaagatgcacatatatatcatctatatgtcgatctatactgctacctacctatatatatatatatatatatatatatatatatatatatatatatatatatatatatatatcacacgtgtactagtactactctagcaagggatatgatcaggaggggcaagctctgagcaatggtccctgcaagatggccagttgctctagccattgatagaggtgcttacgtatggtgtaattatacaggaagggtaggccagcattagctaggaggcagctttgttaatttagccaacatgtattgatgtataagctactgatcgattaattaacagtactactattgtagaactactgctcattggcctttgatttgatgctggtgctcatactatattagtggtgaccactcatactatagtagggttaatatgtgtacatggaggcattggtccacaaggagcaagtgaaatgaatcaatgggcacaggaaaagggaccctatgcaagcagcaagctgataggactttgaccactgagaagctgggggcctggggcagtgtggtgcagctgcggctgcatgcatctgctttgctttggagtgggggaaggaagagaagaagagataagcatatagggcctagagagagaaatccagcatggaacatactgcactgtagtatacatacgaatacaggacaggagaaagagagaatggactggtgaattgagtttcccttgatgtagcccagctttttgtgtgatcttttctgcaaggttcagctgcagacttgcagggggggtaaaagccactggatccttttgggagatatgccttcatcataaggctgatggttaaggcaccacacaacaaatgaagagcaacctaggggaaccaaactcaggttgccaaacataaaacgtcgtggctaatgattcgtctcaagagtcaagatcagatcagctgccctacttgtttgtttccctttcttgagctagattttcccggctttggaacatttataccactgaacactgtatcaccgcctttgtcttcctcgtgtcagatgcta

SEQ ID NO: 65790 - DNA, 2840 bp, Oryza sativa
ggacctcccttctgcagttccttccaaggtatgcccagtagagaggctaatgagcccagcttttggggagcaagggaggcaggcacgcacacacgcttgccctgccctgccttttcaattaactctcatgtggcctaatggtccaattaccatgggctccttactttcattaactctcctgtggcataatggtccaattaccatggacaagcctcctccgtttatttctttctttcctctggcccacccgcatgtgtgcatgcttgccaccgtgcttttctaaactaaagttgcataggatctccctcttttttggaaaccactacatttccaaaaccgcggccatacatatcaacagatgattacagaaaacatgctaatatatgcagcagcaagctcaactacacaagctttaaacacccctctcttattagcattattgaattcttaccatattgccaagctgtacggtttgcagctacagctcttggaccaccagagaagccctcctagcgaaccaaatgcatccccagatttattgtagctctgcttcaagacggtcctgcaacagaatagtacaatcgcaacaaaaaaataataataataataatacggctcaacgtgaccaccacagaaccaaaagaacatcgaaatatcaagctgcaaaattttagcatagttactggttaatacacacaaataatacatcaggtcatgtgaactaaggcatgtacatgaaccaacagatggactcaataacatcaaagcagataagatgcttaaagtccaaatcagtccactagctagacacaaaaattcaatgatttgttcatagccatgattttaagccccaaaaaactacccaccagaaagcctgaatagtagtgatgtcatgaaacatagaatgaaaactagcagattttgcaaaaagtagttaaggcgcaaacagaatgcaaactgtggacctacattcaaaacagatagccaattggcactaagagttacggattgatgtacctatggtgataagattcatacaaattgtggatgttaacaaagtattcatggaccacactgcagcaaaagggtctctcttcatagaaacaaaattcaggtttctggttatcatcatatcatgccaaataactccaaatgacagatgtattagatttgcaacagcagcaaggaccacaaatccattgttctggcagatccttgtttaccatattatcttggattggtacagtaaaaagctggtaagaagctgaaggccgtactagcaaagatgtggatatatcaatagcagccactacagagggaaccacacgccctacagggccagaaatttcagactgcaatttcactccaggacattgacttatgatgcacagcacaactgactatgggacaaagttcctaaacccccagtcccagcgcacagagatgtttctcaaatactgtaaataactgcaggaatagtatagatacatatgaagagcatcctatgttcgggagagagcaaaaattaaactgtcttcataccagccgcaccgcatggccacaccagacagcctacagttattgtcacatggcgatcatgagctgttggtttggctttcagaactcagaaggcaagaaaaatcatactgtccaagaaagccatttcagttgatcaccacacagcagagaaccaaaaggaagtgtaaattgggaaaaggagaagatatgcagagtaggcatatattgtacaatgctaaacaaaatagtagtgaaattatgccatcagtgttcaggcaatcaaaccaaattgcatgaaaccaaggattcatcaatgtctggtcaaaatcggtaccacaaatatgattaaatgatggtctaattaactatctttctaaatggaaatcaaaagggcttcatattaacattaatggatccaaagtatgagtcggcacactgaaaaaaatatgatagaaaaaccgttctaataactgtaagcaaaatattatatgccaatgccacagtttgagctattgacacagtggatgagaaggacccagtcatatctcataaaaggggcatggtgtttaagttatataaatctacctttaccgatcattagttaaaagattcagtgagccagaaatacacatagccatccacaaagaaaggccaaacattgctctctgcaataacaacatatgaaaatcagctccatgaccggccacctccataccctctatatctatcacggtggcctgcaaagatgtgacaatagtcagtcacattcagaattttcaaattcttaggcagcactataggtgaaaagaaagtaggcagaaatcagaatctgtaaacttgcttctacaataatttgaaaatagttagataaacagagagcttgcctgaagaagggggtggtgcaccacgacccatattagctaattcagggctgaccttttgtccagcttcttctagtatgttgatcagatccttggcaaatctggcattagcagcagtgaaaaacgtgtaagctgttccttttgctccagctctgccagttcgaccaatgcgatgaacataatcctccaatgatcccggaaagtcatagttaatgacatatttaacatccttaacatctgtttccagatataagtggcattagtttacagaaataaatataattcatcgatctgggaggatttttgtatacctaagcctcgagcagccacatcagtcgctgtcatgatagggcttttccctgatttaaattcagaaagaacccaatccctctcagcttggcttttgtcaccatggatagacagagcaggccaaccatccat

SEQ ID NO: 65791 - DNA, 12822 bp, Oryza sativa
aagaaagagaacctttttgaagatcgcgaacttgaggaccttttggaacaccaccatatatgcaagtactttttatttttgatgacgcaccaaacttagttgcctcttgctgtatctgcacagcaagttcacgtgtaggggctaacaccagaacaattggaccatcgccaggtgctttaataacacacggaaaaatgttagtagattaccacaaaagaagtccagaatgtatccaagaaaatcggttaagaaacataagcaacatttcgcacctagaatcggctgagcattaacatgaacaatggcaggtaaaaggtaagcaagtgttttccctgatcctgtttcagcaatgccaataagatcacgtcccctcagtgccattggccaaccttgagactggataggagtaggttctacaaacccagcttttgtaatttcttgcaaaacatattctgcacaatggaagttaagtatcttggatcaggaaatatagaatgtaagatgtccaagattaaaaaagagcaaaataataaagaatgtagttcagaaggtaaaggggctcataaattatcaatggctcaagtccaagaatgcaagcagaataatctttgaagagcacaacagatcttaaatgaataacaagtgacatattcatatcctttcctcctgatgaatgaattggctgatgaagtgatgataatgggatttaatgagaggaccaacaaatcctaatcggagttcaaagaaaaccaaatgatactttcaccatttagtgttcagcacttgagctggttgcacatgttatcgctgttggctgtttttctttggaaaaatcattttacaactgttaatcatggcctaactccagtttccaaccctcaacttcgaatagttcaccttttgaccattgactattagaaccacctactgtttaacctttggcctcattctagagtggttctgcagttacatgtcactaatgtgacaatgtggctcaaggttgaaatagttttgagtatttacagccaaaacaaattccgccaaagcagaaattgtggtgtgaaataactgttatgatacttcaattctttgatgattcaatgtagtttacaacacaaccagctaacgaaacaaatagacctatacattcccctcctgaagcacgtccatctaaattccaattcctcctggagcacgttcatctaaattgcatacatagtactatagtaagtgcaggacaagggtagcagtagcacgcagcaaacgaaacctgggaatccgacatcgcggaactcgcgcactggcttgggcacgtcgcggccctccacggtgatctcccggcggcgccggtaggcctccacctcctcctccgtcatgccggccacggagggggactccacgtagaagttcttctcgaaccgcggcagcccatccaggtcagcggccgcggccgcggagtccgccttgctcgtcggggcgaacgccctcgtcccgcccccgaacgccccttcgctgcaaccaaaccccaacccaacccaacgagcaatcagaacccccaacacttagggcttagggtttagaaatcaaaaccacggtggtggagcggttacctgcggcggtcgcggtacgagccggggtccgcggcgcggccgtcgaagcggctcatggcggcggcggcggtcgccggcgacgagagggaggcggggggtgcggctagggtttagggcggggcgcacgtggccggagagtttggtgggttctagaagaagaagcgaagcaaacggaggacgcgaatcgaatttggaggatttggatttggagggcatttcagtggcggcgagttcaagcggaggggaaaagtgtggggagaactgatggagcctatgacgtcgaaaacgtactctgaaaaagcacaaaacccaccagaaaaacgtaatactccctgtgtcttggtgttttttttttcaaaatattgttttcttcgcttcttaaaacggctcaagatggggaaaacgaacttttgattgagccgcggtcgattttaattaaatttagacctagataaatggtttatgggtttcttcatcttccttctttaattatttttcagccttttgactttggactgataacagtagaattgaaaaactacgaattacccccccaactatcatgatcgaccgaattaccccccgaaccataaaaccggacattttttaatcccaactatgcaaaccggacgaattacccccctcgacccaattcgcggtggttttagtaaacgtgggagtacagtcagcaattcttttaatataaaatcagtgggcccacctgtcagttcgccacccctctatctctctatccccaatcccccccctctctctcttctccctcccctcaccagctcaccagcatggcagcattgagaatggcgacggaggagtggagggcgatgctcgggcgctggcggtggcgcgcggaggcggaggttgctcggacgccgatggcgcactcgtgcaaccagcaacgaaggcggaagcgaaggcgagtagcggcacgcacggggcggccatggcggagaggcgatcataccacctgtcatacctcctcccccctctctctctcaggcataaagctcgcacagcggtcggcgtgtgggcgccggtggcgcgcgtcagacgggcagtcggcgtgcgggcggtggtggagtgcggggagacgcggcagcggcgggcggcgtcgaggagggtgttggaggacgagggcggcaggacagcggtaggggcggatggagcttgggggcggcgggcggtggcggaggccgctcagggcatcgaggacagcggcggacagcagtggaacgacggcgagcgagggaggtaggacggcggcgaggacagatgtagcttggggtggtaggatggcgacgggcgatggtggaggccgctcggggcgtcgaggacggcgaggctgaggcagctcggggatgggcggcggaccgcggactcactgccggagcccgatgttgtgtccctcctggcatccctcacccgccctattaagcagaagaggggaacaacgctgcaagcggtggcagtggagtgggggcggcgacgaggggacaggggaggaggagctcatcctcggccaccgacggggtgcgccgcgagctatgtcactgcccccattatgcccgctctcccgacggtgccacacatagagagagagggggggaggaggagggaagccgcgccgagggggtgactgctcgtcgtggccgcatccgccgacgctgcctcctcgttccccgtccctgccgccaccgccgctctgtgtcccccgcctgccaccgacccgtgagagagagaagagagagagaggaagagtgagacagagagtgagagagaagagagaggaagagtgaaagaggagtatgacaggtgggtcccacacatttttataaatagaatattgactggactgccacatattatggattgggtcgatggggtaatttatccggtattgaaagcatagggtaaacgatgtctgattttcgggtttagaggggtaattcggtcgaccgtgatagttcccggtgtgtgtggggtgaggggggggggttggttaatttgtacttttcccgtacatttttatcctagttcgtttttaccaatcatgtgtttcgacttactagacgtaaccgtgatggccaccgacgttgatgacatctatgggcgcaaatgcatcatgcaccttcttacaggagatgatgttgatgttcctttcttcaccttgctgccttgagagttgagaccacaaaaatactttccggctatggtctctcagtttgtacctatgtctcgtgaatggcagacgaaacataacatttcatgcacaaatattctattttgctttcccttctcgtcatcgttgaagcatgctaagagtgatctactgttgttatgggtggggagaaaaaccttgcataccgtggaccgtgcgaagctggtgaatataaataggctctgtttatttcacaaaacaaaaattctcacgctgtcatattgaatgtttagatacatgcataaaatattaaatatagataaaaaaaacaattacacagattgtgtgtaaattgcgaggcaaatcttttaagccttattgcgccatgatttgacaatgtggtgctacattaaacatttgctaatgacagattaattaggcttaataaattcgtctcgcagtttcctggtggaatctgtaatttattttgttattagactacgtttaatacttcaaatatatatccgtatatccgatgtgacaaccaaacctaaaaattttccccaactaaacaagtcctgattagcaaacaaccttcttttacatcaccgtccgtacgttgcctccactcctccgaattgtgtccaagttgaaattttcacatgcaagtacctcaagggtgtttcagatatatttccttgtattccctctcttcaccaaacaaaatgaacaaaatagtaataactgtatccagtagcaaatatttaacttttgataacatctttcacgatgttctataactaaaaccacgaagtcacaatgtcaataaaaaatatcttattggaaaaaaaaccgttttgacaacaaacacacatgaaaacacttgaacaaactttgactgagatcttataagcatttctcacgataaccaatgggttcaaatcttttcgccatcatacgttgcaccggttactcttacaaataataaaacatcctcatctctgctattataaaaaattgaagatatttttatcggtacttttgatacatcatccgtgtttaataggtttttaagttcaatcgtttttagaaatacaaatccatctttgagtcggtttttaattttgttcgtttttaaaaatacagaaggagtcgtataagaaatctctttaaaaaatttacatgctaacttgagacgatcggacccctaattgcggcttatgattttgtaaaaagaatatccaagcgaatttccacgataaatttcaccttagctaaaccgtataataataataagattaaaatagtcttcacccgttgcaacgcacgggtatttttctggttgtataataaacttatcatgacagtaaattaaagattggagagaacttagctaatatggtggtggactcagacgtgggtgggtatgaagtgatcaagagtttatgctaggcctttcggcagccaaatacatagtgaaagtaagagcaggtataataacaggctataagtcggctgtaaatatattttaagaagataaataaggagagagaaaagcagcgggctatagatttgtagccatatgtagcacggactccaagacacagtgtgtgtataacaggtgagaccaggtgttaattgtgtagtatgtaactattgtatgaatgagttattagattggctatagatgaattggagctagtagttagctataatattaaacttgctctaagagtgtgttcgctagttcccaaccagaaccctccgcacgaaaaacggagcaatccattagcacgtgattaattaagtattagctaacttttttttttcaaaaaatggattaatttgatttttaagcaactttcatatagaaatattttacaaaaaatgcattgtttagcagtttgaaaagcgtgcgcgcggaaaacgagtgagaggggttgagaaaaagggcatccgaacacaccctaaggtagccccactctctcctaaacaccccctaaataaggtagcatgtgcttttacatcgaggcctcatagcggtccacccctgagactgagtctcaatctacccccggtcgtgggtacacgatgatcccatctgctagggtataaatttggtgctcatagacaatgtactattgatgtttttagataatagaagcattgttgtgctcagttaattaggaaaaaaagattcatacctggaatactcttagcctctgtataacttggacgcatgtaaccaagcatacacccacatgctagcttttataacaaaggaaagtatagaaaaaaatactaagtaccatcaatccacgtaatatactctcacctagcgaaagtgaacataattcaaatggttagtttttttaacctgttcatgagtatatctaggttttaagttctagaattagcacgtgtactcgtatttacgtctaattatttaatactgatgacatatctgttgacagtgaaacgcgtatattgaccaattcaacctcaagacatgcttataaagataggatgtgtcaaacgctgaaatgaacccaaccaaagtggatgaacgttcactaaacaaaacacatcacacgtcacgttcaatcaaactcatctacaggctgcaaccaacgaagaccgagtttagttctaaactttttcttcaaactttcaagttttacatcatatcaaaacttttctacacataaacttttaacttttccgtcacatcatttcaattttaaccaaattttcaattttagcgtgaactaaacacacccaaagtaaagccctatatcggtctcttcattctccacctcgatagccgccgagatcgatactttgggtctatttggagagctaaaatcacgagaagcggctggttggttgtcagctttataaaaatctagaaaactagaatttttagtttttaacttccaattcattctatagtctgtacaactataacttttattaagatttaaaaatctggataaaaaattagactgtttaagatatattgattcaagagactaggatgtatttagttcatactaaaattggaagtttgattgaaattgtgacgatgtgacggaaaagttggaaatttgtgtgtatagagttttgatgtgaaaagttttctttaaactaccaactttttcatcatttcaatcaaacttctaaattttagcgtgaactaaaagacatctcagacctagtagctaacagaaacgaaacagatcctttgatgtttcatccttatccgtagaataccttccattgcagctccaccactagaaagtctagactctagagtagctcgaaacaccgaagcaagcgaaagagcatcgccgtgccgcgcggagcttttaaaacgccgcaacttccttccttccttcctctcctcccacgcttcccacttcgatttcccaaccgcactccagcgagagaaaataaaattttaaaaggaaaaagaaaaaaaaaagatatatcagctcccgcctggggatgacgacgagctctcgccggcgatggactcaccgccgcaccaactagcactcatcgtcctcctcgtcgtagccctcgcggcgctcttcctcgccctgctgcgcggtcgctgccgctgtcgcgagggcgaggctcatcagctgcccgagcaggcggaggccggcgcgggggtggcggagggggaggagggcgggagggagaggaggaagcggcggaaggcgaggaggcggcagcggaagggcgccggggacgacgacgcggcgggcggcgagggggacgaggcgctgcagctgcagctgctgcggcggcggccgcggttcccgctcgcctcggtggccggcgcgctgcagcggcggatcaccgcgcggtacgacgacctcgcgcgggccagccaggcccactccctcaccatccatcaggtcagcagtgcgccgcgtctctgattccatatcacaaatgtcgcttcagatgcaaggattttgtgcattgcgattactcgaattagggatgtataaagatgtgactccagtagcatgcttgacttatatatatatacaactgggtgccgttcattgtttgtttgtttgttttgctaattgctttcatttcagactttcaagatagaatcagacttaggttttgatattatggatttaatgatgttggttggtacattttcactagtgcggcaagtattaaatcaatggttttgctgactctacatgcggcaagtttgtttaggacagaaataaaaaaactacactagtgttattcacactgacagcaatatatcttcagggttacagtgtcactgttacctgctgaaaaagaacccaaactagagcagtggtagacttctattttgctgtgttggtaaaactagataaatgcatatatgactttggcactatgcagtactcaggccacatgacagtggtttggcaaaacctcattttatttcgtagtttttacgtaggcagagggccatttcctgtgaagtataaattgcacggcgtggtttcatctggtaggtctgcgtcctcttttgctttcttgggtggcacataaactggaatagattagcacaaaggctgagcgaatgttttgtttgttttgctcgtcaattcttggtgcaactttctaactttattggtgtcattggctgttaaagtgttcacttgccttgaaaatttttagaaaggaaataaatctcaaagttgaagattgaacaacgaactattcaccatattcaccacacgcccttctgtaattcatactgaattcatttactacgtgtatgattcatgagatgtgtgacacaccacctatgtattttagtagtagaagtgctgttccatgctccacaaccccgggtcattgacccaatcgacacacattcatggtaactgtgcacggcatatctaatcagaactgaagcttttaatgaaggaaagcaagcaaaagccattttcttttttagaaagcaccaaatcctctaccattgactcaaacaagtgccaagcaaacggagtcatcttaacccctcccccccaccgcccaccgcccaccgcccacccacctccgcacccacgtggccacgccctcctaggaacaaataaacaaaaacaaaataatcgaaatagatctagatatagcttgtgtgaccggctcctacggccctaccattgagggttcgcctccgatcttctgccggaacccatagccatgaggacttcccttgttcgtttcttccttactatcctcgccaacacgtttctccattccccctaccagcactcctcacctcctgaatcatcccaatgttcgacgccgcttggtagcgagagtggaggaaagaggaggcgggggaggagggggaagcagaagggcttgggtgaggtggtgtctgttcacgagaaaaaggaggcaaaaacatcacctttccccctcctgctgttgtgccgtgcaacgagacggcggatcacagaggtgtatgatgagatgtaccaaattgttcgtgctaaaaggaatgatactggcaaggttagtaatattttcttgtatttgtgatacagctagatctggtggatttatttaacagtcggattttagtttgagttgggaggttggtctgttttgagtatatgcaagaacaagaataggaaattttggtgaatgtgtgaagtgttcaccaccaaattattcatcgcctgtagtttttgtgcaattcaagcaggtgctatcagaatttgcgtttctaaccagtgattcagtgaaattaaggtgccagtgtttccaactttctatttttcgcagatgaaccttgattttctattaaggtgccaattatttaaagaattccatttttatgcatcttatgggggaattttgctacctagctagagttaactactccttacagcctcactaacttggtatggatccaatgtatgatccatgtcataaaaagatcactcttagaagttagacccttgtctttacccaattaagtagtatggagtttctattgtgcttgtttcagtaaaaaaatgattcgtaaagaggaatcaaagtgtcgagtggagctcactaatgaaagggagacctaactgtaagttcataagtgttttttcttgcttttatggacataatcttctttattcatcactttgctggataatgatatgttgagcacgtactccctccggttccataattcttgacgttttggacaatgacacggtctccaaagtatatcgttgactttgttttcctattataatatatatacaataaataaatgcatgtttacttttcttatactttgaaagacaaatctatatatgttgttttagttcctttaaactaaatatttttgaagttattgataatcaaagttacaaaagtttgacctcaaccttgtccaaaacttcaaaaattatggaaccggagggagtagtatcttagctgcttgctctgttcctgggttgatcacaatattttggaccatataatctgattaaatggccacttcttcagtgattagattccttggtctgtgtgctctacattttaaccaactatataccagaaataggaatcctgtttgtcaaccgcctttttgtagtagtgttaagactccagaattttgtttcgagttaagagtgaagccaccaactcaaaggacaacacacaattcatatgttctgttatgctgcctcaaccaggtaatatgggcttgagacaacgttgagctgctcaaaagaaaccaaagcttcttttgttcagcgactatttgtttcttttggcttttagttttctacattctgtaacagcctctacgaattagattctaccctgtaatgttgaagtgtatcatgatttatatagcttttaactttttttttcaggttcacgagttcattaactgtttggtagatgcaagaaatgaactgctgcacaagtatgttgctatttgcatgaaatttagcttcagacatccattactccaaataatgtgttatgcctattaggtcggagatggttcaaagaagctgcagaataaagaaggccttactatccaacccttgtagtcgcagggctaacagttatgaccgcctctgcgaacaggtgatgcatttgacaaaaacaaatttcgtaccaacacgactaagtgatacatttgcgaccagaagatctattcatgcaaatctttgctaacaacatcttttgatgtctcttttatatactgacgtctcgggtattggcataggtgcataaattggaagccgagcacaaaaggctaaagaaggatgcggatatctacaactatattcaagagcagcttcagatgtcagagtcatacaaactggtaaacttttactatgttcttattaaaagcaactctgccctgttatattgaaatatgaaggttgtgataacaatgccatttaccttggcagttgattgagcttagtgcgttggtggagaaggccgaacgtgaggatgcccttgccaccgaggccgcagagatgacattcgaggagctgctggctcaggagaagagcgacgccgccttctggcagcgtcacaggaagctgacctcaatcttacccaagtagagtttgataactgaccgcgcgatttcaccatcgtcaatagtagcccgaacccgtaaccagaatttgttcctggtggagcttttaatgttgctagttgcaaccgtggtgtaatgcgcttgccaagctcttgggcgcctgaaagtccagagtccttgaccataaaacctgagagattcaggtggttggctgacgaccagcaaatgctctcatatatcctatctggtacttcggccatgaagatttcttgcctgtggatgccctgatggaattgagctttcttcaatgcagaaacaactgggaccgagccatttatgccacagcctgcactgatgggtgaattggtgatggcttgctgcttgcttcggatttcttgtttctcttttgaggaatggcttgagaaattcagaggcagtagaaggctactaggctagcagtatcatccatggtgcattgctgttcatctttgttcatcttccatctctgcatatagatcatcgagcattccgaagacatcctcagctccggtgagattcggcggcgcgctcccggcggcgaaggcgaccaccttgttgtccacttcaatccagctctgccccggattcttcctcaatccggcctccttcgtcatcaccctcaccttcttggactcgtcccacatgccacacatggcgtacaggttggtgatcagcatgtggttgccggtgctctggtcctcggattgcaggacattggcaatggtggcctcggccatggctgcatcaccatgaatcctgcaggaattcagcaatgctccccacacgcacaggtcaggtctcaccggcatcgtctcgacgagctccgacgcgtcccggagcaagccggcgcggccgaggaggtagaccatgcatgtgtagtgctccatggatggggagatcttgtgcgctctcaccatgcgatcgaacaggcggcggccctccgtgacacgcccggcgtggccgcacgccgacaggacggcgacgaaggtgacgccgtcgggctcaaccgtagctccggccatgtcggtgaacagagcgagggcttcgtcgcacaggccgtgcatgccgtagccggccagcatcgagttccatgagatcaggtccctcgtcttcattccatcgaacaccttccgtgcgccggagaccttcccgcacttcgcgtacatgttgatgagcccattctcgaccagcgagtgcctatctagctcggctttcatggcgtggccatggagctctcgacccagccgtaacgccagtaggtcgacgcaagcggagaggacggtcgccatggtcaccacgttcggcgagagccattgctgctgcattcgccggaacagctccagtgcgcggtcagtgtcgccggacgacgcgaacccgccgatgaccgcgctcca

SEQ ID NO: 65792 - DNA, 3903 bp, Oryza sativa
ccgcagccgtgtatcgccttccctttggccaatgcaaggtcgccggcgtaagggcacgccgagagcgccacggccatggactcggcgttcccctcgcagccgctcctttgcatttcaccgaacagctgaaggacatccgcgtgcttcccgctccgcgcgtgcgccgagagcagcgccgtccacgtcacggcgtcgggacgcgcccctgcggcggccatgcgcgcgaacgcgtccctcgccgcgtcggggtcgcagccgctggagtaggcggagatgagcgcgttccagtggaaggtcgtcctccccggcggcattgcgtcgaacacgcggcgtgcgtcggcggcgcggccgagcctggagtaggcggcgaggatctggccggcgacgtcgtgctgcgcgtggaggccgaggtgaagggcgtgggcgtggacggcggaggcgacgcgcggggaggcggcggcgcggagggcgagggggagcgtgtaggagttcggcagcgccggggagagcgcgcgcatgcggcggtagagcgcgagggcgaggtccccgcgggaacggccgaggtgggcgcggaggaggcgattccatgggacggcgctggtggtcggagggtggtgatggtggatcggttggtcgccggcggcggtggagagatggcgcgcgccgcgaggccgatggctgggacgagaggtagagccgcgagcgcgaaggagacagcgcatctgggagtgggtcccacttgccagtaaaagcaaaagttatgaactccggattatattataaatcgattgacttttttatttatcaaacttttttttaagtttaatcaaatttgtaaaaaaaatatattaatcaatacaaatatatcaaaatatatttaatattaaatttaatgaaactaatttaattttatagatgttgctatttttttctacaaacttgatcaaacatgagaaactttaacaacggaaaaaaaatcaaacgacttctaatataaactgaggaatggatggctgaattgaattcagggcaaaaattagcactgcaatctcgccgttaagtacctttttttttaccctcaaaagttaacaaaacacgtacaattctgggttgcttcacaaattacaacatgaacatacaaagtcagggaggggcacatcaatctggaacacatcagggtgtaggagagaatggaaaccaagggaaaaaaaaaaacaaggataaggtagatgagttagctgtgaagaaagtttttgtcagctgcatcggtggccgtcttctgaacattcagaactttgagatgatccctgaccagcagaggatgtcatgagtctctgcggagatgtagaatagaaccaagattagcatgaggcatataacttgcattttgcacaaacgatttcacaggcatagtgtactaaagagatgcttcaggatatgcatactatttactggaagtgtagagcgatcatgtccttgagttgctagacctatcataatatggaaaaaggttgagcagaactattctatggaacagccgttcaaaaaatgtacctgacgatcttaacatttctgaaggacagcatcacagtaagaatcaaggtaaccatcgcgaagcaaaggtgctccaaggaatggccgctgatgaagtaccggttcacactgtatacctttctgtcagcaaggccttcaaatcttgcaagaaggtaaaaacctgcaccaagatgccaatcaaacaacagttttcgttcaagcttttttttgtagaaagagtttctgctaacataaccttactacataagatgttaacggttacctgtggcaagaaaccaaaatcttgagtgtgtatattttggaggaaacaagaatagcattgcaggaattgcaatgcaaggagcggaattcaaaactacccataaccgcatatcatcaagaaccctgaaatcatcgagaacagagcaagaggactcattttattatctgatatactgacatcaacaatggaacacgctataggtgctggggcactattacctttcacatgcgctgctcaccagtatgagagataagagtgatagcaaacaagataacccagccctttcatcaactctttcaattaccaatatagacaacattgaagaagctgatatcatcatctgcgttcatagcatccagtgaacattcatatcgaggaaaaggatagatacatattcattaatagcattggttatgcacgataacatgatagtcagattggctgcctagcacagtagtatggaaactcagacacatccttttttttctctttttgcctatggttaatacttcgatgatattaaggacattcaagtaggtgaactgcattttttgaacatgaactacttaatacagttttttctcccaatggactcgaagcataaaatgacaacatatcaaaaaaaattccaagtccagaaaccatggaaaacaccacgaaataagtaaacagtagatggggaaattacagaaagatgagatatttagataccggcaacctgtcccaaattaagcggtcatcatctggtttgaggtgatagtaagccgagccaaatgctgctgctacattcccagcatagaagaggaaccatcccaaggcctcccatctcaagctgcacaattccacagtaaaaacaaaatattaaacaccagatcttacctgctgatctgtttttctgttaaataaggatagcaaaataggaatatctctttaagcatcatgccctcaataccagcctagttgtacaataagcagtatttcaagaaacatgaagatcacacacttgttaaataaaatttcaacatcaaatttaaagatttgagtacacggtttggtggaacaccctagctcaaattccattatatacccactctataatatagcaagattacagattattaaagcaattagatgaataagcatgtaatagctacaggcccaggcaaagttatactagcatagcagcaaaaatattatttcactggtcaccaacattacagtccatctttctctcagacagaagcagtttattagagccaggggagttcataaccaccctttcactttggtggtaactgtaaataagttcataaccaggggagtagtaaaatgagcagttatgaaacaattaggcacaagctggcctcctctctctaggttttcgagcataatcagggtaaattgacctcctatataattttgttcaagctcgtggtactcgattctcgaatactttaattacagctcttccctcgctgcaaatcacgaaacaatgtaacttcacgcacttctttataatcctttaggcgagacatttcaccgaacagcagccgagcaagggcaaagggcggagcgcgcacctgatgccgaagcacccactgccacagaggcagaggacgagcccgggcacgcccgccaggaggagcgggtaggcggtgagcacgttgagcgtgttggggacgccgaggaggttgcgcatgtcggcgaagaggtggagcgcgggggagtggcggagccgcggcgtggccaccaggagcagcgccgaggcgaggacggcccccccggcgagcgcgcggcgccggtgctcccggcggagcgccgcggccgcgaggtggccgaggccgaggccgagggcggcgcggccgccgccgccgcggtgggggtggtcggcggcggcgagatgcatgtggccagggggagtgctcagtggagcagaagaatgcggtgaattttttctggtgttgggccgccttgcggttgtgggcctgcttttttggggattcttttttagccaggtcccttccattcatcggccatacaaattagtccctgggattcttttcaagttcggatgagtttatagaaaa

SEQ ID NO: 65793 - DNA, 8067 bp, Oryza sativa
gcacaacttttcccacttcactatattttctgcacgcacgtttcacaaacagttaaacatcgtgtttttcataaattgtttctctagaaaagctgttttaaaaatcatattaatttcccttttcaagtttttttagcaaattttattaactaataatgcgctaataagagatctcgttttattccatgtggaggagattaattagttcccaacacaaggaaatgaaacagcctatatggtaatgggcatgaggcatagggcaagaggtgtgttcatggcgtaccataatatgtttagggggtgtttagatccaccccaaaattttacaccatatcacatcgaacgtttgaacacctgcatgaagtattaaatataggctaaaaaataactaattgcatagattacgactaatttgcgagacgaatcttttaagcctaattgctccatgatttgacaatgtagtgctacagtaaacattgctaatgacgaattaattaggcttaataaattcatctcgcggtttactaacagattctgtaattggtttttttattagtgcccgaacaccacatgcgacacccagccctatataatatccgatgtaacatgccaaaactttacacccctagatctaaacacccccttagagaaatctaagattctcaaaaaacaagcaatttactagtgagaaacggccaaaatatttctctaatatatatatttctccaatttagattcgcaattgccgagtatcaactgccgagaaacggccaaaatatctctaatagcattaatatttcatatgctatattgtttcaaaaaaattatttcatatgcgatatacttggagtcagggcaaattttactttggcgtaccacatctgctatataagttggggtgatcatttggcgttcaaatatgggaagttgggcggcgtcgcggcggtgaccgaaaatggaatgctcatgcaaccgcactgcccggctgcagatctccggttagatacgcagtactagtacttgtcacattgctatcccaatctttttcttaaaaattcagatcaccaggtactagcttactactccagtgatactaaccactactactcctggagactataataaacatatatatatatatatatttagatttattctctatcaatcgccttaatttgaatcaattatgtgcacatgttgtacaattaattcacgtacgcatcgaccgacgccggccgttaatttgtttcagttaattaaagctatcagctaagttattatgtgagtgcatatatatagtggtttcttgtcatgcgcagacagatcgagtgttccttgtgcaaacagaaagctactcgatcatatttcggtcctcaaattaattaccaattaattaattgataattaatcaagtcgttgttggaactaaacacagattggccagctcaaaagcaaccaacaatgtcgttgttatccatgtgatatatcgatgatgatgtgaatctccggtgtcgttagccgtcgtcgtcaattgtctttctgatgattggcttacatcgatcgatcgagctctgcaaggtatcaggaaaaggccagagtttctttccccagattcgcctgaagatatcctttgcttcgatctccctctttctccatcgatcttgactcgtgatcacgtacgcctttctgggatctcgtgtctcttgtttccatatggatcgatcgatcgatcttacgtcaattctggcttgatacacagtacgtgctggatgtggaagatctgtaagaaaagcgggtagatagctaggtatatactgtatatactccccctgtctcataaaaaacgaatttagatcggatgtgatacgtccagtactatagatctgcatagatatgtatattcaaattatttatagtgctagaaacgtcacattcggtactagatagttttttatgggatggaaggagtaaatatatatactgaagctgcagacgtcaaaccaaatgtgtacgttttttcttcgtgattatcttgcaagatcttcgtaccagatcctgatttaatcgcatatatcttatacggtgactagaaagtactacagcctcgatctttcggagtaaacgattgatactgtatttgtttacacataaagcaaacagctaaagctaacagatttagccgaaacagatcccaaacagtatcatacaaaataaagctagataggtctatatacctatataggtcatgatcctacatcagccaggaaaatgtcctgaattgatgcagtttaatacaaggactgagctactaggtgtatgtatgtgattaatttaaatggatatcataaaatttgatacgatagagtacgatgatacaagctcttacataaacacgtaaatctaaattcgaccaaaaataacaaatgctaattgcactgcagatgtttagcgatgtactacggctagctgatttaacttttttttcctagttgtaaaccgaatttagtttatggacttattttatcatcttaatcgataataactaattttatatttttttaacatacttatttaagtctcctgtaaatatcttaggtataaaataaagtaacttttgtccatatatatatactcctacacagttatgcatgcagtactgttcctttcagcggtagtaccatcggagatctggctcggatctagcttgtacacccaacatcgagcactaataattcaggataggtgacaagtcgtcactctcacagtacagattgctactgctgctgcatgtcgcacaaaatctcttcacgtcacaaatctctccacgtcttcatgacgtgaagagattttcaacgttggattttccatctgtactacgtacagcgctgtacgtacgtgcacgtagacgtacgggccccgttgtcacgtactccctccgtaaaaaaaaacttaatctaagagaaaaatgtaacccctacatcttctcccggtataaatttaaacatatggttgtctagattcgttatattaggaggtgccacattcgattcaagattgaatttcttttggactgatcgagtatgtgataattattagtataagctgacttcccttttcgtgagaaatactgtatgagaatggactttggagcatctagatctctctcccccaaaacaaaactctctcacacacacatatacatatacatatacatatacatatacatatacatatacacacacacatatatacatatatatatatatatgaatgaatttagatatacaagtattctagaagtaaatttttttttcttggacgtaaggagggatatcttactagcattcatatgcatggaaaaatattgcaaacttataatacatataactaagattaatttagtttacacccacaagacgacgatagatatgcatcatgatgcattcaagcatgccgtacgtttgagatcgacatgcatatgaaggcatccatgcatgcatgcaaattggctggtagtacactagtagtacgtagtactgtactatatatttacatacatgacctaattaattaattaaaaaccaacttcttctaatcatacatgcggccacacacacgtacttatcacctattagttggcatgcatgcatcacagtactactttgcctctccttttagtaggcaaacacactacttaattatctcgcactacatatatactactactccattatttatattagcttgactagagcattgtccattgatcgatctccctgtcaagcttaattagctgcagtgtgctataacgtatgcacagtacacccatatgtgtatgcatacatacgtatatatacgtgtatatatacgcatgtagatatgcatttgcatacatgtgtcatttcatgcgagtggtgacgtgaaaatcccctggccacgggacaggatggcctttggatcatacttgctcttccgctgcacgaatcttggccagagattggcaccgaagtgccgcttctgccactctgcctggctgccgtagtaaggcaggtactgcttgtaggctatcccggccacctcgcagaaacccaagatctcgtcgttctgctcctccagcctccccacgtcgccggccgccgccgccgaccgcaggatccccaccgtgtagaacacctcgtcaccgtcgtcgtcggtgatcactgccgacatgttactgtcccacctgaaacatatccaggtgtgtgtatgtttagttaccaccatatatgttaaaattaaggaaagtctattcatccttcaagagaacggacattgtttttcatgtcgtaaaagaaccataaaaatactctggaaatatataatataccacttcataaatatgtacgtttaaattcaagtagcatactagcataagtaaataaataacttagtacacactatttgcagtcaaatttgtttttttactacttgtgcaagttgagtttaagattacaatgtttatatagtgatatataatatatttatgtatcatattaattttttatttaaacattttaataagttttcagacgacacgcacaatatgaggggtcgtcattttgaacgaaaaaatccaccccgtaaaaattatatacatgtgtatatgtagtaaagctttttattattattattacttgttgcggttcatggggtagatgaggacggggcccatggcgggggtgcggctgaggatgccgtggaagacgccgtcggcgaaggcgaggacgccggagcgggggaggaacaggttcagccatgggtgcggcacgtcccagagccccgcggcgcggagcttgagctcgccgtcgtggacgcggtccaggaacccggcgtacgccacgtcctgcgcgaacacgaacccgcgctcgtgccgcagctcgcgacgcagcacatccatcctctgcaaataaaatcaagcaaagaaattaaagcatatatgttggtaaaattcatcaaattctttgcagagagatcaccgaaatttgatcgagttattaattttgccagcactagcagcgtggatggacaggtggcgacgtgacgtcatgcaaggataaagtgaggcagtactttgtccacatgtgtgtgtgacgtgtcacgtgtgggcatgcaggatcttctcggatcacatagcaaaagctatagctaggaaatgcaaactgtatatgcatggaataactagctagctatctatatagagccaacatagttggtcggtcgtgttgcaaaagatgggggctcatgcatgcatatgcatgtgtgtgctaaagctggctagctagggttataaccatacaagctgatgcatgcactgtatctagtggcgcacagatctttggctggcctgtcatccatgagagatccatcatatccatcggtttccagcttctagcctagctagatacatgtaactatgatcaaaagctagctagctagcacatactatgtgatgtgtcaatggccacatgatgcatgcatggatggtaggtccaagctggcgatgctgatttctttctggcaaagctctaattcctcagtcccgtaataaggcagcgttcgtttggacgacattgagggagaaagcacctcgttttccgcaagtacgctttccaaactattaaacggtgtgttttttgtaaaaattttatataggaaagttgctttaaaaaatcatattaatccatttttgaaatttaaaatagttaatactcaattaatcatgagctaatggctcacctcgttttgcgtatcttcccaatctcctcaatccccttctcctcaaacacaccagtttatattttgctcattccatttattctaaaataagtttatttttaaaataatcattgcatcggagtttgtgaaaatagagaataaccgaaatttgtagtactttctattggtatgtgtgagatggatgaaaagtgaacttattttgggatggaggtagtacatggtattactagtatatgtccatgtctaaattcattgtattagggtatgtcccatccaattttaaattcttatattttaggaccgatgagtagtagttttgtgcagaacaacagatatgtgcgtagacatacactaatctagtctagctacatgctcaaaattgatactccctcactttaaaaaataaagtatttttatatgcatttgtctagatgcatataattagaaatgcttatattttaaaattgagggagtatatatatgaaccctctttggtcaagatgaaaatgtgatgtttaagtcaacttttagtaactttgaacatcaatatgtatatcttcataaacttttgattggttatatgattttccttaaaaatatacttttacaataccataattttattacctttatttttttttaaaaaaatataatacaaaaatacctgttaaagttgtgcgttctgaagactgtaacagtgtttaaaaagacaagtttttccttgatgtgctacaaatactgttaatgatataattcgtcctggtagctactacctacactagcacgcatgcttttcactgttttggacgaaaaagttttcaccataagtagctaaaagaatatgtcacgatcagacgatgcatatattttatacacctgtttaagcttagtgagagcgactaacctaatactccatatactagcttactaagttgctactatagtatctaatctttgtctctccgggaactaaggaagataaaaaaaaattaacacagaatcgaataattatttaattacttccagttaggtgtgtgatagcgagaggtgcatcgcgtggcagacaaaagtggtaggccaagtacgacgatgtcgacggcgcaagagacttcaatttcatgcaccgttagggtctgtttggtttccacggacttattccaagtccatgtcacaccagatgtttgaatactaatttggagtattaaacatacactaattataaaacatattccatatcttggactaattcacgagacgaatcttttgagtctaattatgtcatgattttgacaatgtgatgctacaataaacttttataattatagattaattaggcttaaaaaattcgtctcgcggattagctctcatttatgaaattagtttttttattagtctatatttaatactccaaattagcgtccaaacatccgatgtgacatgggctaaaaagttttagccccatctagaacaccccttaattgcatgcgtgcgtaagcgtaagccccaggtggcgccaaaagtttttgcagcttagttgttcccgccatcatcacgaggtgggacccgctctggtcggctcagcgcagagcaagctagtagctagctagtataccttgtcaacgtcggcggcggacggcccggcggcgccgccgaagtagatggcgccctcgaggaaatacagcacgccgccggcctccttggcgagcgcggcgacgcgggcctcgtcggcgtcggagaagaaggatgaggaggaggaggaggacggcgaaggcggctgcggctgcgtgcgccaggtctcgaccaggccctggttcaggtggaccgagccctcgacgtagtccatcagcccgcccaccgcgccggcgccgccggcgcgatcgacggcgatgaggcgctcctggtcggccgtcatcgccgccgccgtcgtgtacacgaaccgcacccaccgcgccctcgccggcgccggcgcgagcgggatgcgcgcccgcgtgatgacgccgaactgccccagcccgcccagcaccgcgtcgaacaggtccggcgccttctccttcgagcacgtcaccatctcccgacacctgcagatacatgtatacgtcaaaacacctataccttaattacctcgatcatggcggcgcgtgtcttagtagatgtgatggatctacgtaccggtgatgacgtcgagctctagcacgttggaaatctgggggccatggcggaaggcctggccgctgatgccggcgttggacagcgtgccgccgacggtgaggtggaggtagtctgtccacgaca

SEQ ID NO: 65794 - DNA, 2437 bp, Oryza sativa
cggcggcggcggcggcgagccgaggcgccccgacgccggcgacggagaggttgccaaagtcggcggaggcgcgcgcggtgcccgcctcgtcggcgcggatgagcggcgcgatgccgaggtcgccgaggtcgtcgaggaaggaggcggacgaagccgacggcggccatggcggcggcgccgtggccttgacgaagcagttgagcatgaggagcactgccatcctgacctgctcttgcttcattatcaatcaatcaatcgatcggtttgtgtgtgtcagtgtgtgtgtgaatttgtgtgttcttgcaccattgtagaagggacaaggtggcctataaataagcagattcttgtgtagtttgtgtgctgacgatggaaggcagctgatagatagctagatagacagtagagctgtggtgaccgagacttgaggctctctgagatctgtgtgacaaggactgaaagatttggtttggtttggtttgtcgttttggagattaggggagagtctttttaaaggctaattaagggtgatatatatccttctagaatctagattacatggtgttgcatgcataccatggtttgtgagaggtaattaaagtcgatataattaaacacgtaaaagaattaatacaagtgggaatataataggtcacatatatacatacactaccggaatccagaattctgggcggccattaatttgtactccacaagggagttgtatgcaggcagttcggccggtaacacatttgaaccctcgagggatatcctattatgtattcgaaaaccattcatgaaaaattctcaaaagaatttaccactcgacaaaatttagtcaaaaaaaaaactaacttgggcctaatggctagcagcacggttagtatagccaccctaggtttgattccttccttctccatttttttttatattcagtccaaactagctagaccacacatccaaaaataaattaaaaaagttgagacaaattcagcatataaaccctatactattaacacattgagatgaaagagcattagacaaacaacccgttaattttacaaggacaaatatataagtgaaccagtaaacttaaaatggaagataaagaaatttcacatcccccgcatagaacgctaggtatgttcagccaattagttcacctaattagctttctcaaattaattagttattaggttctaggtataatatttttaggataaattttaaatagtagaaacacatcctttttgagacggatgcaatagtcgtcgttagcccttgcatccctaccatgcaatcgatccggccatagagaatcccataagaggatgagtggtatagagagattgcacgtctatgctgcatagtgtgccattacctatagcttctcgttcaccctgaagtgcagtgcctgcgataactaatcttcactattataaacattaaaaatatttttttatctaatattttggtaccttgctcgagtccatactgatttttcatccatcggccctggcccgattgtttcggtgctgtgtgtctttgtttccactcctaatcagtgtgcgttgtgagttcaagtgcacgcgttgcgcgattcagtcacgacgtccccatatctcctgctgtttccaggactcgacatatgtgcactttggcacatctcctagatggaccgaggaaaaacagaaaagacgatacgtagagccttattatacatacggaactggtcgaatattggtcaagacatgcttatgtgatgcattagcgatcaaatattaattcgtggataatttttttttatattttttcgtgccgacttaaaagctcttgcttaaaaataagctacgataaaaggaaaatcaaaatcaactccgaaaattaaatttgaaaatcagctatatttgttttggaaggggttagatcatgaaaatcaaaccgtgatcatctaaatgctaatgcaatattagttttccctttgaaatgcacggatcttttttccagtgcaaagaagaaaacaaattggtacgagagatgacattttgccttgcctcccattgtatcgcgtcgcgtcgcatgcaagagctgccaaaacgaaacattgtacgattatatatactccctccgtcgctaaatatttggcgctgttgacttttaactatatgtttgaccgttcgttttatccaaaaactttggtgaaatatgtaaaactatatgtatatataaaagtatatttaacaatgaatcaaatgataggaaaagaatcaataattacttaaatttcttaaataagacgaacggttaaacatattttaaaaaagtcaccggcgtcaaatatttaggtactagtattatatttgcgtggcgatgggagctactccatccgtttcaaaatatttgacaccggtgactttttagcacatgtttgaccgtt

SEQ ID NO: 65795 - DNA, 2549 bp, Oryza sativa
acggtgtcaaatattttgaaacgggggaatatattggtcggccaaaacctagtacgtgcgtgcacacagcgaggcggattcgtagcgaagcatatgcatgcagcccaccgacatgtagatctttgattctttggtcgatcgtttgtcgtcgtgcagggcaggtggcgctgtcgtggccgttgatcgatcgtggtgacagccaaacgcacgttcgatcgatccacggatccatgattttatttgccgctggcctgcgcgcggctgcagacgtacggccaccggccggccacctgatcgcgctctcgctctatagctctcgtacgcgacgcgcgcgggtaaccagccgcgtgtgcttgcacgtactcgatcgtatacgttgcatccagctgtccgcatgcattgcagccaggagagccgaggagtgtcgctgctggaggttctcgtacagaaactttttttttaataaaaaaaaacacaccgtttagcagtttaaaaaatatgcgagcgaaaaacgagaggagaaagttgggaaccagccgtgccgaacacacccaaagcttgtccttaacccttgtttatttccctcctctcttatgaatacatgccactctatacatttagttctttctttctaaaatatatataagaacctatagtatcggatggaacactttagtttttattactacgacacatttttgtgaccgactctggaatatatataactttaaactgatcaaattaaacggttcaaaactttgttgctaagttgattttttataattttaatttaaactgattaaattaagtgcatggttgagaactttgtttataagaattttatatgtagcagtgctcatccgagaaatataacctatcattatctaatcagtattacagatcttaaccaattaccttttcttacagcagaagagatgcacgtagatgagtgaatcatatatatacaagtcgcaatcaaagtaatggatccaatcaaggtgaaaagacgaggtgtggccgccgtggaaattctgaattaggagatatattgcttaacacagtattatatataattagttgaagatcgtatcctaattaagtcatgaatgaatgaatctctatagctacggtggtcgaccgtcaatggtcattcctcgacgtactaattaacaaatgaatatattcgattgtgtacgtgctagatcgatcgatgatacgcaattatttatgcttctttgtccaacatgactcatttcacatcctgcccgaatcttgtcgccttgacaattttggcacatgtacgtacagtggcgtcttgatctttatcttagtggcctctctacagatagatatcgatccagctgagaacttgtcaggttttatcgaggaccaagttgccctgccatgtgtatagtgtttgcggatggacagcttttacggtatgcagtccaaatatatcacataaatatacaaattgtatatttttcttattacacgaaagatgtgaacacatgtgggagttggtttcattcctttcccaatcaacctcactcgttttcatgcgtacgcatttttaaactgctaaacggtatgttaaattttatttacaaaaattgcttttaaaaattatattaatattttttttaaaaaatataacacttaattagtcatgcactaaacatcactttgttttgtgtgctaggagtgaaggttcccaacccttgcccccgaacttagtctaaagttctattaaaagtgcacctcctactatgtgcatgtgtatcataagggagtgtctaaattctagctacctgaaactaaattttctatcatttttttcatgcatgataatccaatatggttctcatatcactccctattatttattcatttaaataaaatcccttcttagtataaacaggttgaacaaaaaattggtaacatatatacaaagatttacaaaattacatgaaataaaaataaagtaaaaacatatataacaacaaaattgctgttaaaacggagtaaaattgcacatatatctaaatattctaggtgtccagcgcttgaaatcaaccaaataccatgtatgtgtcatctaactaaccctacattcatgcatgtgttgaaataatatgaaagttttttctgtttacgcgcactatatccgtgtgttgtgacggagataagaatttaagatcacaagttgaagaatggaaagcaataaaaaaatacaagagtggcggaattggtgcagagcatactgtcaccctccaattccaactcccccttttgaaacataatttttatatatttcgcacacatcatctcgatcagatttgcagaaacatatggtgcccagcatatctaaagcaagagatgcagatgacgtcaacaaaccgttcaatttgatgagatttgttcgtataagatcttcacgaggatcctgaataatcctgatgcaggcgtagacttaattacatatagcatccagtgagtttactcgcggcaaaaggtgaaatttgcgatctccaaaaggaaacaatact

SEQ ID NO: 65796 - DNA, 1463 bp, Oryza sativa
tatgattctttctggaattcctctagaagagtcatatttgcaacataggctggatttcatggctcaacaggaaagaaaaggaatcaagcaaggaaagataccaattgatgagtgctattatctaatggatactacagaccctaccggaacactcagacctaatgaagtctgcgtgatactgttagttacagaattaccccttttgcatctgcatatcctttcagcggtttttatatgtatcagtgatcctcagtttactattcaccagtcaccatatagcataggaatatccactatccagcatggacaccactggaactgctttaatgtcttgtaattttgtttagtagaaatgcaccaaaattgccatgctttcttccaagttcttgctgattagcaccataaattttgcactttaacaaggtgagatggagtttttgcaatttccttttagcaatgagaacgcatttttgtattcaaacaattatatattgctggcaatgattttgattgcaattgtgaagttcgttggtaaacagcggctaaagaagatgtttagactagtaacttatgatactaaatacatctgggtatttggggcttcaggacttcaattgcatttttaagttcattttcccaaatttagactaacttgaacatgtagtcttttagacatcaggaaattctgtgtgctggtttttaataaaaagaaaaaagatctcaaatagaagatattatggattattaaaaggttttgaatttgtcaatgttaagaactaatgttctttgtcatatttcttccttgcatccattggtttggtactgtatcacttatgtttgatcgcattctggtttgttctttacttattagctttatctgctgttcaacagtgaaaatggccagttttctggagatgttcttgtttataaacatcctgggttacattttggtgatatacatgtcttgaaagcaacatatattagggatctagaaaaggagtatgtgggatatgctaaatatgctatactcttccctatttctgggccgcggtctttggctgatgagatggccaacagtgattttgacggtgacatttattgggtctcaaaaaacccaaaggtttgttaatttctaattgacattttgccttattgtgcctttgtgcttgattatctttcattctcattaaaatccgtagtgaagttttgcttggttccaccctcgttcatagtgtagttgttccatccatatggccgtgatgctattttaactatggtctatatttattgagtctatccatgtagtcttcttggaaacactctcttctttgtaagaaaagtggcccttgttaaaccttaagggcaaaattggaccttttgccaaacatgtgttatgggcaaggtttcatagaggataaacaccgccaagtggatagctggaaggtgttggcttggttgggatg

SEQ ID NO: 65797 - DNA, 1318 bp, Oryza sativa
cccttctaactttttcatcatattgttctaattttaattaaactttcaattttaacgtgaactaaacccacctttagttaaaagtatgcgctgttgcactggcaagcagagctagctagcacggtcctgcagaactgaacctacagatcgaggccgatgcattatcgtccgaggaaatatgatcgaggttgcatatgcatgttgccgtgtcgggtgccggccggctttgcgtcgccctgtggcatgtgcatgtttgctagctagctactgcatgatttctaattccaaattgctacttcctctattctaagggtgtgtttagtttcacgtcaaaattgaatgtttgaagaaaaaagttggaagtttatgtgtgaagaaaaattttgatgtgatggaaaaaataaaaaattaaagaaaaagttggtaactaaaccatcactaattaagtttatttttcatcgattccacacgtatcaatacatgtaaaaaactaaaacactcttattttattaaatcccagtgtagctatatatatatatatatatagacacacacacatagatatatatatatatatatatatacacacacacacacacacacatacacatatatatatatatacacatatatatatatacacatatacatatatatatatatatatatatatatatatacatatatatatatatatacacatatatatgcacacatatatatatatatatatatatatacatagatatataatacatatatgcatatgtatatgtatatatgtatatgtatgtatatgtatatgtatgtatatgtatatgtatgtatgtatgtatatatatgtatgtatgtatgtatatatatatatatatgtatgtatgtatatatatatatatatatatatatatatatatatatatatacacatatatatatgccgcgtgtgaaatactgaaattaagcgtgcatgctgcgtaagcactgacgatcaaactacgactctgcagtttaatcacgttgtccctgttgctcccatcttcaacgtgctccaaagtcgccaacattatttatacgcgactaaggcttcccttcaaacttccaaaaattccatcacatcgaatatctgtacacatacataaaatattaaatgtcgataaaaataaaaaccaattgcacagtttgcatgtaaattacgagacgaatcttttgagtctaattgcgccatgatttaagaatgtgatgctacattaaatatttactaatgatggattaattaggcttaataaattcatcttgcagtttacagacggaatctgta

SEQ ID NO: 65798 - DNA, 5834 bp, Oryza sativa
tatttatgtaattagttttatagtagtctatatttaatactctaaattagtgtctaaagacagggactaaagttaagtccctggatctaaacaccactaagtacattacgtaccgatcgaattgaaatgcatcgtacttgcacaaataaattaccaatagatgtttgtcgctgcagttgtaccgtgtacgtacagacggctagctagacggaagacatccggacattcagttgtgcttccctttcagcactactgtcggcaattgtactggtatattatctttccatccacagatatactcgatcagtcttagggagtgtttggtctccaaaaaataagttcataggtccatctctcctaaacacccctagaatacgcttatttttagcttcttccatttatctaaaagtaatttatttttaagtaactgttacatcaaaatttatgtagtgaataaatatgttaggagttgataataagaggaataattgtgttgagatttgataaagtgagaatatattctagtttttttattgggatgtgtaagataggtggaaaatgaacttattttgaaatgaacagagtaagtgtacatatatattgattatagttcttaaaatttatttataaatataagcatttctaaaatataatgcattccccaatccaatcaaaacactgcatcgccaggcttgatttaattcctctaatcaaataaagtttttgaaatatcaaagtaactaggggattgccccgtgcagttttgcacggagctatataattcacatagagttagatttaatatacaactgaaattttatttctatagaaaccattatatgcagaaatatagttcaattcatatacaactccgagattctattttcatatatataagatttggattttatatacaacttttagattttatttcaataggattgaatctctatagatataattgtattttgtatataactatattaatccatctatatcgttattatcggaacccaccgcaatctacaagatccttttcttttaacgtgggaatttctagtctccacaatgaagtaatgattcttttcaaggttctcttaataatataatagattacaagtgaatttaatttctaataaaacataaaaaatgcttatatttgttgataggggagtaaaagttgatgtagtgattcccataagtcaatctcaacatattttgttgacttagatgcacaggatcgcttgctagcttctttttctcttgagctgatgtacaacataagtacatatatatatatgacttggtacgagtttaaagaacacagttgtcacgcacgttgcgatatccctatctccctctatatagatatattatatatcgaaaacaagaggcagttgtggtggtacttctggttggtttcgataagtcttatcgaattaatcgttaatgatcaacttgcctgtttatcttcaattagggaaaagagtcatagaattgttctaaatctatacagcaaggacgataggatcttgatgcaaatgacgcatcaacggcaaggtcggcaatacgtatgataatgtccttgctcattaatgcccttttggttttttttatctgatggaggaagtatatacatgttgattaacaaattaatttttttttgagggaaaattaattagttctcaagtgaaattgatcaaatagaacgaaagagaatatagaggattagaggtcgaattgccgggttgatcatcatatcaatcaaagcaatcgaagacacatatatgtgagttgattgaaagatgcatggtacgcttggtcgaaagcatttcgccttcgccggcgtccaaatcaaacgagcaaactgttgaatcttgtgcgatcaggagcgttacatatttggtgaggtgaggtctccctgttgccttgacgttgatcatctctgccatttcatcctctctctctctctctctctcttacattttaccaattttttctccctctgatcgttgaatcttagttgctacatgctccttttagtcgatctcttcgtgcttaaattgtaccaattcgaagcaactatttttaatgaaccggtatttaattagagggtgtcaatttcattggaaatagtaggagtacaagttgttgtacaaataataagaaaaaaaaaagataaggtatgcgtcttttgctcctaatacccaagttttggtctccttgattttcacctctaaggatcttcgggagttctgtgttagaataatactctctccatctacttttgatagttatatttttatcttggcacacagaacaaggataagtaattctacttatcatccatttaaatatgctactagtcattcctcgtaaacaagcgattcattaatatttacatgtctcaatgcccatgtagccaatcacgtgtagaagaatgaagagtcatgcattaaatccaagaaagtcattaagatgataagttgttggattgaaatatgcctatcaaaaataaaatttttagatttggaaatatgactatcaaaagtagatggagggagtatatggtttctctccttttaaatttatcacgtcgttaataggacgatggtgcgaactttttttttttttgtcccttaaaggtggccaaagtcgtgcaccatgaccatcgtagttgtacaccgtatcgtcgttttgatttgctcaagtgaggtccatgttgagatcatgtcccatatttttctcgtgtatctgcattttaataggaggtgataggacggctttggatatgacggcaaagcaagcattaggtattatttggccagccacagattgctagtttgttattagacatccacaccctatttggcgaaaatcttgcatttcttcggcgtccactgttctagatcgaatgcaattgcatttgtcatcttctattttaaactcaggaagtacacatataaaggagatttgagaacgaattggagaacggaagtgtgtaccgttcaagtgggccttaaagggagaggcccagttttccaggaatgggctttgatggttaaggcccaaagaacctcacaagaatggagtccaacttgagcaggggaaaaggtacggagaaagtccaccttgactcccttaaatatcggcgaaatctaatttgtacccctcaacaaaaaaaaatcggatagaatgactcctgaactattgaaaccagtgcaatttgactcctccagtgattttggagggtggttttactgacgtggcggtgttgacctggtcttagtcccacgtggcgcttatgtggcataggaattaaaaaaatcagtgggaccatatgttattaacacacaaaaatattattttgggacccacatgtcatccccctctctccaactactcttcccttctcccattctcctcatccggcggcaacttccccactctctctcccggcggcggtgcggaggtagggcacggagatccggaggcggcgtgaaggcctgtctcctctcccccctctctcccggcggccatggacgacaaggaggacggcgtgtggtggggcagagatgttggcgccggcggcggggtggtcgacgaggaggacggcaacggaggaggcggcccgagagccaacgccctcgccgtcgggcccttgctgccgcgcccttgctgagagatgttggcgccggcggttgaggttgaaaagggtaagcaaaggggaagggcggaccgccttcaaccgaagccggccgggccgttgggcaggggcaaccattggccaggcttaggggtaccttcctccccccggcggggcctccctttccaccaccccatcccccggccctccccgcagaagaagagaaagggaggagaaagagagatagaaaagggggagagaggacggccctccgcccctcatccgcctagttcgccggcgacggcgcagcgcggcgctgaggctaggcggcggttgatgcaacgcgaaggcgccctggaggcggcccaggcggtgtcgggtggcccggccggatggtgcacgacgggaggggaagaggcgacacgggaaggtggccgctgcgggtcgtgctcgtgcggccggctcggtcgtgcgcggaggcggcgcccgcgcagccgacttggttgtgcgtggcggcggcggttcggcgacgagctcgagctgggctcgggtgtggtgatgacgacggcttgggcggatgaagacggcggcttcggtggtagatgacgccggggcatcgacggtggcgaggtggagtcggggctccatgtcgccggcgtgaggagagaaagagagagaagggagagggatgaggaaggagggaagagagagggtgacacgtgggccccacatttttttttgtcaatgacaaatgggtcccacacgtattttttaaattcgagtgccacctaaccgccacgtcaacgccacgtggaagaagaccaggtcaatatcgtcacgtatgtggcacgtcagcgaaaccgccctccaaatccgtcgagggagtcaaattgcaccggttttaatagtttgggagttgtcctatccggttttgcggttcagggttgtagattagattcggccgatatttaagggagtcaaggtggactttttctaaaaggtacattgcgtgatcattgggcttatacgaagtgtccgttttgcagtgctggtcaagcagaaacacctttgagaattcttacccatctcccgttttcttatgattgcatacttgcagttgcagggtgattaatgggaatatggaattaatactatgatttataggaaaatcacattctagcacgagaatattcctctacaccgaatatcccacacctctgcactgcactgtgtactactaccaaggaaggagaaggacacgagccgccatggatggcactctctttctccacaaacacaaagaaaagacggagagatcgacgaggaagaagaaaggaggagactgcatgcctaaccagaccagaccatagccttttccactttcttttctgaatcttctctctcttcttctcctctctctctgcgtttccatggagatggaggtgaacacgtacgtgatgagtacgcgcgtacgatcatcgcgtacacacgtgagagctctgagctctggggaggggcggctgcgagatctgaaaccaccggcattattggattaaagcaaagcaaagcaaagctcgctgcaagctgttcgccaactcgccatgggcgtcgcctagcttagctcgagcttttttctttttctttttcctccttttttttgatctttttcaggcgtctctcctcctacctttgctcctcctttccgttttccagccgccgcgcagccagccaacgacgaacgtaccacggaaagatccatctatgatctatccatccagcaatgcccacgtttagcccgcgaccaaacattagtttcttgttttgtttttttaaatttaatttgcctgaagaatcaagctgtaactttgtgtttttgaggggaaaaaacttttttttcaattttcctggcattaatgttgttcaccacttgtgaattgtgatactgttgttgagatgatttgtttagtcattggagctatctgaaaaaagacaggatttctgcatatgcaggttgacaggaaggttcgatcaaaccaagaacaggagagggtttcatggaaattagtttactatcgaaggagacagaaagcaaactgcactagatatactattcagatatactcttattatagtataatgtagaaacagcaaggctaactggttactgtacttggatagacttgattgc

SEQ ID NO: 65799 - DNA, 11943 bp, Oryza sativa
gacatctcaagctttccaattattgtaagaagaaggtgatgacactttgttaccaaactatgcaagtacgaccaaacagcctatacaacaaaaggagattttgaatcacatcgcttgccttttactagcttataagatgcccttcaaatttaaattttaaaatttaatgttgtagtcgattttggttttctcatcgtaattcatttttttagcattggtttttaaaccaggaataacacatacataaaagttttacttatattgttttttttcttatatgccattttgcttattggatggctaagattattttttcactctactttttttctaaaaaatagtggaaaatcaactattacaaatattgcatatagcatggaatgacctgaaataatcttagccaactgatggaatcaagaatgatggccataattaatttctgacttgttttacaaaagaagaatgaacgccattttccttctcaacttcacactaattacactttcaagactcctatccttttctgtcctagcacatttcagctaattataagctttccaaataatgcaatcccccttttttctttaaatcttccacaaattggaagttgatgtgtggaatctagctagctaggtactactactaccaagtagtaccacactctacagcgcacttagcctgacggatcaaaatcaaaagcacatcaaggaagaagaaaaaaaaaagcaaagggagcctggtttggcaaaagggtgaaaagtgcctaaaactagtgttgcttttgattgtgttttgttgatggaattgcctcttttttcttctctacatccaccagaggggacacatgttggggagcaccagccaacttgagcaccaggcctgctgccctacaattattttggcatttggcagctaaaacagtctccaaatcttttctgtggcaacaaaactgtcattaaatgcacaaattaattaattatatagaccatgtactgcatatggatattcagttgaagtggatcccatcaaataaataaatattgtcaaaggtagtgttttcctctgagtggaactcaaagttccacaaagattgcatagttgcacccattgttcagaattcagtttctttcactcagcacttgagcataatgctgtgagctgtgaacctgtaatattctggcatatgtttctgtcatttgctgtaaactaaccaagaaccgaccatgattagcaaagttactaaaaggcactcacaaaccatgcattccttagcatccactccatacagtgggctcccttagccaggaaagtaagttcagatatgaatccaataaactccaaggaaattaaggccccctttgaattggagggaaaatggaggaaaaacaaaggaattgaaatcctacactattcatgcctttgattcgtaggaatgagaaaaggaaaaacgtaggaaactttcctactcctataattctagagcaaaaacgtaggaaatttaacatccactctaacctcttggaaaactttcccagagtctatctctctcatctaattcctgcatttttcctgtggtctaatcaaacggtcattcctatatttttcctgtgttttgcaatcctctgtttttacacttgcattcctaccaaaatcctgtgttttttctattcctcccttttttcaatcctacgattcaaaggggcccttagaaagcagagtagtactaatccttcgtctttgagctccgggctcatgagtgctagctttagccaaagctagctaagctatgccgccatacaagtaaccgaggaagaagaaagaaaagcagataaattcctcacttgaacaccaaggaatttatattatttgaacttttccaaaaaccgggagtgtctctccttttcatttgactgggaaatgagaacaagctagctgtatgctacatcttttgagaggttgttttgtttattttttttaagtaggtctgctctaatgttgaacaatctccgtttatgattaatctctgcaaccaacttgttacttttaatcaaagtatcaaactgaacatgtatattagatcagtgttgtcgttttctagaaaaaaaaatagcactatactctacaaaaatttcttttacgaaatttcaccatttgcattatattcgacaaaaaaggtacatgagggacattcatttagagcatcaccaatggtgcccctactccattctccatcctggaattttaggattttcatctaaaaactagtacaacagataccctactctttttccaaacttttgaagttattgtccctgtaatattcgctctcgtcatttgagagggagtgacgccgcttctcatgttcccaatctcacattcccgtgacccttctctccttccctcatgaggggcgatcttcttccatgtgaggttagaggaaaacgggagatttctgttggtagttcaatagaatgacccactttttagttttggaaaattaattttggattttctctagtttttttacttcctactatatctagattagaaaacccaaaaacataattttgggatggattattgccaatctgtgatgatgatcttaggatctttgaagaattagaatcaatttcgctaaaacaatgtaaagaaaaatatgtgccagcatgtttaaataaaaaatgttttttttcataccaccctgcttgcgaccagcaaacctttctttatttgtttgtcattaattccattttctccaacctgtccataaatgaacacacaccaataattcagacctaattgcttccgtttccttgacacatttcccattcgtcctctggctcttcctttcaatttgctttgctaaaaaactgttcagcaagcatccaatcgtccgtatatttatacctttgtacgtacgaatccactatcttgatcttatcaacttgtacagttgtaactgtgcaaaagaacacagatactccattttgattgattaattaactcacatgtgtacatagtatatttatactttacgcatccgtatgatgcatattgtttcctgaatcctgaccaagacatggtcttgtcgattataaatttgatttgatttcgatctgccatgcgtgccatgtgtgggaactgaaattaatttgccgtatcatcccggtggtaatttcgcaccggcgttttagcggtaataaagtggctttaggagatgttgttttcgagctggctaatgcaaagcaaagtaggcacgttacgatatactctgcaacgaactttagccactttttactcgcttgttgatcagtttggttttctaattgcgtttgatcagttgctgacattctcttatcaccacttgcagggggcgtgctttaatttggtatatataataatataattgagtattagtgccacaaactttatattcttttcttcgcagcagatgtttattttttcttctcctagcagctttcagctttcttcattgcatgcattgacctgatgttgtgtacttgtgtgtgttttagttgtggttcgccttgttaacatttgcagctgctagccgccgcaattaggactgctaaaatatctatcctcttttcaacttaaaaaaaaggatatttggaaagaggggcgtccctccaaatatttttttttaaaaaaaattatgagcatgttagagattacatacggaatcttggattgaaagcacacacttcttaccactgcactgtgaagtacatctccatcttccttttaactcagctgttaggtttcaactttttagtaaatggaagctgttaggtattcatatacagtgaaggaatattcaccgggctatagcatcacgggatgaagcagtacatttatttgatggattcacctggtgaaaagaggcatgcactttgtatagtcttactactatacgcatatagaggcctagctagctagcaggccactttgagtagtacgtgtaacaattgttggtgtaccaatgatcttcggaacatatgaattttggagaaaatttacatgttttttgtatgtactgtgccacttcatttcctgaaggatcaaatatgaaaagccgcatacaaaaggagactcgacttctgaataggttcacaatcccattaccggaccgataaccgcacaagcggtatctccggttttaacgaaggggttgtttagattgtaaccaaaataaatcttaccaaaattttgacaataccaaaattttatcaatttggcaatactgctaatttttgccaggatttcttatgtatttaacaaattttggtgaaaaaaaatagatgcacatctttagtaactttatcaaaaattggtatggtttgaaatatcatcaatctgaacaaccctgaaaacaattagtaaacccgtaaaaaccaatgaaattcagataaactttgaataaactgtaaaacttagtttttcttttaaaacatgatcagaaaactgagtagtttctcttatcgaaccgttccgggaattccagttttcatgaaattcaggctgatttttgttgggattgtgaaccctgattatgaactcaaacaaaagaaaaaacaggggacttaagaaacctaaaattccaggggcgcctcgcttgcttaattagcgagagaagcgacgggaccaaagttagcttggcaccacagtacaccacaccaaatatgcatggcaaaatcgtatgtatccagtagtgcaaggtggacgttgcaagcacccgtttgtatatgtcgcgatatttcaagatttgcaacttgctaatggcactgtgtgttctgcttggaagcttcctggaaggcgaccggaccattagttatttgtagagctagtgttatagcaacataatcctctcttctgactttcacttttatttttatcgtgtaaataattggcatcaggagtaaagctttcccttcagctcgtatattattgttactatagcttcactttcataattggtggatgtatgcactatagttaaattaactagcaccccatgcaatggaataaataattgatgtgaattcgtctaagaaacatacacaaagagaagaaaagcggctgtggtttacaacttggaagatgatctgaccgataaaaaaaaaatcgggtgccctgcatcattcctccctatcgatggtaaatgtgtgtgcctaactattgccaccatcgggaatccgcacccaaactcacccccatcctagcaactgttgagacaagcgcccttgctcgcctccacactcccgttcttccttattactcatcattagggtttaaattttcggtttgaccgattctattggaggtcatcgatatactgaaattttcgaacttttgaataaatattactcaaatttgaacaaaatcttaccaaattcaaaaaaataattgcagatgaaataatatcgcatggggggtttggaaatttcattccggaatttctaaccctgctcatcattcccccaagcaattgttgaatccagtcacaccaagcttgagggctttggatccttaagtaccaaccgcgaaggaacgaggggaagtccgaatcaacgcagggcgatgtgcatggctaggagccggttggcattggggttaacctggtctgaatcggtgatgtgggaggggatactagaaaggaggatgaagctagagtggtactttttgtgacctttcgacgtttcagctaatgtatcaaaatgttgtggcatggatttcgatggtgtttcacactttttgtctttgatgcatgctgatatgttgatgatccagtacttgaaacataatgttttcatacattagagtaaaacgtttcaagtgtgattcgattgcttctcgtgattttaatacttaattgtatgataatttcttctgatgtttcatgctcaataggaaaaactgttgataggttgattaccaagagagatcgaacaggcaaaaatgtgttcgctcgcggcacgatcgatcaatcctcgcgatggcggctcgagccacgcaccgtgacacgcgcgtaccgttgcaccaccaccaccacccgcaactcgcaacgttcccttcccctttccttagttcttaagtcccatctaccacgtgggccccacccgtgccagctcacctcatccccaccaccacctccggcctcctcctcctcctctataaataccgcccccacctcctcttcccattcgttccatccaccacccacccatccaacaccacccttctccaaagctgcaaaatccaaagcgagaaaccgccattgccacccacctcgattccgctctcgatctcagctcactgctgcattgcggctgtcgctgtcagctcggatcggcgccacggaggccaccgcggacaggagggccgtgcagccggccggcggcggcatggagcccgggttcgggaagcggctgatgcacgtgctgcgcgcggtgtaccacatgctgcggcgcgggctgtgccggaagcgcctcatgatggacctccacctgctcctcggccggggcaagctcgccggcagggcgctccgcgacgtcctcctcgcccaccagccgcacggcggcgcggctgccgtggcggtcatgggaggcggcgccggggtggcgcggggtggtgactcgtcgtcgtcgccgctgtcggcgtcgttcttccaccacaaccccagggacgtggagttcagctgcaccaccacgccgtcctacgcgccgggggtcttccccttcaggttccgcggccgcggcggctcacgccacgccggcggcggcgccagcaactacggcgggctcgacgcctccgccgtggcccgcgtcttcgagatgctcaacgccgacgccgcggctgctgctggcgccggcggggagacgccgctgtcgtcgatgcccggcgccacgccgtccccgttgctggcgctcagcctcggccgcagccccgccgggacgcggcagctccgcgtcaccgactcgccgttccccgtcgagccgccggagggcgccgtcgacggccgcgtcgacgacaaggccaccgacttcatcgagtggttccgccgccagctcctccagcagcaggcgtccgccgcgccaacgccggactaccgtggctagcccgccgaccgccgccgccatcgccgccgcggcatgggcgagcgagcgcgaatactaaagcacgagaagcttatatatatatataagggactatgtggcgtcaaaattgtttcactgacatgtgggtttcgagtttttctacctgcatggctgcgtgtaatttttcctcggttaattaatttcctcgcttgtgataaatctctatatatgtagagttcacgaggagacgagataaaaaaaaaagtgggcttgccgttgcattgcccgcacaacttgtatctgccatatcatgcatatgagacgaaatgataatttttgcactttaattaaactggtggcctttgcatgcttaaattagtttgtgttaattatttcaagtttttttttgttgttgtccttttttttagaggtttttgttgttgtcctattcacacaaactaatcggaagaaggctcgttataaattaattttaacttagaaaaaatggctcggtgttaacttatcggtttcgtactttttcatttaaaaatgcattccttttatttataaaaaaaagtctaaatacgatgaatagcatgagtgatctagatgagggggactccgaattacatctttgtatacaagattacaactgactaaacataaaggcactaatgatatcggtttaacttcgtcctgaaatacctacagataaatatatactttatatgtcctaaaataattataattctatgtagcatatattaagaattgagtaaagaaaactatggtgtcccttactagatataatgtataggcaagagcgagagggtggttaagggtagaattaaaaaaataaatgataagttattgatggaacaattgatactctattgtgataactatttcgagataaatttaaattttaaaatataattattataggacaaaggtataactaccttgttagatactaatcctcaagcatacgtacggtgtatatgcgtttatgttgattttgatatggaatcatctatcgtgtctgcaggtagtacgtgcatacatacgactcgcactttctatggttccatttcaaaccccacaaaggagacagaaacagggaaaaaaatttagagttttgtttttcaggtcaatcatgtgcatcagtagttattatcatcagttcatcactactaactgctcttcgattcgaatcaatctcaattacatatttacatgcatgcagctagcaccgcggcttaattcattttcgttgcatcagcgttgaacattttgggcacacacacttgctctgtgtgttggttaatttcaatattgaaagtgattgtgccaagcttatgctaatctccttcttgttgatagttgacattatccagtatgtggattgagcctagcatcgaatcgttcttttttaaaaaaattcctaggtgtgtcaattctcaaactgaggctgtgtttagttcctgaaactggagagaagtttggaaaaagttggtaatttgggaaaaaaagttgagagtttatgtgtgtaggaaaattttagatgtgatgtgatgtgatggaaagttaaaagtttgggggaagtttggtgtgaacttgtcacgccccgagctagtcccgactggaattagcccgtgacgctccaaattaacctgttaatcgataccagtcccaggaaacagtgctggtatcacaggaagatagaatatcacagcaacagaggtctctttattatagagtaggagtacagtcatgttgggctgtggacagatcccgagctcacaactgcattacaaaagggaaacggaagccagggcttggaccaaacaacacaggcgcgacttgggaactaggccgaaaccataaaactcatcgtaaccggcttgctcctggaagaactcctcatcagcaggatccgcttcatcttcttcagcaactgggggggttatttatatagagcaagggtgagtacaggagtactcagcaagccaggggaaataagtgtttaatgcaggcttcaaagaaaggctggtatttttgcaattgattttatttgaactcttttctgaaacaactaagtgggtgcttctcaaacgacacggttgagacagtgtgtcccgtccggtcggagtatgtgcaatgtatcagtctttaaatcttaaaacaaggttggcacccggccaacagcttttcaacggccacccgggccaacaacttttcaaacggccacccgggccaacaacttttcaaacggccacccgggcctagctgatcccgtcagctacagatttttcaaacatcaaaccccttttcacaacagcaatttcacaagcagtagtcaaacaaaactacgctaggaatcacctcacatccgcccatgaccgtgggcacggctgttcgaacagttagttaacctctgcagagggggtacactttacccacacgacattactaacccggatcacccagcccgtggggatcaaccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcatggctcccctgataagctagttactcagccaggggtgtcccattccacccatgtggtcgtacttgtcttatgttcggatgaaattccaaggaatcggtccttaagtgcgggagcgggaaaaccgtacacccggtacgttccccggtccgcggttttagaaattcatttagttcgcaagcaccgacccaggcgtcgggttttccaagtcttttgtaaaacccaagttttacccaagttgtttttcagattttaagtttgaaggcgaccgtcgatactcgcacagagtgcacgaatatcgaggcgcaactgggtggttacaaggggacatggtataacaattaacaaaggaaggatcaaattcaacaaattaggcaggtccgccaatctgccttgcagacgggacaaccgattaagtgcgatcctatcaatgcataatattttgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttggggaattttggaagttgaacggagtcaatcggatttacggttgggaagatattgaatttttaatattattggatttttggtctgaaggaaaaaggatttatttaaacccttttggaaaaagaaaaggatgagggagggaagatagacttttcctcgggcggctagggcgcggcccaagggaaatggagcggtccggccgagttaactgggccggacggcccaaaagacggcccagaacgcgcgcgggcggggaagagagagggagccggtgaaccgggctcaccacgcgtggtcccgggtgggacccgcttgtcagcggctcggctcaccgtgcggagggagcacgcggcgcacgcgcgcgggcggggagggacgcagtgcacaggcgcggttcgcggtgaacgcggatgcggcgggcccacgcgcagcctcacggctcgcggtggaacgcgcgcacgggaggggctgaccggggtcggcccgtcccgtcctcggctgagctggcgccgacgtggcgcctacgtggctgccacgtgggctagcgggaggtagacgacgacgccggccggaacggacggcggacgacagcggcgaacggtggagcgaaccacggcgatacaggcgaaagcgagcacaccgggtggttgcacaggacgaggggagacgagccaacggctcggattcgccggagggagcttgacggcggcgaatcgcggcggcgacaaccggcggggagggaagagggaaacggcgacgaggccacgaggggtcgattcccggcggtgagagcatctatgcggctacgggaactcgatgctagcgtcggattggacggagctacgccgagcgaggctggcgacgtgcgggtgctacggagctcgagcggcgacggcggcgagcactcggcgagcgacggcaacggttggggcggcgccggctagctacggggagtctactcgtgctaccaccgaaaactaagggggggagatggagcgaggaggaagaacggagggagacactaccgtgcgggacggggcgctgtgacgagaggccgacggcgcgggagtaatctctccggcctcgggccggggaagaggaagaagagggcgcggccgaagtccccttccgcatcctcgaacgcaccggttctcccggcgcctggcgaaggacggcggaggcgagacagagcacgggggcggcggcaatggcacggaggcgaatggaagaggaagggaaaggggaggctggggtttaaatgggcggcaatgtcggtttgggaaccgacttgcgcggtcaagggcgcgagctggcgctcggcggtcgcggccaaagtggcgacagggaggatgacgccggcgaggaggaaaaaggggaaaaggagggggagaaagggggcttgcccctttgccgattcgggaaaaggaggaggtgagcgggggcgcgcggctgagggaggagggaggccctgcctccgtcccttggaggcta

SEQ ID NO: 65800 - DNA, 19424 bp, Oryza sativa
  unsure (1)..(19424): unsure at all n locations
ttcattctctcccttccagctaggatttggatgatccctgctgaattagcttattgtacctgctctcatactccctccgattagtattcggccgggcagctcgcgctaatccttctataattgccccagcagacagacttcgcttcgcttttcccgcgtgtgtctgtgagtgtgagtgtgtctcctcgccttgtcttgctgcacgcctgcacgtaccgtgtcgtacgtactccacatccccactcgctgtcccctacttacttttttagtaccaccgaaaaccaatctagtattaaatacgatgttttatagcctatccgaattcgtttatattaaaaaataggagtagctatacaacattcgatagtttttaaaatgaaaactttcaattgtaactatgtagttacattgtactaactactactacgtaactacaatataagtgatttctgaaaatatcgatggagcaactggttagttgaacgagcatgcaagctgcaggcctcgggtttgatccttgccgtgagcatctgatttttttttccattttcctccacaacacaaatctcaaagcatattggatggtttaaaattcgaaaattttcacctctgaaactgtcaacaataggatagcaaattattaaaaagggaaaatcctatttagtactgggttggtttttttatggaatggagggattagctttattcccgtatattgattgacaggtggaccgtacaatctcatgggtgaacagatggaagatatcgtgacaaatatctctgccatggtacttgtacacacgggcagattaagctctttgcccgttgatccccatatagagaaggaaagagaggaaaggggaggaagaggaagaagataataagggcgggaccgtacctagcaatttcagaccctaatatgaaacataaaacaagattttatgtttaaaaagtatcaataaaaaggatagtaaattgtccatgaaaaaatattacgtaaatggtagcaacgccttccttaagtaagaaaattaagtgctttttaatgtagttatttgattttctttaccaagcgaaaaatggaatatttagtactagaacgcttgttcatgtagttgctataaattagatgccatgattattatcgaacatctattggacccagaaaatataaatatgttctaggcaaatcagtacatcaacgtgagaggaacttttgaacaaataaaattaataggataataatatattggaaattagtggcttgtattgaaatataagaatgttggggcctctattttctttttttttttttgggaggggaaagttgtgcggttgatcaggtggcacatggccatggatagccctggcactctgcgtacgggctgaaggagaaaaaagaatataagttcttcttctcattatttatggatacactcagagtactatacggccaaaatttataaagaacaatatttgatctgagtagagtcatacacctacaactttatcataacaccatcgcaattaaaacccatcctcgcttgttaatcaaatcaaacgttctccactaatattcactcaattcacgtagaaatcaaccatatgcacgtttgctcatgcagggcgcctatttggcgcgggctcgtgcgcttttgataatgcttttgctgctgctttggctttggcagttggcacaccgtgcgcgtgcgcccatcgtcctgagtgaccggctgctttgacacgccaagggcgcaggaaggagaggcaagagcacgaggaaatcgagcaaatccggcgacactttattttctggtgattttctccctctattttgcgttagaaaaatcgttgacatccgaagtgagcgtagcttaaccctaggtttcttatcgtcaagccaattcatccagatttatgtatgaaacattatagataattgtttttttaagtagtaggtgatatatctgtcgaacgtcgtcggtggtgattttttcagtgagtatgcagacattatgattttttttttaagaaagagaaaactcgttgacagacctgtggatgtggtggttctacgaccgtccggctaacctggcacgaggccaatgtgggagcgtctccgttgcaatagtttttacgttgccactagcgcgaaggcgcgcgccttccaagctccaaagcatgtggaaaaaggcaggcaaaaacgcatgcaaaaggtgaaaaaaacacaaaaccaaaaggcagagaggggttagctggtgcctcgctttcgcctttacgacgcagctcggcagctggctttgcttttgcttcggctgcaggtgggccgggctgctgacttggcccatgacgcgacccttttcttctaaactttgagcccaaccagcccaaaaacctgtcattcctccggtccggccagtcacacgcttagcattaagctaaagcttttcttctataatcttttcagatagcggccggcactatctgttagcctgttaccactagccattgatttcgacgagtgattagtgaacgcattacgcatacgacctcatctttttctttttcttttctttttttatgatgtgtgtcatgacccacgaagaaaatccacggtcgaaatcgatggtgaactaaaatgggaactttttttttttttgccgagtttgttttgtcactcgtgctatcgtgacaacatccaaggaatatggctatacggaaaaagatgagtgaatcgcgatgatgtgatcatcgtacgcaccgccacaggttgctgtacaaagttataatcaagacttgataggtccctttttttttagctttgcagaaaggagaagttgatgtgagctaatcagaacggcgacatatccaatgaagactattagataagtgaaaacccatgagactagacctaaaaagtgtataaattcatgagaagaatactgtagatagatgcaagtatgaaatacattctcactaaattttaagtttagactcaactctattatagagggaaaaaagagataacttttgagtgaatagtaagagtaaaatgcgttgcaggtaccacaacttgcaaggtgtgtgcaatttagtcacccatcttgtaatttgctcaaataagtcactcaacttccattatctaaaaaaaaagtcactcaacttgtttagaggtgcaatattatttgtaccaaggtggacgccacgtcagcatgacaggttcaccttgtatgcaaggaacaaagatgcaaattagcccttatattgtttcaatttttcgtttgagtacatatgtttgtttgatactccaaatcttcaatacgtgatttgctgccagtactgaatcttgcctgatgtacaaggatatatgtttgtctttatattgggaaataaagcggtttgttccttgtgctaaaaccaatttttatatgcactcttcaatgtggtaatttgacatcatattcatggattaaataggagcgctcgtggctagcgttgataatttcgccgatgatggattcatacgcagccacgcaggctatcaccgcgactcgctagatctggcgccgtcctatcccgtgcgcacgccaacaaaaaaacctacgatcatggcttagcacacgggcataacatatctaaatagaccaattaaattagcaaagagtaatatagtagaagggtttttctacaaaactgtattactttcgccaactcatcgtcacgtctgccatcgtatcgtccaccttggcaaaaataatacgcgtgacacgttttttattatatttgcacctccaaacaagttgagtgatttatttgagcaaattacaagatgggtgactaaattgtacccaccttgcaagttgtagtacctgcaacgcattttactcgaatagtaatataacactattcatctgaaatttgtcttttttgtttttctcaaataaagttgagtttggacttaagatttggtatatttatctttaaattttttttcataaatttataagacttttaaatatgatttcatgagttctcacttatttgatgatttttattggagccctcacctgaactaccttggagttccacaggtagctacagctaactatcttagtagcatttgcattacttatggtaaaactgtactgtactgtaaaaccaaagatccttcaaagagtgagccggtatttgcacgaaggggaggagcatgggcagtcaggttccccaaactgtttttgttggttacccggacagtcttataactttgaacgttagttcattgagcttgactacggtgctttctactcgtagtattctactaccagtagaaatgatctgaaccatctgtttggaagggtatattagtacttactaattatgtgcttaagggtaatttgggtatttgtgttttccttttcttttaagtctcgtattgctccgaccgtctcgccgcatccatccgccgtccgttcctgcacagctcgattccggtggtggcgcccatttcgatcagccggcgttcatcctgccgccgccgttttatctccccgtcggtgacctcgattatcctgccatcctccacccctggtattcccgccgtcgatgtcgctgatccctgtctagccaccacggccgtgccaacctccgttgctggcgaccacgcgcatctgcactgcaccgatctcctccctatcgaccacggccatgccgatttcttcggccctgacgaccgcgttcacatccgcgttgatctcctcctcccactgaacaagctaacagctagtatttattttcgattatcatggtacttgtgcgtttgctctcaatcgaatttgatttcttcgttgttgataagaagaggaacctgcttttttgaaacgaaccgcacaagaagaggaacatgctaatgctattgctactagattgcatgtatagcgttgtatacaagttccaattcgatttatcggatgtgactttgatatggatggatgctgaattttgattcgggctggatgcaatatattggagtatatattaattctgaagatgtaatgtgctagctattataatattatttgaataaaatacaattcaactgaatctctgaacttgagtatgtataaaatactattttgactgttaatttctgttatggtatatttctaaaaatctaaaagtattgtttgaaaagaaaatactcacaattttaggatcgttgacacagttcctgagtttttatctgagggaacatttctgaattagaaactcagttcctgagttgtttttttagggagcagttccatatagttactaacttatagtgttaattactaatttgtccatgtatgtccacaagcattctcataaatcatcatgatatatattctttaactgctagaatattttcattatgagatgagattttaaagcagccgcgactgtcagattcacttgtatcacagaattgttcactttcctgaacatgtttgcaacttgtgaagtaatcctcaagccggagctatgagagggagcatgtaagaagcatcaacacaattgaaggttggggatggaccactgacgtttcttcagccttttattttgttgtatcagagactttgttcagatgattatatacttcttaagtgatatgcatgtaaatgtggaggtcaggggtgtaattagcaaaaaataaagctctatcaagccaagtttcaggatatattaaccgtggtgattgcagattaatttctgttaggtgaagataaaaaagatagttgcagttatgttagatgattgaaaaaaagaagtggtgtggtactgggattgacccctcgcgacatggacaaaattaaagcatcttgcagtaaccatccacggcaactcccaagtgcaaatatatatcatctttgcctattcatttgttttaaaacacgaacactgtctaccaaagaaaaccacgtgggatatatcgcaagggagtatattactgcttctgtgatagacattaaattatggcgagtacaatatatatatatatatatatatatatatatatatatatatatcaattcagacattggtcgttgtcctttataaaatatcagccccataccatgctgctagatcatactcgcagaacaggatacaactcttgaatgcaagaagcatgacttttgccagtaattccaacgtgcaatctccaacaagacaatgaaaggcaaactcaccattggagctccactgcatggctgaaaaaatgaaaagaaaattatacacattggaaagcctccaaaataaaatgatctgcagagccttacaaaattatggaccttaactgttccatgctggccgtaaccactataaactagtagtatcttctgaaatttgacttatgtgatgtagcacagggagtggaactatttctacaagcaacgaatcaaataaaaatcgatctgtgtgtaatttacgaagtatagagaactccagaattagtactagaattttactgaagcaaaatcataaccatttaaaccgttgtcggctgctcatcaactaaaatagaatgaagcacaagcggaaatcatctctcgctaatggtcacagaagaattatctatgtggtgatttgataacatttgtcagacacatttcaaatttgtatagttgggacaacaacctcagtagaaatctagcaggttgtgcttatgaagtactacttggtgttaaaactgaattttgctcgcgtcaggctgctacttttggaggatctaatagtgatcctacaacattactgtatcatttatcaggaagtgatgggagaaaatgggacaggacgttacctgttctcgaaccagtagcagccgaagagatgggatgaacaatcaacggcaacatcaagatgagggcgacgttgcatcatcagcctctcctccgccggactgccatacaagcagcacatcgtggatccgccgcccttgccgaggcgccgagcacgtacgccgcagccgccacaggtcgctggaggtagagaaggtggatggggcagagggccgcgagggcgctggaggcgatgaacgcggcgagggagatggacggcgacggaggcgacgatagaggtgaacgggaggcccagaatggcgtcaaaggaggcggcgagggcgggggaggcggacggcgacagagggggccgaagaaggcgacgcgggcggaggagacggacggtgaaagaggaggcggacaaggcggcgacggcgggggatacggacggcgatggagggggcggagaaggcggtgaggccgggggaggcgacggtgctggaggggaaggagatgccgatggcgctggaggcgacggaggtggagagggagaaggaccggcgacggaggcggcgaaggagatggacaccgacggaggcggggatggaggagaatggcatcgattaggataggatagagagagagggtgaagagttagataaaaacaaattacgataataccctacgcgaattattacctttggacaaatatatccctccacatttctactcccataaaatttggtgggagtagaactcgatctcaaccatatgattaaatacgatcaacggttcggattaatttctactctaagtagaaaagcaccggagcgggactctagttcataaagattttttcttttcgcgatatttcacaacaattgagcatgcgagtaaactaaattttgttttctcccaaatgtagatgataccttggttattgaagtcgatccaattcgccactgtagtacatactccttcggtttatattataaatcgctttaacttcctgttagttaaacttttataactttgatcaaattgttttcaatacaaaacaaacatcctatcaaaatacatttaatgttacatataatgaaattaatttggtattgtagatgttgttaaattgtttttttaaaaaatattagaacataaaagggcttcaataggaaaataatcaaagtactagggtggtgttattttctcatgaagatgaagattaagttttttttcgtaaaataaggtgatattaatgtatagttaattgagttttaattattacaaacttgaaaaatagattaatatgatattttaaagcaaatttcgtatataaagatttcgcatgaaacatatcatttagcggtttgaaaaatgtgacacgagtatttaaaattttatccgacttttgttggagaaaggaacagggccaagggttataatatgaaaccaatgatgcagtatactagagattaaaatgatgagtcacaaaagatttttggtccttcgaaaaaagaactcaagtaggaatataatctttctcgaaggaatatgagtataatctttagtggcaagagatgtaagaaacaaaatccccacatggatacaagctaacccaaacatgacgagtagtatatgatctttcttgaaacgaatctgaacttctttttattttttttccttttttgataggacgaatctgaacttctgaagccatcatacttacaactacacgccagtgtggtatgatccgcatgtgttcgagagaaggcgtattctacacagtacgtaagctcgagtcggcggcgtaatccccacttactacacaacacggctgtggtaccaggatttttttcaccacgcgccctacctcgcaatctccccctcctcccgtctcgtcgtcgtcaccgccgccggctcaccccccacccgtcgccgccggcgcggaggccaagccctagccccagcgcggccgatcgcctcgatcccccggcgagccgatgggcgtgcgccgctgaagcatgccagcgcgccgaggccgtggaaagcggaagcagcagcagccgccgccgccgccgacgggcccagcggacgcgaggcagccggaggggaagcagcgggaggaggagcggaaggggatggaagggtccgacaaggggggcgccggcgacgacgggagccccgcgccgctcccggagacggtaatcgcggattatctatccccccttggctcccccgctgcgtgacctagatatggctgtcgatttttttttagggggcgttttgtttttttggtttagggttctattgattgaatagacgctgccgctggtgtagatgaactgattgatctatgcaaactgtacacgcgggatgggatggtggagttttacgcttgtggcaaaataactactagttgttctggattcttagcttactttcaattaactctgatccaactggtgacaagagaaggggaggatagcagatgtattgattacaaatagcagctgcacagaactgattttgtagagaattgtgtggaactaaattagaacttttgactaaatgtgaatgaagaatgcttattgtgtaaatctaggatagcatcagtacgggtgatgttgaccagaagcttattgtgcatttcaagcagaaaactgatgagatagctaacatcttgagttctagactccatctagttaatctctagcatttgatggcacttataattagtgtgccatgaatataccatttctggtgtttggtgtgtgtttttactgaacgtagatcttgtcggttgcttaattatgttcatttctgccatgtatacgaaattcaattggttagctgagtgttgttactgtttcatgtattctctgttcctgttttattcctaacatttgttgaattcacatgctgagtgtttgtgttaaattccaagcggagatttgattgagcatcggtctgttaggattagctaccatcatgcagataaaagatctgcctaggaacgggagaatctaaagtgccttaattttattgcgcactatgttgagccatattgtagatgctactgtataggcattctttaggataatggtagctttccattagatcaaagcaggattagtcattatacaggatttgttgcaagaatgaaggtgcctcatgtcacctgcactcagagttgactgcttgaaacctgtttagctcacaaaagatcagaaatgttgcaatggctgttctgatgatgaaattttgtatcattttattacgcatggaatagctgacctgtctcctttttcacatgtttataggattttacatcatgttatcataaccatatatttattttgggcggttgtgtgcttggaccaggtacaaatcggaaattcaccaacgtataagcttgagaggaagcttggaaagggaggatttggacaagtatacgttggccggcgtatttcctctcctactcatggtaacagaaattctggtgcaaatgcattagaggtcagtgtatctccttgaatgattgaagtagttggaactgagactattcgtacttgcgtcagtactcatgttcatttctgtcaggttgcgctaaaattcgaacatcgaaccagcaaaggttgcagctatggagctccctatgaatggcaagtctacaagtaagtatttcttcttctggctctctactgtgtaagtttttctttgtgaataccaaattatttggatacgtttacattgattacttatgataaaccttctcttgcagtactcttagtggaaatcatggtgtcccacgggtacactacaaaggaaagcagggcgggttttacatcatggtaatggagcatgaactagatttttttttttttttgctttccggtttatggtttgattggtttctttttctcttaagaattatcaactacgttttttctaaccatacacatttttcatgcaggttatggatatgttgggaccgagcctgtgggatgtttggaataacaattcccactcgtgggcatcttttgactcttcctaattaatcttgacagttcaatgcagccttttcaattttttaatttgtggccttcttttacaggatgtctgttgagatggttgcttgtataggtatagaggccatctccatactagagaagatgcatgctaaagggtaactcgacctgctcttcagatgttccgtaagagtgtttcacatggcgtctctgaagttttagctaataaattttgtttatgacaggtacgtccatggtgatgtgaaacctgagaactttttgcttggtcctccagatacccctgaagggaagaaactttttcttgttgatcttggactaggtaattcttaatcaacttttatctttatattgtgtcaatttgttgtcatgtaattatttatgttgcttccttatgaacttgttttgttccaatgcagctactaaatggaaagatgctggtacaggaaagcatgttgaatatgaccagagacctgatatctttaggtttgaatagaaagtttattacgatgcctatcattttgcacattactttattgatgcgctcttcctgtttgtcntgcttactgggtaaacaaggggtactgttcgttatgctagtgtgcatgcccacttgggaagaactggatgcaggagagatgaccttgaatcccttgcatacacacttattttcctttccgtggccgcctgccttggcaaggattccaggttaattttgattgattttatgacttttttgttgctacatgcactaatttcgttttgtaattcatgaatgaacttagggagagaataaaggttttcttgtttgcaagaaaaagatggcaacctctccagaatctttatgtggcattggtccaccaccatttcgtcaatttgttgagtatgttgtgaacttgaagttcgacgaagagccaaactatgcaaagtgcattgctctttttgatggcattgttggtccaaatccagatggaagaccattaaacaccgatggtgcccagaaggtacattattccttcaaccattttaatctgcgtctgtatcatctgtcagaaaaaatgatcgtgtaggaatctcagttccaattccctatttctcggatcaaaattcaaagcactagtaaataattaaagttacctgattctatccttgggcttgagagtcatcactagtgttataactaatattatttcccaagaattccaattagttcaatgccaaccttgtgcttttaggttttagtgaaggaaatctatgtcccactatgaaacaactcaattgtgaacctgcctttgaacttcctgtcctagctttctgtaatatgaaacaccaaataacgagtatgacctgcatagactaaaacatagtcaatgtcctgccattaagaccacatgatcagattggtctttagagacagtgacatattcaatatcaaatgtattttggtggtaaaatagttaactggcaaaatctagtgacatattaaataattccttatttctttatgtaatagcgggctacctgcataatgctttgttggattgctgccagcttgtatatcaggttggtcagaagagaggccgcctcacagcggctgaagatgaggagcaacctaagaaaaagattagaatgggaatgccagcgacccagtggattagtgtgtacaatgcccgtcggccaatgaaacagaggtatggcacagtaatctgcttggtagcagtaaaataatactctattgtctgaccacatttatttttcagataccactacaatgtagcagatgatagattagcaccacatattcaaaaaggaaatgaagatggtttgtttataagttcagtttcatcctgttcagatctgtgggctttaattatggatgctggcactggttttaccgcccaagtacatgaactctcccattactttcttcacaaggtaaataattgcgtgtcatcctactattgagtatgtattttttttcctatctgtggttggttactaatcaagcatactcagctctatcctaattgccatctcatggtattgttttctactccctccgtcccaaaatatagtcacttcttgcattcaaaatttgtctcaaaatgttgctacttcacccattccatcatctcaactaatcaccgccatctcttatttaatttctccatctacttcctcatctcaaccaatcacaaccatccctgttttaatttcacctctccttaaccccctgaaactctagaattgcctatattttgggacaacaaggtgccaggcactagtccggcggctggggggcgcctaggttaggctaactagtcaaatccaagaaattagcaagcatattgcataaaaacaagactatataacactaaaatagcaaggaaacaccacccaagttagttcagcctcttaatgcaccatctaatgcctaatcgcggcggctaaccggcgcctggagctgacttttagaacactgagataaatgtataatcacaactttaactgtgcgctttgataggaatggataatggagcagtgggagagaaattactatattacttctttggctggttcaaataatggaagctcggtggtgatcatgtcaacaggtatacagtttcattttgatgcctttagtcctgaatttgcatgttcggtgccaggatcattatgtaacaagcgcaacgattcatctcagagaagaactacagtaaactcatcaaatgtgtactgaaacacgtaatcgaatactaaaagaactggatattaatcaaaaccatgataaatatttgattttaataaagaaaaattctcaaacaaatgttctctttggggtaaatcaacactatgctaagcagcatatagttgataacattagtacatgacatgggtttaatatataaaatcaaggtttcattggttggcctaataagccaaagcaaaagccaaaatttgaattttcaaacttaattttgaagttaattttaagatattttgaacatagtttttttaatattggcttttaagttgctaagaacacatatacaattttttacctataaattaatttttattttctaataaatcattttggcttattaggaaatatgggcaaccgatgaggctgtcaatcttttgcccctagctatgatgaaatcactataaactgctagacaacatttggataaacataccacttaatattgttaccttgaccaagataatactggatgaggtgaaatttgttaaatgttgatgcatcaaagtattcagaaagtaccaccgttaatatgtgtagtgagaagccattcacagcgcaaacacttgggtatcctgtaatgtttactgttgaggtgaaatttgttaaatgttgatgcatcaaagtattcagaaagtaccaccgttaatatgtgtagtgagaagccattcacagcgcaaacacttgggtgtcttgtaatgtttactgttggtatttattatgagcaagaagccaagaactgacttgaatgcttctcaggaacgccatatgcacagcaatcctacaaagtaagtgattcatttcccttcaaatggataaacaaaaagtggaaggaggggttctatgtcactgccttggccacagcaggaagccgatgggctgtggttatgtcccggaacgctggtttcacacatcaggtacgtttggagtgtccaagagccttgtaaaattgaattcattttagcagcaagctacactgactatcaattgaatatgtaaaagtcttgagattttattatctcgcatatctcttttgtaggtagtagaacttgatttcttatatccgagtgaaggaatccatcaacgctgggatagtggttatcgcataactgcaacagcagccacatgtgaccaggtggctttgatcttgagcatacctagaagaaagcctaacgatgaaacacaggagacactgagaacatctgcttttcctggccagcatgtaaaggtgactataccttcttcttgtgccttgtttgaactccacataacaaataaatctgataaatctatttgcaggaaaaatgggcaaaaaatctttatttaggctccatatgctatggaagatcagtgtcgtgaagtgcattttcccgagctggtcctttgtaagattaagatctaataatatgaacaaccggttttgtgacaagataatggggggattttgaagtgcaaactttaacttactcgtagccttcaaaaatataaactaactatcctaactaaccaaagctaacgttaatatgatgaaagactaattttgtttttgtataatgagtgcagaaccatttccattactgatttattgtgcataaattattcaatatgtaaaagaaaagaaaaaacaaaactgcattgctcacatgtatagacaaacttagtgattctgtaccgtgagattaggttttagacttggtaaattttggagagaaaaaaaaaagagatggaccttattgagtaggagtagtaagcttgaggaggtgagctgattaccgcacccaaatatgcggtaggcatgactgttgattttgctctcttatctaatgataatctgatttccgactatttattcttgtggactgctatgacacttcatcgctgtagcttgcttagtggtaactggtaagtagtggagtactactacttatctgatctaaacgtggttaacaaatttctgtcagtgcggctgtatggcttaacacattcagatcaatggtttattaattgccgcagtagcaaatgctccagtaatccaggttttccttgaacattaggggtgtatttggttgggtggatgagcctggatgggagatagctgcccgattttctgtggtgtttggttggatggcagggtggatggggcggcccagaatagggaatattccctcaatatgctggatgagtgtatccggctgattttgctggatgaagccatccagttttggtctgggtgatgtgtcttgttctgattggtcgtggttggtttgattttctgttaagcaagctccaaatgattttttctcctaaaccgtttatctaatttatgatttgattacaccattatatttgttacaattaaatctttaaaacaagatctcggatgattatattttgataaaaaaatatatatatgacaaatgagtctcactaacttttgtctttttccatccatgctatatcctccaacacaaaagaaattggatcgccatatcatgcaaaccaaacaaaaaattgaaccaaacacaccctaggagtacttctttctatctccttttgcaatactggcagcgatttggtatagtgagatatcttgtttagttacaaactttttctttaaacttttaattttttcatcacatcaaaatttttctacacataaatttttaactttttcatcacatcgttttaatttcaaccaaacttttaattttagcgtgaactaaacacacccctagagcaagtagagtggagtaggagtaattgggagtataggtgtatttagttcatgctaaaattgaaagtttggttgaaattagaacgatgtgacgaaaacgttagaagtttacgtgtaggaaagttttgttgtgatggaaaagttgaaagtttgaagaaaaaatttataactaaacaagtcctatattgagtgacatgtgcagcacaactttcgggctccgcacaacagcagaagctgtcacgaatcctgggaatgcgtgcctactcccgtccagggcaatagggtatgcgtgtgctgcctgcttttagggttttcaaagttttcagtacccaactacggaaggatcggacgtctattataaggccatgcctagggcacaccaaacttccgttaaactttcaactttccatcatatcacattatatccaaaatttttctacacatgtaaacttttatttttttttctaaattactaacttttttctaaatttcttcctaattttaggaactaaacacagcactacggtttatatgtttttctggcttatccatacagaattacttaaaatgttactcctttcgtttcaaaatataagaatctataaatggaacgtttagactgtgttcttttggaggggttgagaaccccctcccatccgcacgcaaaacaaagcgatagaataaagcatgattaattaagtgctagttataaaaaattaaaaaaaatattaatatgatttttttaaagaaactttcgtatagaaactttttgcaaaacacggaccgtttagtagtttgaaaagcgtgcgcgtggaaaacgattgagatgagttgggaacttggggaaagaactcagccttaatgtatctggattactccctctgttacgaaatataagaaccgtcccaaaatataagaatctaggaccaggtgagacatttcctattactccctctatcccataatataaggcatgcgcacgttccaagattcaactttaaaaacatttgaccaacaattattataatataaaattaaattttatttgctaaaattaatatcattgtattgacatttaaatttactttgagatggttataattttgttacaataaaccttgtagtatataacattagttttgaagactgtgtcaaatttgaccataccttatattatgagatggagggagtacaatgtatctggattacttcttccgtctcaaaatataataatctaaaattggatgagacatttcctaatacaatgcattttagatagactctctgtccagataagaaaatggcatatttctaataaaaaatataagaaaacgacatgtttccaataaaaaattacaaataagcccacggtgtcaatgacactggccgatgacctatttataaatattcttttattacaaataagtctttttttgaaaaaaaaatatttcacatatgtcctcgacatcaatgatattgacgttgcaccctttgcataactagcttagtttctatggagaggctagtgggatgatgccattgtaattggtggtcatatgggatcacgtcgctaatgatgttggttctaaaaaagggtttattttcgaaataagttttaagggtctattcgtgaaataagttttcaaaaagacctaaaaaattgaaaaaaatagccattttttgtcatatgataattgtgtagatggataaaagagctgaggatggtccaaactggcacaaagatttgtatccaatctaaagtaaaacattggttaaaggatggtttaaagcaaaacattggtaatagaaggtggctccaggtgaaaatcactaaaaactaattgcagaaatagatcgtgggctcaaagcgaatctcattgacgttgaggtataaggtcactgtgtcaatattattggtgtcaaccttgataagaatcccgtcgctattccctccgtatgttttcgaaacaactgttttacacatgtaattctatccttttctttttgtttatgcttttctgtgtcctgtattttgaaaaaaaaactattatatataggtgagttattagattggttataaataactagtactgctagactattagttccgtagttttgttagcttttacaacttcttttttactacgagcgcggtttttaaagtgctaaaatgtacattttcttaaagaaatttgtatagtttttaaaaattcaaatacatatttttaattgtaataattaatattttattaatcatacgatatagcatatcttgttttatatgccatttaaattgcaaaaacaaaactcccggtcaaacgggtatccttggttgttttcattagagtaattttcagaaaatgacaactatagtgagaaaattatcggtttgttacaacaatagcgtgaaaatttatcataaaattgtaatttttacatgtcacaagcatactgttgtcacctacatattttattgttgcataccacgtaaaaattacagttttgtgataatttttcatatattaacgttacaataaattgaaatatatattactaatgttacttttgttacggttgtagtttttttgaaatttacttttttttttcattactactaggagtactacccctcctactaccactacagagataagttcaaactaaaattagaagtttggtcgaaattggaataatatgataaaaaagttgaaaatttatgtgtatgaaagttttgatgtgatgtaaaagttgaaagtttgaaaaaaaaagtttggaactaaggctgtgtttagtttctgaaattagggagaagtttggaaaagttggtagtttggaaaaaaaaggttagagtttatgtgtgtaggaaagttttggatatgatgtaatgtgatgaaaagttctaagtttgaaaaagtttgaaaaacatggcctacacaagggctttggatgctatagtttggaacttcggatgagatggctagctagtaacttttgacgcgtcactgcatctgccgattctgccgcagaagcgcactagcacagggaggccggaagtgtactccata

SEQ ID NO: 65801 - DNA, 4241 bp, Oryza sativa
gcgggtgctccgggcgattggggaggcgcgccaggtccgtacgctctccggcttcatcaggcacatggcgaaccaggagaggatgaagcgcaacgcgcggggcatccccaccgcccacagcgccgcatgcatctccggcccctgccgcgaaggtgagggggtttgctgcttggcattttttgttcaccgactctttttttctcatgcgaggccaatattttgttcaccgcccatttcgttttttttttgtgaggaaaaccctttttgaattttaatcttaatggatggtcgcagaggaggattagctgcgtttgtgcttcctatggcagtgcgttttagcgtgtttttttggctgcaaaacccgcactgtttgggagattttttcagctcttttttttttgttgcgcctacgcccctgtttaatgctaatgcacttttcgtaggcggaagggagtatcttcctttttttgtttttgtttttagttgggctatcgattcctgctctcgatttggagaatcttgccaagttgtgatagggagcaacattctgtaatggtgacgctcagttttcgaattcaatgcttgtcgatcgtattttttttctccttaattttgccacccttaagtcgtggttttggtaaccggttgattttagcctcgttggttcagcttagtatgatggcatttttctatttttttttctttttacctttgcatttcgcccatttggtatggttgatttggtttgcatgttgtttctttctaaggtctttgtagctgttatacatatcctaaattgtgaagtacttcttactaataagtcttgtggttacacagaggaatctatatccactccactgtactacaatgaggttcaaatggatgctcaaacacccaacgacatggtggaggttgggagtcccaaccaacagatgccgctccgtttgcatgacaatggcggttctgtcggacatattgctcgtgtggttccggaccttgctaacccagcagttgggagcccatatggtcgaatatcttctgtgctgctgcagaaccagaactgcgttgaaggttatacgccttcccgtggaatggtttctcctgcgtccaaccaggtggctgtgcagattaactttcctacccaaccaatggctcatgctttgcctaatgatgttatgatgcaggttggtagccctggccaccgcatgccatctgggctgcagagacatatggagattgacagccccatccagccgatcgtttctactccagaaagagtttccaccccgagccctgtgcgggatctatcaagatgtgtcgagaatatggctggcccctcaggaagtcctccatgtcccatttgggtgatgccgcaaattcctccagcaatctgtcctgacacgaccaatgtgttgagggaggtagtgagccctcagatgctagcgctgggagagttggagttcaggaagatatttatgatttttgcttatctttcctggttagattctcttcggtttatgctttttacataataaagaacaaagatgtttttatagcagaacatggactattttctaaggctaatatggcttttatctgtgttatgctgttgctaatacaccattttctctttttgttacaggaataagaaaggagtaaagcctccattatctacaccaaaaagtagtaagatagaagatgtcctctccgtggacagtatcagatccttgaagtcaatgtccatggctcaatttgagtcacgtatctggagcacatttggtcacgataatatatcatcttcagatagagcaaaggttattgcaacaccagtactcttaataattttcactaaaggtctctaaaaatgatcaaacatgatgatcccttttcatattggatcatgatcattgtaaatggaaccacctacgcaagtcattgtccttgaattttgtatgtgcgtagataacataatacatgcttactctagtgcacattggctctcagcttctgatgccttccagatatcaccctttcttcattatgattctagtgtccaggtttgctagatgtacttctgacttgtacctcctaacttaaatgtcgacttggtttacttaataactacaaaaaaaaattgaaatgggtacttgattacaatcatatgacactgcataccatgatggatggaacaaaaactaccttttgtacccaggttttgagtggccagttcttcagaatgctgggacgtcacaattcatttcctacgataagtctgggctggctgacatgttatccacaaccattatatcttttacatctttctagcaatacaattgtgcatgtttttcattcacaatttccttatgagaatattatgctaacattttatttttctgttttccactatttgttccttttcctctattataagttataacttgagcctgatgaaattattctccatgtaatgcttgcagaaccttgattctggtccaggtatgtcaaaagtctaccattgtaatgttgagataagagggggtacagttgtcaaaattttcaaggtgtgtggtgcttttgatacttttatacgtgctcattgtttaaccatgatatttttagatggcctactatttgatgttctcctatctaccagtcatgattgtgtaatgttcatgttcattgctgttgactgtttgcgaatctacccctcacataaaggtgtatatcacccatgcatccttcttaagctgcctaagatttttctggaagttctaatataaagactaattgcaataaaggtcaaggcgccaaaatcaacaaatgctgcactctgtgataatttattttgtaaggaacttaaggtgccatcgttatatttttaacattggctgggtgcagggaccatatattgagaataggaggactcatcttcagaaagttcttggtgatgataacgtccttgtagtaaaatttatggagatatcttcagacactgagactgatttgtctacctatttggaacactaccataaggttgctgaagagggtattgttttgggtttgcgctgctatcgatttttccgtaagttaccttttgttgcaatgctggatctatttggatttaatacgagtggtaggctgatgaatacacataatgtagagatggttactgcaatttatgatatgccattagggtcaaagttctctaatgtcttcatacaaacaatggtaacagattttttgaaagcatgaacttagggtgatttgggtcatgttaactggcatggggatgacacacatgctttttttagaattgtcggaaaaaatggattactagtaatagtactgtaattatatgcaaattagaaagcaatatccagtaaccagtatgaggttgccaacaggtcaatttgttgctgagaaactagtgccattttctgagttgtaaactcttgtattgttaccaagtgtccccattatgtttcatggttcctaatttgtcactgtttcatgattggatctgcattgattaatgtgccttttttagtttacaaggacggcgggaaagagaataaaatgaaagaagagaatagagaagaagaaaacaagaaatgtacttcatctgtcagatgctactttgttcgcactgagtctgggtggaacatggatgaaccttacatactctctggcagaacgattggtcaggctcgtgacctattcatgcacatccgtactgttctcaccttggcgaaatatatgctcaggtttttccttgacttttgaataatatcagttaatctatgcagcatgggtgcaattactgggtgatgtcgagcttagttgcagaaaatggttttgctaccatgatagcaacatgtgttcttataaaatactccttatatgccatgggaagttcaccggtttctttatatgccatcgaaaattagttattctttttgacgcgaaaggtagagaagctctaccttttaaccattgtattaatggtgagccatcgaatagaatttccatgctctcttatgctatccacatcagtacatcaccatgatattcagttgccaaggaaaagtacaaaatcacccttctcccttctctcctcctttcctttttttttcaggagatctgcctttcttcttcaccttatgtacccttctctctcctggattcattttcctctgtcaaaaaaaaaagatcattttgaaggtccgcttttctgtataact

SEQ ID NO: 65802 - DNA, 1429 bp, Oryza sativa
ttttgaataagacgagtggtcaaacgttgtaaacaaaaactcaaaatcctttatattatgggacggagggagtagtgggtcatatgtgtctactctgtggcaataaggaaaggaagtcccctgaaagaaaaaaggcatttgaatcagtttcacaacagtaggtaggcatttcaatcagtttcccaataacagtagttaaaccaaaatttacagaggaaccgtctccacaggttaagttcacacggcacttaccagccacctctcctagaaaaataatcacaatccagagacaccgcaagagctagtgcaacagccctttcaggtaaagtcaactggcgaacaacatgcagttcatcgatctgtgaccatcatttgtgacatggatctcgatcaggtaaatagcagttaagtaggcaagctgtgtgtggactgtgaagtactaaaatgagaacagcacttacatctgaagcgagaccaaatttacggtttagtcctgcatcaccaaatcgaattgcatactggccagcatctgtgaagagctgcagtgaaccaaagatacattcagtccttttttttttggaataatgatacattcagtccttaaaagctcagtcccattatttatgcaggctagaagtagcagtgcaacaaatgaaaaaaatgcactttgaaaagatgtggggtgtggcatctgccatcagctgcatcaaactgcacaaatatgtggagtcaccataaagcaaattcaaattactgcacaatgagtctgtcctgtataattgacgagttctgtaaaaaaacactttaagcaatgtaaaaaagcaacaccgtcatataaatttggaagggcagctcttactatcaatctgtaaataatgaatctatatgtatctagtttttcttgtcagataagcatggaatgcccaccgacataaaagaaaatgcatattatttgacaattctctactagaaaagacatttacctcaaaaccgattcccctccaattacgatcaatctgggctagtacattgtcatcctcatctgtgagagtaaaggtccagttccaaaatccaggattctcgaccacagcaaattgcctattcctaaagaacccaaaaggtggcagatcaagtgtcaggcagtaaagcaatactaaaaggtacacaaagaattgagtaatttgagtctagtcgaagagacaaggaaatgcagagatcagaagaccaaattaccctaagtacaggtcataaattctacgccagagatgccaacgtctgtggactacacctacctcctaaccaaattgaaaccgttaaacaatgtcagtacattcctgcacatttatctgggggcaaaattcccatctaaataaatttgcacaagcaagtaaagaagtttgcataccttggcattcacttctgcataaat

SEQ ID NO: 65803 - DNA, 2464 bp, Oryza sativa
ttaaagttggttgcagccttgggtttgacatcaggcttgactttcttgttgttctgggatgcatgagggttcttcttctataccatattggcactagaacctccctcaacctttttgccccggttgtcctttccctcgccttctcctcaacacccaaagagccaatgagatcagaaacactgaactcttgtctcttgtgctttagagaagtggcaaagtccgaccaagaaggtggcaatttggcaataatgccacctgccacaaacttgtccggcaactcacagttgttgtcctcaagttccttagccagcatctgaatctcatgagcttgttctactacagaacggtcatcgaccatcttgtagtcatagaattgctccatgacatacagctcactgccggcgtcggaaactccgaacgtggcctcaagtgcatcccacatgtccttcccggaaggcatgtgcatgtacacgtccactatgttgtgagcgagtacactgatcagtgctccatggaacaggcaatccgaagcctcgaacttagcctcttcctcatgagagagagatggttcacttcgtttgccctgtgaaacacagaagcattgcatcgctgtcaaccacaatagtgcacgtgctttccacctcttatagttagaaccatcaaatgcatgtggtttcagtgcagcagcaaagccaactaccgaaaatgacctatcaggtttttggattgttggaaatatggtcatatatcggcatattttaatccaaaatattaagacaataaccatggcatgaacaatgtggggtgatctagtgataacatgtagcataaccagtaatatgcttaaggtatcataagcatcatgcacataccaaggacgcaattgacttgcgactagcacgactaacagcggtatgaacgaatgagttaacaacaggagaaggacataccccgagaatggccctccgctggattgtgaggtagaattgcttccgttggtgttgacgttcgcaacggctccggttcccggcgcgccatctccagagacagcagcagcggcgccggcgacagatcaggctccggctccaggcgcagacatggtggatgagacaacaacgaacagagcagtcgtgcgggaagcactccccaaaaccctaatcacccgcctacccggtgcagatctcaggcgaaggtgtggttccggaggccctgctccttctgcgcgcaagcgatcagaagcgaggaagcgaaacagcacaggcgcacgcggaggaggaagaacaccagggagaggaaagcaagcgaatcattctgatcggactagcggcctccttagatagaaggagagattccgcaagttgcagcacacgcgtcgtgggatcgtgggatcgtgcacgcgctattacggaggcagtcgtgggaacgtgggatcgtggttgcaaaagaatagagacgtgacgtgacggcacgcacgcccgccagccacgcctcgcccacgcccacgccctggcccggcgcgcgcgcgcccgcgcgtgtggctttccgactcccacctcgaccggtcaacagggagcctccaataactccctatttaggttgagatactcctcacttaattcctaaggtggtattattatccttaacacttattatggacctttgagatttaatagaataaatcgggcctagcccaattattctaacaatccccaccaaatttcaaggctcataaaaaatgttctcaaggttgtgcctgtttgatatacctgtgttttggtggagactgttaagttgaacttccactaggatatgagctacatcagaccacaactgaacaatggactatgccttgaattgtcagtcttgtgtgatcaggtttcactcaaacccttgactggtactgggctgccgttcgcatcccctctgtttggagcatataagtcaaactccaggcctttcatgagtatctagagatcgcccaaacctcatagactgtgactagcagtcgaactcatataggtgtgttccttctgagatgttctgcaggtcaacatctctgcttgaaaaagccactcggatcacattaaggtatgagccatcctaccatgcagaaaagaatagaagtacatcatgaaaatgagcctttttcaagggtctcttctctctgtcacacaatagtttgtttcaccatctaaattcacgggatctccgatcacaatggacaggtttccactattgtgcaaccttaggtgggtatcaagcccatttccctcgatgcactgtctatcacattacatggtagccccttggtaaactgatctaccaaatttctagccgtttggacatagtccaatgctatcactccggagtttttctgctttctgacagatttcagtcttctcttgatatgcctagatgacttcatgttgtcctttgaactgttcactttaataatcactatttg

SEQ ID NO: 65804 - DNA, 3823 bp, Oryza sativa
ggaaagcaagcgaatcgttctgatcggactagcggcctccttagatagcacacgcgtcgtgggatcatgcacgcgccgttacggagggctcccagcgcgccatctccagagacagcactccccaaaaacctcatcacccgcctacccggtgcagatctcaggcgaaggtgtgattagcgatcagaagcgacgaagcgaaacagcataggcgcgcacggaggaggaagaacactggggagaggaaagcaagcgaatcattctgatcggactagcagcctctgatcgacgtcgtaggatcgtgcacgcgccgttacggaggcagtcgtgggaacgtgggatcgtggttgcaaaagaatagagacgtgacggcacgccagcccatgcccacggcctcagcccggcgcgcgcgcgcgtggctttctgactcccacctcaaccggtcaacagggagcctccaataactccctatttaggttgagatactcctcgcttaattcctgagatggtattattatccttaacacctattatgggcctttgagatttaatagaataaatcggcctagcccaattattcgaacagaatatagggtcactgataatatgttattcgaaataaatagtgcaatgatggagtatgaaactgtgtcagtaaaaggaaatgaacctgctgcgaggactgctctgacggattctgaaacgaacggaggtggcgtgggtgccgccgtggggatccgttcaggcaatcgatcaatggcggcgggataatcgggcgcagcaggtacccaatgagcgagagttccccaaggcagccccgacggcgaaggggaggatcagcggaatcagtcacactggatccagtaccggcattcagcgacggtcaagctaggcatggagttgcagttgcagcggacaaattaagcaacgaaatccagagtaaccaatcctaatttagcacaaattaaagcttcaaagtgtagagtaaatagagacaggtaaagcaatgtgcattacactaattctgttaagcaccgacagctgcagcagacaaattttgaaggggaacaactacattggtctcatcgggtaatagagcaaagagaagttaaggggacacatgcgagtgaaacccaaagtgctcaccagacatgtggacatggcgctgcgtcgaacgccgtctggtccagagaggaataaggccataaatgatgcaaagaaaagctgaaatttttttcacatatatggctatcaaaatcaattgccggaattgtctatgccatattattatctatcaacaatagtctgcaaggctggtgaaattgagctacggttggggatgaggaatggggcgtggtgggcagcggcagaaatattccattgtgaggcaccagagaaaaaacaattggcagatgtttgttactgcatcacattgatttgtacaattctgaatcagttttttttgcacgatcataaaagggtagtcatttattcaacccgttgatatgttgatttagaaagcagtgagccagcaaataaaagggaagttcatctgtcgttgaattgctcatgacttatgataaaaatcacaatcggaagattcaaaagtaaagggataatgcaatcaaagaaaaaattacctggagatacaatggatgttattccctgagtaagcattacatcgatcacctaccgtgcaacgtgcaaatgggattaaagaacatcatgagacaatagagcatgggaactgaaaaggggaagtggcttgatattgaacctgacaatatgtcatgaggtttcgtgaagtcagtggcagctacaagtcattccaatctgaggcttggcaacatggtgaatttgtattgtgacagtaggaatggcaagatcctgtttagcaaagagagggaagtaattcttactcttctaagtgtgaatttcagaaatcaaaatggaacaatggtggaacgaagagtccacctgtctatgttgaccgtgtccatggaagatcctgaccctgttatggtgttctcctcctatttttttctatatagtagttagagaaaatacggtaatttttttttaaaaaaagtggggataccagatttattttttagatggagatcaaatggttaaaattaacgggtccaccgatttaaaggaaaatcgacggtgagattatagaatgccacatggcgacctaggaacgtttgtagaaggtcacgtggcggcttgagagcgtttataggaagtttaatagacttttagtatatacctaggaaggtagcccgcgcatatgcgcgggaattttatcttatttaacaatgttagaaatttgattaggaatgtttatgattactctaatgtaaacatctttattttttcaataatttgtgtgatgtttctttgattgctagtaaccatcgcctgcgtataaattctaaactaaaattacttaaaaccgtgcagttttggttttataagaaaaaatatatatgcaactatatatcatttatacataatgtttttcttttttttaatatttagcatatcttatttttgcactttctaaactctgagtaaaaaattttctttcgtataatatatatgtctttatgaattttaggatatattaattgaagatatttttctattaaaaatatggttaatacgactacatctaattaaatgagctgaatatgttgaaatattgatttaattgtaagtatatagtattgtagtatgaaactacggtttagcggtaaatgtctttcttaatcagaaaatatattagaaaatgagacttttattgctcccaagttgtagtttagggttgtatacttcgaactgaaattatgttagattttgtttccatcataatgccaaaaaagtcaaattttctattatattttatttaaaattttagttattttcattatatcagtactccaaaaatatttgaacattgctatttagaatgggtttcaaattaaaatatttcaacattactatttgagcattctatcaaccatcccttaaatgctttgatctctgcaatttgacatgaaaatataattgggttaaggccatacaacttggcatgggataaagacaacccttaaatgttttcaatatattgtgtatgacaaatagatcctagacgcggtacacgttatgacatgaaaaaataatataattaaaagatttttctctaatctattagtgacatcagatatcatatatgtaatttagatgttatgatcatcttaggaatgtttatttatctctaaaaagatcatttattcataaaagtgcaactaagatcaagtataagtaaatagcccctatatgcatgttaagagaaattaactacttccactgttaaggaaaaatgtatcaatatttataacaccaaattatttttattgaattcaaaattgaatatgtttttataatatgtttgttttgtgtggaaaatgttactgtgtttttttataaactaattcaagtaatttgatgttgacaaaatttaagaattacttgtaatctgaaacagaaggagttggaagaaggtcactagatgtctagcatggtataaataatgggctgaccgtttattgaaaacataaggtgggatattttaatttttaatgataaattttagtattttattttatttattggaggcttaaaggtggatagatgtggtccacaatgtaagtcaatacgcatattaaattattgatttaattgaaaattacaatagtttagaaatatcataaattgaatatacgatttacaattttatgaatattttaaagtctaattt

SEQ ID NO: 65805 - DNA, 6055 bp, Oryza sativa
agttgataattttctgagcaagtaacccagtcattcatcttggaacaacccaggttccaccatatggatacaaacttcattcaattggttatgtaacataaaattttctgaagtaatcgatctgataatacattctgaattcagtcagaagatatgaacaagagtacaagagtaggtaataatacgaatagagacatacctgatttgagcaattcattctgcacgaagggtgccatgaagaaattaaacacctaatctgcagctctgaacagaaaagatctttaattaaattaaacgtggggttctgcaatttcttaccggcggtggagaccagacgatcggggaggtggcggtgcagaggttgcccgccggggttgccggcgcagagtggagcccaattagctaataagattcaagacactcaatcaaatcactcaagtacttgaattgagttctatgctggcatttaagtgctcagagcaccaatgctatggagctcctaaataaaaaagcacaacattttcatgtgaaaaggcatataaatatgctagaacagtattaccatttatactaattatgctagtccagatcaaatcagtacagtgtcattatttgcaaagatcaaagcacccgtccagtcagtagagggttagtatatatatgtaaagtctacatagaagaatagaaaagtattaataagaattcagtggttgcaaatattttgaattcttgaatcatatagacaaatatcggtaacgagacactcttatttgagtctaataattgtgcctcatattttctcagatgattatcagtttgcagatccaacttgttgaaaaggcttagcagctttgacaaaggttaatgtagaccaattactgggaaagggtcttcagtcttatgcacaattaccgagcaaatcgacaaagttacgagaaatgtgaaaaaaataaacttcttatgagctgtattttatagctcaacagtagtacagtacttctgtgtaagattgactggataagggctgcaatataaggtcaaattttacatcaattaagcatttcacccagatcaagaccagtcctataaatctcaaataataacaagaaacaaccaaatgctggaaaaaatggaaaaatatttgacccataaatctgaaacaatgctggcccagttttagagggctatcggtatttccaatacaaagtccagctatgttggctttacagggaacaagtccgaacgtaaattatgcagttaacccacaataataaacatacaagtgtaatactatggtttccccaaaaagtgccctgtaaaatgccatggaacatatattcatcatttgggaaagcgaaaataaacagatagttgatatgtatgactgatagcatatgttcatataaacaccgatagcaccttgtacatattaacaatagcagaaacaataggtcaaactgtctttaccttcactgcatgggaccaacgaaaatggatttccagattgaaactacaaagcggtctttttgtttgaagctatgggaccaaaagtccagtgtcctcgatgcaactgtctgatgaactgacaataatcagataatgcagttacatatgaaactacaaattaagagctcacctcgtcgattggcactgtctatcagtctatggcacaagtactgctccagttaactccttcctagctatcctgcacctcggtagcgaactgcaggcctatctgcatgatcattcttgttgaagtgcagtgatgctattagtataactttatactgagattttggagtccttccatcaaccgattaaaaattgcaatatacaagtagaaaatcatgtttatttacctttagaacaacggtcatgagccactgatttaaattttctgaacctctcttccaatcttccaattattttttctattttgtcttctctctgtttttaactttttttttctcttttcatcccttatttttttttatgctccttcccctcccttaaggctggagctcgcgactcccatcctcttgcacacgctgcgtcgtcgtctcccagccacaccatacaagctgccgcatcagagctgtagctagctagctaggtggtcggcaggagcaacttgctaaggaggctatcgtcgtcgtcgtgtccgctcagcccgtgcatgtcgttgaagggaagcccagaatggggatgggcagcaggcggcgtcggggctcgtaggagagtaggtggagattgtgagctgtcatcgttttgctcagatctggcgcccctgagctcgtccgacaaccggtgcggcctggacgggaaggcggcggcggcggcttggagggcgagtcggcgacggggatcggtggcggcgaggagcagatcggcgcggtgttgacggtcgttatcgatcaatttcgaccgtaaatattaccaaaatagaggagaactagtgatgcttgcaatgcataaatatgttagaataataatattccactagtattaggtatactaacctcttgcagggaatgacactaaagtggaggagaatcgacatcaacacaaacaataaatcaatcagacgatgtcgagaaccagacttatgtatgaatggggcaagaacacagaaataacacgacacattgggccaaaattcacaagtctgcggagaagaacaatggagaaggccgccaaccgaaattgggctggattgggccggccccaggttcgactgaacctggtggttcggccgaacctccctcgcctccgttggcatttctggcaccattgctggggaagattcataatagagattacttgaactaatactttatatttatctctgtataatcatttactttataggctaacattggttgttttcacttttgttgtggaacacagggcagtgcatgactggtttcaacctgccagaaaacttcaaagaaattccagaagctttcttccggagcgtcaggacgcgagtcgttgctccgcagaaaactctaccgacagagaaaccagtcgtaccagcgccaccgaccttcaagactatggccagcaagactcttcgcgagttcgctgctccctctgctgacaatgtggccattgggcagcaggtcaacataggggacgtggatttcgacttgaagtccagccttatcacgatggcgcaggctagaccgttctgtggcaagcctaatgaggatgccaatgctcatctgcaacagttcctggagatttgtagcacgtataccatcaagggcgtcagtcccgatgccgtcaggctgcagctgtttccgttctccctcctcgggagagcaaagcagtggttctatgccaaccgtgcttttatcaacacctgggacaaatgctccacggcattcctctcgaaattcttcccgatgggcaaaaccaatgcccttcgtggaaggatttccagtttccaacagacaagggatgagtctattccggaagcatgggagcgtctgcaggaatatgtggccgcctgtcctcatcatgggatggacgactagctgatcctagagaatttttacaattgtctcaccccaatgtcccgtgatcacctggacgcggtagctggaggagctttcttctctaaaacggttcaaggagccgttgaactcatagagaagatggtctccaatatgggttggagcgaagaacgactccaaacctgttagtgaggcatgcacaccgtcaaggagacggaactgcttgctgccaagctggacctcctcatgaaacgtttggacgaccaagagaaaaggccacaaggcaccgtcaaggccttggactcacacgtcacgtgtgaggtctacggtggcacgggtcattctgggaatgactgcccagaaacccgtgaggaggcgatgtacatgggcaacaacaacgggtatcgtccacaaggaggtcaagggaggaaccaaccacgcccatattatcaaggaggtaacaataacggtaacttctccaaccagccctcctagaaggatcttgtttttgcgcaagctaaaactactgattcgctaagcaaaaagcttgctgccaataataaggtcctggaaaacataaatgtcaaattatatggctttgcttccgcatttcaaaatcagctgagctttaataaaatgatagaaacccaattagctcagttggcatctttagtccttgcaaatgaaactgggaggattccggggcaacctgactcctccattgaaaatgttaaggcaatcacgacgaggggaggtaagtccaatcatgatccgccgtatcctaaccctacaggaactgataggatgtcaaaagaagcgtcatctagtgactcggctgacaaagaggttcagccagagaagacagtgccgcatgagtattgcgacacacggttgctgccattccctcagcggagtagaaaaccgtcagtggacgagcagttcgctcgttttgttgaagtaatccagaagatccacatcaacatgccattgttggacgctatgcaagtgccgacatacgcccgttgtctcaaggacatactcaacaaacaagagaccgctcccaacaacggaggtggtcaagctgacggaacaatgcagcgacctgatactccacaagctcgcggagaagaagaaagatccggggtgtcctacgatcacctgctcgatcggggcacaacaattcgaccaggccttgtgcgaccttggagccaatgtcagcatcatgccaaaagacgtttccaacaaacttaacttcacggtgttgtcactaacaccgatatgcctccaactggctgactcgtcagtctgttacctggcagggatagcggaggatgtgccagtcaagatacgggatttcttcattccggttgactttgtggtgctggacatgcacacagggaaggagacgctgctcatcctggggcatccgttccttagcaccgtaggagccaacattgacgtgggaacggggagtatccgtttccatatcaacgggaaggaggaaaggtttgagtttcaaccgaggacggaacaatgctccatggttagaatcaagtatgggccaaacccgcagaatattcaagtggtcgaagtggagccacccaaaacgaatagcctggcggaattcatgtagaatttccaggagaaggaaacaacgatgccaggaaccgttattgaaggacaccggtaaaatcacctgtaccggccaagaagttagagcagccggctcaaaagaagccgtcttccgcaccgaaatcaaagaaggtgtggaaggaaaagccaaagacgcccgctccatcacctccggagagcggtggaaaatccgcgcactgaaccgaaagaaggtacggtcctacacgtcggacctaaaacgacgcgatcttcgccaacaggtaaattggtatgtatccgcatatttgctttcaacaatttgaatttttgcacaatcacatgtttaaatttcaaaattgcatttaggattttgaattttgaggaaattcttcaactgaatttttcagagcaaaccaaaataaaattttcagcgaaaattcactttgccatgaccacactgaccgttcgaatccaatggctgaaagtggggccggctgggcccaccaggggttcggccgaacaccctggttcggcggaaccggccaggcaatggctccctgccactttttgcaaggtaacggctagtgggtcccacatgtcatttctaaccgttgtgggcaccctaaaaaagccagccggctgggagagggaattccatcccatttcaacacattttcattccctctccaaagtttgctctcaagttcattcaagctttgatagtttccctcaaattcaaatttttagttgcatatatacaagttgctttagtgaaactaaccggcgggtgaaactcttgtcattcctaacccccgccgagttagtccgttcttgcttcattatgcagaatgaggaggcgattgtctcgtctgttcaaggggtccggctcttcatcaagtcatcatgacaggtccggggtgcaggaa

SEQ ID NO: 65806 - DNA, 1027 bp, Oryza sativa
tgtgcactttgaaagaaatagaagatggtatttcttttcgctttttccatgaggagttcacgctcacatggaagggcttaagtacacttcttagctttctcgattcctgtaagatcgatatccagaaaggaatttcagggttcgagaaaaataggttttgggaagatatttctagtgctccaatttgcaagaaacctagaacggatgatatccataatcctacacttaggctcatgcacaaatggattgctatgactttgtttcctagaggtgatctgagacccattaggggagatgaattaattatcatgtttgccatggttagaaaaatcaaaattgctcctgtgaaatgtatgataaggcaatggttagaaagtataaagttctctgctcctgttgagtgcacttctctgattacttggatagcaaaagggttaggggtcgttagcaaccaaattgcttttatctcagccgctcgtccgcgtattgatgaggcttatctagtgcaagggaatattttgaaacatggggcagatggatctttgatatactttttccccggttgaacaaatgaaatcccgttgccaaatgcggggtatcatttgtacaactgccatgaactaaccattcccctgcagaccatagaagaatatcgtgcaggcagaacatacagggagacgcgcaacatgacaaggaacgaacgagaaagttcatcatcctcaacacccgtgcagatgtatgaggcaggttgggcaccaactggggatgcacccgggtggacccaagctacacgccatagcaccggagtctcgacctagacaagcgctagtgaggaccggtggcatgcgcctcatgacatccaatgggaggacaatcaaccttccagatcaagagatgtgcctccatctccaagtgaatggcgctcaagttcctctcgttgggacttgggtgaaatcactaggagaatagacacccttgatatgcaaacaggggagatccagtacaacctcacggaacacatagctca

SEQ ID NO: 65807 - DNA, 1185 bp, Oryza sativa
cttctggtatattatggttacagagttcatccacaagcgcacggatataccattgtagcatttcacccgtgagtattccaagggtatcgtatttattttatcccgtgggaagatcatgtagagagaactcaactaataatttatatattacttatgataatcatattctaaacaggggttaagataatccaagggtagagtgacacacaagcatttctactcatcctcttaataatttatctaagctaggtggaaagaaaagagaaaggaaatctattcctatacttctaatatacatagtatacatacattctagttaactgatatactagctaataccctctatccgatgccctcctggtacttcgagaagtcacctctgactgttgttgatagaaaacacgaggcctgggagatctgcttaactccagtgcaggtccaaaactcgccttcagatgtatgagcgtgccagttgatttgatcctacaatcaacaagaaacgaagacaaagaaaccgcgattaaatccataaatgatagctgatcggctaggtgtcgatgacatatcatttattttaggccgatgtcatgcgtacatcgatcggcagtcatgaataattaaagaacaagtaaatctactcgaccggctgtagatattaacaatatataacccttatgacgatatatacttaaatcaagtgattgggatagatcggtcgccatgccgagactgtataaatcacttagatcgaaatataaattaacaatagaactatatacgttcatatcatagccgatcagatagatctagcatgtatcggctaatactccgatatcactccatattaagatattaaagcaagtagaatatatcaaacagaaccataatatacttagatgcaacaagatcttaacataaagggcagatttaacatgtcaatcaagcacataggataactatagttaaatcaggtaagatcggttgaaaccccgatgctaccctaatcggcaaccagaaggcaggctagagattgatattctaagcatgacttaatatatcaaactcaaccgatgcagcattaagtatgaaagaagaacaatatctagacaatcaagccggtggatgtttcatagagtggtagatatcttatataatccaagctaacgtcgctatctagcctaatcg

SEQ ID NO: 65808 - DNA, 1139 bp, Oryza sativa
cctgcagcccaccaccgttttcgccactcgccgccctctctccccgccggaatcgagctcgcgctgtcgctctctctctccgccgtcgccgccgagctccggtccgcagccgtcgtcaccccggaccacctcccacctcggcgccgcctccttcggcttcgccgcatcctcgccgacctcgtccacctctccgtttcggtcgccgaccaccggagcaccgtcgaccccgtccacccgagccgcgccgccgccttcctccgctccggtcgccatttccgtcgtcgccgtcgacccggggtgagccgtggaccgccgcttcgtttccctctttccctcccctctctcagccgccgctccgccgtgcctatggccgccgccggcgaccataggggcgcgggcgcaccgcctcccgccgctgcgctggcgtggcctccttcgggcgcaccgagcggctgccgcgtggggcccggccgtcatccgcccgctccctcgggtgcggctgacgtgtgggacccacggcgccggccggtgtgagcccgggtgcacccggtccaccgtggaccgtgaggctgccgcgtgggccccactcccgtggacccggtccgcgcgcccctcccctcggctgacgcaataaaccctttttaaattaaaatttaaatgaagaaattcgcaaatattcatttaaagagcatataaacttcaaatgaccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacggttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgttattgttattatttccttgttcaccctagaataaacaaaaccccaactagtgggcactctactcatgg

SEQ ID NO: 65809 - DNA, 5524 bp, Oryza sativa
tggttgaacctttagctgacttcgactgggttgtggcacttgatgatggggcttcagatccagaacttctcatagttcgtatctttggcgtcagcctcatacaacttacccacttcatgtcacgcgtcaacactagcttgtcattactaggataccatgcttgtcatctacttctaagttgccacaaactgcctcatattagttttcctggtctccgggtgctagctacttctgctatgcgatgcgagggtcaataattttcgcctttcaattatgtttctcaacagagtcaacttatcccacttgacatgctttgacgcctttccagatgactttactgctggacttgttattgtttgatcgttaccctgccaaatctgaagcttcgctgttagatgcgattttaatctgacctctatagactatcttcgaacatatcacttggttcataactgggaatagttcccatgaacagacaactcggattcactttctttacattcagtttacttcctgctattctcttcatgttgtcattatttagcattcaaagtattccttcacacattcaaccctgatgtattcttttcagatttctcgtatcaatcacctttcgacctacttctttgcccgacaataaacacctttgctggtatcttctatcagtcacctttggaactttgtcaaccaagtactcttcactccgagagttgtggatgcttctggtgacgatgtggtcctttggtctgctgcctttcagtgaaaccttgaagtgttttcgccaaaagctatactgactgtcattgcctttgatccgaaaaagacatgtctgaaactctcagtccaaacaaatgtctctttggttaatcgcttgattttcttttccatcatcaggttggttattaactcgaggttagaacatggttcctctgaaatgagaccctaggtctcctttgacagtaaacaattatacacataatcccatatcagcatcttccgaaataatcctcatagaacttgtttttattacacatgtctcccttattacatgaatgcaaggccttgccttaaacaaaaagggaaggtgcttaacatcagtacattgcatcctcaacatgaatcttccataaacataacaaactcattgtttataatcatgaatgtatttatttattacatgattgctgcaaactcacgattacacaatgataagtagcgaactgaaaaccacaaacgtggctactcattttgattctggagagatatagctggcattgtcctagtgactgcatccttgattggttctgtgatgatgtgttaggactgcatattgctatcattcacaggagaagcttccttctgattgctatttgaagcagataacggtcttctgcttggtatcgcactcctgagattgattgcccttcgctcggcctggagtaggtcggggagagacacaacttcttccatcgacgacaattctttgctgaggccgtcggtgcagagaatggttggtgttgaaggtattattgctatgatttactgcagagtcaggtgcagcaggaggagcattggtgctgtggatgatatcgtcgaggttgctgttggagctgactagctgatgagacaatcgtagggttgttcgttggatttctgcggtcttggtcaacaacacactgagttggcaatccttgggcacatggttggtaccttcgcacagaaaacatgtgaccttgcgggtgggacattcacctggtggatggtcttcttcacaatgagggcagagtgtgagacacctgctagcaatgtgtccaatttctccacaacgggtgcatgcctttgattccatctcttcctcgccgagatgtcggggagactcatcttcaacatccgaggagacttgatctgacccttcactatcagatactctgccaccatggcttaggaggtgctgggtcaactgtcgtgcacctcggaaggtatttcctctttgacgtctaggaatagttatccctgctggaggccattcggtgctggtaatagtcatcttacgtacttcttcttcagttcgcatcggtgcttttctcttctgattcttactcttcttgcctttggcttgcttagtacgtgaccccacgtggtacgaaaggctaggaggaaagcaattcccgggattcaatggattctctccattgggctctctactttgcacactaggctgcaagcttgacttggtgcgaggaggctggtttagcgatgtctgccctgttaaaccaaaggaaggggcttctttggcatatacccatggacaattcaaggcatagtgtccttattctctacaatcatgacaaaaggggacatgctcttctggcattggaagctcattgatctgggtggcaaatgctcgatcaaacacatactgattttggtcttgacttccaaccaatggtagctgggaactaagcagcatgcttggaatggaccaagggtgtgccctggttaactctcttgaggccagtggtggattgagttgaaaacttgagttactggaggcataccctctgacattctttcctttttctctgttaaacatctgttacagggattgaggtgagagaggaaacaagctaggaaagaatagaccagaactagagacaggaccttaaaggaactaactcttcttgttgatgtgttgtttgtttcacttattatgcaagttgattaagcaaacaacctagcatggttacatcacaacccaccgatgcaaaccacgcgctacacacacaagcaaggaacacacgactaacaacactaccctatagggtggcttaggttctgcgacgggttctccaagatcttcactccttcacagctggcttcactgcttcctccacttcgctagcggatcctgcagtcttccggagcttcggcgaacaactgacgatgtcttcttcttcactgacctgaccatctagtactagttgaaatttgaagaaggaagaaaagggtaaacattttgcaaatagcataggggaaaggaggaaaaaggaactttcgcaaatagtttcatttataaaatatgtccttaggttttatccacttggcttatcatacagtcaagatggctctgataccagcttgtcgcgaccgagaaaatttgcattttcccgaacgctagtgtattaatccccgtcccagaaaaagccggggtacaccacacaaacatgatataaaagacacatctttattctatcgataatatttacattattacaaaggcacttcaggcctggcaatcaaaaataaacagcagcggactagcgggcctacggctccatcttcacaggcgctcaactggggtataagccaggactccacctaagacatcttctccaaagcctctcttactgaagaggggaaagattgagcaagagtgagtacaaccacagtactcagcaagccacaccggagatgcataattaatgcaagggagtacaaggggataattatataggggttaagttttgcagtaaacagcatttaaaagtcacttagttgcccaaagccattttataagacgatcctagagctacacagtattattaatcaaggccgtgaacccccacgaacctgccttaacccaaggcctacgatgattcagaccgaactggcaacccgaccctgggtcccagctcgtcccaagccaacccaagccaaccattccacattttagttgttgagcaaattttaagaattaaaacactaacttgggtacattgctcggcttgcccataaccgagggcgcggctattcgaatagattatactctgatcagaggtgtacgtctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgccttagagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaaaacaggttttaggggctttgaaagaggaagagaggggtatgtccaattccaccataagccaaccattccatagtatccaaatgatatgagaattcccaaagtctaaagttataaaatcacctaatgttgcctaattaatcagcgaagcatctacctaaatttatactagtggaaccatgaatagagtacccactagttggggttttgtttattctagggtgaacaaggtaataataacaatagcaataataatgtcttaacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccacgaaccacgcttcgggaacctccggaacgacgaaagctacacgaagcacacaagcaaagctacaagcctaaaaagaagcaataacaatacataaaaagaaagcacacggttctttaggttatacaaacattaggagacttgaacgggtcgattcagagttcgtatgaccaagatatgatcatccgaagtttaatgctgttgtatggagatttgcggattattataattaagctttgcaactttaaaacatgtgtaagcgctagcctggaaaagacaggaaggctgcgccgttgacatgcggaccccacatgtcaacctaaaggaccgcggtagaccgggtacacagagacggtccacgggtcgacggaagcggaccgcgtgtgtcaaccgaggcgagtggccgacaaacggagtccactagacaccacacgggctgcacacgtggaaaccacgcggctaccgagcgggcacactaacacggacactacacggtcaccacccgcacacgtgaacgactaccgacaccggtacacgggtaccggggtcgacgaccgcacaacgggtacggggcgacaccgaaaggacgaggacggggcagcgagaggagagagatccttaccaccacgcgacgaggcgcgggaacgacaacgacgaacgggcgcgcggagacagacgggcacaacggagacgaacggcgaggggacggcttcggcggcgatccttggacgaaggcgagacgcggccggcgcgagccttgccgacgcggagccgaggacgaagacgaggacggggctg

SEQ ID NO: 65810 - DNA, 927 bp, Oryza sativa
tcaagcgcttgtggtcatcgccctagtcttccgctgtttctcgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcatgacagaaggcatgacaagcagcaggacaggtatcttgaagaagatgatggtggttttgatccgtattgggattgtgagtttttcaggttctgctggaatgaagggatgaggctgccatcaatagaagattgccctggatgcagtgataatgcaggaagttcgagccgatcttataatagaggaaatcagctgaatcagaaaaggttgcctgttcattagaggttgggtccggtacaccaagagcattttcaggatgaagatgaaggcagaaattcacagtggtgcccttctggtatttttactaaaaatcagaagagaagggtccagaggattagaaatagggagcgttttcaggaggtacaacaagagatcaaccatcggctgaagaagacaaagaccaagcaggagtggcgcgttaagagcaaagtgctgtcagccgatgagattgaggccgacaaagcaaagaggctagccagaggaaaagctattgcatcttcatcggtaaacatggtgttcgtcctgccagtagaatatgaagctaatcaagccgatgtgaatgatgtggaagaagcttctgctgattaattttgtcaccagaacaagcaatttttgagaaatcagaggggacatagaatcggcatctcaagccattgtatgttaatggatttgtcaatgggaagccgatgtccaagatgatggttgatggtggggccgctgta

SEQ ID NO: 65811 - DNA, 5330 bp, Oryza sativa
aagatcctcctgcaggagcggagaacggaacatcgacaacttccgcgcccgagaaggatcctagtgcggccagctcttgtccttccgacgggagcacgagccgacaagaacaactcctgaggcgacgaggaccgggtcacaagacaaaagggcacgacctgcaaacttgcaaggtttttctcgacgtagaagctgaaatccgcgcctgcaaggagcgtggaattcaacatgcgcttccccaactcgtgatgtctattgccccattcacaaggctaagactcacgatctatcaagctgcaaggttcttctcagtgccatgaagacgtcgctccctaaggtcccgcagtcacgaatctcttttagggatgcagacaaggaacaaggtgcggcgactacctcagatcggttcgttggggtaatcgatatcgatccccacgagacatctgtcctacatctactcgaagattaggcctcatcatcgacgagtacgctacgtgacgtgtacgccatcgatgtaaccggcacctctagaggcggcaacacggaaacggaggaacaattggctacgccagcccaacacattagagccatcaatgcaataccgagggaaaccccttacgatcccgttctaaacgctgacctcgatcagtggacggaacgactacgggaatcggtggccaacatcagtaacgcgttcgaggaggccgctgccagagcaccctcgaaacaaccgctgacccgcggcgctgacgaagaactgcctgatcagcgggtgtcacctcatcaatctacccctccacctcgcggtgctagcgatctccgcgaccacctaaatatgcgccgagaagcgcgacacacgcaagacaacgaaaatcgttctcgacatcgcatctcttcgcaacatcacgagaacatagagcgacgtggacacccgagcggaaactgagaccatgatggtcgccacgaccgccgcgagcagcggctgccaggcgatgctagtcgaggtaaacgcaacaacgacgatagaggtcgacgccgggacaacgatgattggtgacgacgaggttcacgggaacccgggcgcaatccctgaaaccgtaccccggagccgagcgactcatcatcatcatcgtcatcggacagacatccacggcgagtgtatgatcgccgacaacccaccgcccctggcggcgggtgcgtggctttcactcgtactgtacgagatgtccggtggcctaagaagtttctaccgggagcaatagagaaatacgatggaagcaccgaccctgaagaatttcttcaggtctattccacaatactctatgctgccggagcagacaacaacgcattggcaaattacttgccagctgcgttgaaaggatctgcgcgttcatggctggttcacctcccgccctactcaatttcttcgtgggcagatctgtggcaacagtttgtcgcaaacttccaaggaacatataagcgccacacgatcgaggacgacctaaacgcgttgacgcagaattcgggtgaatcattgagggactatattcggcgctttaacgagtgcagaaatacgatccccgagatcactgatgcttctgtaatccgcgctttcaagtccggcgtccgagatcgctacacaacccaggaattggcgacaagacggatcacaactgctcgcaagctgttcgaaattgtgccaaggacacacctgagtcaagcaagaaaaagagtcgcaagaatgggaaacggaaagctcaagcggagatcctcgcagcaaagtacattgacccgcccaagcatccagacccacaaggcgacgatacgaggaaaacatggtgccctatacacaagtcggacaagcactctttagagacttgtctcgtcttcaaaaaggcactcgcaaggcaactagcgttggacaagtgcaagcgagtacgtgtagtcgagaaggccgccgaagcggctactcaggactcagatttagcataccctgactccgacctccatgtctcacacatcttcggaggttccacgctgtactcttctaaacgggaatacaagaaagtggagcgcgaagtttgttcgacatggcagggggctgcatccaagatgaagtggtctgaacagaagattgagttctctgaagcagaccaccccaagactgccattactccaggacgatatccgatcatggtcgagcccactattcggaatatcaaggtagcacgggttctcatcgacggtggcagctcaatcaacttactcttcgccagcacattggacgcgatggggattccacgaagcgagttgacgcccactgatcaacctttccacggaatcactcctgaatcgtcgtccaagctattgggcaagattatgctaccagtgaccttcggtcaggcaaacaacttccgaacagagcagatcacctttgatgagctgagttcgacgcaacgtataacgccatcatcgggaggactgcactcgcgaagttcatggccgaagggaacaatcactattcagggcaacgcgaagctagcagtacagtgcgacaagcgtgcctcgacatggtcgagcaaactcccaacccgcccgccacagctgagccgcccaagaaagtgagcaaaccaacaagacgccgaagccagacagcgcaattaagatcgttccgctcttcggggcatcactggacgacaaataggaactcacggtcatcaccttcctccgcgacaatgtagacgtgttcgctttgtagccgtccgacatgccgggggtccccatggaggtgatcgagcacaaacttatggtgcgacccgatgccaagccagtaaaacaaaaactgcggagatttacaccagatcggaaacaagccatatgagaagagctcgataaacttctcaaagccggcttcatccgggaagttctccatccagagtggctagccaatccagtcatggtgcacaaggccaatgggaagtggaggatgtgtgtcgatttcaccgatctcagcaaggcgtgccccaaggatcacttccctcttcctcgaatagaccagttggtggactcaacagccggttgtgagttgttaagtttccttgacgcttactctggctaccaccaaatcagcatggcgaaagaggacgaggagaagatagcattcatcatgccgtttggtgtattctgctacgtcatgatgccgtttgggctaataccgctggaaacactttccagcgcacggttcagggggcgctcaatgaccagcttggacacaatgtcaaggcctatgtcaacggcattgttgtcaagactaagaaaaacaactcattgatcgatgatctccgggaaacgtttgacaacctccaacgatatcgcctcatgctcaacccagagaagtgcacgttcagagtaccgtcaggcaagctccttggattccttgtctccggaagagggatcgaagcaaatccctagaagatcaaggcaatcgagaacatgaaatcgccgacaagactctaggaagtccagaagctaactggatgcatggcggcactgagcagattcgtcgctaggatgggagagcgaggacaacctttcttcgccgtgctgaagaaacaagacaaatttgtgtgcacacaggaagccgaagacgcgttcatcgcactcaagtgctacttgtcaaatccccctgtacttgttgctccccaacctaatgaagaattattcctctatatcgctgccacgccatattctgtgagtactgtcattgttgtcgagagagagaaggtgcaaagacaggtttattacgtcagcgaagctctacatgacacaaaggcacgacgccgcacgacagggacgctacgctacacaccgggggctttatccctcacccacctggcgtggctcgacttcgcccggggcacacttagctacttcgcctgcgatgccacaccgactcaccacgggcttcgcctccctcgtcgtccgggtgctctacaccgacttaccacggactcgggggcttcgcttcctcgttgtctgggcatttttcgccgacctcaccatggactcgggggcttcacctcccgcgtcgtccgggtgctctacaccgactcgccacggactcggaggcttcacctccctcgttgcctgggcattcttcgtcgacctcgccacggactcgggggcttcgcctcccgcgtcgtccgggtgctcttcaccgaccttgccacgggctcgggggcttgacacccctcgctgcctgggtactactcgccaccaccaagtgatccgctccccgcgcaggatggctacttcatcgccgaccgaacgcttgcaccgagccgaccgcatacaccgccgccgggtgatccgctccccgcgcaggatggctactgcgttgccgaccgaaggcttgcacctccgagccgaccgcatacgccaccaccgggtgatacgctccccgcgcaggacggctactgcgttgccgaccggagccttgcaccttcgtgccgaccgcatacgccgcctctgggtgatccgctccccgcgtaggatggctactgcgttgccgaccggaggtttgcaccttcgagccagccggctacgctgccgccgggtgatccgctccccgcgcaggacggctggacgtctgcatcgctgcctggtgacttcctccccgtgcatgacggctgcaacaatttccacctggcaatgttgagatgagtactcagccagtcttgtctccaccagatggcttcaccaacctctgagtcttcatcaagcaaagtactcggaggctactgtgggatacacggtacccgggtacccaaggagaggactttgggccatacggcataggttgggccaagagccctaagcccatacggcatacatgtaaataaagaaagagagattcccgggataagatataaatctcggggatcatgcatatctttataaatagaatagggacatccagttgcaatcaactagatactttccttgtaacccttccccctcatcctatataagagggggcaagggtcctgagaggagaggccggatcgtctccacgaggcttcttcctcttctttgatcattttgactagagacagagaaaaacacacactggacgtagggtattacctcatctcgagggcctgaaccaggataaacacctgtgtcaccatctctccttgatcttgcacacctcgtaaaatatattgccgatcatagaaatcgacacaaatgtcttcaaaagatttgagatgacaacaaaattgagttaattgtccataaatttacatatttcagtatagccaaagatccaa

SEQ ID NO: 65812 - DNA, 1164 bp, Oryza sativa
agtagaaagaaaagttacagccaaaaacctaatagttggcatgtatattatcatatagtagtaatgatatttatatagcataaatcaaactgttgggtaaagacctggcagtaccttcattaaaaaaatgatatttatatagcatatatatttaattatgtgttgaatatgatgacttcttggtttgaatatgacgtccattttatttgtttttcatacacatacgcatcacatacgatatatatctatttcttttataaaaaatattagatattcattttaatactcttgaattatgctgggcttgcctttggtcaatatgagtaaccactactacagatttggtttttttttatgcggctaaaatcgacttttgcatgtggatgggcggcccacctgtgctcaaaggtctacgaaaatcggattttcccatatgggcgcttaagctgaccacatgagaaaaggaaaaaatcatgaaaaaatatatataaattctgaaaattgaaaactaccccactaccccgatacgctaaccctagaatcctctcattgtcaacgccatccttgtcctcgccctccggttggcgtcggcgtgcttgtcctcccatcaccgtcgccgtcatcgtcgtcctcattgcgtcgccgccaccgacggatccgcgcggaagggagaggggcaccggatccgcgcggggagggccgccaccggatccgcgtgggggagggccgtcgccactggatcagggctggggacggcagccggccgccgctggatctgcgctcggccactcctccgtcagcctctcgctccctctgccagacccatgatgggatagccgccgtggccctcactcaccgagagtgaggggagaggggagaggagtggggagaggacttagtgacagagagaggagggcagaaataaaaaagagtggcaagagagaggagtattttctcatgcaggtcacttcatggatgttgttacttactttgtgttagaataaatgggctaggcccgatttttctattaaaatctcaagggcccataataaatgttaaagataataataccacactgggaattaaaagtggagtatctcaacttaaatagggagttattggaggctccctgttgaccggttgaggtggggatcggaaagccac

SEQ ID NO: 65813 - DNA, 3250 bp, Oryza sativa
cctgcaccccgaatgcaagatgggcagatgtcgccatcgatgcatgagagcacggcgacaacgagagcgagcggtgggtcgttgtgcgcgacgaggcacgggacgtcatgcgactaggatctcccaccagccgccccgcccagctccactcccgccgcttgttgcttgcctcccacatctggggagagaggggagaagggaaaggaggtgcgctgcacgccggccagcctagaggagtcgaggagatagagaggaggtcgcaaggatctggcgggtcgttgcactcttcgagttcccaacgccgtggatcgccgacgtcgctaggctgttcggcgtcaaggcgacacagttctctgtttcccgcgtgtacataatagacctcgcacgccgcctccacggcgagcaccggaccttggaggacctcgtgtcagcgcccatggggtttcctccgtcgttgctgcttgccgccgtgtggaacggacgacgttgattgggaggcggaagagggcggcgatggagaggaccagctgtggaacgccaccgcgagcccctctagcctgctgcgtgtgcctcggctgcagcgggatgtggaacttatttgccaaccccgccgatatcaacggccaactttgtccagtccgccactggtaaaccggcattgcgggccggaattgctactgggcgagcgatcgcccagggcgatcggatccggatcccccttcctccacctggttttctttttttgacaccgtattactttcctattttaataaatttatgcacctatagttcgtacacctcaagtttacacatttaaagtttagagacccaaagtttataaatcaaaagattatatatccgattcaaatttgaatttgaattcaaatattttttatatatagtatttctatacatctaaagtttatacacctaaagtttatagacccaaagtttataagtcaaaagttaacatacccgtttcaaatttgaatttgaattcaaatattaatttatagacccaaagtttataagtcaaaagtttacatacccgttcaaatttgaatttgaattcaaatattagtttatagacccaaagtttataagtcaaaagtttacatacccgttcaaatttgaatttgaattcaaatattagtttatagacccaaattttataagtcaaaagtttacatacccattcaaatttgaatttgaattcaaatattagtttatagacccaaagtttataagtcaaaaatttacatactcatttcaaatttgaatttgaattcaattttttttatatatagtatttgtatttctatacataaattttttcaactttgtttttttattttttaaaattgtatggtgtactgtagtatgaagagaagaaagagaggagaaagggggagagaagggagcatacagggggagcaggtgggcctgtgatcgccgcccattagccgtcccccttctatattcaactcctttaatgattgggctaccacgtgaaaacacttagaccaagtcgatctgtcattatggaaaaaccgcttttgaaaccacccaaagagtcaatttgaactggtttttgaaattgtgcaaggtgttatatccggttttgtgattgagggatacgattcaacgaagcaagagaggagggagcaaaatagacttattccaatcaactaacaagcaattttgacgtcctaacatctggacgagctaggcccggtttcggacctcagatggcctcacaggccttacagacaaagcccacaagatcaccttgtaagacagcctggtttatgggccaccgtgtagtcatctctgggtaaaaatggacaattgtgttcttatttctgttctttaacttcagctacgattttaccttttgttttaactttgtgattttgtaatacttcagttaagattgtatccctattttttgaagtttttgattttgtcatttttaactgaagtttgtatgtgctcttgttaacatgatttaacggtgttcgtccctacttttccgaggacattatgattttgctccttttttttttacattaagcttcattttataaatgttgcccctattttaatacgaatttccacttgtttagtaaaaaaaaaactaagggatagagcaaactcaaaatgaattttgaccctacatagttagtcatcttaacggaatggggtaagcacaagcttcagctcaaatataaggacatgatcttaaagttaaaattaaggataaaatcgtaattggagcaggggaagccaccgatattatgcacatgtaagtgagctttcaatagaaaattaatgggattagatatatgccactggtttcctatatctttgagcgtgtgttagggatgtattcattagtgtatgaatgtggtgttgtgtgcagtggtgtgtgtaaacatatttgtatgtcgttcaattgttaaaaaaaagtaacaggagtagaaaataagggtaagaatgcaaacaagaaagctatttttttttggatggatcgacgacttgaacatgtgtgctagattgtactacctctgttttctagtagatgacgtcgttgatttttgaaacacgtttgaccatattgaaaacatttatgtaactatcttttacttattgcgagttgttttatcccttgaagtactttaagcatgatttatgtattatgcatttacataaaatatttaaataagacgaatgattaaacacataacgacgttatttattaaaaacggaaggagtaaaaccacaaagagcattgagagaaaatagcaacgatgttaccacgctgctttattgcatcacagtatttacaacaaagatacgtcaccacaaatccacatgaaaatatatacagcccatggatgatcagctgtcgttgacgaccctgcagtcgcacctgacctcgccgtcgctgggctgcccgatgttccccatcttcaccatcgccttggcgaagtcggcggcgaacagcgccgggttggcggcgtactgcctcaccagcgcgtcctgcgacccgccgttgaacagcacctggtcggagtggagcaggcctcgccggaccagcaggttgccgtagtaggcgttgtcgaacgcgttctgcgtctgcacgtcgagcggcgccaggttggtgtcgccgttgggtgccgcggcggggcacgcgcggcggcgcagcgcggcgaacgacgggtcgatgttggcgtcgttgtagatgtgg

SEQ ID NO: 65814 - DNA, 3273 bp, Oryza sativa
tcgcaccggccgagcggcaccgcccagctcggcccgcggagcggcatggacaagacgaatgtcgctcacacaccagctcgccacgcatgtcacgagcacgcgtcgaacactcgggtgaacgtaccagggcggtgctgtcgcgcgcggcgagggcgacgatgtcggcgcaggagacaacgccggggcagacgtcctcgacgttggccttgatctggtcgatgacctcgtacccgcgcacggagttgttgttcggggcggcggtcttctcgccgacgaacccggtcgccggcacgtcgtccagaaggatggacgcgtcgcagccctggaccagtttgcagatcgatcattaataccatgattaatcaataatcatccttgcaaagttgcaaacgttagaaccctaagacattataacgtggtgattaacaaattaatccagtttacaagatgattaaacctggacgaagcagtcgtggaagaagaggcggatgagggaggcgcccatccggcgctcggcctggatggcgctcgccacggtggcgtgcacgaccttctccaccgacgggcagctatctgcgtagtacgacgtcgacagctgcccggaggcgtcgtcggagaggaggaagaagacgagcaacaaccagcaatgccaagtcctggaagccatggcaccgtactccgtacacacagctagctagctagtgatatgatctcgatcgcaattaatcttaattacctatgtgtgattgaccaagtgctaattctttccttaatgatcactggaactctagctcagctaagatcagtagcttcttgctcttgtgattggcacgagctaagaagttacacttgtctagctatttatagtgtggctgagatcagatcgcatgcacgcaaaaaaggggtagctttccatgacgccgatggggggtcacaaacttgtggaaaaaaatgggcaagttctacgacctttcttcctccagttgacgagagcgacataggtgtatgtgccaaataaacttatcggctatgtatcgctcacacaacttcacaaatccaatgaaagtttacaacacatacatattatctggaggaaatttcgttccttgcatatatatcaccttgtttttgctcaatatatcattccatccatcgtcttgattaagctttgtttcatcctggcatatacggagtatatccattagggtttacttgtgatatccctaacatacctattcagtgagttggtgcagtgattttctttttcttgatcaaaatgttaaatttgaaagtttttgaatcacaaaaaactatggtattcttatcttgatcttttcaaaacaaattaaatttcaatctgtcacaattaaatcatatcggaattgaagcaaatttcaaattggagaaaagcactgagattgatcacttacaatatcaattatttcaccttgttttttaacactgaaattttaatatttgagtgaacccttacgatgattcgatgagggggagggggggaattgtcacttatagcctactatgaaacttaggccccgtatagttcccagaatttgttttcccaaaaacatcgtatcaaatctttggacacatgcatggagcattaaatatagataaaatgaaaaactaattgtatagtttgtatgtaaatcgcgagacgaatcttttgagcctaattagtctatgattagccataagtgctacagtaacccacatgtgctaatgatggattaattatgctctaaaaattcgtctcgcggtttccaggcaagttatgaaattagttttttcattcgtgttcgaaaaccccttccaacatccggtcaaacatctgatgtgacacccaaaaattttcatttcacgaactaaacagggccttagctaataagtggcacgaaaccggtgtaaattacgagcaccaaattttattaccaactacacaaaaaagttatttggattggctttgacccggtaaatttacagctgctctctgcctattcgaacagaaaataaattgtgtacttctcatatatttgtcacgataaaaatcaggcttgggccattaggagctcggtctcaacctcaggcatggaaaggacttttggcgcagcttcgccacactagtaccttccctccaccatcgggccctacgcgcatgcattggctcccccacgtccagcctcactcttggcaagacggcagggagcgcccacatcatcatcctccatgatgaattctagtcttgtccttccttgtaggcttgggcttgctgcccctacctcgatcctcttcctcttcccgttgagattcagataattcccacttcttcctaatctctacccgataaggcgtgatgagttattctttcctttgttagatttggacactggtaagctccataccgctagttcgtgttaggcaaatcacacaaactttcgctttgaaaagttcgagattaagcttgtagaatgttttgtggtttttgagctaaaagtctgagttataaagttgcacatattaccactgaaagtttcagaattatggttgtaaattcctgattttgaataaaaaattacgatattatatcgaaatttcgaaccacaagtagatagtttttttttaaaaaaaaattactagaaagtttcatttgttttctcaaaagttctgtgtttatattgatagtttgaaccacaagtagaatatttttaaatttttagttgaaagtttcagttcatggataaatttttttgtgattttgtataatgttagtttgaaccacaagtagaaagttttttaattattaattgaaagtttcagattttgaattaaatgttctgtcattttatattgaaagttttgaatcacaagtggaaagtttttaattttttagttgaaattttctggttttgaatcaaaagtttgtggttttatgttgaaagtttgaagcacaagtagaaagtttattgaaattttaggctcaaagttgaaagttttataattcgggttctctccggttgcatggagagtcaattgcaggacgaaaggatcgaaaggagcagcagctctgattcggataggcacgtgcacaactttctctcctagcacacctgcgcaattgaggagccccctcgaggtaagctctctttctcgtccactgtacattgcatgctgctaccgtttctatatcattgctctactacaataaatataccttgtagagatattttcccaataatatatagacggggtgcagga

SEQ ID NO: 65815 - DNA, 2958 bp, Oryza sativa
  unsure (1)..(2958): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtaacattccaaaggacaatattgtcattcagtaagcacaccctctctccttcattcaaagaaaataagtaatataataatatgtaagaagtaccaatgtaaatgagcatagaaaaaataaaaatcaatgttccttggcaaaaaaaaaagtgtgaagcaaaattactgctttgaatggttcccgagtgttatgatttacttattggcaatcattcggattctatagttcggcattgccaagcacaacacaaacaatatgccctgatacatgtgttatctctctctttgttttttttttgtcattgttgtcagtggacctccgttagcatataagaaaagactattttgcccctaagatatcacacaagcagttaagcaaatgtattgcgctaagcatagtgagattcagttccattctttcactagcatcaaaataatagtatatttaattgcattattgagaggactctacgcgtcggaagccttatgccccctacatcccggcaagcgtgcatgcccaccaaactcttgggagagcatgcatgttgtttccgttgcttgctactccatcatgttcgactgtacacccatccatctctcgctatacttttagtaaaactttttattatttttttctaaattacttatttaatttacaattcgatcgtaccaccgttgttgtaactaaatttttttaaaaagatccaaaataattatgtttctttgataagaaaatatattattattttcctaactaaaatatttatatattgcacatgcatcattgagttgtaactattggaacatcatgaaaacttgctggaacatcaaaagaataccagtataccacatgcaatattttcaaatgaattagtaaaacatccaaatagcaccatatgcaacatttaaaaaaaaatcatagcaacataatagcttacaatgtgcaaaagagttaaaaacattgagttgtaactattgaaacaacacaaaatctagttgaaacatcataagaataccatatgcaatattttcaaatgaattagtgaaacattagaaatacttagtgaaacatccaaataccatacgcaacattttaaaaaattcatagaaacacaataacttatattatgcaaaagagttaaatttcagtggtactactaataagagggtagcgcgttgattagccgatcgcgcgcctcatcccgatctggccgacctccctcccacctctcgattcccacgccctcccctagtaattgttttactagcaatttcatatcttattatatataccgtcctattttttctgaggagttaaattcctacttttacggatgtagtgaaaccatctcgtcaagcggcaaatggggccgaaacagccgccaccgtcctcgccggcgccgctcggacggatgaagcgttcctcatcgtgcctcccttgctcggccgacatagccttcctccaacgctgttgccgacggagctagggttgggaaggagagcggccggcagtggagggcaggttgaggtcgttgtcgctgccggatttggtaagtgtggccggtggccggtagcggaggcgacttcggctccatccataccaactgccccgttgttcatcgtcgccgatgaccctgatctgtgcaaccataggcctccgctgcttggacatcggctgatctgcgcaaccccaaccctccaccaacggggcccaggcggttatagtcctcacctagagggaggtgacctccgtcgacgtgatggtcgacgtcacaaccgtggattcacattaggccgatgaggacgccctctgccataacagtgtgccctaccaataaaagaataagtaaaatagttacgaacaattgatggtaaatcaattgttgaatggattttggagaagaatttgagataattaaattactaaatggattctagcgagaatgcaaagtaaaagtacatcttttacttgatagtaatatactactttgcaaagatatcatatagtaattcttttactctggtacaactgtagaaaaacgaaagcaaagtaaaagtaaatcttttacttgatagtaatatactactttgcaaatatatcctatagtaattcttttactcccgatacgattgtagaaaaaacgaaagggataaactccgctcagggaaggagtgggaaccagaggttgggctagttgaaattgaaaacggaaaaaaagaagggggtggattgggaaccggaggcggaggcgagggaaactgaaaaaggggaaaaaaggaaaacatggtgaagatcgctacgtcaggcacttgaattaacaaacaacgcactgcgcatgtattagcgctaccgtaaatttcagttgaaacattctttttctcacgtgcgaaacatcgaaactcaatggttgaaacatatatttcatccaaatataatcatgtgtgatattttattataaagatttaattataacgaatatagcagtgtaatcagatagttgatccgataaataatttttaggaaaccgtttaagtattgtccatagaccttctgcacgtaacatgtaacatctcatgcatgtactggctactaggtggtaaacaattca

SEQ ID NO: 65816 - DNA, 5969 bp, Oryza sativa
ataaaacgtgggagaaagagaagttgtgtaatagagtgttttcaatggtaaatagtagaataatcacaataacaacaacaataaacaaagtttatgcttctctgctgccatgaaaatagtgtttgcaatggtaaaaagtagaataatcacaataatattgtatatacggagaacttgtgttcatcaatggtaagtagtagaataatcacaatatttttatggcagcagagaagcataaactttttttattgtttgtagaaattcttgcacatccagatatagtttcacaacttagagtgagttcgaggagaaagggattaagaagattaggaagatacgtaaaacgagataagccattagcacataattaattaagtattaactattttaattttcaaaaatggattaatatgattttttaaagcaactttcctatagaaaatttttgtcaaaaatgcaccgtttagtagtttgggaagcgtgcgtgcggaatacgatgggctttctcacccaatcccccaggaacgaacgcacctttagtgtagcacatgataaacagatgttcccatttataatgaccttgcttggttgatccatcacttttcaacccaaggtcatatgtgtactttccatagcttacttattcatccatgtatatcatgtgtatatatgggttggtcacctttgtaaccaacatcaaagctgcgaatcaccatgaacatattaattaagcatgtttaatgccttaattaattacacttatataagcaataatccatcagctgctgttgacggccctgcagctgcgcctgatctggccggcggctccggtgagcggtttgatgttccccatctttatcatggcggcggcgaagtcggcggcgaacagcgccgggttggagctgtactgctgcaccagcgcgtcctgcgagccgccgttgaagagctcctggtcggagtggagcaggccgcgctgggcgagcaggttgcggtagtaggcgttgtcgaacacgttctgcgtctgcgcgtcgagcggcgccaggctggagtcgccggagcccggcgcggcggggcagccgcggcggcggagcgcggcgaacgccgggtcgatgttggtgtcgttgtagacgcggtcgcggaagttggcgcactgcgagaagccgatggtgtgcgcgccggagagcgccgtcatgtcgcgcgggctcaggcccttgttgccgaaccccgcgatgagcgtggcgaggtcgctcgacggcgccggcaggtcgctgttcgccgcgctgaggctcgccgtcgtcgagtcccgccgccccagcggcaccgcccagcttggcccgccgagctgcacgtacgcgcgtcgccgtcagaatctatggaatcaattcgaacattgtgtgtgtcggtgggcggcgcgtaccagggcggtgctgtcgcgggcggcgagggcgacgatgtcggcgcaggagacgacgccggggcagaggagctcgacgttgcgcttgatctggtcgatgacgtcgtagccgcggacggagttgacgttggggaacgccgtcttctcgccgacgaagctcgtcgccggcacgtcgtcgaggaggatggaggcgtcgcagccctggacgaagcagtcgtggaagaagagcctgacgagggacgcgcccatccgccgctcggcgaggagcgcgccgagcacggtggcgcgcaccaccacctgcagcgtcgggcagctcgccgcgtagaacgtcgtcgacagctgctgcccgtaggcggcgccggcggcggacgagaggaggaagaaggccagcaagcagcaatgccagctactcctcgaagccatggtaatctcacaaatcttaattaattaattatctatgagtaactaagtgttcttgcttaatcacttgagctctagctaagcttagctaagctgagttagctcagtagcttagcttacttgatgtgtggctggcacgagctgagaagtaacaaatgtgttgctatttatagtgtggctgaggttgcatttgcatgcatgcaaaaggggtacctttcgatgacgaaaatggggggtcaaagttaggccgctacacaagtggaaaaacactcgagaagttcaaagacctttctcctcctgttgacaaatgcaacactcatatatatgcagccaaatatgcttatcgtttatgtatcgctcagaaaaaatgcccaatggattgaatggaacaaaaaaaattgtttagataacacacatgttgttggcattactatttggagacgtgcgcaatagaccatgagtacagttcaaaatttacaggggatcagagaaaattatatagtccctctatttgtttttggaatgagattagttggttaaaaataaactaatcattatcatatattttggaatgtacctccagatagtaagtatctcaaattacaacaaactttaatgtgccttgagatattttctcaaggactgcaaaacttttctcttggaatgaaggtagtactacacatggatacactagcttagtagcttctgataaaaattttattatattcacacatttatctttggtctctatctacatgatgtatatatatgcatgtggtttgcataataggaaaaatgcaaggataacttcacgaatatgtgacgagaccaccactaggacttcaataaacccctaagcatggacaccaaggtttgtaattggttctctaccaagttgtatgtgtttcccccaaaatacattcatatgcattaatttatgcaattcataaagttcaagcgtggattgtgttcaccggtaaaaatcgtaatcaaccagctaatttgaattaagcttcgtgtctcattcttaggttttatctcggcaaatcgtggtttttaaagttatcttttcctgtgatcacgttcatgcatgttgtgatcacgtataccgatcgtatataaattcgcttaagagatgtgagaaacggattgatgccattaaatagccgtgatgagcacgtaggcgagacatgacaggatcatatatatccaatgtgaataaaagaataatattcaaaacagattgacagaatttaagatggttcgatcggtagcttggaattaaactacatttgctgtggatcgatgaatataggaggcaaggggctgtcgatcatgcaaattggacatattaattttggtattttcacaggcgctatcttacgtggtccgcgtgcgaaattgtatcttcgcagacggactgtcatcgccctccccctcctcctcccccttgccattttttagccggtcctttggcttcgagagttctacccgcctagaaaaatattttgccatcgtctagaaaatagtctttctagtagtggtggatgtgcccatcgtaattttggtatttgagatatgcccatcagaccacatatgagatacgagctaacgtaattaaccttaactggtcagggtcagggtcaccaccatttgtcgtcggagttggagcataaccaaagtagatacgactcgaaatctacataatttaattaggcttcaattttctatcaaacgaaggctgtgtttagttagatccaaagtttagatttggttgaaattggagatgatgtgactgaaaagttgtatgtatgacaggttgatgtgatggaaaaggactgaagtttggatccaaactttggatctaaacacagccgaaggttagcaattccgcagaaggaaacaacctctgtcaatatttggttttccagttctgacaccattcagctgagcaagtatacaaaattcagagaaaaaaaatttcgatcgggactcgcagcattttagggatggacggacgtacgagcagacacgagcatgtgcccggcgacgaccacttgaccaccctaattaattaaactggagtgcagttatacgggcttgatcgatcgaccaacgaaatacttagcttctgacgtgattcaggctggaaagtagcggtgctgatggtgatcgattttgtgtttggtcgttgacactttatttatacaaaacatgcatgcatatatatatatatagggaaactatatgtcaaattgtcaatcgtttcctactacgagcacatgcataactcgcgcaatatgcgcaataattaatactatcaagcacttggttcttcagacttttaggcgtactaataactgaacctcaactgaattctatacgcgcatagtattgaagagtgccaagtccaactgatcagtgacactcacacagccagagaagcatacatgcacgcagaaaggggaactattttattccacgaggcgatgttacttcgtttgctaaaaataatccaaacgataataaaaaattctgaaaaaaatttgataggactcatacaacatatatatacaactttataaaatcttagatttaaactcaactcacacgtcgagatataaaaaagataaatttatatataaacagtagcgcacgattcacatattaatttgtctttttttatttctcaatgtgttggtcaaatttgaatttgttgatttttagtagatcgatataaattactccctccgtcccataatcccttatattatgtccctatattatgggacagagggagtattttttattttttttggaatttattactactcactactacagaaacacacatagaagtcgacactataggtgccggaagtgttaaaaccgacacatatagaccttttcccacctccgcggtccgaaaacataaaaaaccaacatatttaagtgattataggtgccggttctgtataaaaaccaacaccagtactataagtgtcggtttttaaaaaaacctgacatccataaaaccgaactgagccgcacgggggagggagagatatttctagccgttcttatccacagcccacccacacaccgcactctctctctctccaccttctcctcctcttttcttctcttcaccgcactttctctctatctctctccaccgcagtttcttctcttctcctcttctcttcaccttctcttctctttcttctctcccggcggcggaggcggcggcaggaggagcagtggccgctcggaggcgccctccctccgccagattcggtaggaggaagggcggcggcggcccaacaacgccctcccctccgctgtagcgacgtgcggcggcgtcggcggcgtgcggcgggaggtgcggtgtccacccggaggcaccctccctctgccagatccagcgggaggaaggacggcgacggcctaacggcaccctctcctccgcggcagtggcgtggggcggtgttggcggcgtgtagtgggaggagcagcggccgcccggaggcgccctccctccgctagatccggcggaaggaagggcagcggcggcccggcagcacccttccctctgcggcagcggcgtgcggcggcatcggtggcggcggcggtgtatttgttgatctagatgtgatttgttgatatgtgatttgtgatttgttgatcaagatgagagctagatgtgtattgtttgatctagatgagttcatgggtttgagataattttgggatcggcttgacaaccgattttttttggctcatgtgcacttcaaaggtgccagttctaaaaccagcattgatgaccgaaagtcaacagtaccgtctcggtggtaccggttggaaaaactgatatctaaggttaattgggtgggggcatatgccgctagctgcaaacggtcgcttgggccatttaattgcatgtcagtttccgagtccgacgatggttgtctgttgctctgtagagaggtagctctccttccagctggatgccatgtcgactagctttagcctctcaccttcgtatatactaggcatgtattgctcttattcccaaatgtattccttacgttccaaaattaaaccaacggtactgcgcagagagaggacaaaccgg

SEQ ID NO: 65817 - DNA, 2710 bp, Oryza sativa
tcctgcccccgcattttcacttgagacggagggcaggggaggggaggaccgcgccgccgtcgctgccttcccccctcggccaaatctaggaaggagagggaggaaagggtgagccacgcctccctctccggctggatatgggagtgagaggtacgggaagggtgggccgcgtcgccattgtcggtgccctccccccttttcggatctgggaggaagggagggtggggaggggagggctgcgccaccgccgcccttcctccctccagccggagctgagaaggagagggaggggagggctgagtctaagggagagggagagaagagaggaggagaggcgaagtgacttatgcttggatgattcatgttatctggttcataatactgttgaacccgtttttgtaagcagacctcataaggctacgcctgcaaaagtcgatttttgcaaaggtggccttaggaggtccgcaagtaaaaattaatttttgcatgtgcagccttatgaggtccgcctgtgatgatatatattttttcgcagatgggcggcttaagtcgtccatctggaatatatattttcgctggtgaatgaccatcatttccccatccacgacaatgcaggtggcattttgatccacctgcatagtgaaatgggtgtcgtctacgaaaattgtttttccagtagtgagttaaaagttggtttattttgggagtataacaactttcaaaatttatcttatttaagaaaattatataaatattatttgttttgctttcagatgaaagttttttcaattattttgatgtgacttgctttattattaatggtactataagtctaatttaactacaccatgcacatttacgctaaatcttagataagatgtacgaatatttaaatattatgtttaaaagtcaaaattgttgtatatgcatttaaaaacggattgagctatatgttgtctatctgtcaagcttatccgtttagtttattgccggtatatatgtcgccacaacgtaacaacaatgttactgtctggatagctagctgtacgtgcacatgtgctataagtatactaggggccctattcgatctccacatttgaagataaattttagttacacgcaaaacgacattagcacatgattaattaagtattaattattataaatttaaaaatgatttagttgcttttttaaaataacttttatatagaaactttttaaaacacaccatttaacatgttacaaaacgtgctaatggaaaataaggaagctgaaatttggagttataacagggccaattacaggttgcaagttgcatttatatacatataccaatatataagtatgtatcaagtgaatgcgtatatatcgaactaatctacgtaccaattttaaattgtcctagctatattcatattttaaatatgtgggatttgactgtgcgtggcctacatgagcgaattttatccctttgccaccgcgtatattccaatgcgatgtgccgttgaatttgggaattcctatatgtgatatttcttttttttcacgaatagaaaaaaggattgcacattaatatattatagcagagttccggttacacaacgtaaacaatcagagagccattgcccgtggacaaaggaagaaaaaaccagcaaaaaaaaccgaaaagccactccctatacagagggagagtggtggcgtagaaaactccctacactcccaacaggccccaaaaacaatggtgccagcagaacaaaaattttgtaatctatgcaatcacaaacactttacccagcgttaggtgtaaccgtgcaacgtggaaggatgaaaactgacagaaacaatatcatttaaaaaaatgattattggtcagtcaaaatttacatacttatcgattttattattgaatgttattgcaacataagagattagaaaactcaaactttatatttagccttgatcttgacttcttgagcagttgagcttgagcacttcaccgaaaagaggaggagcagtgcattcctggtgggcctactggccaacctccaacggacctcaaactgaagaaaccggcccatcctctccgttacggatcggcctaaaatcgtcccggcccgtaaactcaagcccctcccttttaagaggacgccgcttctagggcttctcccctttcttcctctcctgctcctcgcatcagcggcagccgccggcggcgacatcgtcgggcagcagcggcggcggcgacggcttggttgggtcgccttccgacctcgctgctctgatgaaccctcgccgcatgcatcgcgatcttgatattcttgacatggaattagtagcgtctatttttttatcccccttacggttcttgatctccagcgcttctctgaattctccggttcttcttgctcgctcaatttacttgttttgttttttctattgattggttgcgtgatcacatgagctgtggatgcatgcgatgttgcaaaaccgagagcgctgttgattaatccgatctccctcgggcacggtttgctcgtgttcttggaggggctcagtggagctcggatatgaacccttccatggagtttgtcaggctccctgcgtcctcccttgtacgcgagtttggaatactctccaacatttcttcatcccttgctttctatgttttttttttcctttcaaaatgtattattatattgtgtctttgagg

SEQ ID NO: 65818 - DNA, 5904 bp, Oryza sativa
acattatgtattcatcaaccaaggtattatatgttctatattagatttacttgtaatatatttgaacaaatattgctacataatgagtttcgtgtgttctcgtttgaagatgtacttacttgggtgaaggaaaaagagtccgagcgttaggaatgcatggatgatcaaagaagttgattggggaccaaaccaagatcttctccaagtccacttctatctcaccacgtcaattttggtccatagaagacaagagataaagttctacacattttagattcggattcaggcctcctgacattcaaatggatctagatgctgatctagaaggaattttagggcccatgagtacttgttgtaaagcttatgaagtttactttcaaatggatttcgtcccacgtcaaaactcccaccaagctatcggaaatctacaaaacaagctacatacctcatctagttcgaatctgatttgggtcttaggctaagcccaatggggtgtgcaccctagggtaaccctaggatatccttaatcatatttattcagtagccgtcatagtttagaatcgggttttgcttagattaatttgttaagaacaatttcactgctagatcggtttgtgaaaccctaaatttgagtgcttaatcattcatatgcaagtgtgttgcaatctatcttgttcttacttgtgttctttgattcgcatgcagggattagccttctcagtgatgtcaaccggatttcggtacagctgataaccaggggagaagtagtgctgcgattgtagggtttagatcgtgttgatcggaagccggatcgtgtgtgtcaagttttcaccaaatcgagagttatcaatacctatcggaagatcgggacctagcatccttatcatgtgacatcctggcccaattaagatttagcttatgttgcacataagagctgtgtgcgtatgtttattaccacgtcactagtttagcatgagtggaaccaacttataacggcttgccaatccaaccatatcacttctaggttaacccttttatacgtaacgaggacgaaagtgtaagtggggtagtatgtgtaaatgggcccacctatcagttgggctgtgctgcatggttctgaagggtgggatgttacaatagtcctatggaaatactgattacaatcactgagaggaacattctagcctccaagggtctcaagaatttgacaagaaatcaaagggcaaaatttagcaacaaactaaacattcctagatagtccggtttccctcgcctatatgcaagagagtagatgtatctgctatatgtgttttaataacaacccatccaatctaataggttaaaactaaatcgaattaccccaaactattgtgatagtatgaattaccctctcaattaaaaaaccagacattcttcactctcaactttttgtaccggatgaattataacaatccagttagcactaaaaataataataataagaggggctcacttgtcagttttgcctcctctttcggtcaccacatgtgggtcctacttttttatatatttttttatgctccacgtaggaccaaaaccatatgtgaatttattaggagggtatttcgaccggtataagaagttaatggtgaagaatgtctgattttttaattaagagggtaattcatactgccacaataccacaatagttcaaagaggtaattgggactttttccaactaaaacatcatttgtttatttcttgttacctacttacattcatgcctgcatccagagcgcatgtccatgtggatgagccgaatctacgtggaagtaacaagcaactttaacggcctaatagctaggcccggtttagacctcagattcacaggtcttacgacagacagcccacaagatcaccgtgtaagagagcattgtattcttagaccctatttagatcccaccctaaaatttttcaccatgtcacatcgaacgtttgatcacctatatgaagtattaaatattacctccatcccataatataaggcgtgcacgcattttaagatttaacctttaaaacatttgaccaatacttactatagtatgaaatgaattttatttgttaaaaaatatatcattagattgatatttaaatttattttcatatggttataattttgttgttacaaaccttatagtatattaaaaattataagctaaagattagttttagaaaccgtgctaactttgaccgtgtcttatattatgtgatagagggagtataggctaaaaaataactaattgcacagattgcgatgaatcttttaagcctaattgctctatgatttgacaatgtggcgctacagtaaacaattgctaatgacggattaattaggcttaatgaattcatctcgcggtttactgacagattttataattagttttttattagtgctcgaacacttcatgcgacaccctatataatacccgatatgatacgccaaaactttacgcccctggatctaaacaccctcttatttttgttttgtaattaactttagctacgattatactatctttttaactttatgattttgtaatacttcagttacgattttgtacctattttcttgaacttttttattttttcatttttaactgaagtttgcatttgctctcattatatatatattacgttaaagtggcttaatggtgttaaaatccactagtatgcctttgcagattcgttcctacttttccgagactttatatttttgctccttttttacattaagcttcattttataaattttgcccctattttaatcagggttttaaatctcccgctatagctgtttgaggagtacaatttagccgctatagctccatttagcccgctatagctgtttggaaagttaagcaccaaatatcttagcccgctaatttaaaacattgattttaatacgaatttctacttatttagttaaaagaattcagggaaagtacaaaagttaacaagaattttgacaaatataattgtcttaacggaatggggtaattataaggtttgggtaaaatataaggacaatatcacaaagttttataaaaaaatggataatatcataattggagtaggggaagcacaagtggtttaacaatggagtcgtgggtacatgactttattcaccaaggttcgaattctggtgccacggatattcatatataaatgggtttccaataaaaaaaatagtgaaattagatatgttccacgggtttcctatatatttgaggacgaagaggagagagacgtttggattgtttgagaaaatattatgattgatgtgacccaagcccataccgtagtgtccgatatttttctagacgtgagactcccggggtgaggcattctcgtcatttctttcctaacagtcttaaggttatgtagcgcatgcatattccgacaaaaattaaagagctaaccgaggctatctagtaacaacaataataaaacctattggatttggaaaagtgaggttaatatgaagattaaggtttttgtgtggttgttctttatggactgggttaatacaaggaccttctggatagaaagcactgtgctccattggatgcttcggttcaatgctccagctgtaccctgtgttagagaatccagagagcatatgttcttctttggggcatttgcacaactgacgctcttttgaaagctaagtattaatttgaccttattttattaagtttgcttatttgacccttcttttcaaaattgaagattcagtctgaccctattctgttaagggcatgcaatggtgttaactgaagcacaaaatatcccttctgcccttctcacttgaccctattgcacatgggacacacctgtcagttctctctcctctcttctctcttctcctcacctccactcgtgggggacaaggcgaggtgagcagcgggctgaggctgcgtgtgggcggagagaggccaaggtggtgccggcgagcggcgagagggcgtgacggcaccggcgagagggcgagaggacgccggtagatccgcctgccacagcccgagcaccgctgccactccttgtcgcctccaagccttcgttcacccctcccatgccagatccctccactgctgagccctaccgccaccactccctccctgcgcgccaccgctccctccctcctcgcggaggcaccgccactccctcccctgctagccggcaccgtcgcagatgcctcccgcgccccgtcaccgccgctccctccctccgcgagccggcactggcgtggatcccttcccttcacgccttgccgccgccgttcccttcctccacaagcccgtgcttccgctgatcccctccgtgcgtgccgccactgctcgccgagagagagagagagtgtgtgatggaatacgtgaaagagagatatgagtggatagggtttctttgagggcagtttggtcattacaaaaagtaattttatttcttgtttttttccaaatgaaactttaacggtgcagtagaaatagggttagatggattgttcatgtttgaaaaacatggtcaaataagaaaactaaaaaaagtagggtcgaattgattgttaggcttcgaaacaggatcaaataagcaaatgtccctcacctaaatacctaatgatataatcacagcatgcttcattctcccatccatgctttatgtaactttttctcttagctgcttagaatatttggaaggaaaggaatggtctaattcttcagggtatttagccttctattccttcttagaaaagaaatcataagtccgatttaagcctacatttacttcggctcaaggagatacatagccctttagtctcaaggattgatctactgtaattttcattttcagctcctccaatttttccccttttttggcgtttgccattatttttatataaacttcagaaattaatatatatcgtgggagcctcccttggtttgaaaaaaaaataaaatgtgggagaaagagaagtatgattgtaaatacgtagaacttgtgttcatcaatggtaaatagtagaataatataatcacaatattttcatggcagcagagaagcataaactttgttattgtttgtagagatttgtgcacatgtttcacaaatcacaacttagtgtagcacatgataaaacatgtattcccatttaatgaccttgctttggggtagtaggcgttgtcgaacacgttctgcgtcggcacgtccatctaaaaaataaatataaatctggtatccccactttttttaaaaaaaattgtcgtattttctctaactaatatatagaaaaaaaaaggaggagaacaccataactgggtcaggatcgggcagggtagccgccacgtgaccttttacaaacgctcctaggtcaccatgtggtattctataatctcatcgtcgattttcctttaaatcagtggacccgttaattttaaccattagatcttcatctaaaaaataaatctggtatccccactttttttttttaaaaaaaattgccatattttctctaactaatatatataaaaaagagacaattgctcatttgaccctatttcagagtgtaactatcaatctaaccctatttttcgtagttcgctcatttgaccctgtttttccaaaataaagttgccgtctgaccctatttctattatttttatttaggaaaagaaaaaaaaaatcaaattattatttaaattgatcaaaatacccttgaggactcaaccaaccctatccattcactcccaatcctatccagtcactctcaaccccatctctctcagcaccggtgcacagagggcggcggcaccagcggattaggattcagtgacattcccccgtgatattctcggtgacattgtgtcactg

SEQ ID NO: 65819 - DNA, 5804 bp, Oryza sativa
cacgggggaatgtcactgaatctgtgtccagcagcagctgctccgtgaggaaggaggaaggcgcaggagctcaccgccgaggggtgccaagggaggcgcacgccgccgccgcggggcgcggaaggaggcgcgcggcgcgggtcgaggatggtgcgggagctcgccaggaagtgtttggctgctgctttgttttttctgttgctgctgctcagctgctctccatctctctctcgcctctctctcgcctctctttgttcttgcccggctggagggagacggagccgctcctgctcaggaggactgcatgctgttggtgctggagggattatgtaatttcttttgtgtgaaatttatcaaaaatctgtcaaatgtatgttaaagtttgtcaaaaatatatcaaatctaagtgaattttgtcaaaaaaaagttaaatcaatttcaaacttgtcaaatccctcgaacctaagttaaatttgtcacttatcttagtaaaagaattgtcacttttttagataaaaatacacaaaattagacaagcaaaaactttgaaaaagtagtcaaatgagttgggaggcataaaagccatttttctcagaattaacaccgtaacaccgttatgttgctttaacggaatagagccagacctaacattcctttttaaaaaagagggtaaaaaagcaaacttaaggtaggattaaattggtagtcagagtttaaaatagggttaaaaacacaattaccaaaaaaaaaaaaaaagaggagaacaccatatcagggtcaggatcgggcagggtaagtacgttctattttttttcggcggtgtacatacgttactacgttagtattatttttttcgtcttttttttttggcaaacagtactttttctttacaccttctgcaaacaaacagtactactactacgcacatcgtacgtaggggagtttaggaggaagtgttaatagatatataaaatcacatattacggatttaagtgaaaatcgacagctagatatttttttatttctcataatttttaatatttattttaatttggagatgtgacatgtggtgatctacgagcgttatatatgagtgtcacgtggcggcttaatagcattggtaggaagtttaatagacttatatactgaaagccaaataaacttcctataaacactatcaagccgtcatatggcctcctacaaacgctcctatatcatcgcgtggcaccctataatcacattgtcaaatggtggatccgttaattttaaccaatagatctctatctcaaagaaaataaatccggtatccctaccaccaacaccttacgtatatgaggtaaaaaaaaacgcagtacgtatcccttccaccctccgaaactcccatcttctcctattttctactccctccatcccataatataaggggttttgactttttcttgtactgtttgaccattcgtcttattcaaaaaattctggaattgttatttattttatttgtaacttactttattattcaaattctttaagttcaacttttcgttttttatattttcacaaatttttttaaataagataagtggtcaaacagtgcaagaaaaaaagttaaaattgtttatattatgggacagagggagtagctaacatatcctattttatcattaacactcaatatatttaaaaataattcggacatctaaaaatgatcatgactctcaagttcaattttattctcaggtgttttcaattgttgtgttatttataattaaatatagatttcaaaatgcatattgctcatattttgttatctaaaaattagatcgtgcagccgttctaactgcaaatctctgggcttaatggtacacccataaacacttctaagttgatcgccacgtaacactctaataaattaaaataatatataagtgtgacaaatgaaaataaaacatctaaccatcggtttccacttacatcgatgatccatagttcaactcatcatgtgacacatccaacgatcgaaaatcatcaaataacatcgatccaacggcttccgcctcccctggcaaacaccgcgccttcggtgaaatcctaacgttggagattgatcccacctcccacctccctcaatcgccgcatgccccctctctcgctgttccactgcacccgccgcattcccattcgcacctgcgccgcatccccgatccctctcccgcacgtgatgacacagaaactgctctgccatcagcgctcccctcccccaaaagcctcgctgatttgccccgcacgtcatcaagggcgccggctcgccgcagtctccatcgccgcgatgccgcccactccgtcatcatcgcatccgtcctcgcccaggaatcacgtcgccgccgatgccctccgcgccgatctgttcctcaccgccaccgatccccgctgaaggctcgccctccaccgatccccccgccggaagcccttttgtcgtcaggtcgctgccgatgccttccacgccaagctgctcctcgccgccactgatccctgctgccatgtcgctgccgacgccttccgcaccgagctgctcctcgccgcgtgttggtatttcttaatgacattactagaaatataattcctagcaatggcgccagaaatacttctggtatattatggttacagagatcatccgcaagcgcacggatataccattgtagcatttcacccaagagtattctaagggtatcgtatttattttattcagtgggaagatcatgtagagagaactcaactaataatttatatattactttaatcatattctaagcaggggttaagataattcaagggtagagtgacacccaagcattaacaactcattctcataataaatgatctaagctaggtggaaagaaaagagtaagaaaatctattcctatacttctagtatagatagtatacatacattctagttaactgatatactagctaatacctctatccgatgccctcctggtacttcgagaagacacccctgactgccgagttccttatgacagcccgtcatgaccatacaaccggggctaaatatggaggaataccctccccaggaaattaacttaggattatatataggcgtggaggaatacctgtactgagctgtcaccatcagcggcccacctctcatccgcaatatataaccccaaataatgatatcccgtaatctagacaccacgtataaactaccagaactactctaatatcatcgtcatgacatagagtaattgcataagcaaacattatacccgcactaaagcatctcccaaataagctagccgtatattcagtataacaagaacataatgtaaggtaggtacttatatactcggaaagtatttcaataccataaatgtataaagaagagtattctaataaaagtacaaagcttacaaaagaggaaaggaaagctgctagagccatacccgaactctttcgaaggcttccggactcttggttcctattctatttctattccaccagctagatactactaaactaaacttgagagaaatgagagagctattgctgtgtgtaagtgaagtgagaaggtgaagtccttttatagctgaactacgacggttgtgacggttggaatggtcggtaataccctccaaccgtcattggggcttcatctcaaccgtccagccaaaacctggatccaacggaggcgagggaggttcggccgaacctggggacggcccaatccagcccaatttcggctggcggccttctccattgttcttctccgtagacttgtgaattttggcccaatgtgtcatgttatttctgagttcttggcccattcatacataagtttggttctcgacatcgtctgattgatttatcgtttgtgttgatgtcgattctcctccactttagtgtcattccctgcaagaggttattatacctaatactagtggaatattattattctaacatatttatgcattgcaagcatcactagttctcctctattttggtaatattgacggtcgaaactgatcgataacgactgtcaacaaaaccccccaagcttgaacccttactcgtcccgagagaaggacgaaagggaacaaagacttgattgattgatcaggagttgctactatgctgcatatctcagagatacaggtgcaaggtatatataccctcactcagattaaataatctttggcacggtggcttacccttacccctgattcccacgagacactgcttctccttgccttgggcggttgaaggacagaacatcaattagagtaccaatcacccaatctttattcacctcttattccggaagtcttcaaatgatttttgcaaaagaaagccaagttcctcaaatgattcactcagtctctctaagtgtatcagtatgaatttcctcaccaaatgttgccttgttgattcctactctaaggtttgtatgtggagatcggtagggatcaaacatggcatacttgcattcacatttattactaagtcaaaaacttagactagagcagataactaaatatactcaagatcaagatcgtgcataatgtgtgtgatatatggtggaaatggtatatgaggaaaaataaaaaaaaatacttcttctttgtgcttactttcttctcccaaaaatccttgttttatcggttaggagagggcatggctacatttttttttcaatcatgctcatgcttgatggagcataactttattattattattttttcataaccatgcctttccctccttttctctcttttttttttcaaaaggatttttctttttaggaggagaaagcacatgaaagcatggataatttattttggtggtaatatggaaatggaatggaatattgcttagctcccagtgtaggagtttagcatgtgcatatatgtgggtgtatgatcttgatcagagagcatgagaagtatctacacaagtcacaagagtttgacaaagttcaatggaatgtcaagcaaccaaaatgtatatggtttaatcatgatagcatatttttggctttggtaggaatatatatcaaatgaggaactttcaattttatcattttgaaaaacaaaacatccagaattcaagtcaaactagtatctggatcatagcaactcatatttactatctcatatctcgcaacaacttagacttagatcagcaagtgcaacccatttacctcaggttcccggataattgttggctacttatatttaacctttgagagagcacttatgttgacggtcgttatcgatcagtttcgaccgtcaatattactaaaatagaggagaactagtgatgcttgcaatgcataaataagttagaataataatattccactagtattaggtatactaactttttgcagagaatgacaataaagtggaggagaatcgacatcaactcaaacgataaatcaatcagacgatgtcgagaaccagacatatttatgaatgggccaagaactcagaattaacacgacaaaatgggccaaaattcacaagtctatggaggagaataacagaggaggccacctgccgattttgggccaggttgggccggcccctggttcggctgaaccaggaggttcggccgaacctccatctccaccgttggatgtggggtttggcagggacgctccagatcctctcctgatggcggttgcggggtacttcagacatttcgcagcagttacaaccgtcatacctgcctataaaaggacttcaccttctcactcattcacacacctcaagcaagagctctct

SEQ ID NO: 65820 - DNA, 2327 bp, Oryza sativa
cggactgtcgtaaggaactcggcagttgttgacaaccaaatttggtaatatcggcatcggaaaagaagattagatcaaagtggaatcggagacggagatcgatttaggaacagagcaggaatcggctagagtccggatcggctacagtcaggatcggcagagttcgagtcagacagggctagctgatacagccgattccaagaatacgactcggtgtacatcatcgggttgagttgatatgcttcaagatgattgccacgcatggatagagtccttagaaggcaatcgtatctattaattaggatattttatgtaatttccttagagatatgtttgggcaaaagtctgccgcaaaggcttatggtatcttagagtttgttagagataagaagtcgtgtccactatggacatatcttgtaattctcgggtataaatagaccctgagccctatgtattttttgaacacacacgtttaatacaatttcggcgcatcgccaccctttttcgctttagttttatttcgacgagttcttgctttcgggttgagctgcatcggtttcgatcttcaacaagaggtaaaacttgttatggcgacttgtgttttcgggattagtgcttccatctttatgacactctaatcttgtttatgtaattcgtcaagttatcatatatcttgtataatcttcggtaatatcgtcatctaacctaccatcggctaacatctgttagtagaaggcagccgattaggttagatagcgacgttagtttggattatataagatatctaccactctatgaaacatctagcggcttgattgtctagatattgttcttcttttcatacttaatgctgcatctgttgagtttgatctattaagtcgtgcttagaatatcaatctctagcctgccttctggttgccgattagggtagcatcggggtttcagctgatcttacctgatttaactatagttatcctatagcatcggctatgctatgaacgtatttagttctattgttaatttgtatttcgatctaagtgatttatactatctcggcatggcgaccgatctatcccaatcacttgatttaagtatatatcgacataagggttatatattgttaatatctacagccgatcgagtagatttatttcttctttaattattcatgactgccgatcgatgtacgcatgacatcggcctaaaataaatgatatgtcatcggcacctagccgatcggctatcatttatggatttaatcgcggtttctttgtcttcgtttcttgttgattgtaggatcaatcaactggcacgctcatacatctgaaggcgagttttggaccttcactggagttaagcagatctcccaggcctcgtgttttctatcaacacgcttttggcacgcccggtgggaccgattagaagtcagaaaaccgttttcctcatggccgagaagccgccaccatcgccgtcctcggctagcccaggttctgttaaagagaagatccagcaattagaccaatctgacgttaatgagggtaacgttatgaccattactccggacaaattgacacctgatcagaaggagtttgaagcaatgatgcagcaagcacgaaaccagttcttgaactcattcatgcagacccgcaaggggacagtggtgcaaaagtatcaggtgcgagtagtggctgatgtccccgggaccagttcttccaaggatgcgggactgaaacaagccctagatggcttgggtcaaccgagcgacaaaggtgctacagatggatcggctcaggagaatcagggtgaccactcttaaggagtgcatggagttcaagttgatggcactcagggaccacagggaggaaatcttaatcaagatggcagtgcgtcacatgaatttttcaataattttcaagaccgggttgactatgctgtgcacaatgctgtaatcaatcaatctggggtattagtcaataccttgtcaaacatgatgaaggcgatagccactggttcaatagctgaacatcaggctgcaggcccaatttatttgccaagaggtacctttccaaattatcgtcctttgatcaccgatattcatccacctgttcaagcggttcctcccattgcatcatcaacccagccgatggcgccggtatcgatttccccacctgcgccacctgctccatcaacgccggcaccaggtcagctggttaatcctcggctgttgatgagagagcagccacaacatagtcggcaagttgcgaatcggctaacgcagcatcaggttgctgccgtgtttttgccaccacaatctgctgggggtgcag

SEQ ID NO: 65821 - DNA, 707 bp, Oryza sativa
cccttcaggaagttgagcaggaaatcaatcatcggctaaagaaaacaaagccgaagcaggaatggcgcgttaagaaacaagcttctgtaaccgatgaagctgtggctgatgaagcaaagagattggccaaagagaaaagcattgtgattgcgtcggttaacatggttttaccttgccagccgaatttgggatcgaccaagccgatgttgatgaaatagaagaagaatcggctaaattgattctgtcgccagaataagcagtctttgaaaagcctgagggtacggagaatcggcatcttaaaccattgtatataaatggctatgttaatgggaagccgatgtctaagatgatggtcgatggtggagctgcagtaaatttgatgtctgatgctatgttcaggaagttaggcagaaacgccgaagatctcatcaaaacaaacatggcaatccatcagaaaccaagggtgttctagatgtggagctgacagtcggcagtaagactattcctactacattttttgtcatcgatgggaagggttcttacattttgttgcttggaagggattggatacatgccaattgttgtattccttcaaccatgcatcaatgcttgattcaatggcaaggcgacaagatagaaatcgtgccagccgacagccaattgaagatggagaacccaagctattactttgagggcgtcgtggaggg

SEQ ID NO: 65822 - DNA, 1026 bp, Oryza sativa
  unsure (1)..(1026): unsure at all n locations
aagttagaatcttttacaccattattgagattgaaggccgattagcaatttacttggggggcagaacaacagaaggcgttggataatattaaggaatatttgagttctcctccagttttgattcctccacagaaaggaataccttttcggttatatttatcggccggtgataagtcaatcggctcggtcttgatttaagagctcgagggaaaagagagggttctattctatttgagccgtcggctcttggatgcagagactagatattctcctgtggagaagttatgcttgtgtttgtatttttcatgtacgaggttaagacattatctactgtccaatgaatgtaccgttgtatgcaaggccgatgttgtcaagtatatgttatcggctcctattctgaaaaggaaggattggaaagtggatattttcattgactgagtttgatcttcggtgtgagtcaccgaaggcgatcaaaggacaagctgtagccgattttattgttgaccatcgtgatgattctattggctcggttgagattgtgccatggactttattcttcgatgggtcagtttgtacttatggttgtggtatcggcttggttataatctcccctcggggggcatgctttgagtttgcctatattattaaactttatgcaactaataatcaagtagagtatgaggcagttctcaaggggttgcagctacttcagaaagttgaagctgatactattgaaatcatgggggattctttgttggtgatcagtcaattggcaggagaatatgattgtaagaatgatatgttgctggtttataatgagaagtgccaagaactgatgaagaaatttcggctagtaactctgaagcatgtgtctcgagagcagaatattgaagctaatgatttagcccaaggggtgtcaggatataagccgctgatcaaagatgttcagattgaagttgctgccatactagccgatgattggagatatgatgtctatcggtatttacnnaggatccccatctctgt

SEQ ID NO: 65823 - DNA, 1587 bp, Oryza sativa
ttcctgcagctggaatagtaggagtagctggttgttcttcctcttcgacgttatgactgtctgccgccgaaggaataaggttgcctgattctagctacacaggaggtgaaggaggaggaggaggctgtaaaaaacacaaatgttagacataatcggccgagatcagttgatgagaggattgataatatcttatggtggagccggtttgagagttggtgcggccgatttcttcctcacggcagttttcttcttctgtgattatacatctgtgagtaatcagctgaaaggtgaagtaattacagaggaaatcaaagagagatgcttactctcgaaaaatgagctggggcagaaggagttggaggagtctgcttgggtgaagccgatggtgttctctctgtatcgctcacttcggctgcagcttgatcaacgtcctcttcaatctcttcctcgtctagcgcttgttcgatagatggatctagggcaggcagatcatcagttggcttggttttctttgacttggttttcttcttgagagccggacctgatgtgtccacagctgatgatctggttttccttttcttgcctgcatcggatggttccctgattaagccttagagaagagccgcaattttgggggcatcatagccgatgaatggaggagatggtccacctccatttggaattagtcctggggcatattcgatatctttgccactattgctctggtgtgggggggaagattctgttgtctataaaataggagattgattaatcaggtgatgaatcggctgataattgttcaaatacgattaataaaataaagacatatctgagggacaacatctggaaataggtctgtcatgtacattgaagccggttgatggaatagatgcagcttccattcaccccaccatctatcgaagtttctactcctgaatcttgccaactctatattttcaatactgcccaatgggggtccttgaagattaagcagccgattcatcattaaggtagatgagatttaccctcgcattggatcttatcggcaaagaataagccgattggaagttggcccattccaaactgcctagcagagctcattggatgataaaattcataggagacttggatgtttcttccttgatgaatgctgacagtaaggatacatgggctgattgcagttgagaagatttctctgggtttctaatatctgtcatggttgatatcttcgaatctaaagtccaaaggatgttctagaagtgttgaatcttcatagaggaaccagactcgagcttctttttggaatccttcatagaagctgcaaaaccaatctttgagcatttcggctgatagctttgctcctgcatcagttggtgtggatgcatattctccgaaggatgtgcatctccgatgagtgcgttcttctccgtcactgtcttcaattggctccagtcttgggaattcagcttgtgttacagatggccgattgacaaacttcatgactaccaaattcagccaggattgcagtagccaccatgttccaccagctccgactattgagccgacggctaacttagcccatgcgtt

SEQ ID NO: 65824 - DNA, 817 bp, Oryza sativa
gtaggatcaagactgccgactggaccaaggaagtagtgattttcatgtgataagcttggaattgctaccagattggatgaatgctacaaataatcgagaatagaggagaagaaaatgctatgaggcaagagaaaaccaatctgtggtaaaagaaagagatctagccgatagagacttacctcagcatactcggctggtggtgcagcagacgggatggcggaggacgacatcgccgcgggcggaagtctggccggagatgaagtcgcctggggatcgccttatgcgttggaggaatcgccggagagagagaggataaagtttggcttcagcggtaaaaacggaggaaacaatgtgaagtttctcgggggtgacggttagtatttaaagggctggagtaacggtcagaaaacggcaagtgcgatattcactcggactcgatatatggcaaatccgaaacattaccaaatattccggacttggggggcatgtgttgacaaccaaatttggtaatatcggcatcggaaaagaagattagatcaaagtggaatcggaggcggagatcgatttaggaacagagcaggaatcggctagagtctggatcggcttcggtcaggatcggcagagttcgagtcagacagggctagccgatacagccgattccaagaatacgactcggtgtacatcgtcgggttgagttgatatgcttcaagatgattgccacgcatggatagagtcctgagaaggcaattgtatctattaattatgatattttatgtaatttccttagagatatgtttgggcaaaagtctgccgcaaa

SEQ ID NO: 65825 - DNA, 6231 bp, Oryza sativa
ttccaccgccggcgagctcgccgtggacaagccatcttggagctcctcctctccatctaactagcaaaatggaatccccatacgccgtagatgctcaagccctcaccaatttggtcggaaaccctccccatcgccctagcacctagccacccgtgcccagccatggcggccatgctgtgccactcgcccccgcgccgtcctgcgccgtggcagccggcgggagatcgccggagccttgccgcacccttccctggccgccgtcgggtcgccctcggccggccttgccgtgcgcgtcgtgtttcccctgctgctcccgctcggtcgggaggaagaaggagacggaggaaggagaagaccagccgagccactgacaggccgcgccctctccttgcttttccctaagaaaattaattcggtagaaaaagaaaaggaattctgggtcccacctgttggtcactagggttatggattagattacggattaaaaaaaatcatttatgaacagtagccttttacaatttttcggatttattccaatttgaatatttaaactagcataacttattcgttttaactccgattcgagtgaaacttgaacctaaattcatctaaattcataagctttccaatggtatacaattaactatttaataaaatatatttataattataaattaattaatatcaaatgattagataatagttaacctaaatagtgtgccaataaataaaaatggatattgtacagtagaataattatctttaatatgttttgtcactgtagcaaccacataaattaattataatcaatgtttgaaattaatggatatataggaaaatattagtgccatttattaatctatgtccaaatataattaaaacccatgacttattagttatttaaatagagttagccttataattattaggtaagtaaaatatagatacacatagatcggtcctaagcttgtttatggcaaataataacagagctagtgtgattaaatcacctatatgaaattaatcaacgacatatcccatataatagcatatagtaggagaggtgagcaacccttagttaaccaagcagtaaatagaaactattcaaataaatgattccatatattaagatattgtgcacatatattgtacatcccattatagatatatggtatcgtattaatttgcttgttgcatatattaatttagagggagtatatgacaaacatgaatattagataaatactagttatacatcttgtcctcgtataattacagatcaactgtaaatttagattattcattgtaaaattatgtgatgggataatctgtaaccataatatgattaacctaaacaattctaacatacaaagcatgggtaattgttaaccttttataatttattttgacaagtgaaatatgtacataattaaaataaagcctccattaataaaataataatacaaatgattcacagtaattatttgaccgatccaaaatccatccggcaacagaacctctaatgtataaccgttctatttagatagatgcatgtgtaaccataatccttccttagccattagctagactgaaccaccatgacaacagaaagactaagaaaccttagctcttagcttgattagagtccattagcaagcgcgaataatatgagcaacctttggttcgacctcagcaaatatattttgtttgtgcatatttgattgttgcttgaatattggtttttctcgcgtattatagactttgtgtatcggttagtcgtgaggcaacgtctgcaacttccaggaggtgaaggttgatcaagattatatcgagaatagggattatcctgagcaggcaagtcatcaccattccttgaacatgttgatcccaattgcgaaattgttttgtttacaaataaaattgcatgtaatgatgaacatcctacttgtgattatgccatgccttgattattgtttacccttaaaatccttgtaaccatgattatttatgagtccctagtcaattatgacaattgcttagaaatgccattctagaatcatgcatactcatatttatcaaatgctatatgcttgggcaattacctttgggaatgtaattgagatgcggcatgtggagacatgagcgccacattgccatgatgttgatgacatgatttgtgaaaggagaaataaaattaaacaattgttttcgactggggcggacggaggatttgggtggtatctgggaaaggctagtaccgtccccggtcaattaaggaccgagccatgaagttaagcatgaaacgacccccgtacaaccgtacttctcgaatgggtatagacctagcggattagatagccgagcgaaggcagtatccctgcatagatggttcacccctgagtgaggcaggtgcgctacgatgggacagccgttgaggtagggccgagaggcgtgccctacatcggtgtcgccattggtaggactgccatgagtgtgtgagagagagaacttaacttgaaccataatttaatatgtgtgagacttctctttcccgggagcgccagaactcctcacactgctagaaacatggacgcctagagtgcatgaggatttaagttcatggagcgggtactgccaatgcgaggttatcgaaaagctttaccgtgacgcgtctcatgtgttgggacgaggctcatgtgttgggcagtcgcggagcgcgggtaaagtgtacatccactgcagtgtgagtaaaccaaatctattcgaatagacgtgctcgcggttattgagcaccgggacatgtattacacttggctagactctaaattcttaacctgtgtgggatgggatattgcatgatgatttttatgttgatggagccacttcctgagaggagggaaggtggacgtcctcagaaaaccatgacgactcaatggcgggaagctatccttgggatcacaatggatggtggacagaaccgtcgttgtttaatgtgaacactggtattaaaacttgatcagtctatgctaggtctcatgcttgtgaaaagatttgcaaaagcttgctttacgtaaaagaacctggagcccttccttgaaataccctctatcatatgcattgttgttgtggtggcttgctgagtacggttggtactcacccttgctatttatatatcttttaggagagtgttgaagagaagtccttgtcgatacgcttgcgtatccaacaagatgatcgaagtgcggtcttgttctaggtctcattccccagtcgactgcctgtggcatgttaaccgggcccttatattatttgtcttccgctgttgttctctgatagttgttggcctacttggccctaacgtaagtatttaactcttttagcctgaattcattcatgatatgttgtgatccaactatgtatgtgtgtaccaactactgatccactgattggtacggataaacacagaagatttccgatttccaaaatcgggggtctacattccgcccctcactggcgcccgatagccatcgtcgtcgttttccccaaatcgggccgccgtcgtccgccattgctgccgtcgctgaacctcgtcaccgcccccaataaagcccccttctcccctctcttcccttccactttgcgtgctgcacccggctaccgctagaatggtcatcatcggcgaccaaacgaccacgcccaccgccgccaggaaacctcgccgtgcaccgccgtcgtccatcaccttctatccctcactcgcaagtcgcaccgcaccacaacaacacaagaaaagggaggcgaacgatggagggagatattgcggcggcttcgggggtggacgcggcggcgttcggcggcatcaggagtggatacggtgtcgctcagcagcggccggcaacggggacggcataaggggaaggcagaggtggcggcgcggaggaggcgctgaagagagacagggagagggtgcaggcggttgcgcctgccgacgcaccgatggcgatggtgcgcgtgaggaagaaggcctgcgaagggagatgaagtggaaggagactgactagtgggtcccacatcgtttttcgctcaatgttgccatgttggcttgccacgtgggtaaaagtggcaaatagttaagaagccacctcttaagaagggaaaaaaattaagtgcaaattcaagaggggtatttggataattgccaaacgtaatagtggcaaatagttaaattccccgaccaggagagcacgatgtcgcccaaatccctgtccccaatgtcgccgccacggcaggggcctttctctctcatcgaccaaactgggtggtggagaggctagtagcagatggtggagaggctagtagcagaaagccacaaccagcattcgcgaggaagagtgaggaggagtcgccggagtcgcggtcacgtggagtctaatggtggtcgcatcgctgctcgcggagaaaccggagtgatcagtgagaagaggaggaggagaggggtttaatggcggaggaggagtctctttagagcaagtttaatagtatagcatactactagctctaaatcatctatagccaatgtagggtgtgttcagtttatgccaaaattggaagtttggttaaaattggaatgatgtgacagaaaagttaaaagtttgtgtgtgtagaaaagttttgatgtgatggaaaagttggaagtttgaaaaaaaaatttagaactaaactcggccgtaatagccaattcatacaatagttgcttactatactattaatatctggtcccacctgtcatacacccattacgtcttggagtccgtactgcagcccgctgctcttcttttttttttcctttatctctttaaaatatctttatctcttagcttttgtgagaaggaaaaaaaaagaaccgagagtcggcggttcatccactgcggttcgtgcctttttggatcatcggggactggaccctttgtatggggaaggcaaagaggccgtcgcggtggtgtgtgagtgtgtgaccgtgtcgagtgtattggccgcgttgaaatgattttactactgccagtttttttttccaaaaaggaatccacacaaggcatgtcagcaaaaaaaaaatgatttcactatgttgcaaatgttcactcatttacatctagaactacaataaaaataaatatataatactagctaaaattctagacacatatatatccagattcgtagttagtattgagtttttttttaagacgaggcgtaaactagagtctatattaacatcatgtctaaattttaaaaactgctactatttatataaaatatcgattttgttataacattagttgaacatttcgctaaacaacattagttgaacatttcactaaactacaaccgtagaaaataattttatcaataaactacaacattaacaaattatgtacgcatgacaggcggctgcgttagataggatgggttgggaacccatccccttcccacggaaaatggagtagtccattagcacatgattaattaagtattaactattttttaaaaaaaatagattaatttgatttttttaactaacttttttatagaaactttttgtaaaaaacacaccgtttagcagtttgaaaagcgtgcgcgtggaaaacgagggagaggttgggaaccttgaggttcgaacgcagccgttgcaaatgcaaatcttacttacatgataatagtttcatcaaaataatagttttgagaaaataatcatgtttacaatttactccgacatctataatgaaaaaaaaaagaggttggtgatctataataataggattataggtagaatgtttgtcttgtctcttaccccctccatcccataaaaactaaccagtatcaaatatgacacaactatgaatctgaagatatatatgttcagatttatagtactaatatgtgtcatatcatatcctagattcgtttttacgagacgagggaagtactactatgcaaaatgtactgttagcggaaggaagaaaggctcgacccaattatagtttcgtctcttatgacacttccatatctacagtactctcgccgtaccataatataagagatttaaggtgtatatgacatatcctagtacaatgaatctggacaggctgatccacccaaaatcctttatattatgcaagggagggagtacatgccatatatatatatatatatatatatatatatatatatata

SEQ ID NO: 65826 - DNA, 4560 bp, Oryza sativa
tctacatgcatgcaagatggcattcgtgaactgtcgtcctgttctctgcattgatgggacattcttgacaggaaagtatcggggccagatactaacagcaataggggtagatgggaacaatcaggtattgcccttggcatttgcttttgttagagtgagaataccgacagctagtactggttcctgaaattggttaaaacaaaagttgttggtatgaggccaaatgtgtgcctgatacatgataggcacgctggcattctgcgagcgatacaagagttgcagtttgggagtatggaacgaggataccccggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagcgtgcagcggctccatcgaccgccgttgctgaccctcctcaagctcttggacctctcccaacggatagtccaacattggctagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacagcattttgtttggaactttcatgcagaacaagccagaggagttgcgtaaaaaggccatgaaacatcaagctttagtgcaaggtacccaacagcacaggtttgagatactatgtcaagataaggcaggcaagggtatctaccgcaagagagtgaagcaggagtgtgttatcaaagtcgactggcacatgtcattgctcttgttcaaagccgaagctgctccacaggccatgcacccatgtcattgctgccgcagcagagtgtggcataccagatgcagtatatgtgtcacagtacttcagtaagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaatcaagtgcggcgatgaacatgggttagtagtcagctggcgacttttgttgaggactggttgctcgcaaccgaggaggtcgtggaccacgagggagaaccacacactgaggaggcgtaccaggcctacctatgctggtaccagccacgcacctgtactagggtcaccttcgctcccttggagcagcagccccacgttgcgagcactagagacctctacgccaggcaccgcgaccaggacttcgctcgtgctgtgagtaccctgcatcgcaccattcctttatgttttcatgtctttctcttcgtcaaattttacgaatatttacgaacaaattaaccatgcaggtcgacgacatcaaccgggtcgtcgttgacggttcaacgacgatccaatgtttaggcgtggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtaccgactggtccctgtccagctgcgcacgttcctaggccgactccccctctgcacggaggtaagtatttttattactatttctgtacatgcctcgcacatataagtgagccgtttcacttgccgattgcttcagggtttcgtgcaccgttcagtaccccgccttcctcggctaggccttctgttgtgccccccacaggtacttaaaaaaacaacattacttcgacaatcaatttacatgcattttatgtcttagcttataagggtcccgttgtcgatgtgtaggtttcgcccagttcgctatgacgcaggccgcccacttctcgcaggctgcagggtcagcgtctcaggcagctgcgtcgacctcgcactcagcgcagttctggcagtacaccgggacttcgtcacaggcagccggcacgtcgaatcagggtccaccactggaccatgctaggacctcgttggaccgcttgctgccttccaccttgctcttcgacatcactgactttgacttcgcttcaggctcgacagaggacgtcatcagcccctcacagctgggaggcgcaccgccggtgcagacgcaggaccaggcgcaggccactcctccgcgggacactcgtgctactcgtgctgtgccaccggatcgtttcacctactcctaggaccacgtgcgagcacaggcccggaggaccaagcgtggtcgcggcgcggggcagggccagtagagcagtcttctctttgtttatttgcttcactttccagtactgtatgcttgtgtaatgactacgttgttgttatatgtgcacaatacctttcggcgcatgcacgatacctttcggcgcatgcacgactactttctgccgcaccgatgcagccttctttattcgcgtgcgatacgagtatttgcccgccatttggcgcatacgaccaatgtaacttttggcgccgatcaggcatgtaactttcggcgccaatcaagcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccgactggctttcgtcaatggctagacgtcggggtgttgaggatccgaactggcgtagcaatccttgtgtatacctactaccaccttggtgctagcgtcctctctgcctatgcggtgatcgatgccaactaatggcttcgaggaatcctgatattcgaggaaggcgcttttttaggtgccctaactattttattatctgcatatgcttattcattccgtatgggcaatcgctttattcttcgtaacactactctattcggctctattcggcagacccgcactacggcttgcgcatacatcgagtgggtcaatacagaaaatctcgttctcgacctaaccacttgtttacaagaaggtcgctggtatttcgcatccgaaagtactgagcaatacttacagagaaaagcggcaaaaagcggcttatgaacgacaatgtcgtgaacaacagagcgactggcgggtgctaactacggcactccctccatgggaagcccatccaagatgcaggtgtggtgatcgttgtcaggttcttcgttccataaatcctacaacattgggtcgaaggttctttgtttgtccaaatattcttgacgacgatttcataataagaatattttgattacatgaatccttattttctcacaatatttactaactttgcttgctttacatctattttttcctcccaggaaccactaaggagatgtcaatacagagaatggatagacaccagaagggttctaactccacctagccgtgttgtgcagcttgaactaccagagcaatacagggttactaaagcgcggtttgagagaggagagggatcctcacgtaggggttagctattatcggacaactaggcatattgaaatttctactgtcatgcttccttgtcccattactacatcgtcgctgtgttcaactattgcactacctccctcatagttcgaatctaatatcatctatgtaaccgcaatgcaaatagttatatcatgttcaaattgtactactatttcttcatgttacataattctccttgtttaagtcaatataatgtttctacgacccagtctgcgataggcctatataaattatccgagtactaatacgtcgaataaggtacaaaataatacctcacttaacatatgaaattgcgcaacaaccaacttcaatacatttttataacaatattaacaagttttaccaataaatacttttttatttattattaacataacatagaaaaatcttttggccgtacttttttcatctgggtcccttgccgccctagcagtaagggacccagatgtaaaaagtacggccgcaagctctttatgggcggccaaaattgcaattagccccttgctgccctctgtatgggcggcaagggcctaatcgcaatttttgccgacggcggcagatggcgcggtcgacccaccgtctgccacgtcagcttgccacccaccattagggcggcaggggctatttctgcaatttttgctatatagattatgggg

SEQ ID NO: 65827 - DNA, 4148 bp, Oryza sativa
ttcctgcaccccatatttacaaatgagtgcagtaatcgctttattataaaatagtaccgtaaagatctcattgcccatagcatcagtaatttctgcaacaaatggccttcttgagcaaatagctgaaacattagcaaaatgtttcttgtacatcaaagatatggaatgggtaaataaacacaagacctttttgcacgacagttatacaaacttgatacatatttactccctccgtcccataaaaaaccaacatagtactggatgtgacacatcctagtactatgaatctggacgtacctctgtccagattcgttgtactagagtcacatccagtcctagattcatttttttcgggacagagggagtactttttatcatcacaatgaaaagttatacaacaacaaggccagatcaaataaacaagacgaacatgtacaatagagaacacttccttttaaactactgctatcaacagctagctcaggttctctaatgatctaacctttatgctatacctcaaatctaccagatcgataaacaaattatacataaagcattctacataaaacaaattatacataaagtagttgatatttctctgaaagaagatgtaaagtatgtttccattaagttgaaacagaacaaaagcacagatataacccatccctcagtatcccagtaaccacttaacatggtaacatattgatatgttagatgattaaaaatgggagggaaaatattttttgacaaaaattcaaacacccacaagttacagccttgcataacctgcattcccttccatatctctagtttctgagtctctacagctagatactacaactccattgtgaaattttatataacactacattctacacatcgaaattctacataacattgcatgagtcccaccacattctacacataatgaaattttacataccacatcacagccaccctaattgaaagtttgtagcatcgatcattacaagaaaaaggtggcaagagactccttgcccagcaaagagagcaaccaaaaaatcattcaacacaaaagaaaaggagtcgttaccggtgctatagctaaaagaagggttatctgtctaacccactaaaaaccaacagctgttctttaacactaggaagagaaatgcataactcgataggacatgatgcatgatatatgagaccatgataatgttttatacagaaataaaataaagtcgatgctgactaagcacactagtacaaatatcacatagcataatagttaatttgagaagttcaacatattatgaatttatgacactggtttaatatttagaacacgaaatcatatatgttcgaacttaagtactgctacgcagagaatttaaagaatcaaaatcctgtctctattccactaagttactttgaagtcaaaaaacaacaccatgaaacatggactactacagtattaacttttttttttcgccaggaagtattaacttatttaggataaattaatcacaagccatacctgcctaaatatgacattgcttttctctcgaatgaaaccaacaggctggaaatttgacgaaaaatacaagtcaataatgaagccaagacaataaaataatacaacaatagagtaatacagcaatggaaccaatgacaatctgagtacacatactgattgaggaaagagcggatccattatgatatatctactctcctgcagtatgagtaataacagtaagtgataacaggttgaaagtctgaaacaatcaaaggacataattcaataactgggagaaaatatcaatgtcccaaataaatgtgcatatattcaggaagcacagaatgaattgtgtaactttgttgctggtaaaatgaattatgtcacttttttcagttttttagccgagaaacgaagcacttattcaagtatgtgctatcctccttgaatcacatgaaaattgcctgttgttttatacagtaacaaaaacaaaatagcaaggacaattgaacacagttactatttcatttccaaacacagcaagagaagcatcctagagtcgcaacttcagtacacgtaaatgagtaaatgactcacagatacattacctgctcaaaagccaacatgatatttgcccattctatgtccctagcgatcaggaggttggcccttgagaggagaggcttcagtttggcctgcgaacccacaggaaagtactctcagttaatcaagtaactctagataatgattacacataatttcaacatgacgaaacagctcatgtaggataaacattgaccattaaatctaactgtaaagaggtaaataaataaatatagacaattaactgattggttaatatccttccatcccacctgcccacaaaagtgtccatcttgttcattcaaaaaattggtttccatcttcatcctatatcctatacccttcaaacctatccagctattctgcaatacaaatttaccagcaattccaaaattggggtatagtaattcatcattcactctttcaatctgacatgtcatagttgcaaaacgtatatggattcaacgatagcatcaacaatcagactatgttgaatgacagtgcaaaataacagtggaacagactataaacagaaataaatcccgcttgcctctattggcgtgaggtcccgatcgtcgtgttggaagctcctcgacggcgccatggcgaaatcgccgaacgaatccgcaccgccgccgtcgctggtcgcgaccgcgcgccgcccccaccgcctcgcaacatccctttgcttcctcaactcctcggttcacagcttctgtagccactcccgaggcaccaccgtaccatcgccgcccccgcagccgctcgcgaacccattggatcccccgacatggctgccagtggtcctcgctgtggccctcccagccgccgcggcgtgggagagcagccggagcagccacctcatcggagcgaactgcagaggcgggggaggttaagaggtgttaggattctataagagaaggtttcatcgccgcccccgcggccgctcgcgaacccattggatcccccgacatggctgccggtggtcctcgctgtggccctcccacccgccgcggcgtgggagagcagccggagcagccacctcatcggagcgaactgcagaggcgggggaggttaagaggtgttaggattctataagagaaggtttcggtgtggtcgcggaaatggggtttccacgctccacgacgttaacgatggaggttaagaggtgttaggattctataagagaaggtttcggtgtggtcgcggaaatggggtttccacgctccatgacgttaaggatgggcttttgccgcaggtacggcttccggaggattaaagtgggctcatttccgactaggctatgttgggccaactgggccgtgggccaactaccgtcttaatgttttttttccatttttcaaaatgggcctttacgaaatgtgtcatacacgtccaaagaaaatagagaattgcacctatacatatcattggagcataacaaaagtagagtcttttcatacactagcgaaatgcccgtgcattgcaacggatgaaaacaattttaataattaatctatcatacggtaaatcatccgttttactcattgatatttaataaaaataacgtgaaaatatttagaaatacatcaatatcattgtttattaataatattttttcctttaataattttaacttgcattttattatgttatcacttaaatataaatttatatttttctttaattttatatatgaatcgtacttaaactttataaaaatattatattcacattgtttctaacattctattgttattagattgtacttggcatatatcattttgttttttttattctaaactatagttaatttgaatttattaattacctaatttaaatatctatattattagtctaaattatttttaatattaaaaattataaaatattatagatatatcacaatgttttagagacgggaagacaaagtaaattcgatggtttcaatttataacttgataaagaaagaatgctaaattagattcatgccaagtggcacaatatgtcttataaaatttataacctaataaagaaaaaaaatgtt

SEQ ID NO: 65828 - DNA, 1647 bp, Oryza sativa
cccctaaaaattttgtgagtttggatgagtacaaattatgagcttacattttccgttctaatgcaactgttctaacattttccgttctaatgcaactattctaagagtgtttggatgagattcagtaacaaagttacatcggctaaaaacaaaaatcaaaattaacaagttgaaagtaggtggaactgggcagaggcagatctaaccctgtttcggttgaacccccaaactttttcgagggataacgcagaatagctgatgaggtgtgggtagggagggatgctcaccggcgagcgacgatgcggtggaagcaggaggacgccgggcgccacctctcctcgcaggatggggatcggcgcaagcggcaggcgaggagacgaaactcgaggccgaggccggatgggatggattaggatgctcaccggtgagcgaatgcggcgggagcaggagaacgccagcgccacctctgctagcaggatgccagcggcagggcaggcgaggagacgcgagtcgagggcggcgggcgaggagacgggacggataggggaggcggaggtcgtgcagcgctctgctgccgtatactcatatgcacaggcccatgaggctggaatgttttcatctcccaaaaaagttcatctaaggtcccttatcttgtcgttgagttttaaacggtacttaaccctctaatattgtaaaaccggatcacttttgatcataaggtagtattgctttctggttttgttgacacggtagtattgctttctggttggttttgttgacgtgcggttgagtcccacgtagaccccacaagtcaatcgacaacttctttcacctcactcccctctactcccatctcaacccaaacctccagggcatccaccaatgggtggggagaatggtgtcggtcggcggagaaaagctcaaggcggaggccgccggctgacgtggctcccaacggccgggagcgctcacatcatggacttgcgtgcgcggggagtgcggcgcgggtcccaactacaactgcaatgtcgtcttcacctgttcttgcaaggtgctaggtctaagtaatttttttataagggcgcttatcactacaaaaaatagtttttagtatctttccatatgggcagcgcaaaccgcatgtgaaaacagggtttttgcgtgtgggcacatatggtagctattttttaagaaaatgaactattacatatgcaacaggtgaatcagtgaaacaaaaataattaatagctaaaactggttgagtgaaaaaaataatatgaaatgaaggaagtaaagtatattctatgaactgttggtgctcacaagatttctatacactagggatgaaaacggagcggatacggacggataatgctcataccatattcgttttcatatttttttaccggatacgaaaacgaatacggatagctcgaatacggaaacaaatacatattatctcgaatacgaataagtatcgaatatgatcggacacgaatacggaaacaaatttttctcggaacacgaaaaccaactcaactttaatagaaacaaatattaacatatataattagctcattttatataaaatgaggtataatttataaatattttttaaaatttaaataatattaatggggtgcagga

SEQ ID NO: 65829 - DNA, 3096 bp, Oryza sativa
gaattatccgatccgaaaggtatccgtatccatttttgtccggagcggacggaaactatccgctctgttttcatccctactatacactggaagacaaattcgtgagacccactagtaaaaagtctctctctgtcagctcgaaagacaactgactgccatgggtctcatttatgtgataggggagacacaggtcactgcttgaggccacaggcagcggggcgtgatgttgtcgtgctcggattggaaactgaatttttgtaagtgattggttctgtttgacgtgggcggaagagtcgaacacttgcggaggatatggaaacggaccaaaaattgtgtgagacacgcttttctatgacatatgacaaaaacactattaatgttttaagtagataatgatatataactatataagtcgtattttgcaatgaaatttggtaggatcgatatataaatacattataacctatctctcagtattttcatattttttttaccgccgtatacatatatttcaagatttaaatatcgtggttttacattacaaacaatagtcatgaaaattttaaaaatattttatgagctttgataatggtgttatgtttggcactacaaaataactcgtataaaaagaaacaaagaagataaatgctcgagcaaaccaattttagtagttcaaggggtacaatgaggcaaaagataggttagtgggttaagggtgttcttttaactccatcttcctaacttatactcacttgtttccgatctgctaaacagtgtattttatgtaaaaaaaatataaagaaaagttgctttaaaaaatcatattaatttgtttttatgctttttaaactaatatttaattaatcatgtactaatgcgtgctctgttttactacaggctaaataggaggggttcctagcccctctttccgaactcagcccatatgaaccaatgaaatattctggagaattaaaatagattttctttcaaaccaatataataatatgcttgtgctaacgctacaatgatattatattttgacaatcaggcatacagatacagattcacgccaaggatacaggaaaataaacatccaacctgcatattcattattctgaagcacaaccaaaagctaccaatgcagctgaaaatgaagttttacatcatcccttccttcccaacattctcaagtttagttaaaactctttaaattatgttcgtaaaactccagatattcaggaagtttagaggaagaatgccaaccgctatttctctcgagagcatcctttactcattttttcagttaactcattattgctccattagaagcaaagagtgttgccaccttcatttcaaaatcccacacatttcaaagtcctacacaataataacaagtttaataccaagacatagttatagatttttagttttgtattagcaagttttttgttctgcgaatgtttcagaatcctaaattgaactgtgtttctgattcagatcataaccatcacaaaaactcataatagatcaaaatgttcgtatatttggcagcatgatggaccatgggtgaaaatagtgacccaaaacatttagctgtcttttagtttcagcagaattttttttaaccactttgataattcaacatatgatcattacaatcatcaggtttagtataaagatacagagatgcacatcaaattgagcaacaatatcttcggttctctttaatattttcctcttataattgaattatagagtatcaaatgaacacctcaaatggtcaaatttcatattaccattgagtcttgattatttcaagatcaagccatcatgcaaaagttaaaatgcttccatcaattccccacaaccaaaagtacaagacaatatatatttaccctgaggcctccatgatgtaagcttcagttttcttatacctacagacatcctcaaatgtaaaacacaattccaaaaggcatgccttccatctgacaaatccagggataaaatctcaattgctggcaccttggttatgtcttccatcgagtacggacaccacccatgatctacacaatcaacacggtttcataaacataaatttagcaaaagacaaaggatcaaattaaactttcaacactttagccaaatgcatgttgaaaatgacaaatattcatgactggaaagagtatctactaaaaaataaaatcagattatgggcctcaactttttattttactatgctataaggaaatgtagaaactataatacttcctaaacacaaccaatagcacactgaatttttcatgctaacaattaaaagatggagattaaacatgcccaatgatggagattaaacctgtagcctcaagaagctacaggtgacatgctgatagttacaagacctgagcgaagcaacatgaatctgagttttgcataggcagaacaacataaattatcagcagtgtcttactctatattcctcccattcatgcagacccagaacctccaaaatatcacatatttcaccacaatagttgttacaatacttaaaatgataaattttctgaatgaagaatcacgtacactaccaaagtattttaataatgttgaaaaataatgttgtgtaaaggtcaaagaaattcaaaaccaaaacatgcttcatgtctggatttgactacaataacctcgaatcaaacaactcataaaggattttcgctagaagcataagttgatcaacctatattctgaatgccattgtcaattaaactcaactctaatttgtacagatgtatataggaaaaagcaacagaaaccgatgtattctagcaaatcctctgtcagattgaagagataagaaatatatatttattcataaaaatggccaatacttttttctatgaaaggctacctttctaaaatggctcatttttgatagttcctaaccaggttctaagcagccagaaaccctgacatttctatctatcagcctatgacattcctacaaactagttcaattcactccaacgaatctaactgcatgtgcttcttcaacaagttctggatcctatccaacctgaaagcaaaagacatttaaatcaa

SEQ ID NO: 65830 - DNA, 4818 bp, Oryza sativa
cctgcacccccatttatttatacttttctgcaacgtaggggggccttgagagttcctcttgtggtagcaagttacttcataacctgctcaatttggccttatagggtcgggaactaatgaataaaaagggttggataccgcccaaccacccagccctctaccatatctagacaaatagaatagtccttttatacagagcgggaactcggatcccgttgggtcgacttcctcgacgaatccgcatacccttccaacttgggctcaggaagttcgaacaacacgccgacctcaagccatccgccctgcgagatcttcatcgtctttcaagagacagacgaagaaaaaagggaacgcgaagaggaggaatgtcgtatccagcaacaatacgaggatctcactcggtgcctcaacgagcttcaacagcgcagccatctcgccgaagacgctatccttcaagtgaagctggggagcacgacatcttcaccacgccgcagaacaagatgatcgctgccaaggccctcctcgacaacatgccggtcccagtcaacctggccgtgaacaccaccatcgcccaagtgaaggccatggtggaagccgccgtcgttgttaacgaccaaatttcgtaagtaatgaactaggtttggcattggaatcgaagtggattcggcgaaggactgtgttcgaagaatagagtgtgcatcggctgcagaggcatcggttgaagtctgcatcagctgagatggatcggacaggggacagccgatacagccgatttcattgagatggttataaaaccgtttctggaatcgatcaaggtgctacgaaaggattgccacgatggagataagctctcagataggcaattgtatctattaattaggatattttacgaagtttccttagagatatgtttgggcaaaagtctgccgtaaagacttatatgtatcttagagtttgttagagataagagtcgtgtccggcaaggacttatcatgtatctcgggtataaatataacccgaccccatgtaatttacaacaacagttcaataacactctcggcgcatcgccaccattttactttcgtttgtttcgacgagttcttgctttcgggttgagctgcatcgatttcgatcttcaataagaggtaaacttgtcatgacggcttgcgttctcgggattagtgcttccatcattatgatactctaatcttgtttatgtaattcgtcgagttatcatatatgcttcataatcctcattagttgcgctatctaacttgcaatcggccaatttctactgttaggaattagccgatagagttagatcttgttattaatttagattatatagcatatttaccatctcttagaggttttcatcaccttgtctagatcttatatttatttttatgcttaatgctgcatcggttgagttcggtctgttaagtaatatctataactataatatctagcttattttatgattattgaaagagatagcatcggggtttcagccgatcttacctgatttagctatcttataatttatatgctcgattgctatgctaaatctgccctttatattaagatattattgcattagaatatattaggctttctgtttaatatattttgtttgttttagtatcttaatatagagtgatatcagagtattagccgatacacattggatctatctccatcggctaggctatgagtgtatataatctttatcttgaagtacttttggatataagtgatttatactgtcttggcatgatgaccgatctatcccaatcactttaaatatatttcaagacatagattatatgttattgatatctacagccgatcggatagatctaattttatcttgctttattctttactgccgatcgattccaacatgacatcggctcgaggataaacgatatgtcatcggcaaccagccgatcggctatcgtttgtggatttaaccttgtttttttgtctttctttcttgttgattataggatcaaatcaactggcacgcctttgaacccaagagcaagatttaggacctgcacagaagttaagcagagctcccaggccagtgtgtgttttttgcatcaacacgcttttggcacgcctagtgggaccgagttgtgacatctttcatcatggtggacatcaggcagacatcaaagccaccatccgactctactcaaaagccaccatctgaccttagtcataagcagtcatccgatgtcggccctgacaacatcatcccaataactatggataaactgacgtcggagcagaaggcagagtacgagcagatgatgaacaatttgcataattagttcctgcattcatttaagcaaactcgctcgggcacagtaatccagaggtataagctgaaggtcactcaagacacggaaccaagcacatccaagggaggcaagacttccaagggtaacaaaggcaaggatgatgaataggagaagacaagtcaaaggaagaagagcctcaagaaccgacgaattgcaagatcggattgactatgctgtctatcatgccttgatcaatcaatcaggagtgctagttaatacttttaactaatatgatcaagtccgtggtcaatggtacaattgctgagcatcaagctaatgggccggtttttcttcctgaaggtggatttccaccatatagagagttggtgaccggcacgcagcagcctgtttctggtgtggctctagggcagccgatggcgtcagcttcggcccttggaagaccaggtgcatcgtcatcggcacagaggcaactgttagagccttaccttttgagcagacaccaacctgggcacacatggcataatatccctcggttgactccagaacaaattgcggctatgttcaaaaacaatcagcaaactatagagccaattcagccgataccaatgggacagcaaacacctaccattccacagcctcagcccgttggaaatcagtttgttcccggttagcaagttcaccagtctcctcagcaacatcctagtggtaacattaattttcaataccagcctcattcacctcaagtgcaatatcggctagggggatcaccacagcctcaggttctgccccagtataatcagttcgagcaaatccaaaagccgatgcagggagtgcctcaacagaagccctgggccgatatgattgcagatgtaatgaaggagtagtttggtctcaagccaagggacactgaaaatttgtatcggcacccatatcctgagtggtttgagagggttccattgccaagccgatacaaagttccagatttttcaaaattctcagggcaggataatgtgtcaacttatgagcatgtcagccgatttttggctcagtgtggcgaagcattggctgttgatgctttgagggttagattatttccgttatctttatctggattggcatttacatggttttccttgttaccttataattctgttcagagttgggccgatctagagaagcagtttcacagctatttttatagtagaaatcatgagatgaagctttctgatttaacagcagttaggcagaggcatgatgaaactgtacatgactacattcagaggttcagagatatgaggaacagatgctatagcttggctttgacagattctcagttagccgatcttgctttccaaggtttgatagccccaatcaaggagaagttttcggctaagactttgaaagtctgtctcaccttgtacaaaaggtaactttgcatgagcaaaggtttgcagaggccaggaagaattttaagaaagtcaatcatgtatatccctatatgtatgagtctgaagaagatgattctgaagtagcagcagccgagtgggcaagaagcaaggaggttgtcacttgtcaatgggtgaaaagttctaggaaagaggagaaatatgattttgatatcactaaagctgacaaaatttttgaattgctacttcgggaaaaacaaattcaacttcccgctggtcatataattccatcggctgaggagttggggaagatgaaatattgcaaatggcataattctggatctcatactactaatgattgcaaagtcttcaggcaatagatcctgttggctattgagggagggaaaataaagtttgatgactctaagaagccgatcaaggtggatggccatccttttcctattaacatggtgcatacgtccggaaaggcagccgatcggggtagtcatcggagctcacagcttaattcagccaagattatcaataaatatcaaagaaggtgtcacgtcccaaaacgaccctaaaatatatcctctaaatggtgcctagaataattaaaatccgtgtgaaagcctccaacaattaaaatgtgcaaagttaaaagtcaaacaaggcttagacggtttttgtatatttcctaaaagcctaaaatgcgtaaataaattttagtggaattttcagagcacaaataataattattaagaaataaacaaagttgaaaaggttttataaaaagaaaagctctaaaaagtcccctttccctccctctccctctcgggccggctcggcccatttccctccccctccctctcctctccccgcggcccatccggccttcccccgcgcgcgcgccgctgacgggcgggcccgcccgccaccctcgctgacgggtgggccccaccctttctcccgccgctcccgccgtctcgcccgcgccctatcgccgccgccgccgagaatcccgacaccttccgccgttcccgcgcgcaataaagtgggggggaattattccccgggatccc

SEQ ID NO: 65831 - DNA, 709 bp, Oryza sativa
ctgctgctaggggctcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtaaacctctgttcagagtataatctattcgaatagccgcgccctcggttatgggcaagcctagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatatggtatagctctggaatcgtgtttacaaaatagctttgagcaactaattatcttttaatgctgtttactgcaaaccctaaccctttatattataacccccttgtactcctgtcgcgactgagaaaatttgcattttcccgaacgctagtgtattaatccccgtcccaggaaaagccgggtacaccacacaaacatgatataaaagacacatctttattatatcgataatatttacattattacaaaggcacttcaggcctggcaatcaaaaataaacagc

SEQ ID NO: 65832 - DNA, 1254 bp, Oryza sativa
acagtggcggcaacgccactgttttgccggcgagaacgcgtctccggtgctttccccgcgaaacggagggctgaccgagggagaggaggtggctgcgaggccgagggagaagacggcgcggccggacggtgctccggcgaggagggagaggcggctggaggcggccggcgcggaggaaagagaagggcgacggtgggaacgcgcctccggtggtcaccgcgcgaaacggagggcaggccggggtggaggaggtggcggcgacgctggaggaggcgacggcgcggccggccggcgcacggtcgaggcggcacaggcggctggaggcggccggcggcgtgggagagagaggagggcggcggggagatggctagggaccacggggaggctcgggagggggctaaaacgagagaacgggggatgaggatcccattttatatgagagaagagggagccggccacgggggaggtcggaacggcggcgggaatggcggccgacggccatggaaagcggccggacttggcgcgtccgttcccggggattgaaggcacgaatcaagggggaatttgggggcaattgaagaggattcaatggggattaaaaccccccaattaattttggaattggccaattgaatcaagcggatttggaggagggagcgagctaggtttccgggagggagagagggaggtggccgggcggctggaggagggagacgacgcgcctgacgcgtgggccccacccggtcgggcgcgcggtcagcgcgcggcaacggcgcgcacgcgcgcgcacgtgcgcggcacgggcgggagggcgccgctcgggttgggccgggcggccggcccaggaggagaggagggggaggcggcttgggccaggcaggccgggaggggggggagagacagcccgggagagagagggaggagggtgctgggccgaggggaagggggcccaagaggagggagagaaggagagggagagaaagagagggaggaaagggagacttcggccgcgggccgaggggagagagggaggactttgggccagacttggcccaaaggaggaaggagggttatttttaggtttttctttttaataaactttgttaattgtttttgttgcttaataattatttccggtgctctgaaaattcaagtaaaatttgagggctccttttagaccaaggagaatttaacaaaaattccccgggccacattcgaatttttcttgtacgcattttagtgtttgccaatttc

SEQ ID NO: 65833 - DNA, 1084 bp, Oryza sativa
agccccatgttcgtaggtatgagagatttaatttcttcctttcccattcctcgaatggtgttacttccttatgcttcattggaattttattcaggacatgacacgcagtcaaaactgcctcaccccaccattccatggaaagccccatagtgtctaacatggcattcaccatctcagttagagtacggttctttctttcggccaccccatttgattggggtgaatacggaggcgtcctctcatgaataattccaaactcttcgcaaaaggatgcaaactcattcgaaaaatactccccacctctatcagacctcaaccgtttgattttcctttcaagttggttttctacctcagctttataggtcttaaagaaatgcaatgcttcatcctttgttttcaatagatacacataacaaaatctagtgcaattatctatcagtgtcatgaaatatttctttccccctttagtcaacaccgttcatttcgcaaaaatcggaatgaacaagttctagaggtgccaaattcctcgcctcagatgccttgtgaggcttgcgaggttgtttcgattgaacacaagtatgacacttagaacctttgaccaaagtgaattttggaattaaactcatgttagctaagcgcgtcgtacaaccgaaattcacatgacagagtcgcgaatgccacacattagactcatcattctcgctaatatggttcacaacattatgattattacacatgtcattcagagaaaagcggaacaagcctccgctgtcataaccttttccaacaaaagttccatatttagatacgacacatttattggattcaaacacaagtctaaaaccttctctacacaatagagagccgctaacaagattcttctttattgaagggacatgctgcacgttcttcagctgaacggtctttcccgaagtaaacttcagatcgaccgtaccaacaccatgaacagctgcaagcgacccgtttcccatcaacaaggaggaacctctcccgacctgataagaagaaaacagagaaatgtcagcacatacatgaatattagcaccagtatccacccaccaat

SEQ ID NO: 65834 - DNA, 1417 bp, Oryza sativa
aaaaattatatgaatatatttgtcttgaaaaatactttcataaaagtatacatatatcacttttcaataaatatttttatagaaacaagaagttaaagttgtgttttggagaccgtgtcgctgtcctaaacgacttcctttacgagtatggagggagtatctgacagttggacacttggaatattaataaatataggattcgcggagctattaacacaactgcatcgatctctctgatattgcagttagcaaggaattggaccacacgttcaaatattaaagtgtgcattgcatatatattagccaatgatcacctagaactttggagaatgtatggctagttcgttggtgttcatattgtacttgcgtaatctcttcgctctgcatgtgcgtgtcgttgactagtgaggtgtgatatatcccagctagaagacacactaattattaacttaagcacaccattcccatgggtctaatttcttttgccaagttcaactacttgactagccggccgtgcatcaatatgcatgcacaccactacgtactgatcgtatgatccaactatagggtgcaaggatcggggcaagagacgatgcaaacattaggtgaactattttaatccctcgaacagagattccttgtttgttgaaaaaatcatactgatagttatgaacaaatctttaaatctttaataatattcatacaacaaaaatgtaacaatctatagaataggcataaactgaactcacgcattaagaaaataaaaagataaagacaacatataaataatactagtattttttttctcaatgtgttgtcaagtttgaacttgtttttcttgagcatgcaattaaacttgagagaaaaaagagaacggatattctctctagggattagaatatgttcctacaaacatagggcaattcgaacttaagccctacgtttgcctctctttgatccattaaagaaaaaaaatcaaaattctgaatatacaagagggctaattaagaaataccctcaagtggtaaagtattttttccctgtgaggggatatccctaaattctcgaatgcatttaaataattatgaaacaatttgataacacagatcaatatgtgatatatcatttcataaatatacaaaatcaaaattgatatatacaagttgaaacaaaagatcgaataatccaataaagaacatgcactaataatttggtttttttatcaaattttatatgtcgtatttaaacttacatgtgtatgaagtatatatcacatattaatctattattttttttagaatttaactatttgaatgatatgtgagaaactaaggaactagtatgggtttacgacagatgggtccaccgacctacatcgtccctgtacttcacttattttgtgccaaatgtgcttgga

SEQ ID NO: 65835 - DNA, 1234 bp, Oryza sativa
atccagtagctattgctggtgggcggtacactctcagacgttcctcgtgccggacgttaattcaattgggtaatttattagtagtattacttctaccagtatacggagtagtgtttcaggcagcagctaggttgcccgtgcgaacgcataatggcacgtctcataaatgcaccactgtctcgtcgtccgtccttcgctttgctttgcagattgcaggcatgcgctttctgatacggtacacgcatgtactccaaatgtgtataaacgtagcgatacgtacgtgttggtgttaagggcaggtgacaatgtacgtttctggacagattacgatcccatctgatctcgcatgcacttggacgtatgtataccaccataacgatacagtatatgtgtgtactcatgtactgtagtagacatggagtacgtgcgtatcgccggcacgagcagctgcaccctgcacggcgggatgggctcgggatggatggatggatggatggagacgtcgggagacgcgaaaaccggcgcgttttacaggcgattcccctgcgatccagcggcagagagacgtacgccacggaggagcgacgagaccggtggggagcggcgcgtgacggcgtgaggccgccgggtcggtggatcatccgttccgtgacgcgccgcgacgagttgtggacgacggaaaccgcgcgcgatgggcgccgcgccgggacccgggagggtaccggagcggacacggtggcccgcgggtggccgtgtgtgtagccgtaccggtaagtcgggcactggcgttgggccctttttttccttaggcctggttagtttctaattttttttctaaaaacgtcacattgaatatttggatataaacatgaagcattagctatagattaaaaaagctaattatatagtttgtatagaaatcgtaagatgaatattttgagactaattagtccatgattagccataagtgctgcagtaatccacatgtgctaatgatggattaattaagcttaataaattcgtctcgcggtttccaggcgagttaagaaattagtttttttcattcgtgtccaaaaaccccttccgacatccatcaaacttccgatatgacacccaaaaattttcttttcacgaactaaacacacccttgctcgatatattgcaggacggtatcttgttcggacaatgtattaaaaagaaaaatagaagacaatgtattgtgtacatcagatac

SEQ ID NO: 65836 - DNA, 2901 bp, Oryza sativa
ttcacagcttctaatgcgacttgtttagacaattaattaggataaaaaatgaaatgatgacgaggagtggtataaggtgatacattgtgaacttcatccgtttgccatcctttctgatgaatctaagcagactgacagaaaaataacataatgttatggtctggagaaggatacgacttataaacaatcaaaattatattctacacagatgccaatgaaaattataatggcagatgttaagaagtcatgtagggtagtcatacaggaagtatccgtgtgcacggctgcatactagaggtgcacacagccacagggcaagagaagttgacatcttaccttcaagccatatgggtaaagatggctttcacatcttcaaacacctcaggggctggttttgtcgcatcaatctgatcaaacaatggattagctggaggtaataaaagcgcatgcgttgacaaaacataccaaccagaaactgatagagcacgtgcacaaaaatatggccatatctgatgatggtgatcgaagtagtctccaactgacagataccattttaacacaaagttcttgcacttacttaaccttcccctgtttgctgaactgaatatcatatttctttgtggcaatgggactctaatcatgcagcgcaaatttgttgctatatgtggagtttcagggcctttattgtacactttctgacatagcatttgcacaatgcaacaacttaatcgagtaatgaatcaagtgatgagaaaggatagaggccatatgttaattcaatcacaaacgatcaattaacataccctgaaaatgacaatctacatatatcagacttaagaaaacatccaatcagctcacaaatatgtgtgctctactcaagggttttatttttccccatggtccctgctaaggatatgatatgttgtgcatcactggctgattgcagtgcacaaaacgagatcagagtaaaccatgctttattccatgtgtactgtgaatttcaagttttgaccctgaaccatacagcagtttactatatgatattgtgtgattatcttaaatgatgacaagtctataaatccggtagggagaataaactgtactgcaagaagcatgcataaccattacaaatgtacacaccttcttaaccatgccttttgactcataatactcaatgacaggcaagctggattctacaaaaactttcaatcttttcctgatagtctcaatgttatcatcacttcttccctgcaaggcaacaagaaaaaaataatgtctgaagaaataaatactcaagtgattgtgtcaaaatttatttaacaaattaatatcagagaagaagcaaacctggttgcgacccaaaaggcgcctttccatttcttcctcagaacaatcgaaaaatagaacaaattcaggagatatgcttatctgaagcagttggaagtaagtaaccaaggtctgtaattgcttttaaaatgtaaaatatgaacactaacatacacataaataaaattctcctactgctctattcaaaacaatgaagactaagtaagcttacaacactctcaaatacaacacgattctcttcgttccgtggaaatccatcaatgatatacttgtcatttccaccttttattatggcttcttgcaaaagctttatggttatctcagatgggacgattttcccttccgttatgatagtgtcaatcatggttctgcaaaatatagaaccagtaactaagtgagtgaaacaataaatatggcatgtgtacatgggcaaatgcatgtgtgtgtttttacccgttctctgaaccagaattgatttctgcacgcaagagttcaccagcgctaagatggataaaaccaaaatgctctacaatattgctgcactgagttccttttccacttccaggaccacctgttcatggatgctacatcagattaaacaacacacacacataaatacagttatgaattaacaacagcataagaaggaactgacagcaagttcacttttcttctataaagtggcagtcaaaggcatgaaattacttctaaagaatagagaaaacaatacctagaacaaatataattttaactttcttgccacccaacatgttctcattaatatcctgcagaaggacaatttaacccatcagattgtatgaacacaaaaagataagcatgagggtcaaattcaggatccaaatcaaattggtaactgaaatggctggctgacttacaggttaaaagaacaagtatgcataaataaatactatgtaaaatacatatccatgggatgcatggatttaaccatattctctcacgatggaatgaactgcagatgaatcctccaggaatctgataagaactgcaaggtaatgtaagaaaaaactaccttcttttcagtaaggacgtctggatcatccatggctgtgctcatggctacaagaatacccccatgattcagactaaacatcaagttggtgcataagtattttgcaatagaaccaagaaatatgcatcattcagaagtataaagcaatagtgcaaatgtattcaacattgcacatgcatagcagaccacaaagtaagaactatccaattctaggttgatcatgaagtccagaccctttcatggtgcacagatgtgttggtttggtccaaatattgaatttagctcacggcgcaagagattatcccaccaatttcctgccaacaacagtacaccaatccccgaagaccactaaagacttcgttcgagggttttagtaaacctctcccccctagtaggttagaacttagaactaaataagcaaagcagtagttaaacatcgacgattctcacatcctgcgagaaattttcaatctaatctacggactacagcaaatcagatcggg

SEQ ID NO: 65837 - DNA, 6340 bp, Oryza sativa
tgtaaaagagctgtattaacagtaaagataactaagctgtttatattagagcttataagttggctataagattatctctatatttcgtttcctctctttatgttacttataagaatttaatatatttaccttaaagcatgtgtagagctagattttacttgaaagccaacaatattttttaaaaaaatctttatcctccacataagtttatagtccactattagtctattatctttgctctaagagcaaattttataagcaagttttatagcaaggtgattaagacctctaatttattcatatcatcaactaactaattaagatgtagcatactggtttcaatttgcatccaaaccacaccattcttttcttggagtttgtgaagaaattaccacttgcatgaggggtggttacttctcgtatactatcttagagctcatactacacctaactacaaatatgtagtctacttttgttctctcttcttcgttattcaatagctagcttattgctaataaagggacaaataaaggaaacgtccatcatttttcacccacatgtcggtgtgtttttacataaaaaaatctttagaaaagttaccttttaaagaaaatcatatttcaatttttttcatgtttgaaataattattagtcaattaatcatgcgataatggctcacctagttctatatatctccttaatatttttatctcctcttaaacatagcctaaggtatgtttggaactcagaaaaacaaaatacatgaaataaaatatttgaaatataaaacacataaatacgtgtgtaaaacagaggaataaaaaccatagaaagtttgaaaagatggatgtttggaacataggaaattttagtggatgatttaactatatcctgctaatccgtattattactttgatccacaagaaatagcggcctgcctgactaagctttgttgccagctgttcggtgggaatgtgagaaatcaacgtgtttgcactacaacatgtatgcataccatctcgtctcttccacgtaaaggcgacggattgggaagaaatttctggacgcgcacgcacgcaggcaagagcatttcatcgatccctgcacgcgcggacgcacgtttcgtcgtcgagcctgcaaaaccggtgttgccacgtggcaccattctccttccgttttttggcattgaattcgtattataagattctttcacagctatcggttcaagtggctaatatgtgagccagattattttaacttataaatagattcggggattagtcatttacatatttattattatgctagcttactgctctacgcacattgtgacagtgataagctccactagaacaaaagctttagttttgtgttgggtttcattgggattttaggtagatttggttcagtataatagttaagtttattcagggccacacaggcccccaatcttaaggggcccaaataacttaatacgtgtcacaggaccattagcccaatagattaaatctattgaaatgtgcaattggaaacaaaggctgagcgagcacgtcgattcgttttcggcgcgtgtgtcgatttgagcgtcctcccgtccgtctaccccaatccatacgctgcgccgctctcgcactcgcactcaccgtctcgctgtccagctcgacgctcggctgctcgtcgctcggcttttggccctcgtcgcttagagcaagataatagtataagataatagtatagctcactttttactattagactattttaaagctaacatacataatagattggctataaggttggctataattttcttcacttctctctatctctcacttatatatttaatgaatttgtcttggagattatgttaagctagctcttgcatgagagccaaccctcttgattttttgttacctctcttctccatataagtttatagtagatttatagctcactattattatacttgctcttaccgtctgcacgtctgctgacgtgccgcagtaaagcggcaaggtagcaaccagcgagcaacgtctttgggcgacctccccggcgatatggcagcgagcacaagcggcaagcttagctgccctgcacacaccagcaaggatgccgggtacatgacctaaatttttattctgatcgctaggtttatggtgtatctaatatgtatactagattaaattttattcatcttgtatctatatatgcatagatttaagtagtatttcaacttctaagaaatgtcatctgcaaatcattgaaaactttatttcaagaaatactaaaggaaaaagaaagatactttccaattggagattatgcacaaagacaatttctattaagtttatattgctaaaatatatcatggagtgtaagtttaccggtttattttatcgcttaagttagaagatttcacacggggcctccaaatttcatgggacggccctgagtttattaaggagactgttaatattatgtaattttggtcaagtaaagatatatggaataatatctattttggtttttatatacttttatagtgacattcgtgaaccaaacgagcgcctaagtcccaactcccaactagctaaaaaattgtcaaacaggcccatacactgctgctctagttagcagcctctggggctacatacacgacacgtcttaaggattacgaattacgatgaacaaataagtttccgccctctactgtcaacatgtatcaatacgatttgtctgctagacaactagagtatcaaatcaatgttagcatttcccaaccgatcaaagacaattagcagaagaatacttcgagtacgatggatttcttcgctattactgtactcgccgttgacatatgattccgtaagaaatctatgagctggacgcttgctcttgcgtcaagctttcttctttggtgccggaactccggcagctttacatgaatatatatatacactcatctgtttcaaaatgtatagcgttattgacttttcgcataacgttggactatttttttatttaaaagtttagtacaaatatgtaaaagtataataagttaatattatattatatttgaagataaaacaagccataacgaaataaatgatatttacataaacttttttaataaaacgaatggttaaacgattgtgtgaaaagttaacaacgtcatgcatttgaaatggtggaagtatatattaatgcattaggcagcttgtatatatcatgtgtttacgattgattgactgccatggagttgagtaagactctgttagtcaagcaagaaaactatggcacaaatggtatccatgcatgcacatatctcaagcgcgcgagtgccttggtgttcttgccagttgccacactccaagtgaaaaaattatgcaacgtacgaattgatggaggcgagcaaggcgaagcgcagcgtggccatcgtcggcgccggcgcgagcgggctggcggcgtgcaagcacctgctggcgaggggattccggccggtggtgttcgagtcgggggaggccgccggcggcgtgtggaggcggacgctggcgacgacgaggctgcaaacgccggcgcaggcgtacaggttctccgacttcccgtagccggcggcggcggcggcggaggagttcccgcggcacgacgaggtggccgcgtacctcgacgcgtacgcgcggcggttcggcgtgcgggagcgcgtccggttcggcagcaaggtggtgagcgccgagtacgccggcgtgccggaggaggaggcggcggcgtgggagaggtggtccggcaacggcgaggcgttcggcgacggcaggggtgagtggcttctcacggtgcagcaccgcgaatcggagaacctccaggttggtgaatacgtgacggcatgagcacacagaaaagtgtcattcctgtcggcttatcaccgtcagtttggcttgagccgacggggtttctcaatcactgtcggttcagcaggttgatcgaattttcccgcccaacccacttgataatcgaaactggatgtcaaataatcgaaacccattttaatgagtgttaaattatcaatctctcgcatagtatggtaacaaatgacttgtcaacggattcacctcgcttatcaatccacagacatataagttcgacttcgtgatcctttgcattggacggtatggcgttgcgagcgttccaacatttccacccaaaggagtacctgaagcgttccatggacaagtgctccactccatggactactctagcatggaccatacggccgcggccgagctgattcgcgacaagcgcatagccgtggttggttctggcaaatcggccttcgacaccgttgcgcaatgtgccgatgtaaacggtgagattgctgcaacagaacatgttcaccttgatcacattttccaaattgaatttgaatttgttatgacaatttttaccgtatgatatataatctatctatctattatattattaaaacagccttgaaagaaggcaccacattcgctgtgggggctagaaattcccacattaatcgaagaaaaagaaaaaaagaaaaagaagagtccaagtagaagtccaatttaaaaatagctgaaattcggaattaaaaataagcaatattgaaagaagtttccatataagaacccaatacgatattaaccaaaattcgaaataaaaaaaaataaaatccaaaattagaaaaggaaaggagagtccaagtagaagtccaatttaaaaatagctaaaattcggaattaaaaataaggaatatcaaaagaagagtccatataagaacccaatacgagattaattaaaatttaaaataaaaataaaaataaatccgaaattataaaaggaaaggagagcccaagtagaaatacaatttaaaaatagctgaaattcagaattaaaaataagcaatattgaaagaagtttccatataagaacccaatacgagattaaccaaaattcgaaataaaaataaaataaaatccaaaattagaaaaggaaaggagagttcaagtaggaatacaatttaaaaatagctgaaatttggaattaaaaataaggaatattaaaagaagagtccatataagaacccaatacgagattaattaaaattcggaataaaaataaaaataaatcagaaattagcaaaagaaaataaaagaagagttcaagtaggaatacaatttaaaattagctgaaattcggaattaaaaataagcaatattaaaagaagaatcaatatatgaacccaatacgagattaattaaaatttcaaataaaaaataaaataatatccaataaaataacaaaattagaaaaaaataaaagagagtttaagtaggaatacaattttgaaacaactgaaattaaaaaaaataaaaacattaaaagaacacaatacggtattaactatttttttaaaaaaataaattatgaaattagaaaaggaaaaataatatttaaattagaaatacaatttataaataactaaaatttgtgataaaaataaagactattgaaagaaaaaaccatctaaaacacataacgagataaattaagtaacaggcctataaaagagtagagtgatggcggttgatacgccatataaaaaatgttaataaaacaacaaatagaatcctaatgacgattataaggagggacgtcgggcatgccgtgaagcaaacaagtaaggcagtagccgggacttctagaaagtaaaaaaataaacccattgataatcatattcgatttttaaaatctcaatgacaataaaaaggagaagaagcgggcgggcgtataagagtatggttgcagagccgccgacggttgacgggacttctagaaaataaaaaatgaattccaacgatagttatgttcgatttttagaatcacaatgacaataaagagtaggcgacggacgggctgtagaggggcatagtggcatcgttcaaattttaaaggttcggaacttccaaaaagtaaaaaaaacctaatgataatcatgttcgattttaaaatctcaatgacaataaagaagagaggcagcgagcgagccgtagaagagtacaatggcaaagccgctgatggtttgacgggacttaaagtaaaaatgaacccaaacgataattatgttcgatttttaaaatctcaatgacaataaagagaagagacagtggacgggtcgtagaggagtataatggcaacgtttgacgggacatctagaaattataaaaacgaaacccaatgtgacaataaactctaaaactataaaatacaaattttaaaggttccaaaaagaatgaatagaaatagtgatagatcgagt

SEQ ID NO: 65838 - DNA, 2760 bp, Oryza sativa
gtgtggggtgtgaacctccagaaccttaccacgtcacggctggccgaggtgatggttcacaagcctggtgaaggcctcctcctgagtcttctcgccacaatgctgacaccactggtagcactcaaccacagttaatccatcttgtaagaagaaacgctaaatagatcgtcactaatcgttaacagttcaatttcacaacccattgattccttcagagatggttattgtcgaagctaacggagatgtactacaagaggcacacaccgatgcagaggcatggcatggtgccaggctacagcttctcacagtcaatcttggcttgccggctcggcatcctcccgaagagattctacgaccgggtggacgatggcagcatcgtgctcaggaggtgtgacccgtctttcagcttctgcgccggcgggctggtgctggacgtcgccaccggcgaccacatcgtcgacgccgacgtggtcatcctcgccactggcttccaggcggaccggcagcttagggatatattcgtgtcgccgtggttcagcaagatcgtcgcagaatcttcagacgccactgtacctctgtacaggtcattgcgtttcaccaatcactatgtatcgcagaatttaactatgtcagtactttcttaaaaaccataaaattactgtaatatatttttttcttttgaatcatctctgagtggtgtgatttattgatcgacagacggtgcgtgcaccctcgtataccacagatggcgatcattgtttacgcggagagcgcggcgaacatctacccgtacgagatgatggccaagtgggtggcgcaccttctcgatggtgcattccagctaccgagcattgcacgtatggagaagagcgtggtggagtgggtttgttgggcgcatgatatgaggaggtgtagcggcaactacttccgcaagtcatgtattggcaccatcacaacgtgggataatgatcagttatgccgcaatatgggatacaacccaagaagaaagaaagggatagttgcggagtggatagagccctatggagccgctgactatgctgatatctagtcaccatgtgtcacaaactgaataataataataataataataataataataataataataataataataataataagtggagagttaattgtatttcaaatgttgcacatatagaccatgacaaacatgtggcagcaatggtgaaatttcaagtataacttaaaagggataattgaagagagtacttttcatccgttctataatataaacatttctggttataaatctatacggaagctttgtcagtgcttaaaagtggaatatcgttatcccatcccagttaaaggaagagatgtgtaaaagtacccaaaactgttgcttgccagtttatgagcgctgcacgaggaagcatgttgttgtgaaccttttcagcttggtctagagcatggtgcttagggctgtgtttgcaatcctggatttccaacccctctccatcatattccgcgcgcatgtttttcaaactgctatgttttcataaaatgtttctatacgaaagttgtttaaaaaaaatcatattaatctatttttgaaaaaaaattagctaatatttaattaatcacacgctaataaatgtacactgtacatgttgggaacttaggattgcaaacacagcccggtggtaacggagccaaactttttaacctacaaaatataaagaatgggtccaaagagattggagtaagatttaatagatttttaaacttcccagaagtacggatttaaagtattgagatgggttctgaaagggcccgtgacccattaccacctactgatgctcgatggatgatagagttgttgtcctcattgtttatccgtagctttctgtaagacattattcaattattaatccccaaaaaaataagaaggatatggtgtaaaataattctcccttaatgccctctaatcccttctctaaggggattaaccccaacaagggcttaggccatgttacattactactatatatctactccctccgttttacgatgtaagtcattctagcatatctcacattcatattgatattgatgaatctagacatatatatctatttagattcattaacatcaatataaacatgaaaaatattagaatgaataacattgtgaaacggatgaagtatataaatgttcaggctggctagcgcttcaatattctatcgatggatgcgaccaagaagcgtgtggccatcgtcggcgccggcgccagcggcctgacggcgtgcaagcacgcgctggcgaagggcttccggccggtggtcttcgaggccgccggcgacggcgtcggcggcgtgtggaggcgcacgctggcgtcgacgaggctgcagacgccggcgttcgcctaccggttctccgacttcccgtggccggcggacgtgtcgggcgccgaggtgttcccgcggcacgaccaggtggtcgaatacctcgccgcctacgcgcggcgccacggcgtgacggagtgcgtccggttcggctgcaaggtgctcgccgccgagtacgccggggtgcccgatgaggaggcggcggcgtgggagcggtggtcggggaatggcgaggccttcggcgacggctccggcgagtggcttctcacggtgcagcaccctggatccgaagctacccaggtaattaagttcacgtgctacttgaatttttttgtcaaatttatttatgtttgatttgatcaattttata

SEQ ID NO: 65839 - DNA, 4190 bp, Oryza sativa
cccacaccccaacatttccacccaaccgaggccccgaagtgttccacggccaagtgcttcactccatggactactccaacatgggccacgccgccgccgacgagctgatcagaggcaagcgcgtcgccgtcgtcggctccggcaagtcggccttcgacacggtggcggagtgcgccgctgcaaacggtaagatccacatttcgcggcgagagtaattaatcgatctgtgatgaactgttgagcgtgcgtgctgcctgccatggatcaggtggcaggtatccgtgcgccatgatctgccggagcgggcggtggatggtgaacggcgggttcgtgtggggcgtcagccttggacacctcttctgcaaccggctggccgagctcaccgttcacaagcccggcgaggggcttgcattggccctcctcgcaattctgctcacccctttggtttgtgatgttacacgtttgtgaagtgatagatcgtacattaatttatacggttgatttttttaatttttttaattatttaggtgacatacatccctcgataatttagaataattttcccaattcaacttgattatgtatgcatttttacgatggtatttatatcggtatagtagaaaaaatttagatctttcgtcttttcttttttatttgactggttactagtattaccgtagctattgcttgtaaataaataacctcatcttttcgcttatgcttatactcagccaaaatttaaatctttagccttaaatttggagttgattttgaggtttttttcatcgaagtttatttttcagcctttgattttggatcgctaaggacacatatataaaagttttactcataaattatttttcgtatacaaatatgtcgtttggattattccatgaataaaccaaacgatggagccaaaagtagttggacctttttaagggacaacaaactattttggaccatttacggaacatcgatccaactaggcggcggaaagatatattgatattgaaagcatactagtatcaattattgcatcccaattatggaagaaacaatgtttccttattttaatgtgtacacattcgaattatgtataacagacaagtaaattcgaaaatttcaatatccatgttgtaattttaaaatgaatttcaaatttgtaattgaatttttagcatagttggaattattttactttattttttttagaactactactctatcaaaaaaaaatcaaaccctccgtccaaaaaaaaaaagacaaaccgtagatttccgtgccaacgtttgactgtccgtattatatgaaatttttttataattagtattttcattgttgttagatgataaaacataattaatactttatgcgtgacttatctttttaattgttttataatttttttaaataagacggacagtcaaacgttggacatagaaaccatggtttgttttttttttttgacagagggagtaggttatatcaatagtagtagtgtatttttcaccgggcatttcttcgatataatagtgatgataggattctactaagaccagaaaagtgctcacgaattttaactatatcaagtactagctgttttgatactgaaaatgcttttttttgtttcagagatggctgctgtcgaagctggcagagacctacttcaagatgcagatcccgatggagaagcacgggatggtgccggaggagagcttcgcgggatcaatgtcgggctgccggctcggagtcctccccgacaagttctacgacagggtggaggaaggcagcatcctgatcaagagggcaagatctttcagcttctgcacggacggcttggtgctcgacgacgacgacaccggcgagcgcgtcgacgccgacgtcgtcgtgctcgccaccggcttccgtggcgaccagaagctcacggacatgttcgtctcggcgacgttcaagcagcagatagtagcagctcctctgtacaggtgatactccgcacatcgccgtcaacgatccgttcgccggcgagccggccagcgtctcgccgccgatgagcattcattcgttcgtgcaggcagtgcgtgcacccgcggatcccgcagatggcggtgatcgggtacaccgagaacctgacgagcatctacaccttcgagatgatggccaagtgggtggcgcacctcctcgccggcgcgttccggctgccgagcgtcgtgcggatggaggcgagcgcggcggagtgggacgaacacctggcgatgaggaggcacggcgagggcggcggcggcaagccgtgcctcggcggcgttagcacgtggtacaacgacgagatgtgccgggacatggggtacgagccgaggaggaagaaagggattcttgcagctacgctggtatcctctgaagtctgaactcaagtgaaactgatcagtgatcgatcgatcactgatgtgttgatcacgagtatacgataaaaaagaacatgaactttggaattgttgggctttcagaaaggggaaaataagttgggctgcgatatgaagaggaaaataagtcgaggaaataagcgttgttccaaaactttgttgcatcgcccatcgttcttctgcaaaacattgttcgtgtatatctatttccgtctggctaaaatctaacagagagcacgataccttttcgagatatacatgtgtgatgtgtctgaaaaaaacaagagtatatggcctcatttgatttaaaggaaattcataaaaattttagagaatttcattcctatagaaaattttcctatagtgctttgaattaaagaaataaatcttatgaaatcctatgatttcctatgtaatgcctaatggcatgtaaattttgttggaaatctaacatgaggtagaatctcatggaaactttcctttgagttttttatttctcatctaattcctgcattttttcttacggtccgatgaaacggtcatttctatgttttgcaatcttctgttttacactcacattcatattaaaatcctatgtttttcatatttttatgttttcttaatcctactattcaaatgagcccaaaatggtgagtcaacagtgctgaatatccgtacgtgaatgactgcagaaacaaccggaagaagatcgttgattcttcgcctcttcggatcaaaaccaccctattgctcaacttgtcgcagcttgtgctgactgccgacatatgcattggaattgaatccatgaagagagactgtaatttgcatcagctctttgctatccgattgaaaatgcacagtcaagaaacacaactggtacttatactttttcctttttttgggggaaactggtgtcatctttgtgctttataaaatgtgtaatgtatcacatggaatctagacaacagatggtgcagctcaagaacggccatccaaagtgtctgaaagttttacatttagatcattccactataactatagtatactcccaaatcaactcctgctacagccaaatcgactctcaccacgtcggtgggagagaaggaaaagagacgatgattaagaggaccaaagttggtccccgtgtcaagagagatggcgtggtagggagaagatcatgggtggacctagggggtgtgcctggttggcaccggtatacccaatttttttggaaaaatactaggatgtagtacgtaatcagaggacataaaaatagaattctctcataaaatagaatataacaatgatcatggtttgcctggagatcttttaatcatcaaaaaatcaaatcaggagaagaggaaaggacttgatgaaaagaaacagtggaggaaaaaaagaaaaatatctagatagattaggatatgggattgattgttctgagtcttacagatatttactgaatgggagaatagctaatacggtccctaaagtttcgcttcgggctcaatttagtccttgaggtttcaaaacgtccaaataagtcctcgaaattaatcatttgggttaatatagtccttggacccacaaaaaatgccacatgagcatgccaagtcattcttgcatgcaacaatacaaatgaaatgaccattatagccttaccatataaaaagaaagaaaagaaaaaaataaaggaaaagaaaaggaaacaacaggaaggaacgaacaaaaagaccggcccattactctatctgtttgtgggctgcaggaat

SEQ ID NO: 65840 - DNA, 17784 bp, Oryza sativa
ctttattttttcttttctttcttttttatatgataagggtagaatggtcatttcatttgtattgttgcatgcaagaatgacttggcatgcttatgtggcatttttttgggtccaaggactatgttaacccaaatgactaatttggaggatttgtttggacgttttgaaacctcagggactaaactgagcccgaaacaaaacttcagggaccgtattagctattctcccttcatgaattatggacgacatttgaatagaattttcaaaaatccgaccaaaatttgccatcggaattgggttttttttttaaaaaaaaatggtggagtgatcgctagaatgggcacaccaagtgtaattttttttgggtccgccacgagagaagatgatccatgcatccggtgcaatgttattgtcaccgtgatccacgcacaatccgagatccaccgtccatcttcaagatcacaatcacgccacacaaaacttgcgagatcactctctccctatcgcatcttctatctcggctctaagaaactcctatccccaacgattgttgctatctaatcgtcagctcttcgcctcatttttcacgggcacagtggaagtggcggcagtcgaattaggggcataaagtagcaaagtggcctaagtgcaaaactttcatcatgccatgctggatagccacgtcaactcctgatccatctcatttgtattttgaacttcggatgatatattaaactatgattaaataagcatatgtgtatttacgcttttatatatctttcttttataaaataggataaacccggcctctacaacgcctttacgtatctagatgacacatagtctaagtttaatcgtccgaatatttcagttggtttagcgcaccagattgtactgttcacaggatttatttattgttctccttgcatccacagtgtttgtccgcggtacgatggaacatgatccggatccatgcgtgttatcctatatttctagtcgtccaattactactccatatcctaccagaaaactgtgacacatcattattcaaccgttgcacagaacgctgctcgcaaagccgaaacttgtaaaatgggggccagaaagaagcagtgccagaggaagaaaaagtctgtgccccaaatgtggagcatatggcctatatcgcaccgaagtagtaccatgtaaagttacatatgaagtcaactattgcaacaacccaacccacctgtcctacgttaaattcagcacacctgaagtccccaactttacgttatcccctctgtaatagcaatacacgttgtctttgctcagaaagaaaaaaaaaacccaccacagtatgataaaacacggtcaaaacagcacagaaaacgtgccaatttgaaagattagtcagccctggccagagtccggacacgaaccgcgatctcggtcaaggccgtcaagcgaggccccggctcgcgcaggcgcaggccgcgcggctgacggaggaggagtcgcggctagtccctccgctctcggcacgtgagtcgtgacgcgagaaggctcgcggcgcggagcgaaggagagatccatgtctgtttagcgtcggttagatagagctccaattataaatttagcttcaggatttggatctgaaataaagttgtggagcttcatctcattttgtaagagagctctaccaagcttcgctcttattttaggtggagctgtttggctgagctctagctccactatgccaaacagacctttagtagagctttaactcttaaatttaactttaaaagttgaatttgaagtggggttgtggagctgcctaaacccagtttcatatttctagttttattttataaaagagttttacctaactcaactcttatttgagattaagttaaaactgtttggctgacctctaatttgatgagaactagagctagagctagtcctgtgtcaaacagctcggacaacgcatcgcgagagtcgcgcgcgtcgcttgcgcccgttttgtcgtgtggcgccgcggcacggctcctgcctgcgtggctgcgcgcgcgcctggatcgatcgggttgagcacgtgtgcgtcggctgcgttgcgtgcggcggggactctgctttattcgatgggtttggcgcgagcgccgagcgagcgagcgatcgcgacggcgggacgccgacgcgcgtgtgccgggcgacggcgttttttcgttgtgaagtgtgaacacggtgctggtgctacgttttcaccggttcaccacgatttcggtgtggaaactgcgagcggtgcaacgttttcaccacgtgcgatcgatcacttcgctttccaggtttcgctgcccctgaatatgtgaattcatgaaccaaattctattgagaacgaagggtttcctaacgtgcctcaaagacaacatgtaactcccaattcgtctcagcctggtctaaatttgttaaaatttgaatcaaacttcgttcgaaacttttcaaactcatatattttggcgggttcttattatttttttcctttttccttttgcaatcggatcccagaaccctagccacacggtcagcacactgacagtggttcaattttttttttcattttacaatcgttcaattttatctgcttaaaggaaaaagaaagctcgattggtggtttaccaatccattaaactgtgaagctctccttgaattgtcaagcaattttgctaaaaatatgcaatcacattttcaatattattttcttgccttttcctaatgtgattgttcttgtacgattgtctggtttaatctaatttaggtggggatttcccccgtgttccttaaaaaaaatgtgattgctatatctcacctatatcctcttatatctcagctatttttggtgggtccgacgtttttaggtgtgaattgtgaacagtgctctcgttttcaccacgattttctgtgtgagtgtgagcagtgcttcgttttcaccacgtgctctgaaaatttgaatactccacttcactttgcaagtttcgctgctctgaaaatttgaattaatgaatcaaattcttttgaaaaggaccgaaagggttttcctaacatgcctcaaaagttttatctattggtgcacaagtcacaaacgcggtcaggcagacagtcgttcaagatttacgaacgttcaaagattttgtgctacctaaaagggacaaagaaaactccattagcctacgattgtacagattgagctctccttgtcgttcagttatactaaacactttaccaccggcataaattgccaagacatgcaacggtcatatagcttttcgtcaatttcggttggagattcatatatgggattcaataattaaggggtctttattttgtgtgagcgattattagcttgcgtttgcttcaattatttgggtgtgtttttttagacttgatgatgtgcgctggttttgcacgaatttatgtaataattggttgtagctcgttgagtaaagattggagttctattctactccctctattccataatataaggcatggtcaaatttgacacggttttcaaaactaatgtttatcttataatttcttatatattataaggtttgtagtagcaaaattataatcatatgaaaggaaattcaaatgtcaatccaatgatataatttttagcaagtaaaattaaatttatattgtactaaatgttggtcaaaatgttttgaaggtggaatcttgaaatacgtgaacgcattatatttgggatggagagagtattatcttaagaaaaatgccaagacatgaggaccaagcaaaagaatatgacattcccacttacttccttcgtttcacaatgtaagtcattctaatatttcttatatttatattggtgttaataaatctagatagatatatatgtcttgatacattaacaccaatataaatgtaggatatgctagagtaacttacattgtgaaatgaagagtgtacaacctaactatgctatcaacatgtttgataactttaccagttggcatatacttgcttggctacttcgacgaaatacaaggtggcctaaaagttgaagtgcagaaagcacgatcgcctctgttgttcttatttgtgggaagccactttctacccgtatatatatttgctaaagaaatgtgaaagtaaaactcgtacggagactgaacagaggcatgtgagaaacactctggaatggaaagtgtcaacgtgttaacggagtgcatcaagctgtcgtgtaatctgtacatttctgtcagaaaaaaaaaacttcacattgtttttcaaaagaattatgatctgtacattcctgtgatccgtttgacccggtcgtaaaagaatcatgcattttttttctcgacatgtgggcatgaagcatgcaggttatattaggtcattcccaacccaaaacactagacatagtttccataaactccatatcataaaaaaaaactagtactagacactactctttcaatgcaaacaccattatttcatacttgaatttaatgctacttatctcatatgatatcttatctcatatgatatcttgaatattgtgtagaaatcatgtctcatgcaagacatggtttccttctctttcctcatttattcacttgccgcatcatttttcattctagatggcagcttatttaatgctatggacactatcctaattattgggttgagaatagccttactacaccagatgcaataaactaccgagtcacattttaaatagaacagatagaacagtgaaaaaaccccaagatatacgaaccataattctcttaccccacgacactacgtggtgcctattccactgctcatccagccactcatgtgaaaggatcatcgatgttagatttgagaaccgacattgatggctttccacgagtaaaaaaaaaaagcactgagtcagatccatgaatcaagttaatatgattgtattaactaaattaatggaactgttaaaaaactaaatgaatggaagaatgacaaatcattcacataatatcccagaatatgtgcatgcttcgagccaaaagaaaacctaaatcacactataaattcaacatcattgtctagagccaagtggaggggaacacaatgaggtatctatgggtgaagtggagacaacgtcgctcatccatcgagctagagttgagcttgtagatttgctcctagcctctgtcaccccgccgcccacaccctatgcgtctcccttccccagctatcaaaaaaggttatcacttctctatctttgcttcgttgtttcatcgagctatgtagatggtaggatctggcctcttcgagcgtagcgaggatgaaggggaggcgatcaggatggatctagtcttgttgtcactacctctccccataccttgacgatgacaaaggcggatctgaccgctccccaagttcgagataactggatttggtggccacccgtcgaggagaggtggatttgttggccccattgctcgttggccaggattaggtggttgggagaaaatggagagagtagagagagagagagagagcaagagaggaggagagacgtatgcgctcggagtctcgagtggttgcaaatgaaactgatcggtttgatatatttttctagctcactaaaaactaggcactattttttttgttgtgttttaatagaaaaccaacatatataactattatcagtgccaaatttttttacagaatcagcatttataattatcattcgtgtcacggtgccagtttttatcagtcaggaaaacccttagcgccggcttttttttttcttcttcaactaaccggggtacgtttgggcgtttggctgcctggctgggtcatggaacggaacggaacgtgtcaacgagttggcatcaagttttgtcatgtactgtaatctgtacttttcggtcagaaaaaaaactgaacattgtttttcataaagaattgtgatctgtacagtacattcctgtgatccatttgacccggtcgtggaagaatccgtgcgttttttttttcgacttgtgcgcatgaagcatgcagaactgaacaagtatgcaagatgcaataaacggcggcgtcacattttgaatagaactgtaaaaaaaaaacccaacatattggaacaataattccattatgaataagattttatttacacagcttcagatctaaagtttttaaactgggtatttctaaccttataatttcatagatttagatctatgatcacgttaataacattttgacaaatcattttgtttctattttgatgaaatttaaagttttaaagcactataatttaatatacaaacttcaaatcaaacgtgaaccgaagtctataataacatgcctaaacttattacaagtatgaatggagtattcaaagtaccctatgtttacagtttgggagttcaatgcgttactcccctgggtaaaaaaaaaaaagaaaaaaaatcatgtttgaaccttttaacggttctttcagttgtggttttgaccacaatattttttataaaataaagttaaagattatcaaagtacttttcaacacaaatttacacaagacatttttatgttcgttaaactatgtatttcaaacttcattgatagtccaaagttaaaaatttggtcaaatctaatctaaaacatcatataaccaaagggaatatttgaaaagccgaacatactttttaccacccatactagaattatttgggaaaaaaaatagccatgtttaaaaaatagttgccactaattttttttcctttattacaaagacttcagtcccggaggaaaaaaaaacaaaacggagtacgaaaaattggtgaggcctgtaacaattctaaacacccagccagccaatcatgttcgtctcctgttggaacttgtaacatcagtagatcacctaatatgatcttattatccatgtatattaagttgaagggccaggatcactcacctaaaacacagcaatcaactcccctaaaaattgataagaacaaaccactcctcttgttcctttccaccaaggaagtttcagtgggtgttagtgtgtcaccatccatggcaagccatccatccatggatgcaactcacatacatcacccatcaccaaagccattggtcccatattatgctttccaagtagctttcacccactaactaactgggaggaaaattcaagtacagcatcgccaatgattcaatgataaacacggttaaaaaaatgaaagcatagtcgattaattaattgtaagcccatcgaattacaccacctgctggaattaactttgagtaatcaggtcaaatgaagaggacatcccatctctttcctgacgagttattattaacccacccacccggaagccactgattcacgcagccacaagctgattagagtagcatctgatccaatccaaagccacccacttcttctttatatacctcccgcgccatctctccttctcccagctcgaatcggaggaccagctccgccgccgacgattcttgacttgccttcttctccggcggcgacgattcttggcttctttggttgattggtcgggcggagcagcggtcgaacagcttgcgggcatcaacaggcgaggcatggcgagggggctgtttgcgtgctttgggaggggaggggaggaggcggaggaggaagcagggaagaggccggcgctgcggcggcggaggacggtgaacctcaggtcgctgtcgctggaggacctgtcgcggacgctggcgaagacgaacctgcacgccttcaccctggacgagctcaaggcggcgaccaagaacttctccaccagcaacttcctcggcgagggcgggttcgggccggtgtacaagggcttcgtcgacggcgagctccgccccggcgccctcgagtcgcagcacgtcgccgtcaagtacctcgacagcgacggcgtccagggccaccgcgagtggctggtgagtttgccgctgtctcttctgctgccgaatcatacatccagctcgtctgatgtgatgatgaactgataataatgattttctcgttaatttttgtgatcaggctgaggtggtgtatctggggatgctgagccatcctcatctggtgaagctggtaggattctgcaaccaagatgatcacaggatgctggtctacgagtacatgccaagaggcagcctcgagaaccacctgttcaagagtaagtagttactaattaccacatgatttggggttaattaccgtgtgttagctgttgcagcttttgctaatcgagtgtgtgattcattgggtgtgcagatcttcttgcttcgttgccatggtcgacgcggctgaagatcgccgtcggcgcggcgaaggggctcgccttcctgcacgaggccgagacgccggtgatctaccgcgacttcaaggcctccaacattcttctcgacaaggtaaatcacacagcaagcttaatttacagcaaaattcgttggtgttgaccacatgatttgtgttgcaatttggggggattacaatttgagagcacagtttaaaaattgaatcattgttaagctgcagagtgtagggcaagtaggatgaattgagaatgtagtagtggttgtttattttgtatacgcgacacgcccaatcaggcgaatggatcgcacgttgtcaactgtttccagccgggtcaaaaatcgtagcttccaacagtaggattaattaaaataatgcgacaaataatgcgacaaattagcagcaaaacctttgattgtttattacacaagccggtcgttgggcgtagaactgattggctttgtctggttcgttaggaacccacggtttttttaagttcaacgatccaaactgccatactggctttgtcgtgtcagtacggtacatgccaaccactaccacaacgccacagcaacatcaatgaaatcaaaatgcacaacaaaatcacaagttctttttagttttgaacgaagttgcaagaatatttatgatcttaggtcccatttggcataactacagctttcaactctaacttacgtagagttagagctgtcaaacggtacagattcttcaattttagagcggagttagcggagctgctccataaatttatactatagaggtgtagctgggtttttgtcgctccacaactccactccatcttaatagacccattaaaataggcacactttgatgccaaatttgctgacttgtcaaatgggaaaaatttgcaggattacacggcgaagctgtcggactttgggctggcgaaggaggggccgcagggggacgcgacgcacgtgacgacgcgggtgatgggcacgcacgggtacgcggcgccggagtacatcctgacgggccacctgacggcgaggagcgacgtgtacagcttcggcgtcgttctgctggagctgctcaccggccgccgctccgtcgacaagcggcggcgcggccgggagcagaacctcgtggactgggcgcgcccctacctccgccgcgccgaccggctgcaccgcatcatggaccccagcctcgagctgcagtactcggcgcgcgccgcgcacgccgccgcgaaggtggcgcaccagtgcctgcagagcgtgcccaagtcgcgcccctgcatgcgcgacgtcgtcgacgcgctcgagccgctgctcgccgtcgacgacgacgtgcccatgggcccgttcgtgttcacggtcggcggcgaggaggcggcggcggcggcggccgggagtagcgccgccggcgacgccggcgacgacgagccggcgagggggagccggcggggaaagaagcacgtcacgtcggccgtgcacgcggagagcccgctgcgcgacggccggtacgcgagcagggtgaaacgaccggagagcccaccgagtgtgatctgatgagtacatagaacaaacaaactgaatttgtacatagcaaaactacatggtccttgattcatttgtattatactacctttgttcgtgatgttttttgtctaaagaatttgctaagggaaacgttgattaatagagttgtttaactccctttgtaacttgtaagaaagaaaaggggagtatttttctagattttaggcgcatatgcaatgtgcaacttttgttcattttaactacgatttatctaactttaaagacttttaatgtttatgcctgtaattttgtaaatgttatgaacggtaagtttattacatgtaattagttttttttgctacaataatttaatgctcaactttttttatctacaaaaactttgtttaaataagtaacaagggactttcctaaaagaaatccacatatatctagcaattctttgggaacttactagtattttatatttgaaaaactctaacccttggtttcaatccaaagggccaaatgttcctatcaggtttacatcgtacagaattcctccccaagtttttttttaaaaaaagctgaatgctcgttctttgttgcggataaaatatatattataattttaataggtaccagaaataacatgtgttttgccataaaatgtgttacctatcatttttcaatagatcaaatctattgatagatttgattgatttttagtaaatagaagtttacgggggtaatttacaaaactacaatgagagcagatggtggtgtcagccagacaaccaccaccgctacttcttttaaagtacttccttcatttcatattacaagtcgtttgacttttttcttagtcaagcttatttaggtttgactaactttatagaaaaatataggaacatttttaatacaaaacaaatatattatcaaaatatattcaatggtaactccccgtcaagatggcgacaatgacgtcgagcgcggcagcaacggcggagggacgatgagccatcttctggagacccgattagagcaccgcccgccgccaccgccgccgccaccaccaccgattccccagtatggcatagtcacggtacagagtgcacaggatgtcgacgcagccataccttcaacccttgttggtgaggttgttcggatttgggtgccgttcgatatgcccagcttcaacccttgttggtgaggttgttcggattcgggtgccgttcaatatatcattgggcacagtgttggatataggtgaaattctcaaggacaatgttcttgggcagtccctggtggaggacccagctctgctggctgcgaagctaagccaagcgaattggcttagcaatgagctccgtttagtgcgatttcgtgtcgagcagctgcagcatgcagatactgcatctgtctgcctgactccctcctcatcagggaatctgaaactttggatagtttacctttttttgttgttcctgtaaagaggagagcttcatatgtctggcccccattttgctgtgtggcccccattttcctattgggaggagtagttcatttctatatagatagttgaagagaaatatcaatgtctcccttagttaaggatttggcaaatatactcattttaaattgaatttccattccttttagctccagatactagtatccctcttattcatctcacctctgttttggaataaaggaggtacaatcgatgtaataattagctaaagcctacctcttattcatctcacctctgttttgaaataaaggaggtataatcgatgtaataattagctaaagcctaaggcaacaaaggttcaggttgtcaacatgttcatattcacaccggcattatgaagttatcattaaatcgatgacttttacaatgggacctttaatatagatagactgaaccatatggtaataactcaagtgcaaagatgccattcagatacataaatttatacttatttgttttttaaatgtcactcatctcctttatggggtagcgatgctttataaggttctgaattatctatattttagaaagagaaaatgaattctttttaaagtagattttaaaaaagcatctgacaaaattaaattgcctttcatctatcagatgatggaatcaaaaagatttcctaacaaaaactagtgatccgatatttcccttgctatctagctatagaaaaaagagttatagaaaggagatacggaagatagggtagctattatgcaatatgcatatgcctctgaggagtcagcaaaaaacataaaattcatactttgcctcttttgaaaatatgtctggcttaaaaatcaactttgataagaatgagctgattattgttggacttgaaaaagaaaaggaactaaattctgttctatattgacttgtaaaatgtagtgccccgttcaatctcccgtttgggagggtggatttttgttgcatgcaaaacgagaaacatcattagcacataatcaattaagtattaattattataaatttgaaaaatggatttatttgcttttttaaacaacttctatatttttttaaaaaaatacaccatttaaccgtttgaaaagcatgctaaaggaaaacgagtaagttgaagtttgcagtggaagttgaagtttggagttgaatatatagggctaagtagtatacctctatacatgttgtctttttatagactaccaaaaggtgtatacctctatacattatagaactagatttttatggtagaaatatcaaggcataaggaaatatcacttagtccagtggccaatgatttgtaggccaaaagatcagggtggcctggggattcttgatttatttagatactatgaaagtagcattattggggaagtggctttgaaagctggagaatgatgagggtcttcggcagagtatgttgtatgacaagtacttgaagaacaaaactttgtgtttagataaacacaaaacaggagactcacaattttggtctgggctacttgagagatgagatacaagattttttttttctgaaatattgtagaaaggaagtaaggaatggcactatgactttgatttgcgaagacatatggataggagacaggactttggctgaacaattccgagagttatttaaggaggggactacgcatcggtcacccgatccggagtggccaaaatcggccgctgacgtcagcatgatccgattgcatcattaaattcgttacaattaaatcttcaaaacaagaccacacatggatatattctgacgaacatttttttagcttattattgaattatttttaaatattgcacgatgttccaccaagtatatcggaattgtttcactgagtagatcgaaaatgtttcaatcgtttaaatcgggcgttgtttcaccttatataaaaaaatattttagcaaatagagaaagaatatttcagttcactgcaacattagatctatacatagtgaaacattgtaagtacactaggtgaaacatttttggtggaacaaaaaataaaacgaattccctcgaattcccttaatagagggtttgcaaaatatgtgggtgatttgttgcaaaagaatgtttcgttcactgcaacattagatctatcaatagtgaaacattatgagtacactaggtgaaacatatttggtggaacaaaaaatgaaacgaattcccttaatagagggtttccaaaatatatgggtgatttattgcaaaagaatgtttcgttcactacaacattagatttatacatagtgaaacattgtaagtacactaggtgaaacattttttgtggaacaaaaaatgaaacgaatttccttaatagagggtttccaaaatactatgtgggtgatttgttgcaatggagtatatagtggagacacatgacaggtgggggcagaaaacatggtggggcccaggcgcctgcatgcacccgtgtgggggacggggcgcgcggggggagcgcccgatctgctccacccccgtcgggcgcccggcctgcagcattttcggttatataatataactttcactaaaatagtaacaatagcaaaggtctttgagatgggttgggatgcctttgaattcagaaggacactaggtggggatatggctgtgaaatgagaacattaataaaagctttgtaatgggaaaattttgcaaaatgggaaagacaagctcatttggacacttacaaaaagtggggtttttactgtcaaatctttttactatgcaatgaagggacacaggtcgtgcaatactgcaggctgacatgtgggccctgtcagcctacagtactgcacatgcagtactgcaggggatctcaattggcaatgaagttgcaagatagtggttatccctttaagaaaatctggagattcaagattcctattaaaattaaagtgctcatttggttagctctaaaaaatagtattttgacaaaagacaatcttataaaaagaggatggaggaagggtactgcaaaatgtcagttctgcaacaaacatgaaagcataaatcacttgttttttttagtgcagtttagcacgttttgtgtggcataccatgcattgtgtttttgcatgttctatacctggggggttaaaagaagtaatgggtggatggttaagcaagttctctaaaaagaataggagcctgctttcaataggaatagctgctattttgtggagtatctggaaaatcagaaacagggcttgcttggataatataattccaaatgatctgtggaagtgatttttcagattgcacataatatatcaaatcgggctattttggagaacaaggaggaagaggcaagaagcttgctggagggggccagggtgttaaagcaggtagccgctgaattctacagtgctcggcatggctggagcttcagagctggaaggatccaaggatgacagaaggaagacgacgtctctcaagcatggagggtttggaatatgagcaaaaatggctgagtttttttgggtgctattaggaaagtatggactgttaagttcttagatgtagaatggctgaaatggcgttttgaatgtgtgttgagcaggttaagggactatgtataaggggatggcacctagattaggtgggaggaggttgtggtcgtctcctgttatgctcttttttcgcttttgtaatgaaaaaaaaatcttgcagattatgttcagtggcatgtctcgcgacaccaagaatcgcagtggctcggtcgctggctggcgccaaggatgatgccaatatcctccggcccgctgatagtcacaactctgaacggcggcggcggaggcggcaacaaggcagcgaggacttcaagaatggattatgtgaccaacatgttctttgccgcctgaacgccatcttcaacagcagtcgcggccgcactcgtggactcgacgatcagatcgccatggcaggcgggaccgcccactgcgacgcgttcttgctcaccgccagcctcctcggcggattcttgcggcttgtcatggaagcccccggtgcgcgcccggcatgtcgttgacgctcgcgtcctggcccgccatgtgctggacgcccgcgtccgcttccacgcccacggcggcgacgccttcttgcgagttgccggcactttcttgcggcgcctgcgcctgcgcctgaagactccatggttcttgaggaacgtcacggaagcccgcggccatgcacagcaggtgttcgacgcctgctcccgcgggcatgtcccggccggccacgccttgttgagcctgagacacgtcgtcgaaggcgctcgcctcatcttgcatgttgccccgtatgcccgcgccctgtcgcgccatcttccctccgcacaacatcttgttgtggtcgcctcccacgtggccgaccccgacgccgacggcgctgctgctggtcgctgcctccgctccaagaaaggaagcaactccctccggaaacaatggaacggggagagcctccaacgccttggaggcgagaggaccgtacgccgcccccgacctcgatcttgtgagtcttgtcgtcctctgctccccggcggctgcctccactgctttcttgaagacccgaggaatccgcacccggggcgttctgttcttaggtgcgggatcgaggggattctttcggagaggagccattgaggcggggaggaagggggcggaccggaggcggggagccggggaacggggaaggagtggaggcgccggagttggggaagaagagttcaggtgagcgaagcgggtgggggaagacgacgccgagaagattgaaaatcgactctttcagtggtttggaaagtggttctctgatgttggcaggttgattgtggttgacccgttgaggatcagaaaagatgctgtacacacagaaaaaaagcatttccgcataagcgaggttttttttctatggcaggtatgacttttggagtcaaatggccgctaatgaaaataaaaaccggggtgaagctcgccacccgcttgcaaaaattaatttttccacctttatttttgcagctctcctccctctcctctctctcagctctactctccctccgcggccggtcgcgatgacgctgacgccgactgcgccaacaatgctgacgatgacaccgcctggatctaggaggagaggggaggcggcggcgacgaggagctgaggctgcggtgcggccggagggggtgcggcggtggtggagcggctccccttcctcttctctccctccgcggccagccgcgacgacgccgacgccgacgatgacgctgccttgatctagggaggggaggggagcggaggcggcggtgtggccgaagacggcgtcggcggtaatgcggccggaggggaggtgtggctcccctccctctcctatccctccgtggccggccacgacgacgccgacgccgactgcaacaacaacaccgacgatgacaccacctggatccggggaggggaggggaggcggcggcgcggctgaaggagaggtgcggctcccctccctctgctctctggcagctctactcctccgcgcccggcagtgacaacgacgaccaccgcgactgcaacgaccgcctggatccggggaggggagggtaggcagccatcggctagagggggaggccggcagagccgctggcaggttgggggtggtggcggcggattttattttattcgctaaaaatattttcgcaagcgggtggttctaccgtctatgaaaatagatgccgcctggaaaaatgagtttcacaggcggaccgctgagccgcctgcaaaaatcatctatttttcgtaggcctttgcgtgccggtggtcctttccccgtatgaaaaagctatttttggccgtctggaaaaacgatttttctagtagtgacacatttcgcccagggtttacgattccgacaagcccttccgtttcgggcgctggcggaattcggaatttcgcgaaatccggtggaaaactgttaaattctgaacaaatttaataaatcaaaatttgaatacaaattccctgaatttgccgacaagttctcgaaaaccggtcggttttggtaaaattccgatcaaattcatcgaaatttcgaccagtaagtatttttctttttttcttaattccggtcggttttggcccatgtaagtgtttccttttttttttgccagtaataataaaatccccaccgtcaatcgggcaagaaaagaaattacagcccgagtcgtgcatgttgaaaatgatcgcgagttaattttctttcgatgaaaagataaaaaaaaaaaaacaagaagggagcccacccagctaccctgagcgctccgtcctccggctcgtcgcgccaagtgaagtacacactgtacactcttccgccgccacctacgccccgcc

SEQ ID NO: 65841 - DNA, 2588 bp, Oryza sativa
cccccccccccccccgcgccgccggttcatacccctgccaccttggtccgtccggagattcgcgcgtcatcagcctccttctcaggtactatctctcggctcattctccctctcagttatttgcaccagggaaagacccggaaggagaggaacatctctgtggttgctctcgttttcgggtgaaatttttttgtctttccgattatactgggagtaacgatgaggattcgattatctctgtagaataggatccgattccggctaggtttcggggtgaaccaatccttgtttccggacactgcttgcctactatatatgttggattgcagcagattgattgctttatttatctgcagagttcagaggagtccggttgccagctcggagagcagctagaggatcgcaggtaatctctctctgccagccacaattatgctctgatttctcccccaaacctatctgcatatcagtatatggaacaatctttttttttttgttgttgttttgctagaaattgttttatttgattagggggaaattgaaaagaaaatgctaaggttgaaacacatcagtgagttatgatctttttacaatagtcaataggtactaggcaggatattaatgattacaataggtactaggcaggaagtttgagtaggatttctcttaatcttgatttttctctctcctcccttccagtctgcgcccttactaaatctggccatctatgttgttgcagaacaggaatggagaacaatctgattcgtagaacaaaaaggctgaagcgatgccatcagcagcccttcaaacaaagcagggcaaaagttcagtttgcagatcttcctgaggtgtgtttagaaacgagaaacctcttcaggtttctgttttcaaaaaatagcttatcgaaaataacttctaccatgtccctcttgtgcaggatttgctgtgcacaattttctcaaaaattgccactgaaggatgttgtgaggaccagtgttttgtcaagaaattggaggcacatgtggacttgttgcacaaaactaagattcgatggtgttatggtatccagggataatattaatgcaatcttgcagcagcactctggcaagattgttgaagagtttgaggtgaagtttgaattcgacagcaagctagttgatcacctcaatggtttggttgattttgttgtatcatcacagacaaaaaaaatggcttttgatttagtgccaaccaatcctgttggtcttcttgatcgatacagatttccctttgagcgtttcgacaatggaagcatctcccgtctacagcatattcagcttagctttgcatctttggaactacctccccatttcagtggttttctaaacctaaggaatcttgaccttcacttaatacgatctactcagaaggatcttcaagatttgttatcacaatgctttaatattgaatggttgagtttagttagatgccatattggtggtgaaataaaggtgacacatccattgccgcgccttctatacttacgagtcacatactgtgatataaccaagttataacttaatgccatcaacctcaaagcttttatgtatgatgggatgcgacatcctattgatcttgggcatgctctggtactgaaggaagcaagccttcatttttttggctctgtacatcttgaggatgctcttactacactcccaagtatgcttccatgtgttcagtccctcagtttggatgcctatgtacctctgactactctcccaagtgtgcctccttgtgttcagccgctctgtttggatgtctatgttcctctcgaggtttgttgctacacctttgaagtcatatgcaattctttgctcaattctttcttactatcaccttttcaggtgtcctcgctgctgaagaacacgtgcaagttttctcatctgaaatatttacaactaaaattacgtctatattatcatgattcgggcaacatcctctctttggcctcttttctcagggccagtccttgcatagagaacgttagaaatacatgtgagtactatatgttttcctatttgcaggaaatgcgtttattccatatttcttctttaatcattctggctgttagcaatgcagtactaagattttgatgatctgtcaattaattatccatgcaatacaagtcttcttatcaattcccattttcactcattgcagttcaattcgtatgctttgtcacacttgtattatcagcctatcaggaggcttccacaaggtgaatacggctatctaaagaacatgcatattactggatttgttgcatcgacaggcgagcttgaatctctgctacatgtcgtggaaagtgcctctatacttgaagttttgactattgaggcggctggcatgttagggaaagatatagattatgaaggaagattaaaagttgaggaattgacaagaagataccttgatgggataatgttacgaaatacaagctctatatggcataagttattgtagtatagaagaggtgtgcttgagatgtatttgaggattcctgtgtgcaaggatctgttgttagctgtgtgcatgtattccatggatca

SEQ ID NO: 65842 - DNA, 1270 bp, Oryza sativa
gcgtaaacagtagtacatcaagtgaacacaagtaggcggataagggacagtactatatagacggtaagcagcgatatggacgggctccagtgcaaaagagaatatagcctagagattgcagtgaccaaaatagtatcctaaggttgtgaatttaaatcttcataggaacaaatttattatttgagggctaagttctaaatttaaaaaggtcacatatatccggttggatataaagaccaggtaaaaaaaaccttctctggaaaaaaatagcctggctctaatacatgacaaaacaatattagtttttgccatctcttgggttgttacatcatactcggtaacacggatatcattttcgaccggtggaagatgtacagctggtcatcctttgtcccataaatttagtaatacagctccttctcgaaatatatgacgttggttaatacatttttaactaaccaacaattatatttgaacctttcactagtggagaaaggactagtagagaaagggtttttacttccggttcgtaatcagaaatcctaacgcgcgggtgatcgcccccgcgctgccctagcgatcaccccacgcctccccctatgctcctctctcttcttcccctttctcctcctcttcttctcttcctattatagtacatcacaaaaaaaaattaaaaaaacaaaaagttagaaatatttatgtatagaaatactatatataaaaaatatttgaattcaaattcaaatttgaatcgggtacgtaaacttttgacttataaactttacgtctataaactttgggtgtatagaaatactatatatagaaaatatttgaattcaatttgaatcacatataattcaaattcaaatttgaaacgggtatataaactttaggtttataaacttttgacttataaactttatgtctgtaaacttttgacttataaactttaggtatataaactttaggtgtataaactttatatgtatagaaatactatatatgaaaaatatttgaattcaaattcaaatttgaatcggatatataaacttttaacttctaaactttgggtctctaaactttagatgtgtaaacttgaggtgtataaattttaggtgcataaatttactaaaataggaaagtaatgcggtgacaaaaaaggaaatcaggtagagggaggaagggagagggaggggggcgaattgatcgctacccccatctccaggcgagcgatcgcccattagggtcccccgttcgtaattccccttag

SEQ ID NO: 65843 - DNA, 3197 bp, Oryza sativa
caaatcgatcatctcaaatactcaagtacatcacaaaatcttaaaaaaaattacatcacaacttctacaaaattcatcacatattcacatcacacataagtcaaatacatcacacaacaatctcatatccaatcaaatacatcacacaacaatctcagattcttcaaaaaagaaaaaagaaaaaaagaaagccgctgcctcgcagcgcgccgccgcaccgcgcgccggccggccggcccaccgcgccccgctgcccgcgccggccggccctccgcgccccgccaccctcacgccggcctggcagtagagagaaggagaggaatagagataaggagaataatagataaggttgaggagaggagttaaaaaggagaggaggagataaggttgaggagaggacgagagacgagttaaaggagaggaggagatacctcgatccgatcgcgcacgcctctccgatctccgcgtcgatctttttcccggttggtattaccaaccgggactataaatagatctttagtcccggttggtgagtagagcgtatggcgatctttttttccgattggtgttatcaaccgggactacaaatatatctttagtcccggttggtaacaccaaccggtactaaagtttgaaaagtaccctgtagcttttaaaccaggtgtttttagtccctgtttttaatacaaccgggactatttgtgaaatctggtcgacccaccaaatatggtttcttcactagtgtttaatgggatgactctctgtaatagctgcaccatttctataatagaaatggagggctttgcccctttgcttaaaagaaaaacaacatcatacaaataaacacggaaggagtactagcttttacaaacttcttgaaaaacgtaagattctcaattctcaaaacacgagaataaataaaacacctgatttaaaatattatggtccttggattctaaaagaatgaaaaccataggagaactacgtacatagaaaacagtttgagtgaagcacaagaaaatcacggaatttggaagagaggtagacaaaaaatcccaagaggttacagcacatgctaagaattctccaaaattttcatgatacatgccaatctatatataggaatttttaaaggaattttaggaactcaattctttatcttgtaggaatttttttctataggattttaaatcctttgaaatttctgtattttttcccccgaaggaatcctaaagttcatctggttggttacagtagtcctcactcacaagatgatttgatgcggagaccgtgtcgcaaattgaccactgcacggccgcgccgccctgatccggtcagagagctcttcgcgctgaggagtgaggacgactttgacagcgtccatcgccgcgacgccgcctctttcgtgttagttttgttctttttccccccattgatgtacggagtaggcccttcaaaagttgcagattctccttttcgtttgggttcgtatgctcacatggtgattggacaccaccaccgttttttgtcaagtgagaaagtgagatgagcagagcaaaatgagtttttggcgaaaccttcttccgtttgaacgtccccctgatgcttgattgtcccttgccaagaactgctcctagtgcgatgacatgtgacatgtctgcctgtaaaactccagtgaaactccgtgtgtttcacccagatgagtttgttctaggttccaaacttaacaaacgaactttagctgcctgtctgtaagctaaagtgaactagtacgatgctactacttggatctctgaaaaaatacacatgctttgtcatactatatgtcttctgagctgtctgcgtcctaggtggtgccatggtgcagtggggtgtgcttgtggtggggaaagatggctgccgctctcgtcctgaccatttgctttactaaataccttaatctaggaggagagaccacttcttcaggtcaaccactggctgctgctcaatcgagctttcccctagctctcgcctctccatgttccggggtcgccaatctgcgagctcggttgcagatttggagccggtttccatggccggagctatagctgagctgaccgtgcgtgccctgcagccgttacgtgtgcagacatttcaggtcagtgcagtgccctttctctggtctctggatttcagtgctcctttcgctctgcatctcctgctcgttttctagtacttctacggttctacctgtgttaagatttgccttgccttcctggctttctgccatgcgacacgattcagctggggaaatggagagtagttccttttagatccggccaattgctctgataaaaacgtcaagtactcgtacatggtgcatagccctgatttaaaacgaggaatttgttgctgccgtatgtcttctgcggcagtgaaatggaagaatctctcaatccaggcgctcctttctcacgcgaatcatgtagatgcaattgatgtgtacggtgtaccgtgtcatgcgcctttctgcgaaagaacagtgaccggttcatggagtaaaaatccgtcagaacaaagccaaaattgacaagttgatattagtggatcacaatcactttaagttagttatttacacccatctctagtggtcatacgggtagtattatctcagttaatatggatgaaagataaaagcttctcgaaacgaacccctaaatgtagtgaggccaattacccaacatataaaggggagcgtcaatgtattgggaagaaataacaactttatgtactgttgtattgctgtggagtcatttctcggagcatcaattgatttttccacacgtggagaaaaaaacaagccacaaccaaagtaaaaagagcctgtatactctatatatataaaaaaaaaacaggtgtgcctatatatatatatatgtgtaaaaagagcacattccatcttctaggactctgcctctgtgtactctcaggatttgttttttttttttaacgaagggtgtacatctgagtaataagcttatgttctacagtagaaaaagactcaattaaatctccaaaattaactgttactgtcaaattttgcttaaatctaataagtggatggatactacaaaagtgttggtcaaagatagcataaccttatcatggttgccatgcaataatagtagtattccataaaaaaattagaaaaataaagc

SEQ ID NO: 65844 - DNA, 1167 bp, Oryza sativa
ttgtgctttttgtgggagacccttcactttaaatttcttcttccttcctccgcgaaccttaccccgatccaaaccgttctccactcgtgcaaccccgcacctctctagaatcttgatcctcccaagctgctcaagtgctcatcccccatggcgagcgccccctcggtcaccgccttcttcgggctgctggtgtccatgtacgccaccggattcttcccctacgtcgacctgcagtcgggtggcgagagttgcttcgttcgagctccgccgcttgacgccgcggtccacacgatgctgctggcggcggcggcggcgatggttgccttccacacatccgtcgcactcatctacgcccgtatcggcggcggaggcggcggtgccgtggacaggatgatccgcccgcaggtcgtttacctcatcctgttcttgtcttccggcgtgcttcacgtcttcttggctcctcagccaggcgccatcgacggcggccaagatttgctacccctcgccgtcgcggttgtccacgtgctccgtccagctgctgcagcgacgacgttcttcctctccatgacgctcatctacacccatgtccgtgctgttggccgcggtgaagggggagccggcgccgccgccaccgccgccgggaacgtgccgatcgcgacgaccaccgtggagctcctcgccaagctggtcctcgccgctgcgcttgtcacggtcgttcttaccctcacttccaccgtccttgctgcctcctacgccgactgatcgacgagctgagtttcttcctactgctggtaagcgatttgagccatttttcttgagtcatctgtgctggttatgggatcgacaatgttcagacttgtccgagagttagtgttcatcctgtgctgtaacaagatcggattatatgtgctgcaagtgtgcttttctggtcattttgtatgtgaccagctgcaactcttcgatacttattaatggcttgtggatttgatggactcgtgttgtggtatagcgcacactatgttgcagtagcattatatcgtgtctggttcgtcgctccgtttgcttaatttttgatggtgatgtgggtatctttctttcgtacttttcgtgtgtactagttaagatttgtggtcaatggatgtgtacaatgtgttctatatgtagggg

SEQ ID NO: 65845 - DNA, 1993 bp, Oryza sativa
ggccacaaaaaatgttactccctccgttttataatgtaagtcattctagcatttcccacattcatattgatgttaatgaatctagatagatatatatgtctagatttattaacattaatatgaatgtgaaaaatgctaaaatgacttatattatgaaacggagggagtagcctttaggaaaatgagcatgtgcattgctagcagtttagactcttttttcccccaatcttgggttcttcatactagccaccacggaaaaataatgcttcaggtttgcagaatcttgaccgcttgatgttcttaccatgtgagaggcaaccagtaatgcttcaggtttgcagaatcttgaacatttgatgttcttactctgagatgttagaaaggcgagcagagaatctgtctttctgaagatcttttggctctcatgatctattagaatgaaattattaggttgattacttgatcgtttttactccatcagtttctttctgtaagaatagttaccagatcttatggggctttagagagtaatacatgtttttcatctaaatcaatgtacagagcattagcgttttcatcttatatctcgtctgatgtctggaaagcactcattcctatggaaattaagcattttttgtggttagaggttggagagaaagaattcagtctacgttgttgagaattggattgggtaagatctttgtgctgtatgtgcttcgcatgatgatgcagtacatattctctttagatttcccactgccaaattcagttggtgcattcgcagagatgatttgaggtggatcaaactacatgaagctgtcaatgaattccgctcttcacacaatggcttaggatgattcttgaatggcattatgctgaccctaatcctactcatcgtctaagaaatttggaaagagagaaatcagtcatcaatccaggcgtctgtgaagagttggttgatcagatccactgaaatgggtgctgccatttaagtccagatcatcaatccaaaatcaagtgtcgttttcgattccttcatttttttttccttttcatttttttatcggatgtctccgaagagacccttttttatttttttgagactgcatagaaaatgtcattggtcagaagctactcgatccattgttcttcaccatatcctagtaccaatcaaatttgttctagtgttacaaaatgctctagacatggttactgcggtccccataataagccaaaacggcttattaggaaataaaaatgaatttgtacgtgaaacttttataaatgtgttcttggtgacttaaaagccaatgttgtaaaagaaactacgttaaaaatatctcaaaattaagtttgaaaattcaaaatttggctttttctttggctgattaggccatccgatggaagcctacaatgggtttgcaagttgatgccaattgaaatatgatatgctttatgaaagccattttcatcggattgtttgcattctcttgtgaacttccagcgtaatatgcgatggtccgagtctgactgtcttattgcaagagcaggaagggtgaatgcaatgtgtgattcatactgccgaacagtgtccttgctgaagaaacagaggaatcaaacatcatatactccttcagttgttgccacaatgcagcgatattctactgctcaatagtaaaattttaccttctagcaatttcttggaatgtgctggtcatgatgtgaagtctgtgtgtcatggcatgatcagcagttaattggcacgaaaaatggtatatttggcctgcatttccctcataatttcgtttgcaacatcctgcagcaaaaaaagaaagaaaaaaagaaagatgaattctgaatggaacacgaagaatgtcagtgtgctcagttccaataaccttctccagccactggctgcatgtagtcccaataacatcaggcaacaacctggttacctgcatcaagtaaaatcatgtctgcacattactctata

SEQ ID NO: 65846 - DNA, 1678 bp, Oryza sativa
gctccaggaagggcgagggtgccgaccggcaacgaggaagacgacccaccgccgccagctccctttgcactaccatctagacccgcgccaacgcgggaaacgctgccgctctggctccggcgccacctttgtccggcgccaacttcagagaatgtcagctttctaaaggactaacaacaggcaattcaaacaagaaaaaatatgcagtagaaaagcatttggtaggttctgaccgtgcccacagtggtcatggtcttccaggaagttcagcaaggggtagaggctctctttgtcctggaacaacttggacgacaagtgacggttaaggaactgcacccatctccgatggacttggacatgaacaggcacgggaaggaggcattgaagggctcaaaatcaagctcgagaacaactgttggtgctgtttaagaaaaggagaggttgaattcagactgttatgttgcttcagttataatgtgcatatcgtctttctggaacttactgtccatcaacaagctgttccatgaattccaagtactcaggaacactcagctcctccacagccaactcactcacattcacccaaatgtagtcccagacaccagaccttggccgcctgatggccagtgcaacacatgggggcagcacaatggcttcctacatgcagtcaaggaaattaaattagaaaagctggtagatgacttcgatttgactatcgtcgccatgctggagtaggcacattgccaaatatacttgggcagcacgcagaacgtcttcaaatgaagcacatttctctttgtcagcttcgatcaaggcatcaattcatcaaactcagcaagcaactggtgatgctacagcactccctttcccttgttaacatacctgcatagagtgatatttgagaaatagaacgaatgcttcgatctcacatccttcctgtggctgaactgtgttgatggcattaccatatagaccagattcttactgattctagctaaaaacaatatttttaacatcatccaagatccatgactcataatcaatatgttacatctcatcaaagatcattacatacaccatcataacaatctcaggaaaaactatataaacccaaaggaatggatcaccttgtcagctaagagtcagtaacatgctctcatttcactactcaatttactaagaactaaccaattatgcggataaagatcaataagaactcaaccatttccaggagcagattcaaaggagatcttcacctagaaaagactgcaatcaacttattaggatgagatgagaaggtggtaccaaggcgttcatggagactatggaggcaagccagcttggcagccatgactcacaacttcaggaactgcaaagcaaggttacagattagcacttacaaaaactgaaagcagctatggttacacaataaatcaagtgagacaacaatatatagaacattttaaaccaaagtgcaagtatcgatccttcaccaaactaaaggcaagtaacctgcacaagatagtcagttctttgacagtttccagaaagataaaataaccagctttatcaaatggatttcttgggttttagagtttagcacaactcagatcctaaatccaaaaggacagcaaaagatgcacaaagatttttctcagttgaaaaacataacttcttt

SEQ ID NO: 65847 - DNA, 702 bp, Oryza sativa
tatcctcattaatgattaattaataacataattaatcaccaattaggataattaattactaaattattattagttaattgttaattaagtatttaatcactaatcaaattgagcctttggaccgtgtcgctatttgattccgaacggtctcgctcttctgttccgcgagaccgcgcggtctcgcgctttccccgcgcgataccgtccgcaacgtcacgcctatgtcattttcgtgtaatggttgtgcgagatcgacggtatatttctgtaaaaagttttgcatcccgaatatttctaagaaaaaattgaatgaatagtatatttttaaatttaattccatggtacaacaggtgtgtgtgtggtggggactggggagtgattggctgtctctctctgtgtccatttgctttactaaaatctaaatttgggaggaggagacttcacttctttcaggtcaaccccctgtcgcctcaagtgagcttccccttcgtccatttcagatttgcaggggagcagccgaagcagccggcttccatggccggaactgagctgagcgtgcgtgcgctgctgccgtacgtgtgcagccatgtcagccaggttagtcaatccactgtcaatttctcttggttctgaatttcagttctctcttttcctctgcatctcctgctcctttttgttttgagaccgatttgccctgccttt

SEQ ID NO: 65848 - DNA, 9170 bp, Oryza sativa
  unsure (1)..(9170): unsure at all n locations
tgctttgacaaagatgtgctgtcgacgcggcccatagcctgatttgggaggaacaaattttcttacccatgtccttcttttcctgataaaagggcagcttgtgttgtcttccggtgcttcttccataatacaaaaacagtgtgtttctgcaacagtagtgttctgttcatgggcaacccaagaagggatacatgaaactttcttctgatacgagacatccgaatttgggcgtgtcctggtctcctggacacggcaaaaaaaatctgccacaccgtatctgaactctgaacagcacacgctctctcaactgctagtcctgcacatctgaacatgcctagagaaacaactgcttgaatggaaccaatccaaagtttagatgggccccaaatccggcctgcctatatgtgcaagcccaaaatttggactacaatcctataagaaatatactacacaaatctaccaaaaaaaacaccaatgagaaacttccgttaaatttgtatgcgaaaactttcgtagaaactctgacctacggcacaaaaagttcagccattctttttgcaccaatcaccattcccctccatttttcagataattcagcagtaggtttggtttctttcgtgcaactcttgcttcggcctcgtgccgacccttcaccctccccggattccaccctcccttcctctcctcttttgctgtagcctgtagtagcttcgtcccaagaaaccaaaccaaaccaaactgaagccgaaaccaccctccttcgtctcctcctctctcgagaaaccaaatcgatcgaatccgaccgaaaccatccatggcgagcgcccctacggccgccgcctgcttcgggttgctggtggcgatgtgggccatcggattggtctcctacctcgaccagttcttgggtgccctgatgagctccgctcgagctctgccgccgctcgacgttgctgtggaggtggtgatggcggtggcggcgatcggctccctcaacaccgccatggcgtccatctacttccgtgtctacaacggccgcgccgcagctgcgaacaggcggatgctggatggtgcgtgcttcgccgtgtgggcgtcggccagcgtcctcctccacctcatcttcttcctccagccgggcgccatggacggcgctgatcaagatctgctacctctcgccgccgccgtcgtccgcgccctccttccagcttctgcggcggtgacgttcttcgcctccatcatcctcatctacgcgtatctccgtagcggcggcgccggcgccggcaccggtacctccgtgaagctcctcaccaaggtgaccaactcggctgcgcttgtcacgattgttcttagcctcgtcgtcgctgccatcgttgtcttctactccgagtaaatttgcccaaagcttgtcgaaccaaccatcgatccaatcctataccgctgcagttcgttcgggtaagcgactttaatgtctcgagtgtgtgttcatgctttgtggtgtaataagaacatatttcgctgtcaatcgtatgcatccgagtactactcttttacgcataatctgattgtggatttgacgcaaaaacatgatctattacgggaactcaactcatccggttggagtcttggagatggcgcgacggtttggtcactttggtgcatgcagtgcagcagccgaggttttgagcgcccgcctgtcgaggcgggattaaggtggccgtgccatgccagtgccggcgcctacggcggctgtcgcggttggagaggtggtctagctcgcggcggcgcccgcgatgtcgctcggcggccggcggcggcatccactggtttccgtccatgtggggcctgccgggtgacggcctgaggctgattttggggttggttgggccgtacgtcgaggcgatggcctatgttcttagccacgaaataggtgggcacggacgcacgacggggggcacggcagccggcggcggcggcggctgcggcgagcttgccggaagaagcatcagctccgtccagtttcggtggaggattagcggcccaccgtcgccgacacatgtccttgtctggttcgcagcttctggtgtggattgtggagttgtgtcgctagtgcttaacctcgaggtctggttgctcattcgtcactttttgtctggggctttgacctttgttatgccgttgcgtttgaatattttcatttttgacgcgcactcacgtagatatatactgctcgcggcagaatgtttttgttatagcagtttggtttgcctctaattagcaaccgaaaaatggaagcaggggatcgatcgtgtggtctgaaaaaaaacagtacacaagcacctaccagtgaataataacgccagctggattttaacgccgttgatgagcaagtgtgttcatttttaacgtgatcatcagcctcaccgtttcgcttatgattatctgcacaatttaatactatctccattttttaatagatgacgccgttaactttttctcacatgtttgactattcgtcttattcaaaaaatttacgtaattataatttattttgttatgagttgttttatcactcatagtactttaagtgttttaagtgtgatttatatcttatacaattgcataaaatttttgaataagacgaatggtcaaacatgtgagaaaaagtcaacggcgtcatctattaaaaaacagagggagtagcaaataaaatataatacatggataaaacttttatatacatgtcattatcttgacgatgcaaacccttgatcccttgttcgttgtcttcttttttgccaccctatctatttagcacgagggattttgtggtacttgagaaaatacctataaatatcaaaatgttactcaagataagtagtaataggaagtattaatttttacaatagaaaatataaaatcttctaattctttctcaaagatagtaaagttacccatccgttctagtgaaagatggaaggggccaattctgcatgtttttttgttgattcacgcgccatgtcctcaactccccctccgctattctgagttgccgccaccgctgtccccacctgctgcctccctcgtccctgcccgttgttaccatcctcggctccccctctgctgtcctcgcccgccgtcacccactccaccgtcctcggctacccctccgccggctgctcgatgatggagagaaatgaagatgatgtgagggagaagagagaagaggattgagtagagagagagaggtgagggaaggagatggagagatgagactgacaggtggggcctgatgattaaaaaaagaagaagaattgctgatttgactgccacgtagaaccaaaaccactccggtttaagtcgagaggagggaggttaattaatttagccggtattaatagttgaggggtgaaggatgtctggtttttggatccgagggagtaattcgtactcacctaatacttaaggggtgtaattcggactgttctcttaaagcaatacgcaaggttgagagtttccattcctgaaatgactttttcctaagaaaaatatagcggggacgataaaataaatttaccctagctgcttgtccagttgtcttgttggaggataatttctgaactcattagttttcccacatgtacaagaaaaaaaatgcacagctcaacccatgtactccctcaattctgttatactgatttctgaagtactaaatttgtcacaaaatgtattgatttctagccgtatctatcattatttcataactcaagaagtttatctttttaataccccttatttaccacctaacaacactattctactatgaatgaaaggtacttcggtcttttttttactctactaaattttcttacgattctaacattatttagttcaactaaataataataataacattttcgacataaagcaaatatatcataataagaaaaataaattacaatggtgatttaataaaactaatcttgtgttatatatagaagttgctacatttttaaataaacctggtcaaattttaagagtagaaatttaacttatttggacagagggaatatttatttgagtaaaacatgcagccctgttactttaaaaacgaatactccctccgtcaaaaaaaaaaagacaaactctaggtttccgtgtccaactttgactattcgtcttatatgatttttttttataattcgtatttttattgttgttagatgataaaacatgattaatattttatgcgtgacttgtctttttaattttttttataatttttttaaataagacggacggtcaaacgttgggcacgaaaatcagagtttgtctttttttgacggaggaagtaggtcaaagaggataaatatggggatttgacatgttctgggcacggtacaaacttcctcacaagccacgccaagccacgcccttgcatgccaatgattactcgaaaacatctttagcagatctctataatagtaggatgtggattatttttataactatttaggtgacatgcacgaaatgaggggatattccttcgagtgatgaattctcctttatagtactccaatagtagtatatgacccatagtataaaaacctaatatgggatgggagattttatattactataaatttggacatactatctgtcaatattcgtagtattagaaaatatctaacccggttctagttttttatattttgagactgacggagtattaagccttcaattaactaattaatatcctgaagctgttggtccaagcacatgcgaaccttttcagaactggttaggaatgggcgctactatcccagtccggatccagccaactgcccccatccaacagagaacataccaacaatatgaacttggagaatttaatatggatatggatttgcttgcataaaaaaatcttattatttctccgcgataaaacagcaaagcaaagtgcgtggaaactcccgttaaatgatcctgcagaagcgccctcctcctcctcctccttcctcttcctccaatttccaaaccctaccaccgaccaccgataaaagtccccaaactctccactcgctcaaccgcacccctccagtttccccacacgcctctttcctatcccaagaaaccaaatctctcagtggtaccatggcaagccgcccttcggccgctgcctccctcgggctagcggcggctgtcgccgccgctgccgctgccggattcctcacccacgtcgaccggttcggtgaaaacaccttggttggagctcctccgtcgcgagacgccgctgtccagctgatgctcctgcggctgcttgtggcggcggcggcgatgggtgccttcaacaccgccgtcgcgctcatctacgcccgcctgtacaacgccggcggcggcggcgtgaacgggaggattacacggggcgtttacctcgtcctgtttgcgtcttccggcgtgctacatgtcttcttggttcctcagctagagccaggcgtcatcgtcgatggcgctcaagaacttctgcctcctctcgccgtcgccgttgcacatgtgcttcttccaactgctgcggcggcgacgttcttcctctccatgatgctcatctacgcgcatgtcggtgccggcggcggcgccgttggggacatgatggcgatcccgacgaccaccgtgaagctcctcaccaagctggtactcgctgctgcacttgtcactgtcgttcttaccctcaccgcgaccgcccttgcctcctacgccgactgatcagcatcagcatacgcatccatcgacgacgacatagacacggtctactggtaaggaatttgagcattttaatttaatttcgtgagacaggtgccggttatgcattggtaaatgtaagatggtgctcgccttgtgctgtaacaagatgatcaggctatgcatgctgtgactgtgagtgctgcttaatggttgtggatttgatgagagagctttagcagcacggccggttgtctcagcttgacgattgcactgcatgttttgggggatggttgggagttgggacgcgatggtctcggtaattaggcaatgtggtgcccttttatcggtttcttgcttcgctgtagcgcggcgacgacgacgagctggccaacttgatcgaggaagcagctggccgggaagatccttgtagggatactttagattgagggggctacacctaggagtttcgaagagttttttctgttgtctaacaatacaacaactcaacagaaactagaattagcttgagtttgttggaatctttggtttactaggaataatatgcatggttttcagaagtaattggntgtactctccactaacattacctttccaaaatgtttcaaattttatgcagtggaggaagctttttcggccggaagaggagagcaagctgaaaacaaaaggtggaacagatgaagcaaatgatgacaagattaagacctccaagagcaggagtgggatagttgtgatgtttgctttccctgtttatagttgctgtaggagttctactggttgtgtttagagcttgtgactgttgtcattggggtccttttgccgtttagagttatttagctaagtgtggtccctgtaattgaatataagtgcaatataactacaagttggatatacaataacacgaatcttaatgcaagattttatggatgaaaaagtgaaagataggtgccaaagatcttgtgaatgaaaagtgaaatggagtacaagaaaatacacgcgatttagaggtacacacaacaaatcgaaatgattagagctcaagatttccatgaaatatgccattttagagacccaattccatatgaattctagagacccaattatttattattgggttaattggatctataccaatacaaatatgacatttagataaatgacactactattcatgatatcgtctacgtgccgctagaatttggagaaattggaaccccgccgctccctccatatcattttttttttgctaatctaacaaatcatgacacgtttaacattcgacgtagcaacatgtggaccaaccgaagatgcaattgctcttttaccagtagtactccctccgtttctaaatatttgacaccgttaactttttagcacatgtttgaccgttcgtcttgttcaaaaacttttgtgagatatgtaaaactatatgtatacatacaagtatatttaacattgaatcaaatgataggaaaagaattaataattactcaaattttttgaataagacgaacgatcaaacatatttaaaaaagtcaacggcgtcaaatatttagaaacggggggagtatatgctaagactgtgttcggcagccagttttcccaaatcctctctctcatgtttcacatgcatgcttttcaaactgctaaatagtgtatttttttaaaacgtttctatgtgaaaactgcttaatattgatccatttttgaaaaaaatactagtacttaattaatcacgcgctaatgaattgctccggtttccatacacaagatattagttcctaactagtcctaacgaactcaacatgagtaaaaaacttactccctccatcccattttaagcacaaccatgagttttcatttccaactttaatcatccgttttatttgaattttttttatgctccactaatttcatcgttagaatgttaggaatagtcttcttgtttaaagaaggtggaagtatttgttttctttattgatctgctctcgaattaacgaacggcacatcatattcttgacttcttggcacaccctagctatcggccaccgtacacactgcatacacaagatcggtgcagtgcacgcgtgtaacaccctaaaaattcccgataataaaaatcactaaaattttaaactttttaaaacttttacatcatactggatgttatggttgttattgcttgccaaactgtaaatcgtctcaatagaaaaatcaaattaaaagatgcacatctaagtaataactaaagtttacgacaatatattgttaaccctataagtatttatgcacaagaacgcaaagccaaataaagcacaagccaattattagtttctataatgtagattacaaattgaatgttaaatacttgaaccatgttgacaagtgtcatgacatctaagtaactaggaaaatagtcgccactacaacgaccctatatataaaggagtgtttcactagaataattaaattaatatttatatgttcatcaagtctctcatgggatggattcactcatgtaaaataatttgtcatgcaaataaattgagctttatatataaaatgcgttctagattaatattgcaccaagtctcaatttaattttatggaataatagattaaacatgtccatgtaaaatacattgttatacaaataaacttgaccaatgtgctattgtattattaaaggtcacattagaatatttaattagtttttttaagaaatatcaaagcctatatgttatattggataatttaatggaaagcaaattcatttgggaactaatgaataaccaaataaatatttaaataaaacatttgaattctcaaaacccaaaatgtatagatgacatttcaattcaaacccaatcacattcacttttacagtttagccccaccctctccctctattccccttttctttcttttggcgcactattcattgtccgccaaccgttcgatctcggcccaacctcgcgcctctctcccgtgcgccgcgccgcccctccggtcgctgctatgccgcgtgcctgccttccctattcgtgcgccacattatgcgtgcccgtgcgccgcatcgcgtcacgccacgccgcgcgggcccgccgccgaccgagccgccgaaatcccgcgcaaaagctgcggctccacgcgcgcgcgtcatcgccgtcgccatcgcgcgtcgcctcggagcagatggataacggccactgcgccatcccgcgtcacccctagccctagccaactacctttggacaggagaaccgccctcaccaagccgccactctgccacagctcccatgtgcgcgcatcgccatggccacgtccgtcaccaatgatgtcccggcgcccttctttgtatccggtgggtaaaacgaagtccccttccccagctagggctaaaactcgcagactat

SEQ ID NO: 65849 - DNA, 2099 bp, Oryza sativa
  unsure (1)..(2099): unsure at all n locations
ccaagccaggccatcaaaaccccatcccccctctgacctgtctctagtcatgcatttcatcgaacaccttgctatcactctctcaccaccgctagagatcaccattgtgaggctccccggccagagctggaggttggagggaggggggaggttccgtgctgccgccatcgccattgggggagcagaggaccgctggacaccgggaaccacgcgtcgaacactttcgggcgtcaccaacagctagccgcctctgcttcgtccgcaccgcaccacgcgtcaccgcccttcgccgtctctccatcccggggtaaaacctcgagcctatagcatcctctacacctctaatatctagcgtcggctccagtttgtaggattaatgcctatggctgtgctgccccagccgccgttccgccgccgacgagctcaccgtggacaggccatccccggtgctcttcctcccatctttctggagaaatagaacgcccgtacgcccgatatgctcacgcactcatcaatttggtcggaaacccttcctgtcgtcctagccacttgtagccgagctcggctatggcgcagccatggcggccatgcgccccgtccctccaagcgccgccgcagccggtgggtggtcgccggagcttctccgcacctcccctggccgccgccgggtcgccctangcggcttccgtgcgcgccgtgttcccctgctgctcccgctcggtcgagaggaagaagacgaaggttaaagacgaccttcagccgagccactgacaagctgtcccccactcctcctatttcctttagaaacttaatcctgtgaaaaagaaaatcaaagctttgaccccacatgtcagcagcggttagggataaggatatattttagattaaaaataaatgaattatgaacagtagcttttcacaatttctcggattaattcgaaattgaatctttaaactagtataacttgctcattttaactcggatttgagtgaaacttgaacctaatttcatctaaattcataagctttccaatggtatataactcactatttaataaaatatatttataattattaaataattaatatcaaatgattagattatggtcaacttaaaattatgctaataaataaaattggtattatacagtagagtagatgtaataatatttgtttctagcatgttttgtcacagtagcaaccatgtaaattaagtacagtgatgtctcaaatgaacggatgtatagcaagacactagcactatttacactatttaatgttcaattaaatccatgacttataaattatttacataaaagtttagcctcacattttgtaactaaaatataaacacatatggatgaatatctttagcttgattaggaggaatataacagagctagtgtgactagttatgttgtcggttgcctatattcagtaaatggttcaatattaatatactgttgcatacacataaccttttagataacctactagttgcatatattaaactaggtaataaatgaagaaccagtatattagctaaatactagtgctagttataaatcttgaccacacataattttaattttagttcaaccacacctgaggattgttcattattaatttataaagttatacaataacataatcagtaactataatattattaaaccataaatctaaagtacagagcgcataattgtcaaccttttatgaaaacggataaaatccatatatatacatcatgtggataattcgaataatagcttcattgataaaataataatgtaggtgaatcatggtgatgatatggtttatccttaatctccccatcgacatagccatgctataaccttagggacctgaccattttaccttcataacagatctcttccataagccaatagctagactaaaccacagattagcaaaatgtgtatgtattgtgctagttagtaccaatagagccatcgggacaatataaaatactaagaaaccttggctcttagcttgattagaatccattagcaaacacgagtagtataagcagccctaggttcgacctcaacaattatattttgcttgtgcatatttgc

SEQ ID NO: 65850 - DNA, 2821 bp, Oryza sativa
  unsure (1)..(2821): unsure at all n locations
agtcatcaccccatcccttgagcatgttgatcccaatcgtgaaattgttttgtttacaaataaaattgcatgcagtgatgaatatcctacttgttattatgccatgcctttgattattgcttatctcattattcccgtgtacccataattacgtatgagtccctagtcacttatgacaaatgcttagtaatgctaatttagattcatgcattctcatatttatcaaatgctttatgcttgggcaactaccttggggaaggtagttgaggtactgcatgtggagacatgagcgccacattgccatgacattgatgagatgatttgtgaaagaaaattaaaactaaacaaatgttttcgactggggcggctggaggacttgggtggtgtccggaaaaggctagtggcgtccctagtcagttaaggaccgagccatgaagttaagcatgaaacgacccccgtacaaccgtacttctcgtgtgggtatagacctagcggagtaaatagccgagcggaggcggtacccaagccgtagtggttttcttgttgtgtgtgaggcagggcctacggtggggcagccattggtaggaccgcgaggggcgggtgcctacagtggtgtcgccattggtaggattgccatgtgcaaacctaaacttaactataacttaatgaatgtgtgagtctttccccctcaggagcgccagaactcctctcactgctagaaaccttggacgcctagagtgcatgaggactaaagttcatggagcgggtactgccaaagtgaggttattgaaaggctttgtcgtggcaagtctcattcgttgggacgtaggcttatgtgttgggcaagtcgcggagtatgggtaaagtgtacatccactacagtatgagtaaaccaatctattcgaatagccgtgctcgcggatattgagcaccgagatatgtattacacttggctagactctaatttcttaatctgattgggatgggatatgcatgatgattttgtattggtgaatcaacttttctcgagaggcgagaaggggtagaccccagaaaaccatgacgaccagtggcgggaagctatccttgggaacacaatggatggtggacagaaccgtcgctgtttaatgaataatggagataaaacttgatcggtttatgttaggtcttaggtttgtgaaatgatatttgaaaactcagctttatgcaaagtaaccatagccactccttgtattgtcctgtacattactgcattttgtgtggtggcttgctgagtacttttgtactcattgttactctatatatatcttttagtagagtgttgaagagaagcccttgtttgtacgcttgcgtacctaacaagatgatcggagtgcggttctaatctaggtctcgttccccagtcgactgcttgtggcatgtcaaccgggcccttgtattattttgtcttctgctgttgtcctctgatagttgttggcctgcctggctctaatgtaagcatttaactctcttagcctgaattcattcgtgatatgtttctcttagcctgaatttattcgtgatatttgtgattcggctatatatatgtaccgactactgatgggattggtactgataaacattaaaaattttcgatttctaaaatcggggnnnnnnnnnnnnnnnnnnnnnnnngtgcattgtaccgcgggagagtggggagaggaattctgcttgccagccagagtcaatcagcactctatagaatctgttgatctgttccttccaccccgtgctgaaaaacacgccgtccacatctgcctttgctaccttcgcccagaaggcacgggacgggacacatgatattatcaccagaagggaaaattcactcgactttttgccaatcgttatatatttgcagcgcattcataaaactaaattatcagcaatattaacaagtagtattataaacacacttagtacgctgtattatcaaatacatggatctggttaagatgcagtggctagtgtgcctacaaggtaagcaataacacgagtatcactggattcaaaatagatgacttaggtacattagtaaaatattatagcaatttactgtagcaaacaatttgaaccattagatcaataaaatagagggctcaaattgtgtacagtaacttattctgtagccatagtagcaaatgtactgcatctcaatcccaaaatacatgaacggtgtaggtgttaattgttcatcaagcactccatcttaatcaatgtgttgttagtttgtgactgcaccaagagaggaaaacaacaaaaatagcactagttaaagatggcacggaaatttttctacaatctgcaccgctagccctgacaagtaacggtggtatactggtatggaagatagctggtttgttacttcccccgttcataaatataagtattgttagagtttttaacaaaatttaaggatgagttacaattactttgatgcttacgagagtttacttaattagaaaaggtcccgagtattgatgcaactagtgaacatttatgaaaaataatactcctaaaatacttatacttgtgaataaatatcaaattctagaaatgtgtatatttgtgaatggagagagtagttgttcatgaggattaaggataaatgtgaaactaaaaggagatagttataattggttaagattaaagaatacggagaaattaagtagatatgattatgattggtttatatctcataaaaaaagtatgtgaatgagtatactttagaaacaaatttgaacgtcaccatctatctctctattttctacttcctccatca

SEQ ID NO: 65851 - DNA, 6325 bp, Oryza sativa
  unsure (1)..(6325): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcattttttttcttatgtagtaagactagaagttggaaacttttgaagctgtagaaccgtgatagtcctgtgtgtttttggaaattctaagccattcatttatgtctatgaatatatttttccctgttaggtctgtttatcttgtggtatgaatgcagaaaatttaataaacaacttctcattacaaatcgaatcggccctgagttcttgtaaaatgtcaaattcatcttttatagctgttaatttcaattttgttgcatcgtaagctttatcttaaacgggcgcccaatgttcttaacaatgtgttgttggatagttggcaagattgtagctgcttgggcagtgtgttttcaacagacaatgaaacaagatctagtagtacatattttcaagttctcaaacaataagacaagacctaggagtacatattttggagcttgttgagtgaatcttgttttatttaagaaacaactgtttaacagggcaaagcattcgtgcatctttaaatactgttgtaagctcttttttggtacagcacatgatagcatatcttcatctcgatcattatatgcccctgataataatcttgctcaagccttcaatagaaaaatgatggcatgatttaatctgtcctaaccatgttattataaagttttttcagtcaacatatatgaaatatctatttatagaacaacatccttttttttataaaattcctacagagcctgatgttcttaaaaagaatgttacttttctgaagtacaacatatgaacagttccaataataacagaccatatgacttttgctttcatctgatcatctcagcagatagcaattcttactttatatatatatttatttggcttgcagctccttcctttcattgcattgttaactggagttgctgtctggtatggatatcagtaatcttgttgtttattattatatgatgcaatgctctgaatgaaatacttaggattctgtatattattgtgcaggtcttacctctctccttcagatattatgaggaatcagccacatctgcttgtgatcggaactggttttgcttttggatatttggtggtaagtttttaatttgttttgcccctagcatggattttaatcgatggtttaacacaggattctacctccttcctcagtgcgcaatcaccaattcactggagcagccactgtcatacccattgttgtcatgcttatcagttctaaccacatggttcctgctaggccttgcctatccttaaaaacagccacctgctatgagttcaaatttcaaagcaaccaggggcactccatgctccagttctcttcactatttcagcattcttcatgcttcagttagtgagagcctgagagggcaccaaggacaaaaatcgtttttgaaaccagccttgtttcaatacctgaggggtgtcaagtatccagttttagagtttagagtcaaaatgcggcctgctaagagtttagagtcaaaatgtggtctgctaagagcaagtaaaaacttcctacattttggaaatggatctttgttagtaggttactagaaaaacaataggctgcttcaatcaggttttgatcaacccatctaacctataaaaatactataaactatatgaaataatgaccaaattatacagaactgtgcagcagaattgcaaagggtccatatgcagataaatcaggccaatggtatttgggcatttgtatcactgttgtcttgtggcagcaattagttacgcaactgaacatgcctgccatcagctgaccttgccttttgatctggaaagggtggtaaactgaatactgtttagcttgttttgtggacgatatatcatattggatattcttgtgttcattaaatgtggatcagcatttcatcaacttgcagttccttaattactttcttatagttttcattatagttttcatctttgcaaaactttcttatgatctactttgatctatctgcacagcagttataagtctaggaatttttatctaaccatcacaaatcactaattaggttatatctaaccatccaagttatattgcgacaattaaaaacttgatagtcccattatccgcctggatttttatgaaaagcatttatggctaacatgcacaacatattggtactgatatactgttgctgaagaagcacctaatgccacttggttcacctaatgtgccactgcgctttgttctttactgaatagtgatggagcatttttctgtagagtgagatttgcaaacatagtgcataatactaatctaccatcatccttgtttttccttcctggaattagtgctcatattttgagttgccatgcatggacagggaaggatgatacttgctcatttatgtgatgaacccaaaggtctcaaaactggaatgtgcatggtatgtccatactccatagttccatgtcttgtttctatctgcacatcacgtgtacatgagtcacttgaagtaaaataccaaatatctcttatttcagtctctggtgtttcttcctttcgctattgcaaatgctctcacagcaaagatcaatgctgggtaatttcttttatctttgttgcccctagtactgctaatatttcaggtgaaccatttacgcggatccattaaacgatatatcattattactattgccaggattcctttagttgatgagctgctggttcttttcctgtattgcgcatacacaggtgaactgatttaccttaattatttatttttggtgtgagattgctgaagtactcggtcttagtttcattgtatgatcactcatttttgtgggaacctgttggcttggttgacattaatcttctgtttgttcccttggattatatatcgttgtatgtattgcaaagtccggaatctaaagtctcatgtagatatgcctatgttttattgatggactggtttcaggttaatggctagtgttggcctagtttgctcacaagcgcaaaaactttttttaaaaaagaaatcctgcatcatctgttacagtggaaaactcattatggtcctctttttatcaattgtgtgatgcatactccacagtattctattaacagtatacacgttatagattgatgtcaacttctaggtttaccttctgcttgctgcttttataggtttacaaccaacacgtagtcttagtgtgttatttatttgtgcagtgggcctttacctgcatcttgccgtttctgttgtgcatgaaatcaaggatgctcttggaatctattgcttcaggtctgtaaatctatttgttatcttcctatacttaggaagtaacctgtctcatcaacttctttttttccttttgcttttttgacaggataactagaaaagaggcttgaatgtgttctgagttcttacatagcaataggaggcattctgtcaccttgtttcgttccagatatttttgcctttggccataccaaatctcatcggtgtgcatcctggggtcctgccccttgaacaccacaacaagcagtcgtttgatctgtttgatgcagatggatacttttggagtgtaatgcagaaatatctttagtcctatatatgtacatgttgtacacccagcttttgacgtacttttgggttccatagttaaggaatcgataggttttgtactatttagatgacaggaggatgaactattattgcaagtgtggagtcgtgccttgagcaaacaaaagcgttccatgattgtagctggttaatttgcatgtctaccataatgcgtcacctgttgtttcggcgccacattactgtatgtttctgttatttttttaaaaagtctggttgaactccagtctccatggctcagacgagcataatggtgcaactgcccaggaattatcactgacagattgcagctaagctccaacagcatgagcaagcagacagaaccagtcaatgccaccaaatctatgcattttacgagcacaagccatctactataatcacaattaggtgaaaccccgcgtattgttgcgggaatttagtatgataacaaaaaaaaataacgtataagatagctagataacatcagattaagtaaattaatgtagtttatgataatttaaatttaaatagtatgtagaatggtgattcagtatgactttatggaagaagaaaaatagggatatagtttggaccgtagaataatcatctaaaggctaaaaacaattgatgtgatatgacttaattaaaggaaaaaaaggagaaagataatttggaccatagattaatcatttaagtactaactaagtgaggatgaactatataagtatataggatatcataaaatataataaagatatacattgaaacattatatgaattatgttggatgataatttaacatgtttatatttgaaaagctcttaaattataatagctataaagatatagcatgtttacatgatgtttaaatgtgatgattgttagtggatgataatggggcatcttggtaattagtggattaatagatgatgatgtggcattntgttagtggatgatgatgtggtattttgttagtagatgatgatgtggcatcttcacatgtcaagcttaaagaagttagtagagtaagataggattcagttcttcactgtcacgaagaattacagcacgagcagaaggggaggagcagtttaagaagagccggtgcccggatgactgctgcttcagttcagaaatcctgtctgaaaaaatacaactacagcagtatactagtgttgatcagagacaggtttagctgttcgatccgagtatcatatactgtccatttttcgccaaaggtttcgtttctgaactcgtgttggagtacaggattacagatagtaatccttttctctgaactgacacaaggatcaaacagaagtgggcgactgggaatagtagtgtttcctgcgaagaatctgtgagatgctcctgctccacaaagcacgcatacagctcttccctctgagttgactcgtccctgatcgagctgagctgccagccagcggcaaagcgctcactctgcaagtaccgatgcacaacggcgacggctagagacgctggagactgacatttgcaatagttgcagcctcgcttctgggcttcgcttcggctccgtggaagaagaagaaaaactgaataagaacatacacagcccagtgtggctcagcgaggcaacagttcacgcttccttcccttgcgcgacaggtgacggcaaggctgtggcgaccggcgagatcgacggaatcgaccgtggattcatattcatatgatcatatcctttctggacgagctggcatgaacttggcagtggacagctcttactaggccctgctgttcttataagttactaagagcaagtataatagtaagctataagccggctaaatgctaaggtggagaagaaggagaggagagagaggagaagcgggccataaacttatagccggcttagacacaagaaccaagaaactatgtaagagagacaagtaggccatgtattaattgtaaagagctaactattatatgggcaggctaatagaagtctacaaagaaccttataaccaacaggtcggctgtattattaactttgctttaattactggattatcatgggcaatctaacacgctactacctctgtcctaaaataaggttgcgttcgtttgggtggtagggagtgagaatgcacatcattttccgcacgcacgcttcccaaactactaaacggtgtgttttttgcaaaaaatttctatatgaaagttgctttaaaaaatcatattaatccatttttgaaatttaaaatagttaatactcaattaatcatgagttaatggcttacctcgttttgcgtatcttcccaatctcctcaatccccttctactcaaacacaccctaagtgcagccatagatatccgtgttcaatgttttgaccatccgtcttatttgaaaaatgtgtgaaaaaattaaaaaaaatagtcacacataaagtactattcatgttttatcatctaataacaacaaaaatactaaacatatttttttaaataagacgaatagccaaacgttagacataaacagtgtaaaaactacacttattttggtacggagggagtataaacga

SEQ ID NO: 65852 - DNA, 713 bp, Oryza sativa
ccccaaattctcgattacagcaagacgggagacttagtcgtacgctctatactttctcggtcgacatcagagattgacttagacaaaccctttcggtgcccgcacgaggctgacaaaggaagtccaacgttctctctaaactcaccgagaacggtcacatgacctcgataatagttactccaatgtctgcgcggttgagaatatgaattcgttcatttgcatcgaagtcgggggctactgtcagggttatgtataccacatacctaatagtagttgactaaatctcggcaagacccaccacataccatgtcctatacggaaacaatctgcggatataggaggagttccggataaggaaagacaaccagagttctacatagaaacgacaagaactactcggattgtatccatattggttttcctagttctacttggacaaggggacacctatcggtataaatacaagcccccctaggaggacagggggacaaccatgatgagacgatcaacacgatcaacacccaccatgacgagacaatcaacacccaacacaatcaacatagaagccacaacatacaagccaacatactccaagacaagacgccggatatcgacttcagggataggtatggctattcccctacagtgtctccggataccgtcaggagagacgaaaacgctatctctgatctcgccgggcacggattcgagga

SEQ ID NO: 65853 - DNA, 1671 bp, Oryza sativa
tgtatttattaagcctaattaatctgttattagcaaatgtttactgtagcaccacattgtcaaatcatgatgtaattagactcaaaagatccgtctcacaattttacatgcaaactgtgtaattggttttttatcaacattttaatgctttatgcatgtgtctaaatatttaatgtaacggaatttttgaaagtttgaagaaaagtaaacagaacttataatgtacttccacatgcagctagacgaaccatttccgacagacggttacattgcatttccctcacatttccacacgttcaaactggaccagacagctagacaaggattgggccttttttttttcttttctgagaacggattgggcgattgcccataacctctacgagataatccaaaaaataccattgacaaatatccaaatacaagaaatatcattgacaagcacccaaatacaagaaatgctatcgtacaagtgtgaggaatacaagaaatcccaagaaataccatcgtacaaacgatttttgtcctaaaaatactatcgttgttagggttccatccattttgcactgttaaatacattgtttatcctatagcacttaacgacgcggaatggacggaaccctgacggcgatggtatttttgggacaaaatcgtttgtacgattgtatttcttggagctcatatttgtcgatgatattttttggatttggatgcttgtcaatgacatattttagattatctctaactttatttgattgtcatcccgctgtctataacatgtgggccctcatgtgtctatgacatgtgggtccagtggtaaataatttagcactatttataagagtggcaaatagttaattattcgatggtagctaggtactagtaccgtactagcaatccggtgtgaacggcggcagggcacgagtatgagtatgagtatgagtacatgtttgaacggcatattttccgaatatgccacacgggttcctttcgcttgcgtggcccccgcccttcaaccggtgggctctgttgggcttttcgccgtgcccgagttgtccagccatgacccaatgccgcaaccgcaatgcgtgctgtgcttgagctttgatctagcgaacggaatgtccccatccaagctattgaaagacaaatccctgaaccaaacacatgtatgaacccacattctctccgtaagttaagaagaaatcgataatgccgtccacactccacacaactcacagagtttttagtgatgaacaatcgccaatctcatcagggatctgcccagacagcccattcgacttcaagtcactgcaggtacaaacccaagctcacaagttactgcgagtccaagcaccagcaagccacatttccaaacaacaacaaagtacaccaccacgtcttccatacatcgagacgatgcccttcaacctgccgacggccggagagatctcgcctccgaggttgagcccggataggttgctgctttgcaatcaacaggcatgatcagtgacgaaccagtggacttgtcagcaagaaaagtagcgaactcggtggtgttcttcttacagcgcggcgacggcgaaggtgacgttgtcgcagaggacgccgcgccacgagcagtagtcgccgccggcccaatcgtacagtacgttgtccacattgcggaag

SEQ ID NO: 65854 - DNA, 9520 bp, Oryza sativa
catttaaacatgctactagtcattcctcgtaaacaagcgattcattaatatttatatttctcaatacccatgtagccaatcgtgtgtggaagaatggatagttatgcattaaatccgagaaagtcattaagatgatagtttattgtattgaaatatgcctatcaaaaatatttttttcagatttggaaatatgactatcaacaatagatggagggagtactacgatagattttctgttatctgtgtgggccctttccaaaaggttgctttccaaaacatggctggagactgccctagcaattcacttcaacgagatgatgttcaagttcaacaaaagctttgtatttctcgatcacataaatttggcaaatgggatgaggcaaacacgacgaaccaaaaaggcatttatctagtgatagacactaaaccacaatcaagctagtgatccaaactcccagagccttcaaatgtaatatacaaattagtcctttgatgaggtatctagcaaagaacaatggacaaaacgagtgccaaaagaaaaggctcgtggcctttctagtttccaactttccatcacaggcgaaggttcgaaagggaccggacagagcagaagcagacgaaactccgggttgagtacttcctccgtctcattaaaaaccaatcagtatcagacgtgacacattatagtactacgaatctgaacatacatatgtccagattcatcgtacatgtcactttcggttctagattcgttttttatgggacggagggagtaggcactagcagtagtagcgcaatgatagcgaagaaaggtttcctttacgaaacatgggtgcatgcagaattcacgaatggtactggtctactagtactagcagtaaggccatcacagtgagtcatcaagttttgatgttccacaagaccacatacaagtagcttgtagtgggtcccaccaatactactttcccctcccccctctctctcccccactcttcctttccccaccgcaggagtcgggcggagacagaggtcgcggaggtcgggcggtccggccgggcggcggatcgtgggatcaaccttggacggcagcggcatgcgcggcggcgggcggcggcgtcggtcagcaccctcctcccctggccagctcgccgacgagtcctaccgcgccatcatccccggtcgccaaggtggtcggactcgctgtcacggctgccgcgggagtcggcgcctccgctgccgccgttctcaagagccctgccacgggagtcggcgcctccggcgccgtccttccctccccggtcgacgccctcctcccccggccgacgccttcctcccctggccggcgcgccgaggacgctgcctgccatagtcgacaccaaggcggcgagctcgatgaggccggcgacgtcctcaacttcttcagtcccctcccctccccctcgcttccggcggctgtcgagctcgcggcggcggggatcgacgtcggtgggcggatcgagcttgccggctccggaggtgtcctcgccgctaatggcgacccgtcgagctcgggtggtggcctcgccggcgacgaccaccaccacctagcatgggatgtgggagcatggcaggggaaccgccgccacggccggtggtgaggtggagtgaggtgtagacgctgctatgcacgatgattgaggaatcactgacaactttgatggaatcgctgacaactttgacgaggaacgtggagctttctttggctccgcgttcttcagtttctagcgtgagaagtgcacgtggctgggaatctctgatgttaaagggggaagccgaatgccatgtcacgcactgtgaacgccctaatatattccatttcttgcccattccttcaacgagatgatatccagttcagcccactgaccgagacactactccaaagagagaagcataacacgaacccaaagcacattgtgtacatacaccaccgcactaccgagtaccgagtacgttctcccagcgtaaaatgcaaaaggatgaaacgcacaccactttagtattacgccctcaagaaaacagaaaaaaacaagtagcactcgaccactcgtgtcgccagtgcaggactcggtcacggcgatcgggcgatgtgaatcttcagagtcaacaggcgcagccgaagacacgacgcggacatgcgtcgacgacgacgacgagcgggacggcgaggaagaaggcaaccgccaaggccgtaaccatgaccatcttgtgggagcgttccgtggccggcgtcgtggcagcgtccggcgtcgcggccgcatgtttcgccttgcggaagcggaggacgaggatcgtggtgccgaccacggtggcagcggcgacgccgacgacgggcacggtggcgagcggagcaaggaggcgctgcgatggcgcgtcgaggatgccgaccgcgaggcgccaaggggcaacgaggacgaggcagatggcggcgagggacaccgaaagggtcggcttgataccgcgctccgtggcggtcgcggcaggggtggcgccggcgccggctccaccgtgcgcattcggaagaagcacgccgcggacgcgcgaggcgcaggcgcccacgacgagggcgactccggcgaaggcgagcgggacgaggtgcccggactggaacaatggcaggacgagcagggacgcggagacgaggaacgcgacggccagggaaaccaccagcgtcatctgcgcgaacgggtcatcagcgaccgccgcacccgttgcgccgcgcccggcacgggccgcgccgggcacagcgcgcggtttgcggaagaagcgcgcgagaagcatggtgccgagggcgggcgcggtgaccgcggcgatgacgaagacggcgatgaggatgtcgacgagggggctcttcccggcgaaggcaagcaggagacgcagcgcgtctggtccgcccagagcgcccgcgcccatggccacgacgatgatgttccgaataactcgagacattggggctcaccgcctcagaactctgctcttccttgtgctcgttggcctctctctgttttttcttttttttttttggcaccgttggcttctgtttgattcacgattctcgcctacaaccgcaataatatatagtatgtggaagggtatctgcttgtgcgtttcttttttctttctttctttttttttttacatgtgtgcttttgcgtttctggacacactcaccacacatcatcgccgccggcagaggctgggcgggtcgttatcatgccagcgtggtccccttggagatccaaacgattcgaccaatttcatgtatggacacgttgatatacgggtagtacaaagacggtgaggaccggaagtgatcgcgattcgcgagtttcctttgaatcgatccgtaacgtactccacagggccgaaaatgatcgtgattcggaattcgcaacagctcgttgcggtgacaaaccggactacataactgagttgccattgattgcgtattttgcgtcgtagatctctgtttcctcgcaattcgcaagataggtactctactccttacatccaaaaacttcttcatttctcattatctttatcctaaaatagtttcatctttcaaaagtcattccattgttgtttgtaaaggtgaaggataaatataccgaggctagataaaattgcattgagatttcttactttgatgataaacaaaattattttggttttaaaaaaaaataaacaaagctattttgaaatggaggtagtagcattgttgatgataaagcggtgacacaataggcagtaatatgttgctcctccactgtttcccgcgagagtgtgccattgtgcaagttatttaattacggatgacattttggacacgccatttttcttcatttccccccttctccctactgcactttacctgttaattgtaatgataaggagaaaaaggaaaagaaatcacagttatataggctctgtttagttgatggtaaagtttagattttagttgaaattggagatgatgtgactaaaaagttgtatatatatgacatgttaatatgatggaaaaagactgaagtttgaattcaaactttggatctaaacacaggcatagtcgagaatttggggatggcgtgttcacacttcacacgcccaagtaatttattcggtcagtgagctggagaaggaagcaaattacgtttggccatcccatctttccaatttcgatgaccgagaatctgagatgcaatcctgctactttcactcaagacggtatgttttccgaggacggctgtacgttgctgatgactagtcttgttcatcctcagtcgccgtaaaggaaatttcacttcactttgcacgttgctttttgggttaaaatcaaaccatgagaatttgatgataagagcaaggctaatagtgaaaagtagtagtcggcggtagtacatgttcaggtcatttaaagttaatactgtatattgtttatataaaagattggctctagagtctagatgtgctttacggaagcaagaataggtttaaagtcaagtgctatggtagatgtgactatcacctctaaatttatctattttattcaatcatgaactaagaggcaacccatacaatgtatcacctctagtacacaaataccaatatatctaatactctcacatctttcttgaaatttgtgtggaggttacctcttgatttaggggtggctcatcatctctctcctcacttctctcctccacatcatcacttaatccaatgtggcattcttagggataatatatgggtcattatagtacttgccctaattgttacatgtacaggtgatcaaaactaaactccatctctgtagcccatcctgcttcagcatgaaactaaactagtacttaaaatcacacagtatgcatatgcacataagatcaagtaactgaactatagacccaccaagcgaataaaatatttcatcttgcctaatttaccgtgctatcgtccggcgcttgcagaagcgctcgtttcgctctctctcatgctttctccctccacgtatgataatactgatgtggtggttcctagcgccagctgagttcagtactattagagcaagttcaatagtatagccaactactagctccaattcatctataccaatctaatagctcattcatacaatagttacatactacactattaatacctggtcccacctgtcatacacacactatgtcttggagtccgtgctacagctggctacaaatatgtagcccgttgcccttctctctcctcatttatctccttaaaatatgtttgcagctggcttatagcctgctattgtacctgctcttagggtatttacaatgcaagctatgggacccatagccttagcctcaaaacttggtccaaggacacccttcccacagtgcaagcacccatagtcagggtaccaagcctacagccggtgggccccacgaaaaggaatcgtcacattgagtactactcgcgcggaccgattcgtcctcctttcccgaacagccctcgcgcgcctcctcgagtactactcacgctgcctcgcctcctcctccctctccgcgacgccgatgggaagcggtggcgagagtcgtccccggcggaggcggctggcgcggcggtggcgagaggtgtccccggcggcttgcgcggcgttggtgggaggcgtccccggcggagacgactggcgcggtggcggcgggaggcatccccggcggcagcggcttgcgcggcgtcggcaggaggcatccccgacgaaggcggctggctgacgagacgggtaggaggaaggaggcaatggacgccgttcttttttttttgttcgtttttgttctttagattcttgatttgtttgcaccaccttgatttctttgggttctttatttgtttccccaccttgatttcttccggttcttgattaacaggcgtggatttgattggggaaatcttgcgatatcggtggagcggatgaatcggtggtgaatcgggagaggatttttgagggcgaatcggggatttcgcgatgggattcggcgcgagggtacgacacctctgggtcacgtgctccacagcgcacggagcttgctacgcgtggactcgctgcgagaaagttcctcgcgtctttacttggggccaaggggctcaactagggcgcgcgaccttgctccacgcaagcacaaatcctcgttggcgtggtatagcaccggtctatgtcactacactgtgagaggccttatacctgctctaacagggaaagaaaaaacctctgcggcaatcatatgcctgttgcaatgctacccacggccaccccaccatagactgtttttcgttttaaggtccactgttactatttttttttttacccggtgatgattataccacaatcaagctgatggtccaaactgaaagaggccccaacgatagtggagtatctgtcaagaattaatataagacaaaactggcgccacaagaaaagataagagttctcgaaaaaaaaccaagaaaaggtacacgaaaaaaaaaagaaaatataagtctccaaagcttcggaatggaaataaaggtacacgtacacgaaagttggaccgagatgcaaagagcagaagaagaatgatgcgaagtgttccaaataaaatcgacctttgcacaaaaagttccaaccgagcacatcgtagagttgaatgatgtgtcaccgagaaaaaaatcgacttacagatagaagttgagcacaagcaaataaaaaaaattgtcaagttgcacgagggggcggtggacacggatgagactaaggcggaaatgctaacgcccgcgctggccccttccatgtactattgccttcctcttcttccccttcctcctcccctttcactacaggacaccacacaatttttttaaaaaaacaaaagttagaaaaaatttatgtatagaaatactatatacaaaaattttaaattcaaattcaaatttgaattggtatgtaaacttttgacttataaactttgggtctataaactttagatgtataaacttttagatgaatagaaatattatatatagaaaatatttgaattcaaatttgaatcgggtatgtaaatttttgacttataaactttgggtctataaactttaggtgtataaactttagatgtatagaaatactatatgtcagggttatgtacaccacatacctaatagtagttgactaaatctcggcaggacccaccatataccatgtcctatacggaaacaacctgcagatataggaggagttccggataaggaaagacaaccagagttctacatggaaacgacaagaactactcggattgtatccatattggtttccctagttctacttggacaaggggacacctatcggtataaatacaagcccccctaggagtacagggggacaaccatgatgagacgatcaacacgatcaacacccaccatgacgagacaatcaacacccaacacaatcaacatagaagccacaacatacaagccaacatactctaagacaagacgccggatatcgacttcagagataggcatggctattcccctacggtgtctccggataccatcaggagagacgaaaacgctatctctgatctcgccgggcacggattcgaggaggaaggctaccctgttgtcgactacgagtcagatcttcagaccaatatgtcgacaacagttagataggctaccccacatattgtactggtgtgattatggtgaataaaagcaactccggctccggccaacagtatgtagggttattacctgacagctcaagggcccgaacctgtataaaaatcctcgtctccatctcttttacctcagtctcgtgtatatcctagcaccaacgatccccatactgtccaaataccgtagttgagacatcaaacgtcgacagtggcgtgccaggtaaggggattttggtgctctaggatttcaacgagataggttcaaaagacgaattctccgacaacaagctactcgatgacttcgctgtggggagatctaacccgaccaaaatatgtctcccgatgagatcagaaccatcgtcgtcaacaactcgatctctcgagatcgaccaaacttcaagacatcgctgccgcggagaacagtgacttgatattatcaactaggaggtctccgatctccatctcttcggaagcgacatcatcaactgatttttggtaacctcggtaatgccgctgcctgctcagaacaccggccatcgaggaaccaaaatcaacatctcgatctattcactggattcttttgggactcggatcattctcacaccccgattaggatccaaattttggacccctgacgcatactgagaacatccatcccgacatcatgtgttccaaggatcattgatcacggatatctaccaggtatcgagaaaacaacaagacaaagatccaactaatatgcttgctcctgacatgtacacatgcatatgtatggactcagtacgtgcttaggtatgcatgcattagttggccgacgtgtacatgcaaagaagaccaacatggctgtctaaattgcaatgtgttgattattcagataaatcaacggccgcccgtgatcaggtatttagtagattgattttttaaaaatggtctactattttcgtagatacatccggcatgtatctacaaaggtacgcaatattttatctgcaatttatcgtacctatttttccaatttatacagcattgtcagatcaacaatttattatgtttacctagagcatgcttcttatacaatatccgttgtgcgagtactttcgacgataggccaactatggtctaacgctaggggctcactccgttctctcctgtataaatcatgcttgtttacggtttacataatgcctgatatttaatctgcttgttgtatcctgataatactagaagatctatgcaattttttgagtacatactcgatattatctgctatatattttgccttctagaaaatatttttcaggaacaattgagcactcgagtaggtaatggtcgagtacactccattatcgagaacattctcgacaaatgcggagttatcgcacccaacctgccaacaaagaccgacgacctatctcatagcacaggccatggctggactactcgagaaaaggttgttaacggataattcctcgcgaacgtcgtcggcttgatcactcgacatgattgcgaacggacatccggatatgctataagttgggtacgtgagtcatgctggccacatgagatacacttgcaataaaccaactctaccactttagatggtcaaggtacgactatcgcctggtcctcgaccagcaatgtagcgtttctccggctacttccaccttcagtggtcgagttacgactactgcctggtcctcgaccagcgatgtagcgtctctccgactacttccaccttaagtggtcgagttacgactactgcctggtcctcgaccagtgatgtagcgtct

SEQ ID NO: 65855 - DNA, 2351 bp, Oryza sativa
cccgaatttgaaggttaaatgtgtaatggtgagcttggaagcaactattctagtacaatgtctaattgtggacattgcagagtaaccgttcactcgaactctacatagaggtcttgcgacgatgatctgcgttattgtataggttttctaatatacattttttttctgcgattgccgtttcataaacttttccggtaacctcttgtaagcgttttaagggaaaggacatcacacatgaacggaaatatatgtagtagtagatgtagatgtctatattcgttgtatgttacatcctaatactaggttatcttttttttacagagggagtaagacatatgctgttattgtatatcaatactccctcagtcaaaaaaaacttaaatcctggttataaatttggacaagcaatcttcaacccccagtggaatggagggaaggagaagtacatctactggtggaatggagtacgacactcttcaggacacctgtagtgttggtgggattagttcggttgactctttagttcgcactaaaattaaaaatttgattgaaattgaaacgatgtaacggaaaagttggaagtttttgtgtgtagaaaaattttgatgtgatggaaaagttaaaagtttttttaaaaaagttgggaactaaaccaggcctcaagcgaacaaaatttcaattcaatcgctacagtgtagaaattgatttgtgggattcgctcagtcttatccatgtctgcctccccctcgtgcaacctgacaaaaaaaatatttttatttgcttgcgttcgatttctatttgaaagtcgattttctaggtgacacatcattcaactctaacgatgtgctctctttttgtgcaaaggttcgattttagccaaaagtgggagctgctctttgcatctcggtccaacctctgtgtacgtgtacctttatttcccttccgaagctttggccattaccttttcttgtggcgcccgttttgtctaatattctttgacagatactccactatcgtttgggcctctttgagtttggatcatcagcttgattgtggtataatcatcaccgggtgaaaaattaaaaataacagtcgactggtcactagttaaaagttaaaatgaaaaacagtctatggtggtggggccttgggcagcattgcaaaagacattctggctcatagcagcacacggccggtttgactgccatatgattgccgcacagcattttctttttcctgttatcatcacattctcacggttgattttaacccaaaaggcaacgtgcaaagtgaagtgaaattttctttacggtgactggggatgaacaagactactccctccgtcctaaaaaaagacaaaccctgatttccgtgtccaatgtttaattgttcgttttatttgaaaaaattatgaaaaaaattaaaaagacaagtcacgtataaaatattaatcatattttatcatctaacaataatgaaaatacgaattataaaaaaatttcatataagacggacagtcaaagttggacacggaaatcaaggtttacccttttttctggggacggagggagtagtcatgagcaacggacagccgtcctcggaaaatataccgtcttgagtgaaagtagcagtagtggtaaaaatacatatatatagtgcgcaacagaagatgtgtcggatcctaaaagctagtcctgatcttctgttcatgttttctcgacctgtgttgttcgtcttctgctgcatgctggctacaggttggttttaggttgatttttttggttgatgcctaactttatctaattcaacctattatagatgtaacaaagcccataaagtatggtcataagtgtggtacaaatttaaatacactatttattctaaaatatagtaatatactttctccgtccgagaatataaaaaattttaggcttggacacggttattaaaaaaataggtagaagtgaatggtggagggttgtgattggatgagtagtggagatagatgggaaaagtgaatggtagagggttgtgattggtaagaaagagaatattagtgaagaagttgttatattttgggatggagggagtagtagtacgaatcgggatatactagtgatgagtaaagtagggcttatcacagctaaaataatcaactaaatgcctatcttaataaactgcaacatatttaaccttcgacgtggcaatatgtggatgaaccaaacatacccttacccttaccttttttagtatgctagtaaaatacttatctttgttttacatggaaaattatttttttgttcctatatacttttttcgtttcagaataagtttatctcgtatgtggataa

SEQ ID NO: 65856 - DNA, 3165 bp, Oryza sativa
catttttacatgcgaccaaaagtgaattttacatacggccaatgaaaatcggacttttgcacgcgagcaacgcatcttatgttgtcacctataccggccgcatgcgaaaataaattcggcaaaaaaaaagataaaaataaaaaaccccaaaccctagcccgccgcctgctgttgtcgtctccatcaaagcgctggatctgccacccccaccgcccgctcgtcaccaacatcgcattctccatcccaaccgcccgtcatcgtcgccggcactagaaccacgctgggatgggccaccccgccgtcggatccacgcgggacggcgccacctgaggccgccgagctgcccagccgctgcccactgccgcccgctcccactcggaggagaggagaggagagagagagacatcagtagacggagggggagagagaggatgcgaggtggaaaaaaattgaagtggtgagggaaagagagaggaggggaaaaaactatgaagaagagcaggatactttcacatgcggactaagtaagaggcctgcatgtgaaaatatacttatttttgcatgtggccccttaagagactcgacagtaaaaataaatttttgcatgcggatctcttaagtagctacatgcaaaaatgaaggtcgattttgaagttcccgtacagtaaaattattttttaagtagagatcttactatattgtgatttgcaagtttgtgacttcactaaacagaggacaacaacaaaaataagacttaagagggcacataatttttctacaatctgcaacctgctccaacaagtaatatgacaaatttttcaccaatgttcttttcccaatcacaattctccaccatttaattttttcacccaccttcactttttgtccaatcataaattttccctatttaattttatccaatttcttaataatcgtgtccctataaaaaattcctcaaacagagggagtagtgcagtagtgacgtttggagtgacgcagtttgtattgcgtcatcggccagtgcagcagtgacgtgtggtagccaaacgggttgaaggtttttctttcctccctcttttcaatcatggagtcgttagcgcaggcgcagatcctagctgcggcagccaatggagacctcttgtgatgatatgatgagcacgtacgtaccggatgtcgccgccgccgccacggtggtcggcaccacgcttctcgccttttcttccgcagggcgcggcaccggccggacgctgccgagggcggccacggaccgcttccacaggatggttgtgattattgagcctgtgtgttgttcccgaacaaaattttttcaacctgtcacatctaatgtttagacacgtgtatggagtattaaatatagataaaaaaaactacacatattacgtgtaaattgtgagactcatcttttaagcctaattgtaccatgatttaacaatgtggtgctacagtagatatgtgttaatgacggattaattaggcataataaattcgtctcgcaatttataggcggaatctgtaatttgttttgttattagtctatgtttaacacttcaaatgtgtgtccgtatatccgatatgacacgccaaaactttacaccccctggatctaaacaacctctacatatgagtgtaagcgtgtagttagggttgacgaaacagatgacaatcctttttcagaaaaaaaaactgttcaaatgtaaccaagttatgtcaaaatttaaatattcagtttgatttttttctaacttaaccagtttaaaatgtgctctattgtttttttcttttttgaaatgtaaatttaccgagtggattgtgatcttagaacctccagatttcacaaaactggatggtttctaccagttttgtaaaccctgattgcaacattttgtttcatgtagtaggagtatgcatgtagcacagtgcacagatgattgatggtgcagccgaaaagcgacaggcacaagtgaagtgaatattttctccataatttttttgtatcccatgttattattgatgatggctggtgatgaacaaggctagtcaggccatgtcctcgtgccgctctttctgaaggtctattgccgacgaaaataagtacctactgaagttggagtagaatctgtcgtagtggcattctgaacaagtgttattcgtgcctgttgttgctgcatgttggcctgagattttactcttccaccagcaccagcatgtccgtaatacatcggcgaggttctggagatgagatgccgccctggttgcaactcggcggtgatctgccgacggaattcagaaaggcgtttcctgaccacgtttgcaactcgtgaaaggtgcttcctttcgaatgctttttgttactacctccgtcccaaaataagtgtagccatagatattcgtgtttagcattttgaccatccgtcttatttgtaaaatttataaaaaatattaaaaaaattagtcacacataaagtactattcatgttttatcatctaataacaataaaaatactaatcataatattttttcaaatagaacgaacggtcaaacgttgaacatgaacagtgctaaaactgcacttattttaagacggagggagtacttgttttctttcccctgtcattagtcattacaactgacagatttcctccttttgggatcgtgtgtgaggatttggaacaactgaacaacatgctgatcagatcagcaaggatcaccaattcaccactgtgtcactgcgtgactgtcgcgtgagacgagcaaataaatatagttctcttttgaaaccgaaaaggaaaaatagctcttgtggagttgtgggtaaccgtctccattgaccatgtttttaccgtgcccaaagccaatttctgctgctcctagctagcatcctagcacgacatgtttgcctgtagaaatccagtgacatgtttcacccaattgagggcggattaaggttccaaacttactatacttcgtaacacatgcgttgtcatgttttgtggtggtgccatggtacaagaattaaatttgaaaatatactattcattcaattttttctcagaaatatttcggatgtaaaattttttacataaatataccatcggtctcgcacaaacgttacgcgaaagtgacgtgacaatgacgtcgcggac

SEQ ID NO: 65857 - DNA, 1716 bp, Oryza sativa
ttgagcaacaatggtctagtaggattcattcctgcagaaattggcaacttgaggagtatcatggagatgtaagtatttgcttaggtgtgaattttttaaccatctagtcccataggtactataccccatatttgtggtttttcagtgatatgtccaacaatcatcttggcggtttgattcctcaagaactcggaatgctgcaaaatctgatgttgttgtaagtagtacctttcatgtcagccttctttttaaacccataaggacattgaatctgtagcctgagagacatctgtctatcattctcagaaatctcaaaaacaacaacataactggggatgtctcttcactgatgaactgcttcagcctcaatatcttgtaagttgaataaccagaaaatttttgaagcatatgctccagtatatgttttttgctcacattatctatctgttttatgatcagaaatgtatcctataataatttggctggtgttgtacctactgataacaacttctcacggttttcgcctgacaggtagtgtgctccatcatttccatcactatcatgttcatttactcagccttggaaatagcagtttaacaatgtgatacttttcttagctttttgggtaatccaggactttgtggatattggcttggttcttcgtgccgttcatctggccatcaacagaaacgtaacaaatattccattcatatcttacataattttttcatacctaatagacaaagtcaacttttcgttacctacattttatttgcagcactaatctcaaaggctgcaatacttggaattgccgtgggtgggcttgttatcctcctgatgatcttagtagcggtctgcaggcctcatagtccacctgttttcaaagatgtctctgttagcaaaccaggtaatgcatctgcaaggagttttgctcaacaaatcaactcatttctctcctgccaagttcaatattaggatactatcttgtccagcaattattgtatttagtcaattgtttgtttttacctgataactgggttaatggtagagcaacactaaagcgctgtatatttgctgtcacagtgagcaatgttccccccaagctggttatccttcatatgaacctttcccttcttgtatacgaggatataatgacgatgactgaaaacctgagtgagaagtacatcattgggtacggagcatccagcacggtttataaatgtgtttcgaagaaccgcaaaccagtggcagtaaaaaagctatatgcccactatccacagagcttcaaggaatttgaaactgagcttgagactgttggtagcatcaaacaccggaatctagtcagtcttcaaggatattccctatctcctgttggaaatcttctcttctacgattacatggaaaatggaagcctctgggatgttttgcatggtaagtgccgactgccaactcattgcacagtttgattgtcattgcaatttgcacagaagcaccaacatgccattctcaaaagcatgatatttgacacattgatatttgcttctgttgattgcaataccaaattgttacatgacatcttgttaccatgttaaaatcttttttttcattattctagaaggtccaactaagaagaaaaaacttgattgggaaactcgtctacgaattgctctaggtgcggcccaaggccttgcttatcttcatcatgactgtagccca

SEQ ID NO: 65858 - DNA, 6829 bp, Oryza sativa
ttctggtagccctcaataattgctgaatgatgcccattaggcttgtgttcctacatggggaccaacaacatgaaacctatcctgtgagtagatctatttgcactgtttacgtgtggtggattgatccatcgcatatggctgttgaaagctccattatcaattgcagtgtttaagtcccctaaagcctgccacttttgtcccctgtcatcaattatgtggattgaaagctacaatttagtgtcataaaaattcctcttgcagccatttacattttttacgccttcacttggcatttaaccgacctccgacttggagagtcaccctaatttctcattgattttacatgcttatatggcttttcatttatcggttttccttgctaatgtacagactgttacaattcttggtctactgttgcaaatgcagatcttgtcaaagacggctaacaatgctgtcatggagacagtcgacccggacattgcagacacttgcaaggatcttggtgaggtcaagaaggtgttccagctggcgctcctttgcaccaagagacaaccatcggatcggccgacaatgcacgaggttgtgcgcgtcctggactgcctagttcgtcccgacccgccaccgaagtccgcacagcagctggccatgccgcagcggcctgctgtcccgagctacatcaacgagtatgtcagcttaagaggcaccagcgtgctctcctgcgccaactcgtcgtgtacttccgatgctgagctgtttctcaagtttggcgaggtcatttctcagaacacagagtagaatagtctgcagaaatcgtcatccgatcttgggattcaggcaagcagctggtgaagctaatcaaggtagtgaagtgaactcacgttttgtgactttgtccacatgttgggtgcccagaaaattaacaagagaattctcaagggttgtggctggtgttctttactgtaaaaaaaatgcgtcctacttctttcttcttcctttttttttatctcgtttttgtctaacttaggaggtgtccatgaatctagtactaaatctcaagacagcttcttctgttctgtaacatttctgggattggaatgctggaactggtattactaatagtctctcggtttggacaaattcgcagggtggtgtttcagtttcagcatttctgttttgcactaacatctgtaatggcatctgatacagtagtagtagcaatatagtactcctagtatagcatatggtatcctgagaaggtataattggtcagtgtgacacctgaattctctcttggattttctcatctcctggcatcgccatgtgcttgtattgtaccgttgtcgccgagcccatggaggcatcgtcagtcagtcagggacggtgtaaatgatgcgaggctgtgcagcgatgctggggccggatgggagagaacagtaggggagttcagaagagatgaaggcgtactgccatggctgcctgagatgattgattgatgagtgggccaaggaggatgggcaggggcggtgcgcaatgcagttctcgtgaactcggggtactgaactcaggacgcatattccaaacccaatctagtcgcacaaaagcaacccacaacgattttttgatggaaaaatattgagagtggaagggaaaatgctcaaacttagcccctatctggtactccaggaatgtagcaaccaagcagggattggacacaacttaatacaacgtatctgaatagatcacttgtttagtagctactccctccgtcccaaaaaaaaaactcaatctgactcctcttaggacaatgtatctggactaatgatggtcacatcccctcctagattaagctttttttaggacggagggaatagattctaagaatccggattctatcttctactactttcatcccaagatataaggagttttaggcttgggtatgtggtatttaaaaagtaggtggaatgaaatgtgagaatgttgtgattggttgagaaaaaaaattagatagaaaatttttaaatgctgaaaaattgttattggttgaaaagagaatgtagatggagaagttattatattttaggacagtttgaaggctaaaaattgttatatttttggattgtgtaacagtagcttttccgaatctagattataacttgggagttttttattctgagaaaagttacggtggccggaagctcctccaaataggttcttgatcacacttcaaagtccaaagatcacgattcctttgaacacatgatttttaaaacaaggaataggataaaagcataagaatagattatcacaagctatgtaatattacaggattttaaaatactatatatggacactataggtaacattttttgatggttcacagtaaatagaggaattttggaggaaatcatacgtggaagagtagagagaaagagagaatgtgcattggacttagcaaagaaaaataaaatatgaaatgtgagctcatgctaaatttcctaagaaatagggtgtaagaattgcaatacgtaggaatatttagtcctattcctttgatccaattttttgcgggccagacgggctggcatgcttgcctctggctcaacacggcccgccaaagtgttgggccgttcgtagtctccctgctcggcacgttgggccatcacagcacggcccgtttaaccaatcgtgcctaggccgtgcggcccgtttggcccctttccttttcccacgcttcgcccccacctttggctcctcgcgttcgtcgccggcgccgccgcgcagcaaccagcgttcccctccccctccggcgatgagctcaagccgacgaggcggcaaggaggcgaggggcgccgcccccggctgcgacgtccgcagccgcctccctcctcaattcgctccccaccacatgctcgcgagcttcctcctcgtcggccaccgccgaccatccactgcaagggggtcgccgcggtcgattcgagcggaacgcggatctcccccgccttaccagcagctggtccagctcgacggcgaagcggccgatccggcggtggcattcgacccagcggctaggtgctccaatggcgggattgctcggctgacttctctgaccaccgcctgctgctgctttcctcactctgacgatgacgattgttgtgaggattgtttacttctcttttacatatctcttcttaggatggggtattcgagacttaaaaaaaagtaatagtaaaacaatagttataccgttagtaaaaacatacagtttctaattcaaaatgcaacaaagaggaaaaaaaacaatagcaaattaattttcttgatttccatagtctgcacttttcttgcctccaaatcttctttgcgctcttatctgtattgctcatctattgtgcaatagagtcacacaacgtaaatgtaatgtttgcaattttaggtgcggtagcatgtaatcattataatttactaatctgattcagttttacacgttcttggtcttccctactaattcactactgttttttaggtcatgagaatcaagctgcactaggtgagaactagaaaattggcgtgcccttggcgctcttactacttacaaccaatgcatataggcatatagcttatggtcttctttatatgttggttaataatttatgaaaatatcatgaaaattttttccgcattgaacaaactgatcaaattaccacagattatgcaatcaattatttgatttacagcatttacaagctgatcaaacaaagaattatgcaaccagcacaaagattttcccaaaggaccacaaatcatactttatttcgcatcctttacatcatgtacacaacatttggcagattttcgacctactaggagatcagatcatcatacgaatcaaaatgtcatctttgcagacagttaagctcctacagctctgagcttttcctccttattcctacctttggttagctaatgaatcaaaaatggactgaaaatttactctctttagtcctgcagctctgagctatcttcataaagaaaaggggcatatgagggcagcagaacagcatccgcatcggcttgctggaaatttcttctgagaggaagaagagcagcggcggcatcaccagcgtgctgtccgacgacggggagctcgcgtacaatatttttgtgctgttaattagtacaaatttcgctttacaattaattgagaattgactaaactgaaaattataatattgctgcaggagaactttaccggctgatgtgtttctgctccattgactgacctatccaacccaaattttctctttggacagacattggttgtacattctgaagataaataaagggttatactcaaatatgtggagatgtctaatttctgaaattacaacgcaacggcattcttctagaattaagtggatataataccactgaatattcttgcgataagaaaaatatatgaataaggaattgagctttgacatgtgttcaggaaaattaaagcactaaggaaatgtcataaaaatttgactctgtagtatttattaaattgactcaaattcgttcgagtataacggaaagttagtgaaatctgtgaaatctgccttttcttctgtctagacataatatattatttggtgatttataaatcagtcatttaaaaaatcgaagtagctcaattaactaaaaatagactatcttattgatcatactcgtcatataactacaaaagagatgatcggcgttgagctatcgtcgctacaaattacagaaagttgaagtgtgtcaactggattttacaatgtgcatatgctcatatactgtcgaaaaattatccaacttctcagctctagccatgtattgtagtgtcttacttgcccatgtttgaatcaatttcttttgaactttcatgtcaacattgctaaagaccaccagttagtgctgacaaagcctaatttgatcaagttcgtatctatatcaatacatcattatatattaagggaataaccctgaaacctgtacactataaccggttagtcttctctggattcgcaccactggatacacagcctaaaatggacaccggtggttgaagttgtaacagatcaaaatgtcataacactggttttgctaattctttctccgcttttcactaggagaaatcacatcagtcaactccgccacttcattgagactaatcgcgacaagtttcgtctgaactgaggttagttcaggtagaagtgcaataggtggagaagcaaaggcatccattacattgatgctttttgtctgcaggcaatggcaaggccggtttttacagcactcacgctcgtcgtagcccctgttcttgcctggagaactgtctacaacagccggatacaatgccttcctgcagtttgttgggctgctggtggaatttgttgggctgctggtggcatcgtcaacagggctcagttctttactctgtgacttgttcttgtcgacagagcttggaagaagacccttgcgcttcttaggggatggaacttccggtttagtatgttgagaagacaacacatcatccttagcactcacaaggaaactagacttgctattgtcgaatttggtccctcttctcctatcacaggtaaacaataaacaagtcagcagaatggaatatatatgtcttctattaagacatgaaaaaggacctgccagtaattgctattagaccgagattaacgagctctcaggcaaatgtaagaaatgtgaagaaaattcaaggcaagtgcccaaaaatctaaatacttagtacttaataatgtttatcaacaatagtttgccagctggctaacatatgcatgtgaaagaaagtctttttgtctgtttgatcctgtgcttgcactaattacgtgccaaacacacatgatcatgttcagaagcacatgataaatttctgcttataattaaaatgccatataaggtcaattaaagttttatgcgaataacattgttggcaggtatattagcccattaagcactagtgctagtgctactgccaactgcagaagcaaagctacatgtatttaaatcagcaataaataactcatgtcgctgtaagaaaaagcaccggcagcagcaatattgcatggacattgcttagaagctgcatccatcgttcaaatcaagaaataaaatcattgtgatgcgtatagattacattaaacttgtttataccagtaatattgcagagtgtccaatggacacgagagttaacaaaggttgaatgaattagagaactaattgtgcttcctgtaacatgtctgcgggataacagcatgatcacatattctttggaagactggaacaatgtagtaatagtgtaatactaggtaactgcagagtgctcaacgcaaatataattaagcaatgtttttggattcttgagcattcaaaaggtatcctgctttactgtagtgccagacaatctgacgcgagatgttcctatggatcgatgggaacaatagctagcaaatttgtatgtatattcgtgaaagagaatactagcaccacctaacaaaactactccttcagtttggagtaccaaatatcaagcctgcacagctaaacagctccttagtccttccgaaaaccacgagctccttcagtaaaagttaatttttccacaatgtttcaaaagttcaatttcccgaccacattgttaaaacgcaagtaaaaacgataattaatcacatctgcccactcgaaaactaattaagcacacaacaacaacaacaacaacaacaacaacaacaacaacaacaacaacaacacatgctacttttcacgc

SEQ ID NO: 65859 - DNA, 1563 bp, Oryza sativa
ggctgcggggcagcgcctgctggagcgcgtccatggtgtccaggggacccctgtacgagctctccacctcgccgtcgctctcctcctcctcccccgccgccgcggcgtcctcgcagtgcaccatccccacccggctgtcgctgccccaccccgccgacgacgccgccgccgaggccgccgcggggcggagagctcccccgaggccgaacagatcgccgccgccgccgccgtgcccgcgcccgctctccatggtgatcggcattgctccctaccccccactcctctctcgcgaggcgcgagctcacatgcgaagagaactagagaagagaagagaggagaggagaagcggagcggcgcctcggagacgagacgaagggtggggggctcgagtcgcgtggggctttgcgcttgcgacgggtgtttcgttgggatttggcaccatggccttgcacacactgacgtgtgggacccaccaagtataaggcagaaacacgctctgctttggtaaaaatgctctagaacgttataaaactggcaaaatatggaagacacaatgtaaagagtagtaccattttctagtgtggggtgcatgaagtagcattgtattgaaagtccagtctatgcagtggcattttagcggttttctcgttgtttaagtttgtggattctcctaatagacgagccacgaacttaaaacatagtctagctcattacttacgcgctctcctctttggtctcaaaatctagatctaggttagcttcaattccatgtctcctttgctgtcatcatctcactatgttgtcacctgacctcaccgacactgataggtgtcaatgtgctagtgcggcttgctcgatcgtcctcctctccgccccatttgtgtcgatgtgctcatgccaccaacattgccccaccgccctatactgaccctggctccggcgctaacgccacctcgccgcccacctttggtccgccgtctcctaggctagccctctaaacccaattccctatctcccccttcccagttccaacctccacttactcaccctcgaaaccctaacccagtacttattgtatgatgtcgcttatcagaaagcgttcacgtcacatacacgtggttgaggattaggacatcaataggtttgtgggaagagaggtttcgacttaggtgcttttcagagagctgggtattctatgcaaggtagtaatacctatttggagctctaagaaataattgatactcctatatatcaagtcgtttgatagtcaatgtgtattttttttccttttagtatccccttccggcaatgccaaaaatatatttggaaattggatgtggtgccatggtaagaaagatggttctatttgggccagtgcactgcattgtttaatttggcattaccgaaatgatttttgacaataataaatcacctaatcctacgtgggttatcttcaacttcaactagcacaacacttggttgttgatactatcacaagaggggaaggatattatgcgtaatgatgttatatttctagataaggtagctatggatcttttgttc

SEQ ID NO: 65860 - DNA, 1473 bp, Oryza sativa
tgagaagacaaatcaatctatcggatatctggatccaacaaggatctgtcaagcacaacataccgtgacacaatcaccaaattccaagcagctcaaggacaagacgcctgaagagatagaatataagaagggcttacacaaacagaagttgattactgtcgcacaatacattggatgatccttcttacgctttcaaaataaaagagtcattctagccgcgtacaactttaaataagtctagtaggttttttttacatatctgtgttatctcatccgtaactaactgcaccttccttaccatgtagcgatcattacatatgtttcattatctacccgaagcacggctccgtgacagtcctcgacccccttgattatcatcacaagacgtacaaacaatttctaacaattttacaatagtaagtgattctgatactcttgcatgtctactattaatatattataattaaatctcctccttaatacgaaacggtaaagaatctgtacagtgtgtacaactactacaagaaaaagggtggagagcaaattcaaaccagggagaagctgctaatacatacatattggccggtaatagtccacacagttaatatatttcaattatttttctaattacaaaatttaacttttttccttctatgatatgccattaagtgtcacaagcaacctagagacatggtcctttgcagggattacgcatgcgaattcctcagggttaatgggagatacaaggttaacgcagacgatgtaattctctcgactcaacgtataagtgcattagacaactacgcatctagaacctactatatatatatatatatatatatatatatatatatatatatatatatatatatatatatatattgtgcaaattaattaagacaagaaagctcagggtaataaatgcaataattagatgtgaaatttgttgatttatactcgcccactagcgatcaacatatagtgcccatagaccatagtaaaagatcggtagcgtgtctcccatggtccattgctcggccaaacaaccaccgaccaactaactaacctacctagctaccaacaacaatacaagatcgatccttcaaatggttaatgaggatacactgcctgataaagcagttgatcctgtgggagtacacattattattagctcactcttgcagcccacagatatttatctatgatgcaatggatttaaggacccatgtggtatttatttggattttgtgcgtctttgacacacaatggtttggtatcttcttcttcttcttcttcttcttctactactactactactactactactactactactactactactactactactattttgctatttatcgtttctcaagaaattctacctatgtgggtatctcattgttcaggaatcaaactaccaacatgggcacttttgaatttagaaattttacatactaatttttatat

SEQ ID NO: 65861 - DNA, 3486 bp, Oryza sativa
  unsure (1)..(3486): unsure at all n locations
nnnnnnnnnnnnnnnnnnnnnnnnnnnnnnnnnccacatcccttaagttagaactctgaataataagatcggataacataacacagggataggccctgagagcctgaccttttcaacgatcttattcgagagcgatcttctcggctctgatggaagcacggtgatagcgaccatacgagtatacgactcatcacgacgcgaactgaagctatgtgggaaataatgctaaggaatagcacgtcgtttgattcggctgttcagttgcaggtggtacgccgtgtacgcgggcgtcgctctcagtgtggcaagcggcaagcggcaacgaaacatgtacgacgcgtcgtcccatctcgccgtgtaacgttagtctgtcatcaccatgaacagtgtagtaccagagcagtgaccagtgtctgtatggacttacctttctactgttctgaacattgctgatttgctgtgcactaccgtcgacgttactacagtaacgaactaaccaaccgaagtgctctgcggatcttttcgattggcatttgaccctccacgttccattccattaggaaatggcgaactttccgtcctcgtccacgatgacgtcagcagacagcgtcacagcgcctcggacgccgcaggttctgaccaaactagcatctgtccccgtcccaatatttcttgtccgaatttcccctatcagtgatcgatccaatccgctgcttatatgaccatccacttccttcccctctgttctacacatagcgaagaggagagaaggcgagctagagagagagcaccgggagaagaaagggatttcttgttcttgctgccagcgagagctcgtctttttggtgttcttgagagatttgttcttgttgatcgccatggcaggtgatcttgcgatggccactgttctctccctgggctgcgccatggtgggcgccccggaggcgctccgcctcttgctggacctcgccgggcagagcagccccatcgccggcgtcgtcgtcatcgtcggcgtcatctgcgccgtcacggccgccaccgtgctcggggctatgctcctggtccgcttcatccgcgtcgcgggcaatgcccctgacccaaccacggagcgcttcgcgcgggtgactctgacggtggccgtcgccgtcgcgctcctcgtcgctgcctgcctcctcgccgtccccaccgttccctccgccacgttcgcccgcgcttgatacgaggctgttcttcacttccctgtgggtgtttgtcagtgtgtgtgtgattgctcagctctcgtctctcgacaagtttacagcttttactccatcacctgtgtggttttctactgtttatctcgcagctatgtgatgttaattggcgaaagcgattgatcttctgagatcagagctgaattttgaatgtgtcgaaccaattcgaacagagcttgtgatacaccatagtacatcctaggatgatttccttttctgacgaatccgaaaaaaggcgccccgtattcgtgtttggtttgttcaatgttatctctgttggatctctctttggttccgtacgcttcagcatttggatatactttgatagtgacgtatcaacaggtaaccaccgtgcgtccatgccgatcgagggagaggaacaaatgtacacaaaaaaaagaagagttgttgggcaagccatctctgtgtctcgtgtcttctcacgcttatgcaaaagctctaacgcctgtgtttttggctttctgcgagatgatatacagacacatatgttttggacaggttctagcctagagagcttccccctctttcccgttccaggagcacgatggaggcgtttgcactgcgaggtctcgacacgttgggttgtgccacgtcccaaaggcacaaacaattttaccaacgttttattgcagaggactaacggcagattgctatggatagatcatcaagggcgagcaacaaacagttggccatgagaagtttcagttgataattgataaaaaaaattgacaattactaaactaccctgtatgttattttctatctctaaagtaccctttaacaaatcaacggttgatgtgtaataacaggatgcctcccgagcactgtaaaaggtaaaagctctcatcacgggtcaatgacgacagctgcgaaagaaaaagggcagaagtcgtggccatacaccgagagagaaaatgtgattggacggtcggtcgctgtcgccgtgtcaccgtctcaacatgaaatcgaacaaaaaaagagtgcaatgtgcaatgtttgtgtgtgcaaaaaaaaggggagcacaagttgatgcattcgtgaatcgtgacagttgaggcagcaagccagcaacgcggacatgtttgtgtgtacacgaggaagtctcacgtactgtccgagagtgcacaaggctaccccagcgtcatcccttacatcacacaatttacggagaagaatttcaaaagtcgggtcgagagaaatcgcagacggtacacgtcaaggtctcctcgacttggtggctttccatgtcaatggacaaccgcactccctgacggccacctgctaggaccacgatcaggagctgggttaatttgcagcaaaaaatgcagatgtggtgtgttcaattgccgttgttgctcgcgctcagatacctgcaaactggcaaaatggccggcatggatactctattactcctgtccggatgtagggtctgcctgcccatcagatcccggttttatcaggttggaggggaacgtcgcatttgctcgtcgtcaccacacccatcgtgcgcgtgcacatgtgggatgtgcaggtcagaggcatcagtttcctagtcgacggctcacggctccaaaagcaattggctgccttcaaaaatatagattcccacctgatcatggaagatcttccttttccctacgggctccatcgctatgcttcggcttatccaccgaacttgtccttttgatttcagatttttcagcggaagcatttctaccgctgggcaggttatgattaaacgatcttctatgaattggtagttcgtagccctcctcgtgtatttctttttgtgtgtgtgtgtgtgttcgtactgggggtcacaggatcagcctctaccaacatattggcagctattacctggcccacgtaattcggctgaaaatctcacagcctagtcaacaaatcgatggggttcagctgagaagccacaaccttgtcgttatttttctccgtgtcttatcctcaagtagttaacctcttggcactgggcatattgatttggttgttgttattaggggagacaaagtaggggaggagttagctggtgttccccagcatgctacctttctttactttctgtcgtttttttgtttcttagtctgtaatgaactcgtattctttttagtaaaagcttggcgtaatgcctttcgtccaaagtaagggaggagtaagaaaacaaacgacagaatacgcattatacgacggattcagc

SEQ ID NO: 65862 - DNA, 3407 bp, Oryza sativa
aactttttctctcaagataaaacattatactaccttttttcgccaggcaaacaaatcaccgggcaaaactctctataataatggtatttaccaatacgaacggctgcactccgaaacatatgcacatagagtgtgttgcccggtgaaacgctggaataagcaaatgaaagcttgtactaatccaaacaaaaaaaatgtttgccatcgtcgacaagccacagggatagggtgatgaaaacattcggctagtcgcctcgctctgtcagccacgtgaccacgtcggacgagcactgactaatcgcagacgaagaacacaacgacgatggtcgtgcccgtgtggcggatttgcagcgcgtgtgcgtcgcgaactgtggtaactgaaagggacagtgtttcgaccgtcgtttcacaccgccttcatgtcatcctccgattgtacgaacggctgcactccactccagtgcttcagcaacaacacaaatggttggctggtactgtcggtgctaccaaaattttaatactagcatatctgggcaacaaaccaaactatctatctattatatactaaaagtctattaaacttcctataaacgctcctaagccgacatgtgacggtctaataaattagggaaatccaagaaattctgagaaaaaaacaaaacaccaaaccgttaattttcacataacatagtggacccattatttttcaccattagatctatttaaaaagaattcctaaagcccaatccattaattatcacctcccaccatacccaccacctcctgggttgtccccttatgtgtacgtacgtgacctcctctcccctcatatacgtagatacgtctctccctctcctatccttcctttcatcttccaattttctgcctaacaaaatttaatatgtaaacaaaatcaaacgttagataactaatgattgtaatttttataatatattttatttatctatattgggcatgtttggatatataagaatatataatttgaaaaaaaaactcctatcttttacatggcaaataatgagcaattaaatattattaaaatataataacatatatgtgatctcttatctctctgcttgctcactttctcctcgctattttgtaggagtagcaagcaaatcattatatacacaataaaaagtaaatttcacaaagctacatatttaaggtgaagtttcaaaatctaaagatttaatcgatcaaatagacaaatacccattgtgtaataaagatccattaaacatcatgtagatcaatctataataagctccattaaacatcctctacagtgctactaacctaccacatggcacatctgataaattaaaaataaatctattatatagtaaaagcccattaaacttcctacaaatacttctaagtcgacacatgcatgacactttatataccggtatcgcgttgggatagtatcccaacgggatcgctccctgtccacttccctcagacgcgagagtgtaggccaccgtgggagcagcacagatgcggctaacgccggtggcgcggccgcggccggcgccgacgacctccggcgtggaggacgcggccgccggcgacgagctccggcatggaggacgcggccgccggcgagctccggcgtggggcatggtcgcatggacggcggaggatctgcgtggtgacagagacgacgccggcgacgagctccggcgtggggcgtggacggcggaggatcctgcgtggtgatggcggcggcgccggagacgagctccagcgtggaggacgcagctgccagctgaggcgtggacgacggacgtgactgccggtgacgagctcccgacggaggacgcggtcgtcggcgatgagttccgatgtggaccatggacgggggaggatgcggctgccggcgacgaggttcgggttcagtgtggagcgtggacgggggaggacgcggccgccggcgacgatgcctcgacacctcgacgcctagctcctggtatctagtaggtatcatatgaatatgatacctcacaagtatcaccccgatacgtcgtagaaatcgcacgatacctgataggtatcacatgatacctcacgagtatcacctgatacgtgataggaatcgtctgatacctgatacatggtagaatcgcatgatacctgataggtatcacccgatactagctacttatcaggtgatacctgtaaggtatcatacgattcttaccacatagaagatgatagttgcgtagttgcgaggtatcaagtgatactcgagtaggatcataaatctgggaggtagcatgatcctccttagtatcatgtccagtttcaccaggtttcataggtgatactttgggaggatcatgtgatacctgagaggtatcatgatccttatctgtatcttgtctggtatcatcaggtttcacaaatgatatcttagaaggatcacatgatactcatcaaagtatcattatgtgtggtacctatgcagtaccacatgaccctacttaggtatcatgtctagtaacaagatcctatgggttttaaagatgatactttagtaggatcgtgtgatacttgcgtttctaccacatatcagatgatacttgcgaggtatcaaatgatacctatcaggtatcatgcgattcttaccacgtggtgggtgatgcttgtgatgtttcaggtcctgatatctaaccggtatcaggtgatacctaccaggtatcatgtgattctactatatatcaggtgatacttgagaggaatcagataatacctatcaagtatcatgcgattcttacaacatagaagatgatacttatcaggtatcatgcgattcttaccacgtagaatatgatacctatcatgtatcatacgactcttaccacgtagaagatgattctaccacactccacagccagccatgaccaagttaacaagttctttgcacaccatcttgtctctttgctcccccaaagtagcagatggataggatgaaggcccggactcgcagcgggatcgacggccggcgacgaaggagccgaccggagagggcccgcgacggagttggggcgccggtggagggcgcaccggccggccacgcagatggagccgagggtgggcgttaacggcggcgccgtggatggcaggcagcggtgctggagctctcggcggcaatccggcgaccacatcatcgacagccacgtcaccggtgacggagttggggcgctggcggagggcgcaccagccggccacgcggatggagcaccaggcggcaaatccggcgaccacgtcaccggcggccgcgtctccggtggccgcgtccttctctccccaagcgggacttcttccctgcgccggagtcaccgacggccacctccttctcacagcttaggcgctcagcgtcg

SEQ ID NO: 65863 - DNA, 1854 bp, Oryza sativa
gtagccatgccctccttccaatatattccaacgtatatacgattcggaaggaaaataaaaggtacccacttatgtaccaactacctcccccttctcagctaaaaaaaaaaagaaaaaccagaaaaactccctccccatggtgcatatacgtgcttgagccgtgagcagatggtgcatggtcgttggaattaatcttggctggtcggccggtctggttgttttataattaatcttggctgtgattgtttctttcaatcatacggtcatacagatgtaaattttttgtatttatcttttttatcatacttatgtatatctttatttttatggataaattgtacatatgtattttctctcgtacataaacaggagattaggagtgacccctctgaccccgtctctcccctaagctaacatctatatatatatgaaaaataataacaagatagtttataatgaacccggggttgcctcaccctcattggccactttatggaaatagattttgtaatggttttgctcctagagatctatttaatagagttttaaccggccacaagctaatattgaatcagtttaactataaaattttttttttgaagtcctacttatatttttctctttttttttcatttctatgtttctctttatatatacaagtaaagtataaagttatgttttggtttgatacatatcaagagacgaaggtcaataacaaatccataaagtcatttcattcatgtctttgtggtagcttcatgggtttctccacatcttgtatatacaagcagctcaaaatatgtggtattccatatcatgataaaagttatttcttcctattaaatttatattttaagactcatattgcctatatttttctttaaaaaaataccataagggtcccacatatttcagaaaaaccatgtccactatttgcatatttcttcaatacatgcatacaacaaatttattaattcatatgcaagcatatagcaaattgcgtgcatgtgaaccaattaaattaagcacttgatggtaaaaataaaacattcatcggcgatataaatttcttgaagtttcttaagaaaaaaaagatataatgcacaatgaattaaaaaatagtatatcttactttcacaatttgttatatctgtttaaaaaaaactaatacacatgcccgcgcgaatgcgcgggctacctttcctagtttcagaaacgatcgtgcggtatttcttttcctaattctcgtgattaaccactttgatctacaatcatgtcctcctcaatcctcataactgtccgcgtatatagaaactttaaaagttagtccgagcggtcgtcgctcagttcacaatcacacatggtctggagtctggacccatcctaaaaaattccacccaacccgacggaagataaagataatcggactttcacgctcgcgacccccaccaaagaataggcagcgaagaacgaaaaggaccgcgccgcgccgccctgactattgacctggtccgccgcaagaatataacgcagatggtgcaccaataataatcacaaaaccggtcagttggatttatctgccgatgtgtttctcggtatgagttggaagaagtcgggtggaacggattttcagagacgagtcgacgcacgccaccagaacgggcggcaccatttagcgagccactcgaaatatcgaatactcgatcggtcgaaaatgccgtcagacttgcatatttcgtgtgtgcaaacaaacgtaccactcctggcgctaagtacattcttcctgcaagttcagctttgccggagagtagagtactctggtagtacccgtagtccaagcgcagctttgccaag

SEQ ID NO: 65864 - DNA, 8066 bp, Oryza sativa
gtaaacacctataaaacgtgtcgctggttcggcgagaatcgcacattagagactagagaggcgacaggaagagcaaaggagatgggcaagcgagcctcatgaaccgaccaatcctttgccgaagcgctgaaaggcgacagcgagaccgttttgttgcgaggtttgtgtgcaagcgagagatcacaggagaaagggacaccgatggaaaatactagtaggatgactagatgagtacagtacatgttgggtgcaaagtgaaacatgcatatcctctcatgtaccaaaccatatgattagtggctcctagtcgtgctctcttcacatacgtcaaagtccgaaagtgagcaaggctatatgtagcaggacgttgtcatatatagcgacgtacgtgcgcgtcaacaaggtggacgtgaacgagattggtcacgattaccagcatcgctcgctatcgacgcctcagaacgtaacgaacatggtcacatggacatgatcacaaggactattctgcagcagtgcacgcccgaattacggttgattttcttctttcatcttgtcagtagtgcatgccctgcccaaagactcgcaagtcgcaacttcgcatggaataggggcaaaggatcagcatttgttgtgcggttctgtcgagtggccatgtcgtgccagtcgccacttgtggagacggtcatacaagtgatagcaaaactttttcggtttactgctttacttctggagtgttgctatacgttcgactccctcgtccgattcccatccaatccaactttatctgccaatcgttacgcttcacgcagaccaacttctctccatgtggctagggcaattagcagctaagtgctggtcagacgtgagttgtacgtagcgattttcttacttttgtccgttctgtggcgcctagcttggactgaaacatgcagcacaatcaatcgctcttcaattcgtgccatccatccttggacttcgttgtcatccgctccgtgatcggcaacgagttacgcgattatttcggttgatccttcgaacctatcgaactacatgaatccaggagaaacagagccttatgtatctctctcactctgtgtacatcgagaacccaaatcagcaatccatttctacatcttcaacttttggtaggggtctgccaaatatatacttgcaaacctacgaggctagcgtattatgtggatacttgcaatccatttttttttacttgcaatcgcgtagctccagctccagtaccgaatcttcacatcttctatactgggaccacagggtggaaaagatgtgctagtatgcatcagcacggccgctcggcaaatcagcaatgccccctgggcccctgctgctgccaagaatatgccgttaatcaacacctataaattaagccggtcgaggggttcagccacggcgagaagagcagagccgcgaaggagatcgatcggcagcttagcctgagtaagcacggaaggtgagagtgttctcagctgttgagccccatcccccatggccgcaattcttcggaataccatcgttgtcgccatgggcgccggggctctgggcggaccggacgcgctgaggctcttgctcgggttcgccgggcggagccccctcgtcgacatcctcgtcgtcgtcttcgtcatcgccgcggtcaccgcgcccgccctcggcaccattcttctcgcgcgtttcttccgcaagccgcgcgctggggccggcggaacgggtgcggcggtcgatgacccgttcgccaagatgacgctggcggtgtccctggccgtggccgtcctcgtctccgccaccctgatcctcctgccgctgttccagtccgggggcctcggcgcgctcgccttcgccggagccgcgctcgtcgtgggcgcctgcgccgcgcgcgcgcgcggcgtgcttcttgcgaatgcccacggcggcgcccccgccaccgagcgcttcgccaaggcgaccctgatggtgtccctcgccgccgtcttctccctcctcgtcctttgcatcgcggtcggcatcctcgacgcgcctgcgcagcgcctccttgccttcgccttcaagaacccacccgccaccgtggccgtctgcgtcgccacagccaccatcatcggcgccacagttgtcaccttgttcttccgcaaggcgaaaaatgcggatgccgccgccgccgccgccccaacggcgatggccatggcgctcttccacaaccacaagatgatcttggtgatggttacgcccttcgtcgtcatcttcttcctttgttcataggtggtgcggtgccggtgcagcgtgctgggcaccggtggttgaaaaaaaacgtaatccctcgtatgagtacggtggtgtatgtacatatgctatatgttatctttcgtgtaatcgggaagagaaatgtctttttggttcgtgtttgcctcgtcccatttgctatatttatgtgatttagaaatacgagttttcgttgccttattcgggttgaacttgaatatcatcatctcgttgaagtgagtaatcgacgtgaagtattaacagaactagtttagtgaattgctactgcagtctccagccgtgttttagaaaggcccgcacagataacggaaaatatttcgtagtactttgctatcatcgggtacatcaactagtggggtgggaccatgggagtactttgctatcatcttttttctgctttgctctttccctttccaacattcgcctgtgatggaaacgccacgagccttttgtcttggcactcgttattatccaatgttctttgatataaatacgagttaccacatttgagggatctgggagtgtggatcgcacagctttgattgtggtttgccgtccatcagcatttcagcaactgtcatctcctcgggctcgttatcgtacgaggcgcagcctagcgaaagttgtggtgattgttaggaagtggcagccaccagagtctcgcccggagcaacacggccggttcgattgccatatgatttttgcaacttgtttcctggatggaggatggtttctgccaaaagcgaagtgaagtgaaattttctcaacgaaagttttgtcctttcttatcacgatgcctggtgtgaacaaggctagccagcccatgtgcccatgccgttttctctgaacgccaattatcctttctaaaatactatacttaacttaggttgtgtttaattcatgttaaaattgaaagtttggttgaaattgtaacgatgtgacggaaaaattaaaagtttgtgtgtgtaggaaagttttgatgcgatgaaaaagttggaagtttgaagaaaaactttgaaactaaacacggccttaagaaaaaaaaagaatatgtagtgacataatgaacctgcagttagtttcttgggtttgttggaaccatgccaccttaattttgcaaaatttgagatatgccacccgtatctcaatgacatgtaggacccacatgagtcaatgatatgtgggttagggtgacatatcacaaattttgaaaatttgtgtggcatggtttaaattttccatagtttcttttggtgctttatgttggcctcggattgtactagagtttggagatcagagtctttgtcccactatagtttctttttttgagatcagaaggatcgccggccaattgtgacgcgctgcaaccatgcattactcgtattttctccttcatgtgtgcactgggaaacgtattttctccttcgtatttgagcgccacgtctcacacggaaagggattttttttctccttgcactgttgcacacacgccatcaaggcatacacaacacaaccgggcacggcgaaaagcccaacaggccgaaggtcgaagggcagaggccacgcgagcgaaaggaacccgtgtggcatatacggaaaatatgccgttcaaacagttgaatactcgtgccttgccgccgttcacaccagagtagtatctagctgccataagacggcaataatcctcctgatctctacatgaaaaaagtgtgtccgacggatgttgtggcaagcaaataaagttatgggcaattgcctatagccgtctggtccagtttgaacgtggcggaaatgtggcgaaattgtagagtaagcgcccctggcgagtgatgtggttcatttagctgcatgtggaagtacattatagtcgattgatagcgcaaagttgtgtgcgctactcagtggagagaaagggaacagaaaatgaccgtgtgacatcatttccttctagggaaactgtttgacttggctcttgtatattcatgtgaggaattcatgtgatcatgtcctcagttgttgtccacgagcagcatccgttgttcttcctcgaagcagatctaccatcccacactggttctcaaaaaaaaaaaaaaaaactcacccacactcgctatccaatccaatccaactgtccgcatccatatgatagcgaaacgctgccgaaagctaaaacccgcaacggcgaatcctcctcacggagaaaaggggtcaagacgtactgctcctatgagctttttcgccctcttcttccgcatgtcatctcctaagattatcctgttctatcttggagtaacggaacttcaaatggactctgttttttttattaaaaaaatacaaagaccaaagtatatgaagttggaacaggtccattcttaaatggtactcttttttatttagtatacttattttttgctatatcatggttaccgagtggtattattacgcatccaatatttctctgtgtaaatattaggatccagaatttgaaggttaaatgtgtaatagtgagcttggaagcaaaactattctagtccaatgtccaattgtggtaatctgagtcatcctataggttttctaatatacattttttttctgcgattgccatctactacttctggtaaacgtttcaggcgaaaggacatcacacatgaacgctaatatacgtagatgtttatttggaaaggttcaaaacgacaccataaatgaacagatggagtacatctgccgtcattgtgtagactgtagtactcccacgtcccataaaaaaccaacctaatagtgaatgtgatatatcttattactacgaatctagacatatctttatgcagattcattgtcctataatatatcatatctagtattagatttattgtttagacaaaggtagtacggccatgtttagttcccacacaaaaattttataccctgtcacaacgaacgtttgaacacgtgtatgaaatattaaatataagctaaaaaaactaattacatagattgcgactaatttgctagactaatcttttaagcttaattgcttcatgatttgacaatgtggtgctacagtaaacatttgctaatggtggattaactaggcttaataaatccgtctcgctgtttactggcggattctgtaattatgtttttattagtgcctgaacacctcatacaacacactatataatacccgatgttacacatcaaaacttaacacccctaatctaaataccaccctacgtctactaatgaaattgaatacggcattctttaggacacctatagtgttggtgggattagggccctgtttagtttcatgggctaattattagccacccaccttttagccctgaattagcccctaaggatccaaacatgtgggttaatttggggctaaagtgaattagcccccctcaaaacattagcctctccaaagagtgctaatgggactaattttctgtggggaccataaaaaaaacagtcctatcttcctccccccctctctctcctctctctccatcttttagccctaaactagctcatggatccaaagatattgtcccagactaatgtttagcctaccaattcaagactaaatattagctcttaaaattagcccgggactaatcttccaaacaagacctatttcgattgactcgagcgaacaaaatctcaaatcaatcgctacagtgtagaaattgatttgtgggaattcgcgtaaaaaaaatctcagggcttgtttggtttagggtcataccaaaacatcggtagtgccaaaacctaggtatgttttggcactattaataatttggtagggtagaatactaggtaatgtgtttggattaataccacttggaagccaaattttatattatggtaaagaaagttctagaattgtaccaaattaaccatgggcattactattcatttggcttcaaaccaaaccatcatatttactattcaaactaccaaaaaattggcatgtcatattttggcatcaatccaaagtggcccttagtctgggtggttctaacgggcgatcgatcgccaaggctatcggggagcgatcgattcccctccccctccctccctccacctggtttccttttttggcaccgtattactttcctattttagtaaatttatacacctcaaagtttatacaccttaagtttacacatctaaagtttagagaccaaaagtttataagtcaaaagtttatatatccgattcaaatttgaatttgaattcaaatatcttttttatatatagtgtcgacgtttgatgtctcaactatggtatttggacagtatggagatcgttggtactagagtatatgcgagattgaggtaaaagagatggagacagggatttttatacaggttcgggcccctgaattgtcaggtaataaccctacatcctgttggccgaagcaggtattgctcttattcaccataatcacaccagtacaatatttggggtagcctatctaactgttgttgacatggcggtctgaaggtctgactcgtagtcgacaacaaggtagtcttcctcttcgagtttgtgcccggcgagattagagacgacgctagatccctacggccgacctctgtaggtaccggacagggtcgatccaggcatatctctgatgtcgatatccggcggcttatcttggtgtatgttggcttgtatattgatcttgtgtcttgatctattattccgtgtatgttgattgtgtcctctcctcctagggggtcttgtatttatacccataggtgtcctcttgtccaagtaaaactagggaaaccaatatggatacaatccgagttgtccttgtcgtttccatgtagaattatggttgtctttccttatccggaactcctcctatattcacaggttgtttccgcataggatatggcatgtggtgggtcctgtagagatttaatcaactcctattagatatgtgttatacataaccctgatagtttcagttttaactaaacttctaattttaacgttaactaaacacacccgaagcagtaggagtattttctcgcgtaggagtaaaagtccatatgcatgtaaaaatttagaggtggggtggtggcagcgacatcctttttgccaggtggtggcatgcggtttcggcaggattgggcagcgacgccaatccaatctgctttccgccgtgacgcgacgtgcggcggatcaaacaggagggagacgagacgagatggtcctgtgaatctgtgatactactccggctactgctgcgccacaaagccctgtgatgagttgacttatccctgtgcgtgcgtggtctatctgcgatagctcggcgatgggagtatgtgcaagtaccaatgcgccgcgccggagtgggactggaccggaccgtggcggatggaggattgggcgagcgagagatgggcgtgcgacagtacgagtccggccggcgtcgtgatgaccattaccttttctattggattatactcctctcgtacgcgtccgtccctcccggtcgctccaacgcatgcagtattccaactatccaaattatttatgctgctgaaatgttcgcagtctaaggccgagtttagttgtaaaactttttttcaaacttttaactttttcatcacatcaaatcaaaactttcctagacacaaactttcaacttttccgtcacatcgttacaatttcaatcaaacttctaattttaacgtgaactaaacacaccctaaggacctgaatagtatgaatgaaaaaaa

SEQ ID NO: 65865 - DNA, 1593 bp, Oryza sativa
aataattccccacaatattgttacaacaaattgaaatagaccactaatgttgcagcaaaatgatagttttgtcaatatagttgtaattttttgaaatttaatctatatgaatacatcttttatgtactagtacatgttattggctgtttataaaacctaatgccaaaaaatagcctaagatcaagaaaatcttaaaaccaacttaaaatggctatggcagatgagctaacaagcagatgataagatacgtataatccttggaatgataattagatgcgatggtggaacaaagatgagcgcacgctttcgctaaggtggcggtccgttgcaacgaagcattacgtttggttgcatcaaaagcggcataggaaaatggagcgctgcagctgtacgtagtactacgtattcgtgccgccgtacgtgcgccccatgtctgtttcgtttaaaaatgatggcccgatgcgggcaaaaactggtagtgccactcgatcctccacgcctcctcttcctgctttcttcgcgaagagatgggagattcacatgcatgctctgatgctcgtggaagaaaaaggctgcagcaaagcaaaagagatgagagacgttttcgttgttggcactgttgcatcccgtcaccctttttctcggttttgtgctgcctttttttctgcccacttgctgcttgaactggaccatgtgttgatttgcccccctgaatcgttgaatcgtaggaatgaaaaaacagaggaataagaaaaacacaagattctgacaggaatataattgtaaaacagaggattgcaaaacacaggaaaaccataggaatgaccgtttgattggaccacaggaaaaacgcaggaatcagatgagagagatagactcagaggaaatgttccaaaaggttagacctcttactaacttttctccaaaatgtgcataggattacccattccataggaattttaaaggattggataggattcaatcctttgtttcaaaggtcttcataagattttttttcataggattgaaatcctccaaaatttctatatttttcctacaaattaaaggggccctaattctttcttgtcagtatgtttgcaatgcagaaaggaaaaagtacgaattatccccctgaactatcacggttgaccgaattaccccatgaaccataaaaccggacattcttccaccacaactatacaaaccagataaattaccccccctcgacccaatccgctgtggttttgatctaggtgacgtacgcgtggtagtccagcgtggtagtccagtaaccattctatttattaaaaaatgtgggacccacatgtcatactcttcctctctcttactctttgtctcactcttcctctctctcttctctctctcagtctctgacagcgtcgactcctacgagcacatccgtgcagaggagatccgggcgctcgttcgcaacctatttggatgtgccagccacgccgttgccgtgcgcgagtgcctcgtgaacgcgacgctgcggaacatcctccacatgtcggtcggcgagaagtggtcgggcgtctacggcagcgctgatggggaggtgttccggcgcac

SEQ ID NO: 65866 - DNA, 6561 bp, Oryza sativa
attcagttgatcgcgatagtttgaggagggataatttgtactttttctatgcagtaacttctgaagtacaacctactcctccaatagacttgtctcattagctcacagtactacatccgttaaaaaaaaagctaatcttcagctataaatatagatagtctatatccaaattcatagtgaaaagttagtttttttccgtgaaacggaggaaatacggtacttatagagagctcatgatgtactgtcgcgtttatttgttcgtagcagcttattcattggtgacggataggattcatcggaactcggaggatggccacgctacgctaccattgcgaacggaacaacaatcggtgtgagagacagaaggccgcattttctgaagatattaaataaaaatctgatctttatattcaccgccttacaactgaataataattaaaaaaacacaggactagaatactaagcttcgcatctatatatttttcgtctttagtccagcttcaaacttgctcatttttccttcttaagacaacagtgcatcactcattctctctattatatcaaaatcgtcctgccaaagatcagtttttcttttttgcctaatgagatttacagcacaaatcgtttcaggaaaagttagaagaatttgacaaagatcagaattagttacttgtcataaactattatatcaaaatcgtcctgccaaagatcagtttttctttttttgcctaatgagatttactgcacaaatcgtttcaggaaaagttagaagaatttgacaaagatcagagttagttacttgtcataaactattatatcaaaatcgtcctgccaaagatcactttttcttttttgcctaatgaggggagtaggagtatcagttttgtttggggttaaattgattttggccgttgttttcttaaacgatgtcagagtgaatcaattttttaaaaaaatcagacggtacagctctgatactaaataattagattattcagaaaatattattgaccaatgtactatctccaaatcaaaatcaatagtagttatgaaaccgacagttatgtttatatgtgaacgggggagtattacgtgctactacgcaagtatctgctcgtgttgtggtgagtttgttatctgaatccatggtttcctaaacctccggggctggggttaccgtgtcctggcggtaagcacggttaccgtgcagtaaacttggcaaaccgtgtaaaatttatcaaaattttaaaatattttttaaatttatggaggttactgtggttttcctttaaacatacctccgcggtaagcgtgcttaccgtgcggtagcatacacaaattttgataatttgatactttacagaaactaattttacaaatgaatcgtggtcaaaacttatttcagaaataaccattttgttcagcgccaaatcgtatgacgctcaacttagacacctcagcgtcacgtcaactggtgctgaatgccgtgccactacagatgggaggctgagtcggcatgccaacgtatatccagcgccgtgctatttggtgctgagatgtctaaattcagcgccatacgatttggcgctgaagaaaagtgttattttttaaataagttttgactataattcatttgtaaaattaattttttaaaggctcaaattgttaaaatttgtgcggtgaacgaggatgcgatgatggcggtgattcatcggctcagctgctggtggctcgctcgcccatttccccggcccgtgtcagacaaacacagagctcgccatgcccggtgcggcggtgccgggagctgtgcgccgaggagacggcagcacagaaaggggatggatggaaatatggaatgctgtaaggcatacatcaatccatcaccccatgcacatcatgtgtagtactaactccgtcccaaaataagtgtagacgtagatattcgtgtctaacgtttaaccgtccttcttatttaaaaaatttatgaaaaatttaaaaatatttagtcacacataaagtactatttatgttttattatctaatagcgataaaaatactaatcataaaaaattttcaaataagacgaaagatcaaatattaaacgtgaatagtataaaactacacttattttgtgacggagggagtacttgtccagactacatctagctccaacgagctgcagcgagagagatgagatgagcacaagtgaactggatatttttttcacattttagattttttttgaaagattattttacaaataaactcctaaaaatatttattctgaaaattaattcttttttgccaccaacatcattagtgtcgtggtccaacatgataatgccaatgacattgatgtcatcccctagtctccccgcagaagatacagtaagttacgtatacgaaggacaacggtgccaatgagatctaaaatgatttatttgtaataaaaaatacaaatagatccttggtgttaataacactgatgttgaggacttatttgtaaatttttgtattataaatatattcttttattattatttttaaaaaataggtgtgcatggatgatgcatcgacgagaaggctagttggcgatcaatcacgcgcccaccccccctccccgcgcgactggacactgtcacgcgcggagagggggcggcggacgcgtgccgcgggtgaggagggagagccagttttccttttttttccattttttccgtttctgttcggttgtgttttcatttttttttccggtttcttttctgttttttcccggttttttattttttatgaatacaaagtttgtattcgtatgtataccaagtttgtatttatacgtatataaagtttatatacacgtatgtaaagtttgtatacgcgtatgtaaagtttatatacgtgcatgcaaattttgtatacgttgtgtattttctattttttattttttaatacgtatgtatataaagtttgtatttatcatatacaaagtttgtatatgtcctatataaactttatatacatcatatataaactttgtatatgtgtatatattttatatatattaaaaatatatttatatgtatatatatgtgtgtatatatagtatatacatacgtatagaaggctgatcgcgtatcagccgtccccatgcatcgatataagtgatttagcttccgtgggaaagctagcgggatctggcgccaataacgttgacatagtaaaaaatattcattctcagattaagtttttttaaaagtttatttgtaaaataagtttttcaaagggacaaaaagtgaaaaatgcagcacaactgaacacagcaataactcacgtactccagggaagaaaagaaagagaaaaaggagaggtgagggtactggtaatcaatggaggccgctgccacccctgaaaagggccctgtccttgcaaacgcaccgcacaggctccaccaggctcacacagacactgttgaacttgtttggagagcttcttccataatcgaaaactccctaaacattttagttttttcgtttaaattctaaaagactttaggtatagaatttagaaaataattaaactagaaaaaactgaaaaatttattcttttcaattttttaaaaactgagtgccaatcaattaattctcagaatttaattttaagttctcaaacaaacccctctttctcccctctcccaacccatccatcactcatgcacgtctcactcagtgtctctctcctcctctctgggcatgcatgcatgcggctacgctagctagggtgaaagggagatcatcacgtggagagagatgcagatagtagcactccagattacagattgcagagagagtgattggcagagcggcatgcccctcgccccaccactcacttggcatttctctatcatcaccatgtactactcctactgtcctacaaggacaatgtacggcgcaatgctttgcttgatggagtatactcctatttaagatcgaatcttcagaaatttcactgaaaatctaaccatcctgcagaatcactagtactatagcgttaatcgtgttctgaagattagagtggtagtatcgctttaggtcctgtttgggaagaatatgctggttggtagctagcttctaaaaatcggaagaagctggattttctacttctgaggtctagtttattttctagattttacaggtatagattctcagaatttaggtgacaatctgaactgtttggcggagctagaaattctgggagaagctgcagcagttaaaaactccccgaaacagacgcttattttcgtgtgtactccaacatgcacggatacacactctcggaggctcggagcttgcttttttacaccaggaattgcagagcaaggaatccagtagaaaagctcacagcttcacagtacgacagcgagaaccaccggaagaagaagcagcatttgcagcaaacaaacttctaaaactgacgaagcatgctgatcgaatccgctcccaaaatgcagctgctgtttattgcagcaagcaagcaacagtggcccttatctcttcctgccatcgtctcccggttccaggagatgcccatgcctctactactctctgcagtttcttctgcgggcaaaccgatctagctcgctcgaacggtgcaccggtgaacgcaccgcggcttcgttttcctcgccggtgaaacgcaacgacgacgactgcgacggcgacgcctcgctgtgaaacaaacatatactccggcctcgggattactgtactatggtttggagatcacagccgcttggaataaatgtggcatgtggaagagaaatggtaaagagaaggcaatgccttgggagggatgcttatccattctagtaggagtactactgtactaccgatgcagtcacgcagggattctatatgctttttcatcatagatgaatggcttgagagggtttaaaaaatcacgtgcactaaccttctcagttttaaaattacggtacacccctcgtgatgatcgttaaaccgtgggatggcgctaactccacccagaacggtttggtaaaccctgcacattgtaggtcgttggcgaaatagctatgagcataatttgccccgtttgaagggatgatgatgaaaattaaattagcgcacgcaaaatgagtaaaccattaacgcacaattaattaaggttagaaagttagaaaatatatttatttgatattgtaatccaactactatatagaatagaaaattttcatatgaaacataccgtttagcagtttaaaagggtgctaacgaaaactgaggtcaaatatgtatcttagcgaaatgaaaaattaatgaaacaatcgaaaataatctaaagataaaactaatatatttacgtgattagtggtttaaaaagaaatattgaaaaataaactataataaaaaaaccctaacattatatctaaagttaagtttcagatattattttttggttccaactaataagctaacaagcaaacgacaagaagctttgataatagctatcgtactttcatcaacaattttgggtgtctaataaacttgtaacaagcaaacaataagaggttttggtagaattgtaccttgatcaacaataggctttatattttttttctattacacagaagacattcatagcatgtaatagaagtacagatactactatcatattgatacatatgttcaccactctatatcatacggagtattggctagatttatttattgtaactgttttttatcttttatggctaaattgcggaaaatatttaataaccattgatgataacttgggtatctgtaggaccaaaatccaaaagtccaaaaatcatcactcctcactacgcgaatatccacagctaaataatgcactcatacaatttttctttaagagagagggagtacaccgattggaatttccaaatttatgcaaggctttaaatgagaagggctcactcaactgtagcatcatacctcaccatgcagagcgcaacagtatgcagccatggtagcttgagccccattcccaaacaccacgggtgacagtgtcacgtggcgatgcacatcgtcaccatctcatggccaaaaatacgccagcctctccaactgttaatcatatccacagtgcacgttgccttcgctgtgcactgcatcatctctactgcaactgtcgctgcaacagaaaccacagtagcctcggtttttctaccaggacacaggcacacagctgttgcaaggctgagttgggtgctaaaatttctcaacttctattcctttcgttctcacattttctaaattgtaccatgatatattaaaaagttttataaaaaattatattaatttatttttaaaacttttagctaatatttaattatttatacgctaataagacatctggttttccgtaggaggaaagttagttacgaacgaaaacactcttttgacgtaatgtcaaagagacatgagtctctacctagtgggatccatccctatggacccacaagtgactcaccctaagggcatcactaatgggctgcaggaa

SEQ ID NO: 65867 - DNA, 1837 bp, Oryza sativa
  unsure (1)..(1837): unsure at all n locations
agtccatataaatgttttcatatttttttaaaacttttaatgatataaatcaactgttatccttatatatgtccataagggtattttaggcattattgaaaaataagctcaacccaatagcgtattgtagagcaattgataaagtcgccagtatattgtagaaagagagaaagtcagtggtaaattattgaactactataaactaagtggtatagaatagattctctctaatctaattgaaagtttcagtaactagtctctgcaaatattagtcctggttaacctggacttgtaaagatgagaataaatagagaagaataaataaaaggatgagaaaaggaggcaaaagctggagataaagaaaagcgcggccctgacatttcctgcaggagcctgataaacatcacgtttcgtgttggatcaatcatggtgtgctgacatgtgggggtatagtgaaccctggccccacatgtcggtattggcttaaatcggctaaatttagtcgtgtgtttttcagttgacgtgcttacatttgctaatccagccaactgaagtttagttcaaagtagtccatgtatttccagttagcgtagcttcgttgattttttgcacattcatatgtttgaaaggaacctttagacagaagagaacagtgaatatggttttcatttttcctgatgaactgaaaaaaaccacattttccattatccattacaaaaactacattttccattatccattacatgaaggcccaactgaaatccatgtttttttcaaatcaatctagtctgagtggaatatatggattgagagtatacttatactcgttttattttttttttgggggtttgatatgaaaaaagtgataagaaggattgtgatttgtgaacaagtatgataagaacaagtactctgcatgatttatgaaactatatatttgttgcttgtttactattagaaggtctacatatgtgaagtactcctttcgttttaaaacataacaatataatatcggattagacacaatcgttcaggtttatagtacttgataatatcaaatcctagttggtctgaaaacatataaggagattcctagtaggtcgaagcaaagcaaggaagtggtcaaggggatcctgcaagagtttcaaagggaaattcgaacaattttttgagttcaatatcacacaattatctggtactacatccgtcccataaaaaacgaatccagaattggatgtgacatatttcagtactagtatatgtcatatctggtactaggttggtttttttataggacggagagagtacttgtcatggtaatctcatactgtaaggccttgtttagttcacccacaactttcaactttccatcacatcacatcatatctaaaattttcctacacacataaactcctactgcctccgtcccataatataagggattttgagtttttgcttgtantgtttgaccactcgtcttattcaaaaaatttatgcaaatataaaaaataaaaagttgtgcgtaaatactttagataataaagtaagtcacaaaaaagtaaataataattccaaaactttttcaataagacgagtagtcaaacagtgcaaacaaaaactcaaaatcccttatattatgggacggagggagtaacttttctttccaaactaccaactttttccaaacttttaacttttttcaggaactaaacacaccctaagtaataagcctattagtttttaaaatgtttatagtttttcttggtaatctcgtcgttcgcaaaaccatggtaggataacgatatttcctaccaaaacagtagggaaaccctggcct

SEQ ID NO: 65868 - DNA, 3085 bp, Oryza sativa
tggttcaaaagcaaagactgagaataaaaaaataataccacctaaattaacaccaagaatcaaagattaaaatataaaattgtctagacttcgctgtataaaaaaggggttaattggatccatggactacaaatatatcattttagctaaatgccactactattcacgatatcggctacgtgacaatggaattaggggagattggcccattagccccaactccatcacgtttttcgtgaaaaatctccattagccctaactgcacgtgggacctacctgtcacttccatctatacctccctcccttctcttctctttcccctctcctctctctccaccaccgtcgcaaccgccgtcatcgaccacctccgtggtgggaggcctcgggagccgccgccgccaccatcctcgacccatccgacgtgggagggctcgggagacaacaccgtcctgaacgctattcacgacaggaggttcgggagccgccatcctcaacgccatctgcaagagagggctcgggagccaccgctatcgctgtcctcgaccccatccgtgacgggagggctctggagccgccgccgccactgtcgtcgctgtcctcgacgccatttgcgacgggagggctcgggggacgccgccagcatcgccaccttcgtcctcgacgccatccgcgagagagggctcgggaaccgccgccgcctccctcgacaccatccgcgcgggagggttcgggagccactgccgccgtcgtcactatccttgacaccatctggaacgggagggcttaggagccactaccgtcctcgacaccatccgtggcgggagggatcgagagccgccgctgtcgttgtcactgtccttgtagcagtcgcggcatgaaggaagagatagggaagacagaagagggaggatggaggaagatggaacaaacatgtgggtcccgcgtctaggggtctaacggaaaacgtgatggagtggcacggttccaatttcttcaaatttcagtggcacgtaactaatatcatgaatattagtgtcatttatctaaaatgtcatatttgtaatggcatgaatccaatgaacccaaaaaggactccaataaacaaaggctaatcttgtatttcctcgttcttctctactctctccgtttcataatataagggattttggaggatgtgacatattatgggacaagaagtatatctactattgtaaaaattgaagatatttccactgatattttggtacgtcgtctattttttagtcggtttttaagttctttcgcttttggaaatacataaggagtcatataaaaaatccttaaaaaaactcacatgctatcttgtaacgagagtcgtagtcctaatttctttggaattcttgtctggcataagaaagcaacgtacaagatatagctatcatcctaataagggttctgaattagatatcaatattatcaaattaaaaatcccatatactttttagataaaaaataacaataatatgattaaaatagcattcacctgttacaatgtacgggtattttttcccgtaaaatatagagtaagagagtagaatcggatgagatatatccagtactattgtgctccctccgtcccaaaaaaacgaatctaggattggatgcgatgttttctactactatgtatctggacagatgtatttccagattcatagtactcgaatatgtcatattcagtactatgttgggtttttatggtacggagggagtaactgtggacagaggtaataataggacaccaatatacagttaggggctgtttagttcctaaaaacttttccaaaaaatatcacattgaatctttggatacatgtatggagcattaaatatagaaaaaaagaaaaactaattgcacagtttgcatgtaaatcacgagacaaatcttttgagtgtaattagtctatgattagccataagtgctacagtaaccccacatgtgctaatgatggattaattaggcttaaaaaattcgtctctcggtttctagacgagttataaaattaatttttttattcgtgtctgaaaacacttccgacatccgttcaaaccacgtacaaatttcaccgactaaacatgcgcttgctagctactagttgaataccggagtaaggtggtgtttggttggagggactaaagtggggctaaactttagtccctcttataaaaatataagtccatatggtaaagacttatattttaatgagagagactaaattaagtataaactgcatcagctactcgtaagctacacttatgagtatactcgactgatgaaaaatatagtggaccaccacatgtcataggcgagtgagaccatgctcctcgacttgcgactcgagttctactcctaccaactctaggccaaccagatagatactgagaaaaaaaaaacaacgacactgatgtgacatctcagtgtccatcggccatcgcctccttttctctctcctctcctctcaccatcttctcctacagcaaatcactcttctctctctctaaaaaacttcacaagcctactagcctactactaggcacgtagctagcccctgccactctatcgcccagcacaagccatacagctacccgctgtcactgcgccagcggccgcagctgcgcaaagaggagcgcgagaacccaagaaaccaaccaagagctgcgtcccataaaggcgcgctgcttcaatccatccatcttctgatcttccatatacttcgcttcctgtaaatgtcatcgccgccccggcggtgcctcgcagcggagcagcagtggccatgacgccggcgccggcggccgcctcctaccgcgctctcgtcgcgctcctgctcgtcgccgtcgccgttgccgatgatggtgggtggatggctggctagctagctggctgttggttttcggttttggttggtttcttgctggggggagtgtgtggttttgtgtactggggagcagagagattcaggggggagttggtttgatgggattagtattttattagtgttgcaagtactcttcctttttggaggcatggtgattctcttgtgggtgatag
